United States Patent 7,214,786 (NUCLEIC ACID MOLECULES AND OTHER MOLECULES ASSOCIATED WITH PLANTS AND USES THEREOF FOR PLANT IMPROVEMENT) - sequence listing, part 22

SEQ ID NO: 87361 - DNA, 402 bp, Triticum aestivum
  unsure (1)..(402): unsure at all n locations
  Clone ID: PAT_TA_87361
gtgacccccaccttgtccttgttacccctgattcatcatcaacgactcgaccaacatgatcgatgaccagagtccgacacctcacatcacatcacgccccttttgttgctcgactctgcagacttaccatcgagtgccgagggtggaacctcatacatcactcctgatgagatctctctagtgtagctattcggtcctgggtcaacgagggtgatcctccacgaccattcccgatatgactctgtccgtgtaaccctctaagtgtgaaccttggagggtgggtcctcttacgttcaccttggatgattacatccgagtggattcaccgagggtgatcctccgggtttctccttgatgtttgggacacatattaccttgactttacttngaacttgggtgaaa

SEQ ID NO: 87362 - DNA, 636 bp, Triticum aestivum
  unsure (1)..(636): unsure at all n locations
  Clone ID: PAT_TA_87362
gtgatttcttcccagcttggatccctaaccaagtgctcatctcaaaggtcagtgcacttgatagactgcttaattgttttcagatacaccttccttgtgcatatatatggatgaagacgagactagtctataggcagtcaagtcaactgatcataaatatccccttgggtttgcaaaggtgtccattcatctcagatctgaagcacaccccgctgggtgttcctcttcctagcatggtcccagatcaagtgttcctgtccaaggaaaggcactgggagaaataaccctaagaaacctttacccaaaggagtttacattagacttttttggaagaaaattacaaatgactcctcccactgatatacaaaaggtccnggccattcngggacattttataangnatgatttgccacaacagtccctgccttttanaggtngattaataattgaantgcttaattaaccgggaacccaaangcctccatacctggacacngaaanacggtaggtgacgaaantgggtaataantttgggtgtgtgggattttggtggtcgtggatccttccccacggngngaaagtctcagacaaccatnaagnacgtagacccncaagggaagtgncccctgaaccctg

SEQ ID NO: 87363 - DNA, 627 bp, Triticum aestivum
  unsure (1)..(627): unsure at all n locations
  Clone ID: PAT_TA_87363
gtgatggccgctgcctactcccatgagttgcctcgctacggtcttgaagttggcctcaccaactatgctgcagcctactgcactggtctgcttttggctcgtcgtgtgctcaagaaccgtgatcttgatgaggagtatgaaggcaatgttgaggcacaggtgaaggactctctgttgaccttctgatggagaggaggctttccctncntcttgggtgttgggccttattaaggaccaccactggggaaccgcgtgtttgggtgcccttnaaggaacttttggatggtggcctttgacatcccccaacaatggacaagaatttgctgggtttttaagaaggacgagaatcccctggagctgagntcaaccgcaaananacctttgngagnatgttgctgactacatgagncactaacaaaaggaggacaaagattccaacccnttcaatgganacacaaagaggggancaactgatgacaggaacaattacnagaagtcagctgcancgtgctgatccacaaggcaataacaagggctccaagaccaaagagtananccagaactactnnanaagaaggaaccnctcaaggtaagcctaaaatctgcggccccatatacagacaaaaa

SEQ ID NO: 87364 - DNA, 487 bp, Triticum aestivum
  unsure (1)..(487): unsure at all n locations
  Clone ID: PAT_TA_87364
agcctccttcgcaacatcaccggcaacccagaagtcagggtcaacaagatggggagggcagcgggagtgcttgagaaccatgaggagggcaggcgctacgccgagcacggcctcagagcctatgtgcaggacaagaccccgagatcatgccaggaacaacaattcttcaccagcccaaaatgaanactttatctncctgttgacccgcatttataactgntgtgggcaaangcaaacctattccaanattccanaatgttttttcctccatattccaagaggcaccgtcaattactccttnatggaaagacatgttatgtttttgaggtttnntatataagntatggtttgatggttcccaataccnnttccatntaattggtgntatcccantntccgtgtatttnngtgtgttgttntnggnacccnatgggactcaaacgattacggcaaacatgggatatgctacgcngggaaaaaaaaaaaa

SEQ ID NO: 87365 - DNA, 212 bp, Triticum aestivum
  unsure (1)..(212): unsure at all n locations
  Clone ID: PAT_TA_87365
cagagatgtgcaaatgatttattaaaaaattggatttccaacaacacattggnttacatcgggtatgcattttttgnagaatanaagtcaagnttaaaactttttaccacgacaacnanagtaaatccaacctatatantcaattacgcntatattttnatattcacagatatgtcncanacacacatttnactcccctggagaacaatatc

SEQ ID NO: 87366 - DNA, 640 bp, Triticum aestivum
  unsure (1)..(640): unsure at all n locations
  Clone ID: PAT_TA_87366
atcccaacttcatgatacataaacaaatgccgcccaaattgtaaatggtgttatatcaaccagatgtctacaaaatagactaaaggggtgcactatataaaaatgcatcggccccaaatagtgctagccggcatcattgacaaaataaccagatatgggcgaactagtgtatgtgcatgcaaagtaaaatgggacacgccgtacctagctaatctagttaattgacgtacaccacccaactaaactaaatgtatggcccttccatatgggacatacatttaagaaaactaaaagatgaccaaganccatanctgancctgattgcacttngaatattgtatgcacttgcatatccaccaaaaaaatttatatccttttnacctgctcccatatacgtgttatgctccaaaaggttcacctacttgtcctccncataagngaaantanctnatcagcccctttacgnttgcaactattaaggaagaagagcntctatcnataaacaaagatacacaattgtnagtacaaataatncatgccanacactncatacgttgttcatatcatcatatncatttagggcatcacaattgntaccattagaggtttctaaagtagaaantaancagncagntngttn

SEQ ID NO: 87367 - DNA, 592 bp, Triticum aestivum
  unsure (1)..(592): unsure at all n locations
  Clone ID: PAT_TA_87367
gcaatgccttattcatggcttaacggccatgggcatagaagcaagtaacaatggcagacaacatcatacatttaattggaggaatgaaatacaaatgctaggggggtcacttattcaaaccaattaactacacaaaacatgagaacgttgtttgaaggaaagtgtgtttgaaatganccatccaaagcccttnaccnctcccaacaagaaggtatatcatatcccggacaccctccacncacctcccggatccagatgtnccacaatgctccaaaaatcctatcctccgcctccttatcaacgtttgacatgtcactttgacaattaaggtggccttccccacaccttccctgacggcattatttcccgctgttacacccgatcatgctgcgaaactccnatgacatatcttcaagcctgacaatctcnacgccaaacaacanccacnntttnaaggctntcaaacttaactnaacatcaacctcgataacgnggcacaaggcatgatgacaactcactatcaaagctctagacncgaatcacacncgaatgcacttgttctacccaaatcngnanttcaanaattcatttc

SEQ ID NO: 87368 - DNA, 576 bp, Triticum aestivum
  unsure (1)..(576): unsure at all n locations
  Clone ID: PAT_TA_87368
tgcacatcgatatggcatcaagagagtaatattaccagaaagaaacttgaaggacttggctgagattccagctccgatcctcgctggcattgagattctgctcgtgaagcgcattgaggaagtacttgggccatgcttttgagaatgggattccctttggaggctacactccagtctatagcacgggcaatctcaaatgggccctgatgtgggtattccctccggtggncatgtacctgntttggaaatcctcgctatccaccgccctggatatctacaaatggagcgtccagcgtaagttganaatttntccnaccnggagtgaatctccatgacgccaanaccctccgtcccaactcaattttaacttaatatgccngatgttttanatggnactttgctacccacaaaaanngcaggagtttaccccggctttgggattggatttatananggatcccaccaaccaagcncnttttggaanggaacaaggggggccaccgttttgtccgttgggtgtaaagtacctatnaacaagggaaattanntcctntcaaaaaaaagggtttgtaccaa

SEQ ID NO: 87369 - DNA, 660 bp, Triticum aestivum
  unsure (1)..(660): unsure at all n locations
  Clone ID: PAT_TA_87369
ggtcgatccaagctatccaagctaggcgcggccttttcggctctgttcagttcaccaccttggcgtttcaccgtgtgcaagcgaagacgagctggagcctgcgatgtgtgccgacatggcgaggtccagtttgtttgtttgtttcctgactgcggttgctgttgctgccttgctggctttctgtctgctggatattttcccacttcttcaccttccacgagcctggaggagaagacttgcattgctcccgggcctcgcctccgtgggtcctccttgggtgggctatatatcctttccggactgaatattgccacctgggggggaaanactccattctccnatactctctccctctcgcgtcctaccgaatgtactaacaaattacaacgacctggattaatatacacggcagccggcctcgctcctctcccccgggagangataagcacaaggcgacacagagagaggaacaactgntccaacccggagacctccaccgccatgaccacgcaaggcaagccctcctggaggtactaacggcgtccggtaacacgacaaacaaggagaaanacgcgaggcgtcctaactntcactggcnaaancctgggatanttctcgcgcctcacacacanaacgaanccncggnaccanttntgnatt

SEQ ID NO: 87370 - DNA, 647 bp, Triticum aestivum
  unsure (1)..(647): unsure at all n locations
  Clone ID: PAT_TA_87370
gatcactaaagaaatacaagcttccatgcgctgtctcggtcgtcatcgcgaagcttcacagatttaatcagcgcacaatgcatctgcataatttttcaggatgtccattcaccagacactgttttgcgtaccaacttaagttcaagaagcttgttaaataatttgctgccctctatattatagtactgtgccaatttgattaggacaccatctttaggatgtcctccgaacctaatactgtctgttcctattaaggaactgtttgggaaattctactttttcctcctccatatgccaagtgtttgctatttgaaantatggcatggtatgttaacccttttaccgcattcctgacacatattttaccaagggttccaagtgattgggatcatcaanaggaagctttgatnaagacctaaccnctcttacaagctgatgtgtacatgttgtaatttcnnactcccgctgntncccncaacacactgggaatgtccacactaagcttcaancagtctgttgtccaataagtatgggggttaaccnaaccctgactgaatgnttcggggccggacaatcccaatgngctntanccccatgcgtcttaactccgatggaancgggtncactannctganaacccttcagtg

SEQ ID NO: 87371 - DNA, 425 bp, Triticum aestivum
  unsure (1)..(425): unsure at all n locations
  Clone ID: PAT_TA_87371
ngcncctttagcctccttcgcaacatcaccngnaacccanaantcagggtcaacaanatgnggagggcatcggtagtgcttgagaaccatgaggagggcaggcgctactccgancacggnctcagatcctatgtgcangacaagacccccganatcatgncannaatcaacaattcttcaccagcccaaaatgaagcacttagtctgtccngtgactccncaattaataactgttgtggtcaaattgcaaactattcaagcatttcattaatgttgttgcgtccataatttaacagacatcntnaattactccttaantgaacagnacangttatgttttnatggnttgcnacanatttnagntttnttngttccnaaatactgctcaattganattgtggatatccatcttccttttattnctg

SEQ ID NO: 87372 - DNA, 456 bp, Triticum aestivum
  unsure (1)..(456): unsure at all n locations
  Clone ID: PAT_TA_87372
gtacaccgtccgcaccctccagaggaccgtccctgctgccgtccccgccattgtcttcctctccggtggacagagtgaggaggaggcgaccctgaacctgaacgccatgaacaagctccagaccaagaagccctgggaacctgtccttctccttccgggcgtgccctccaagcaagagcaccctcaaagcctggtcccggcaagacgggagaacgaagagaaagccaaggacgggttcctgggtgaggtgcaaaggccaatcccgaggcaaccctttggaacctaacaagggcaaccaaccctttggcaagggncctctgaaacctccaagttaaggatacattnacggttnaacncctttcggactttggccttttgggtccccttacaatanatgttggntttccaaaccccgaaaaccttggaaacaaactttttaaaaaangaatgtntttt

SEQ ID NO: 87373 - DNA, 337 bp, Triticum aestivum
  unsure (1)..(337): unsure at all n locations
  Clone ID: PAT_TA_87373
gttgaacttccaaacacggtaggagcagaaggccaacggacaagatctcgcaggcaatatggtcgatttttcttgaaccaactcttcttttgtccttccatttttgggtctatttatgaagtgccagtgtaaatacaggtgtattttttgtatccttacataagccaaatgcgatgagggtgcaccanctttccaagcttgggaaangcattggaatggcgaatttgccaaactgtgcgatgagcagattgntccatggcctaataaatacattgggagttttactttccacaanttccaacaanaaaaaannaaaaaaggnnccccnagggggggg

SEQ ID NO: 87374 - DNA, 622 bp, Triticum aestivum
  unsure (1)..(622): unsure at all n locations
  Clone ID: PAT_TA_87374
gccacgccaccgagcccgcttcgaaggtagcagcgggtcgtctcgttgtcgcgcttcagtgaagcgtgaggaggggtctggctgagctcaggagagcgccatgggcccatcctcgcgacctgcggcgggagcacgtgccacttttatttccgttcttcttttccttcccttcattaaagagaaacaantatgggggccagctgggggcgtgcaacaactatgattcccaagtgggttgtgctatatttatcgtccttgtgtttgtgtttgccagcgtcaacnttcaatgtttgcgccgttagaataacttaacttgatgttcctgattanttcccgcctgggaaagtgcgccttcccccgatgccaagccagctcctatgctttgnagctccngggaactgcanttccgttannagctatctccatcctgncccaanatgcngcatnccgtttcncacaagggaccaaggacacgttaaaggtgccaactgcaaccagggggcgncncaatccctaatgatcttanccccatgcgtcnttaactctacngaaacctggtacactatccttagaacccttccactgtaancaagcccncnttcctcaattcacatganggccc

SEQ ID NO: 87375 - DNA, 631 bp, Triticum aestivum
  unsure (1)..(631): unsure at all n locations
  Clone ID: PAT_TA_87375
ttgaggttgatctatccagcattgaacccggtagcacagtgactgtcaagtggcgtggaaagccagtcttcatcaggcgacggacagacgatgacatcaagctggccaacagcgtggatgttgcatccctgcgccacccagagcaagacgctgagcgtgtgaagaaccagagtggctgggtggttattgggtgtctgcactcatcttggttgcatccccttcccaactcctgggagactttgtggtgggtctgccccttccatgggtcccactatgacactcctggnagatcncgcaagggcctgcccccntacaactttgaggtnccactacanttccttgggtagataacaaatctccatagctaaagcctaaaaccanactaccgacatatattaccacaggatgatcctgttgcgctgttattgtttcaatgtggctagattttgtttcaaggactattgcaacgtgntcacgttaccacggaattaattgcantgcgaaanaattantcccnaagtgcaacgggttcaattgtttgncgatttcgaaanccancgaagganatgnacccctcggcctgcaccaaaattttaaaacaaaanacatctcactgttcaaaaaaaaaaaa

SEQ ID NO: 87376 - DNA, 642 bp, Triticum aestivum
  unsure (1)..(642): unsure at all n locations
  Clone ID: PAT_TA_87376
ttttttttgagggaagaacacgaggtagaaggatacattgcaatggagaagaagactcccttttataggcctccccaaatccaaccgttatgcactcttcccgtgctcaagcggtagtactaggggcagtgcacaaaagttcatanaactgaggccgttaagtgccgccggggagcggtactaccgtgctacatccgctctactgccgcttaaggcaaagaaagcaacccgaaacaagcatagaaagaaaaaacctaaagcggtactaangagcggtaagtagacagcggaanttcnncaaancaagagttgccatgtcctccgacgctgttggncactgtttgatgtttgtttgttgggccgngtccctctcngcggttgtgcccttattggtgttggtaaatgtttgtggcaaagcctcctgtncccgtgtgcccatttttaaattaaaaaagatggcaaaaaagccaagcggagaatatcattgggtacatttgttttgccacnaacttttacctcctgngaacacaatnncngattagaagaaaacaattanngattgaanaaaaggactaacnaacnctaagntanaatcaccaactacccataaaaatttttgtgtanccncncgcgtacaaaaca

SEQ ID NO: 87377 - DNA, 573 bp, Triticum aestivum
  unsure (1)..(573): unsure at all n locations
  Clone ID: PAT_TA_87377
atttgaaattccacacacccagttcatatatatgagggtatcttgagaagatcagttctgccactgttgttgttggagacagaattgaacgagctcttcctttgtatcatctttcttatattgatcagtgatagttgttgctgcttttagccctccgtttccgtggagaacttgttcaagagtgtagaaaagaaaaatatgtggctatagaagcatatatgccattcaagttaaaacatcaaaagaaaaataacttggaaactatatatttattggactggtgcacctatccacttccaaagtacttcctgtggggtcatcctgatcagaanttaccacctaaaagaaaatatttaaccgactcattcatttatangtctcctcaattttcatggtattaacatgagtttttggtccctgttattttgaaagganacnntttgaataggatccttgacattgataggantgnaagaaattccatcaagtctgctaccctccagttgagatatcatccttggaatcctcagtctganagagntcgaccatangctcagncttatcaaatattga

SEQ ID NO: 87378 - DNA, 528 bp, Triticum aestivum
  unsure (1)..(528): unsure at all n locations
  Clone ID: PAT_TA_87378
gagacagaggcgccagccgtggtcgagacagagaccaaggaggccgtggctgaggcagagccagcggcgcccgaggaggtgaaggaggaggccgcgcctcctgccgagccagaagcaccggccgtcgccgaggaggcaccggctgcaccggaggaggcgcccgcggccgcggcagaggagccggcgccgcggtggccagcgtcagcgtgttaagcgcgccncccganggaagaacttggcggtcaacttccaacggcggcggccgtntgctcctaanttgcacggnttatgctaatcaancaattgattgatttgaatgatactttttacnagtgtggattggaatgctatccccggtcccctnacntgggctaaataaaatgtntccggtccggtccaccccattccngtcaacaacgaacnancaatgcatctcgccggctgcgtctgcgtctctaactggacttttacgtgtgtgnananttcaantcaactatgatnatggtanctaacggttgcgtaaaaaan

SEQ ID NO: 87379 - DNA, 412 bp, Triticum aestivum
  unsure (1)..(412): unsure at all n locations
  Clone ID: PAT_TA_87379
gccgtcttttgggacacttgttgctgatctactgaagcttgctgttgaaggtgtggggaatcttgtcctcaacattgccccgctacgcatgcaacgtgtgaagaaaaaaacaggcctcactcctctcaaagataggcttgtgatgcccgaggacagggaagggagaaccaagttaccccagaactcaagtagcaccccaaatggataacccgagacgtccatgctccctnagtgctgctaacgaactgtggcaaaagtcataagagcatccaatcatccgattccaagatcctatctctccaagcaanacagtccaccaaagagacagganacctganttctacggttcaacccgaacacctccaagcaangcaaaggcccaaaaaacgtcccgtcacgtcatccggagaaa

SEQ ID NO: 87380 - DNA, 414 bp, Triticum aestivum
  unsure (1)..(414): unsure at all n locations
  Clone ID: PAT_TA_87380
ccgcagcgtcctggatcccgagcgccgtcgccggtccctggattccatccgctgccgctcatccagcgccatgcggaggctcctcgtcccgagctctacacggtcccggactccgaccaccatccaccgtcatcgttggatctcggaggtgcctcctcctcctcccccttgtgcttcacagcgccggcgacctacctcacacgtccgtgtccgaatcctccccgcacagtgcccgancacaactggtgnaataaaatcccctctccctttccctcattctgtgttacanggatgggacnatcctatttttggatgatcactgntttttgattgatctangttatatgtgtgttcctgaattcangttcctcnatatcntgaattccaaatactggtaactggagaagtttcaaa

SEQ ID NO: 87381 - DNA, 404 bp, Triticum aestivum
  unsure (1)..(404): unsure at all n locations
  Clone ID: PAT_TA_87381
gtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactccgtaccgtccgtacgtacgtgtgatggtgtgagagtatacgtngaataacgagcnctgatctgatggagtcccancaaggttgcgtnttcatttcgtgtggttactccctcgtctccgcctatctcctnccttgngtgcctttgtgtgtatgttgttttcatgtttccctgtatttcttcnacctacctccnactaatggatggagttgatgaatatgtnagaatgaatgatttacctnattttaaaananaaaaggggggg

SEQ ID NO: 87382 - DNA, 636 bp, Triticum aestivum
  unsure (1)..(636): unsure at all n locations
  Clone ID: PAT_TA_87382
gttgattctagtgttatctgcacagcagaatttggaagaagctgaatcagtagctgatattgcactagatgaggctgagcaagaggatcaaatgggtattttgaggctaaaagcactaattcagtcctcccgtggacaattcaagtctgctgtggaatcttttaggattttgcttgcaatcattcaaagcaaagaaggaaactgggaaatttgacccttatgataaggttaaaccctgcatgantaagagatggaagcatgggttaagttttggcatccaatatacacaaagttggaagcatggaatgactcaaacatctnccttggacaaagcaaaccaatgattccttactccaaaagtgctggatgtcaaaaggctggatactggagcccanccttgcaccaagaagcctcccaggacgncatcctcctctccaacanccaagacnagncctaacaggtctatggnaanatctaagaatctgggngcgaatnacgcaatccagaacttctcgagggcancgctagagcaaaaacatcancctgtggntcgcncgccgaatctaagntnggctngcccnaggttcagactananccccaattcacatcagttttcnatgcaacttctgatagac

SEQ ID NO: 87383 - DNA, 431 bp, Triticum aestivum
  unsure (1)..(431): unsure at all n locations
  Clone ID: PAT_TA_87383
gttcagactgcatcgagaggtccatttcgccgttcagggaatcgaggatgagcgctgtcgccccaagatccctcgccggagaggacaagaagacgtcatggccggaggtagtgggaaagtccttcctgctggctcggcgatgacccttgacttcaaggaccaaccgtgtccgcatcatccgtccgacaccgttgccgaccactccttccattgggctagctacttttccgagccgaagagacatatagatgcattatgcatgctggatgaataatttgtttccnataaaaatgatggataatacccaagtgtgtatnatgtactcaacgtccgnaagttgctgatgtgtttaacnacatgccaatgaancccgctaactaatggcangttgcctggttactttaaactaattaancccnaatggtacaatt

SEQ ID NO: 87384 - DNA, 566 bp, Triticum aestivum
  unsure (1)..(566): unsure at all n locations
  Clone ID: PAT_TA_87384
tctggtagaaaagatgtagtctctcgtgtgaaccaaggtgctgacctcttcgcaaagttattagtcggtttctaccttggttgtgtgcgtgtgtgtgttcttgagagaagatagaaagaagagagagagctgtgtgaggcagcttgaggtggaagaagaaacggcgctgcgacaaggaggcggcgccaacaattgggcatcaagaccacgctggatccatggcggcgacaacgatgcccggcggtatggtgaccggcgtnggcggtgacggaaggcgaccggtacggcaatggtgacncaatggatccatgttaggtnggaaaacgtccggncaggtttaggcgttnngggnggggaaaaccccctgggnaccgttnccgggttaagcccctaggagnaaacggtngggcaagccccaaaacttgggccattccttanaaggaaccggnttacctctaaaaaantcggtacccatcctaancaancgncaaccnatacgngggaatcacacacataaagttgncaaccatnttgggcattccaatananggtgnatggccaganta

SEQ ID NO: 87385 - DNA, 346 bp, Triticum aestivum
  unsure (1)..(346): unsure at all n locations
  Clone ID: PAT_TA_87385
agaaggactacgacgagaatgacctggcatacctccagaagaagaaggatgagcaaaaggccctgaaggagctgaaggccaaggcaggccagaagggtgcgctgggaggatctggtctcaagaagagtgggaagaaatgatctgcccacccattccgtaatacccaagaaaatgataatctatctatctacctatctgtttccgcgttncactatcctgtgggttgttacagactacttcantttgtgttttagcanttgtgcatcctcncaatatgtccccttnaacctatggattttaacanctcttctgcttancnatnatacaaattgcccttnnctaataa

SEQ ID NO: 87386 - DNA, 337 bp, Triticum aestivum
  unsure (1)..(337): unsure at all n locations
  Clone ID: PAT_TA_87386
gtcgccggcggcagcggcaacggcgccgacgtctggtcgtcggtgccggcgatgggcatgccggcgacggcggaggaggagtacgcggtcgctgctgggatgcttcgcggggatcgggatcatcatcctagcaggcagctgggctagcctactccagttacattacagttccagttggggttactaccctaganactccaggtagtangtcctccagagttaacccgcggtaggactccatganttccttttgnccttcctattaagntcacggccgttggtgttattccatgttaccatttcccngcaaaagtggtcccaaccaagttgtgcataa

SEQ ID NO: 87387 - DNA, 492 bp, Triticum aestivum
  unsure (1)..(492): unsure at all n locations
  Clone ID: PAT_TA_87387
cgccgaggtcctggagcttgcaggcaacgctgccaaagacaacaagaagacacgcatcatcccccgccacctgcttctcgccgtccgcaacgaccaggagctcggcaggctgctcgctggcgtgaccatcgcccacggcggcgtgatccccaacatcaactccgtgctgctccccaagaatccgccgccgccgagaaggaggccaatccgcccaagaagaaggccgccacaaatcccccaaagaagaaggccgtcgccaccaaggagttaggcgccccttagctacctgtccttngatcaaggagaagatgatgaatttttgatgattggttatgtgtatctaattcctatanccagtggtcttccancacttcnattacaagcaattatggtcctgtttgtaccaaattaatgtccaaaaggtggaagatgatccttcaacancattgtctactgaattttgttgcgcgctttgctnaaaaaatgtgatct

SEQ ID NO: 87388 - DNA, 589 bp, Triticum aestivum
  unsure (1)..(589): unsure at all n locations
  Clone ID: PAT_TA_87388
gttaaccattcaatcttctggaagaacctcaagcctatcagtgagggtggtggtgaggcacctcatggcaaacttggctgggccattgatgaggattttggttctattgagaaacttataaagaagatgaatgcagagggtgctgctttacaaggatctggatgggtgtggcttgctttggataaagaggccaaaaggctttcagttgaaactactcctaatcaggaccctcttgtgaccaaagggtcaaacctgcatcctttgttgggaattgatgtctgggagcatgcgtactacctgcagtacaagaacgtgaggccggactacctgaccaacatctggaaggtggtgaactggaagtatgctggagaagagtatgaaaaagtgcttgcgtgatttgtctgatgagtagacagacagtacttggctcgccctgagtttccgctgttggatcttgtaatcagtataaaagtggcactatcacntcggaacttcgtcattcataaagtacacacgtcnaagccacaatcattcaattggnactgtacgtccgcttccaataaccatccangcgttcaaaaaaaaaaaa

SEQ ID NO: 87389 - DNA, 556 bp, Triticum aestivum
  unsure (1)..(556): unsure at all n locations
  Clone ID: PAT_TA_87389
tgcgtcttcttccgggaccacatctacaacgacaccaacatcgaccccgcgttcgccgcggagctacagcggaactgcccggccccggcgggctccggcgacaccaacctgacgccgctcgacgcgcagacgcggttcgtcttcgacaacgcctactaccccaacctcgtcgcgcggcggggcctgctgcactccgaccaggagctcttcaatggcgccgcccaggacgatttggtgcggcagtacagctcgaacagcgcgctcttcttcgccgacttcgtggccgcgatgatcaagatggggaacatcagcccgctcaccggaagcgccggcgagatcaggcgcaactgcagggtcgtcaacagcagctgatccctcccagaattcaagttgcagaacaaactacatacgggaaagcaaggaatgttcttaaaactttgtgtaactaatttaatttcgtttaaatatactctgtaataattactgtcacgagaatttcgttacaacactgtgttacgtttgganaatnaattanttaattgttaaaaaaaaaaaa

SEQ ID NO: 87390 - DNA, 180 bp, Triticum aestivum
  unsure (1)..(180): unsure at all n locations
  Clone ID: PAT_TA_87390
gtcggtagggaggcgcaccagagagctccgtcgccgccgccccaagtcgtgccccacatcggcctccgccgcgcccgcaaaagctgtcgatgtcggccatcagaagctgctggtgccggccctccgatacccacggcggctgcggctccggcagccgtgagagctgctgcctngngggaa

SEQ ID NO: 87391 - DNA, 559 bp, Triticum aestivum
  unsure (1)..(559): unsure at all n locations
  Clone ID: PAT_TA_87391
ccgaggcgcacacaccaagacgacagtcggcagcggcgctcccccccttcaacagtctacttcctcgtttccgtccagatttgcaggtcatacctgagttgctgctgctgaaatgggtagcactgaagccccaacgcccgtgcaggcacctgtgtgctccattgtgaacgaaggcccagcagtccggctgcttgctccatggtgaacgaagcagcactccctgccactggactccgaagccgaagaagaaatatctgcgcttgcccccgacaccaaaaagtcaagagatgaatgcacctccaancacggggagctgcctncaccaagtggtttngaggtccacaaacancctcccntccganggttcaaggcctggatacccctccaagatgctnattttctttccatggatttggcaaaacatctatttnaatcantanagatttccttgnttttaaagttntcccgnaaggnttaaggntaacgacttgatacttcccgtgggaaaaattacggagacgtgactaacggtanatagaatttctggggtaaaaaaaaa

SEQ ID NO: 87392 - DNA, 175 bp, Triticum aestivum
  unsure (1)..(175): unsure at all n locations
  Clone ID: PAT_TA_87392
agaacatcctgttgtttgggttcagatcgaagctgtagcacctggatgattnnangtcccttnaccggtaaaaggtnagntngtaaatttgggggggtttgaaaatcctcaatttgntttccctaagcnaatcncattagnaanaacantgtntagcgcacccaaaaaaaaaaaa

SEQ ID NO: 87393 - DNA, 381 bp, Triticum aestivum
  unsure (1)..(381): unsure at all n locations
  Clone ID: PAT_TA_87393
ggcacttcccgagccccatgaaggcgttccggcaccggaggtcgtcggcgagcatgccggagcgggggtgagattcctcgccaccagtgggggatctgtctcttgctttccttttaggaagtggttataatataatcaattaactatatgggggttcttcttttccacttttgtggctccgcgtgctaatgtgatacgatgtttaagctagattaaaaaccgaaagctgtgatctggggcgcaatgcgctcaataccctctggggcggcgtcattccccttgctttggtncccccggtgtcgtnctgtacacttgctgcccaccgtgttatacatctaattgggacatttnactccccgattnatctgcgccaaaaaaaaa

SEQ ID NO: 87394 - DNA, 561 bp, Triticum aestivum
  unsure (1)..(561): unsure at all n locations
  Clone ID: PAT_TA_87394
gtaaacctgggccaggagtttatttgataaaggtttcaatttgcgccccatttcatggattaacgatgccaagagcataccatttatacaaagtcccaagatcgatgtcttctcacatatctcacataataactacttgtgctctgtttttttctttgtattcaggtttccagaatgattggccacacctacctaataagttcggaatttaaccatgagccccttctggcttgggttccatattccaaggcccttccataatccaattctttgccccgaaccatccattgaagaacatagagtgtgcagaatatcagtttgttatatttgcatcaaatgaactatgggagcacttgaacaatcaggaattgtgggatatagtcattggtcaactccggatgtaagatgattgccatactcctcatatatacccttccaatgtactaaaatatgctccaatttagctgctaaatgtgatagtaaccaaatagttaacgaagtgtaccaacatgtagtattactgtaaagacaacnaaaccggtggtcggataaggagatacc

SEQ ID NO: 87395 - DNA, 568 bp, Triticum aestivum
  unsure (1)..(568): unsure at all n locations
  Clone ID: PAT_TA_87395
gggtggttgcagcaagaaaaccaagacttgtaaggcagcatgctctgtaagaagtgttgaagggaatcacataacggccataggagaaacatcggtgtcggttcaaccaccagcaaaccaaggcgagggggcaccgacgtccaaagacatggcatcagaaggatcctgtccaaatgcagatagctacaattcagacttttctgaggctgcatccaggtttactgtcaatctggatgagagtctgcttgcaccaaaaagaaaaaagaaacgtggccggccaacaacaagcagggacaaggtccatatgagaagggaagcaacaaaagtcaaggtttgttccatctgtaagggcaaaggcacaatcaaccactnccccgacctggtgaccccctagaaaagaaagaaatgggcacatcacaatngtggatgcctgggcataggaaacacatcagcaagccccctgtctcnatggcggtgtccccatccaatagtttcaaaatgttgtcaaactctgtccngtaattgctgttgtataaaaaattccaanatgttactcaaaaaaaaaaaa

SEQ ID NO: 87396 - DNA, 564 bp, Triticum aestivum
  unsure (1)..(564): unsure at all n locations
  Clone ID: PAT_TA_87396
tgagctccaggacatgatcaatgaagtcgacgctgatggcaatggcaccattgacttcccagagttcctcaacctgatggcccgcaagatgaaggacaccgactcagaggaggagctcaaggaggccttcanggtgttcgacaaggaccaaaacggcttcatctctgctgctgagctccgccacgtcatgacgaacctccggggagaagctcaacgacgangangtggacgagatgatccgttaagccgacgtcgacggtgatggcagtntaactatganganttgtcaaggccatgatgggcaaatgacaccaaccgtgctcccaanacaagaggagaatnggcattgcatattaatttaagatcaatcctattggtcgattcccaatttaacatcctacctaactgtnctgctaaaangtttgncgangcaatccngcnaagtcncaatgtgttcaaaaccctggggttangtnaatntgtccccctggggtanccgaatctgtnccccntttgagaaaattttacaaattcgcntnncctcatacatgnaactgggnttct

SEQ ID NO: 87397 - DNA, 628 bp, Triticum aestivum
  unsure (1)..(628): unsure at all n locations
  Clone ID: PAT_TA_87397
taaatcttgtttgttctctcgaagattcgtggtgctagctcgacgttatcctatcaaattgtttccagtcgtgcaattcttttcatccatccggagtatttcaggagttgttttttccgtctcgatcatccggaggccattattccagaagaattcttcgtcctcacatttcaagctaccgttatccaattatcccggtgctttgttcaaatgctcgttaatcagctcgaattcttcccggtgattctttctctttcatcagtcatttctgaattcttatggtggtccgttcaagatctttttccttggattatcatatnaattcatccgtttttttttcaaattccaccggggggtcaatgaagacttcccaagttttgcgccatatccccttaaccttttttccaaagaagaataagtagtatgcaaaataatgctcgtcacaatttaattgatgaaggtaagcatacaataaactaatttantcccaaagtgataacatccaaggagttgtctgatgaataatcagtcaagggttaactttctttcgngtaaatacccggaaccgcggacccacaaacaccagggnactatcttactaatcaccaaaaattgcagggttcagggg

SEQ ID NO: 87398 - DNA, 237 bp, Triticum aestivum
  unsure (1)..(237): unsure at all n locations
  Clone ID: PAT_TA_87398
agatgctactgtcgaccctcttgtgtcgtanatgactgacccggtgtgttcctgcgtacatgatcgaccgaattttgatgtggttttcatttcctgtcaggtcatgatcgttgtattcctttatttgatttgcttccacacgtacgctaacttttgtatcttgcttatcagttgtacttctcactgttttgagtaaattaaacacaggccgttgctttccgccgtaaaaaaaaaaaa

SEQ ID NO: 87399 - DNA, 582 bp, Triticum aestivum
  unsure (1)..(582): unsure at all n locations
  Clone ID: PAT_TA_87399
cggtgcacatagttcttgataataaatcgaccagattttctattaacaaatcaggaaatcgttgatgccttatatacttgatcaggtgtgctttcagcaagttctggagcaaagagcaagatgcaagtgtgattccggaatctcatgcttgggtttctcctactcttttctgcagtgcacttccaaattatctcattcccctagagtattggtaggtaactctcattcccctgggagtactttnaggtaatgatcctaagaanccttgccaggtaaccatgctccttacttccancatccttaantatttaagtgcctcctttaataacggtaaatgtttaaacctaaagattaactattcccaagacacgcttcctacctactaancatattatttcancctggctaagtaaccaaaccgggtacatttgcctggncttaaacaaggttttttaaggagagttttatacacaaatctggttcnnctgggaaagtggagttgtaaacattaanncgngaaccanagaaaagtaattctactttggcaaatgggtgcaattancaggnntaagcattagtgtn

SEQ ID NO: 87400 - DNA, 602 bp, Triticum aestivum
  unsure (1)..(602): unsure at all n locations
  Clone ID: PAT_TA_87400
ggacaccgtcgcgcaggctttctttgacctggagaacggcaaccaggagctcaagagcgacctcaaggacctgtacatcaacactgcaatccagatggatgttgttgggaacaggaaggccgtggtgatccatgtgccataccgtctgcgcaaacccttcaangaagatccatgtcaaggtcctcaagggactccgagaagaattttaacggcaagatgtttnccttggtttgcaacaagaagatttntttaagcaacccaagaaaggttctgctgttcaaacgccctngcaaccaagaccctgaacactgttcaatgannggaccntggaggatgttttgtacccaactgaatttttgggaaacctttcaannaccttttggatngtgccaaggcacaaattactttgacccnaaggacgcaacacctgatanaactggggactctctgaattacgcaaattttggaaaaactntcttgatancttgacgaaatcctaaatcatgcctgaaagncccaatttaaacttttatcaaaattttgncaggccactatttgcacaagtttcaaanaantttttaaattgggnnaaattttgaatn

SEQ ID NO: 87401 - DNA, 306 bp, Triticum aestivum
  unsure (1)..(306): unsure at all n locations
  Clone ID: PAT_TA_87401
ccgtctgcatgatctccaactccaccagcgtcgtcgaggtcttctcccgcatcgaccacaagttcgacctcatgtacgccaagcgcgccttcgtgcactggtatgtgggcgagggcatggagggagggcgagttctccgaggcccgtgaaggacctggctgccctgggagaaggactacgaggaggccggcgctgagggtgggaacgaatgangatggcgaaggangacgaacgactactgattctgccctttcgttccaacggggattcgttccccttctgccgcctaactttaactacaatttt

SEQ ID NO: 87402 - DNA, 218 bp, Triticum aestivum
  unsure (1)..(218): unsure at all n locations
  Clone ID: PAT_TA_87402
gtggtgaacctggtgagcgccgtggcggtggagacgtcgtggagccaccgtggtgtggattttagtatggtcaaggtgtccaacatgtcccataatgcccttctggtggatgatcgagcgctcgagatcatcatccgagagatcaacgggctgattaattatggtctcattcacctgggacagcgttggttcaaaagcatgctggagntccgtgttct

SEQ ID NO: 87403 - DNA, 322 bp, Triticum aestivum
  unsure (1)..(322): unsure at all n locations
  Clone ID: PAT_TA_87403
cttgcttgactcccagtctcatcgtctcgatcttcggttcggtgatctgcgcatgcctagcctgaggcagtgcagcactttagctgttgccacgaagatgaagatgagcaaggcccctgtgctcctgaagaaggcggtgacgatgtgcaaagagcaagacaggcgtgctccgcagccaagctcctcttcctccgcctcgctccgggcgcaaggatgggcaccgtccgcgttatgtctcaacaaagatacacgcgctcaatggcngccgccgcgagnaggcgggaaaggggggaantgccaaaaagtctgtccttttccgcaa

SEQ ID NO: 87404 - DNA, 645 bp, Triticum aestivum
  unsure (1)..(645): unsure at all n locations
  Clone ID: PAT_TA_87404
cgtcaatggacgtgttcatccacgaggactacgtgaacaagcgcaacatggtgaggagggagcagaggatgaagatgcagatgcaggtgctgcagcttggcagcccaggcgcgtgccggccgccgccggcgcacggggaaagacagcccgggagcgggagcgccgaggcagtgcctgacgccaaccggcatctcaccgtccgtccaccatcaaggctccctttatcaggtcctcccggaggaancctctcatccggttcaccgccgctcttcccattgcctngagccgttactaagcaacccgaggtatgttgttangtttaaaagaataacgttggntcctcctgatgggtgnaacttttttcaaccatttttgtctccctatttcnaactatgttatgcatggccgtttacaaataaccctttttgaaaatgttgcctgctatgaacactacactgtggggggggcccggtaccnatgnccctaatatgatcctattaccccgcnaatgggcgngtttaaactcctgactgggaaaacctgcgtaccacttaacgccttnaganatccccttcncactgggtatancaaaggcccaccnttccttcaaantnccactatgcatganccccgtncggcataccn

SEQ ID NO: 87405 - DNA, 445 bp, Triticum aestivum
  unsure (1)..(445): unsure at all n locations
  Clone ID: PAT_TA_87405
tcgtcttctaccgtttccatccatctcttccattccataacaacatcaactcaagatggcccgtaccaagcaaactgcccgtaagtcgaccggtggcaaggccccccgcaagatggcctccaagtcggccaagaagagcgccctccgctgggaggcgtgaagaagcgcacaggtcaaggcccgggtaccgtcgcgctccgcgagatnaaggaantaccaagaanccacccgantcctcctcaaggaanttcccttnccaangctccnttgagggaaaccctccaagatttacaaaccgttctcnaggttccaaaancgcttgccgtcgctgccctttnaaggagctgcttgagttactccntggtctccttccnaagacactacttttgcncatccaagccnaaganggtgatatcaagcccaaagnatcaactttccccgnagt

SEQ ID NO: 87406 - DNA, 310 bp, Triticum aestivum
  unsure (1)..(310): unsure at all n locations
  Clone ID: PAT_TA_87406
ccgggcagtccggcgagggctgcagctgcggcgacaactgcaagtgcaacccctgcaactgttaagctgcatgcactcgtacgtacgtgtgttggtgtgagagtatacgtgaataacgagcgtctgattctgatggagtccgagcaaggtgcgtttgccgtttgcgttggttgcttgctcgtctcccnagctcctgcccagggtgtcctttgtgtgtatgttttgttttcatgttcccctgnaatttcttccacctacccccacttatgggatggagttgatgaatatgttnagaatgaaaaatttaccc

SEQ ID NO: 87407 - DNA, 609 bp, Triticum aestivum
  unsure (1)..(609): unsure at all n locations
  Clone ID: PAT_TA_87407
cagcagcaagccttttgaggggatggggcgagccaagtcgatgaggttccagacagaaggcgccggcacctttggtgggttcggtggtggcaccgagagcaaattcagattatacaatgatcctgtcggcgccagctctagccagccccggaagccaccgcccgtggagacgaagcttacctgcacgcttccagagctatactctggttccgacacgcaagatgaagatatccaaggaacattgtcaanctaatggggcaactggggcattgaatccggaattcctgacaatccgatataaaaccggatgggaagaaagggaccaagttcacatttcccggacaagggcaatgagcaacccgaaccactttccgccatttctcttcctcatcgacgaaaacctcatgatgatacatganggaaagnaacactgctgatctaccagaaattcgactggtggatcatttggcaaggacacatgatctgaaaccttgacgcntnactggtgattaactgacagctggtacacgggatatgacttcancncaangagggatccatgtgaaaatggganggangatcnanacaagtcagtnattccgaaagcnt

SEQ ID NO: 87408 - DNA, 565 bp, Triticum aestivum
  unsure (1)..(565): unsure at all n locations
  Clone ID: PAT_TA_87408
tttttttttacaaatatcacattttatttcactgcaataatattatagtaatgtgttcaatacaagcagagactgctatgagcaagcacacaatgtacgtatactagcacatgaaagacacctgcacgaccattgatacaggccctatagctaggaccatagcataaaccctggatgttttgaatgatgaccggtgaagagtgacactggcttattacgaaaaaaggacactaatccaggttcactttagntcttggttaaaccagtccaaccatgtctgacanggcttccctcnggcgctcttcnacagcacctgcatcttcacttttgtactcacagccacccatgagaaccccnanggaaatcttgacaaagtganatccccgttttanaggatanacctgctcaaacgtttgacaattccgggggggangtttggcatttcaactccaataccccatggggattncacccttgaacctcaacattacacaaaaggtcnacaaacacgccggttcaatacttcgcaatcggcaacacttngcccnacaataccncccccaaa

SEQ ID NO: 87409 - DNA, 608 bp, Triticum aestivum
  unsure (1)..(608): unsure at all n locations
  Clone ID: PAT_TA_87409
gatagttggacgggtctggagttcaaagagggagccatgccacagcttcaaaggctttggcgtaccctcggaataataaaagcaggggatcaatttgaatatccggatattggcatggagcacctcacttgcctcacaagagtccatgtggaggtcagttgcgcatatgttacttatttgcaggtggaggctgcagaagctgtcatcaagagcacaaatatctggacccacattaagtattgagcaagatccaatgggaccctggatgaaagggagaaagagcaacacccactaagaagatgaatacccaatnttggaaaggtaaaagggcaacactccacaagccagatgtgnnaaggtaaanggagacatatcccatatccancctggaaaacactattggagaggatgaggaaaacactnacataactngaaaanttctgaaataaatgggnattccaaanggaacatcattacccttggaattanctgagaaaccggaacacaatttgattngacccattnctganaaagtnatnaagggnaaggaacatctggccggaaancttttaatgaccattcgaagaagnaaaaggcaaggccacnng

SEQ ID NO: 87410 - DNA, 297 bp, Triticum aestivum
  Clone ID: PAT_TA_87410
gcacggtgaagctgtgggtgatggcggcgctgctcagcgagggcttccggccagaagccacgtcggagatctgctaagccacgtgtcgtcattccatgtgttgttagtagtgtggcgtgtggcgtgtcctctggtttgtccctgtccgtccgatccgtaactgagtactacagaaagtggccgagttgtaccgctgctgtgcttcagtcgaccagggccgtcgcccggcccgcatgggctgggtcaaacggcgccgttaaatgtatcaagcaattggacggtaacaaaaaaaaaaaa

SEQ ID NO: 87411 - DNA, 516 bp, Triticum aestivum
  unsure (1)..(516): unsure at all n locations
  Clone ID: PAT_TA_87411
gtgacatttcaccgccccaagaccctgtccaaggccagggaccccaagtaccccaggatcagcacccctgggaggaacaagctcgatcaatatcagatcctcaagtacccgcttaccactgagtctgcaatgaagaagatcgaggacaacaacacactccgtcttcatccgtccgacctgaaggcccgacaagaagaagataaggcccgctgtcaagaaaatgtacgacatcaaggccaagaaggttaacaccctccatccaagcctgatggcaagaagaagctacgtngaagctgacaccaagactacgatctcctttgatgttnnccaacaaattccggatccatatagtcccagagggaaggccctgcaattaagcttttgtccttggttcctggtgttatnggattttggtagttgttactttacaaaagggtcnattgtccattgcctaccataccgcgcaactttcatattttatcatccaattatngttttgaccttaaaaaaaaaaaa

SEQ ID NO: 87412 - DNA, 270 bp, Triticum aestivum
  unsure (1)..(270): unsure at all n locations
  Clone ID: PAT_TA_87412
aaattctccgagaaatccgacgtcttcagtttcggcgtgttgatcctggagatcgtgtgtggccgtaggaacagctccctcatcgatcacgaatggtcaatgaacctccgtgggccacgcatggaccatgtggcaggagggccgcgcctccggagctcatcgacacgctgatggggcaccaccgtactctaaaggacgangtctgcaggtgcatccaaggnggncttctgtgcntnaaagganttncaaaggnaaaaaggcgggaaatcc

SEQ ID NO: 87413 - DNA, 512 bp, Triticum aestivum
  unsure (1)..(512): unsure at all n locations
  Clone ID: PAT_TA_87413
tctggatggaggcgtgctagcgcctttctcctcgggggcatcctcttgaagcggactgcaactaggagaccgatggttattggtggctggttcgtcgaggccaggggcgacaatgtctgttggggcaatgatgatggcgccaagatgattgggggtccgcggcacgggctttgggtatccggctatcccggcgttccaatgtgctcttcccgtggttgcttggttgtttgttggagtcccaactacggtggattgttccaaantggtgacgaatgacagnacccagcggccttccgcngangacccgtcccgggcaaccctgcatatttcccttcccaaagatttcatcaaatcgaantgtccntcccttggcgtgtgtggcacccgtttngatttngcaagttngccggtgggancatttccnggtttaatttgaancgttttaaccggtttccccnaattaacctgaatcctaaccccccttaacaatgaatgcaaactttgcccccttt

SEQ ID NO: 87414 - DNA, 412 bp, Triticum aestivum
  unsure (1)..(412): unsure at all n locations
  Clone ID: PAT_TA_87414
gcggccccgtgcgcggcatctccctcaagctgcaggaggaggagcgtgagcgccgcatggacttcgtgccggagaagtcggcgctcgaggtcgacgaagatccgcgtcgacaaggagaccatgggacatgctggcgttcctccggcatggccgacctcccccggcgtttgagcgcgccccccgaagccacctcctgccgctgccccctaccgccaagccttnnaacggccccgcngtgggatccgcgcctaggtcctcccgatcctcctccnccgtaccctatcactttacatgttttaataataaatccgttactttgtggcaantgatgtttttgaacccaaacttaatttccaagtatttttgttctgccntatgggnaaatgatcntttaaccncaaccgttttaaaa

SEQ ID NO: 87415 - DNA, 575 bp, Triticum aestivum
  unsure (1)..(575): unsure at all n locations
  Clone ID: PAT_TA_87415
agctcgttgatcagtttcgaagaaaaaaatatatgaaaagaacaagcaagacaattagtggaacctatcaaagaacttgcgatttgtgaaccaccgtgcaaaccccgccattccccatgtcaaaactttttccggacacgtcctaggctagctttttaataagaaagaaagaactaaataaataaagaaagaaagaaagaaacacacaggaaccaatattaaacaagaaacgtgcagacaagaataatgtcatgttccggtatccagcattccaagaactttcnaacttggggccattcaagggcatttataacttcaccccanttttcaatttgatccgacagggtttccnngggaccttcanatgccngtggacnattccccccncnggacttttggngaacccacacctcaacananattccngttttgggtgaatcccccananacatggtatnttnacggcncctttaagtttcaaaaactttgcaatgnnacatcnccnttcaagnccaaaataagttgtgtgttnaccgggctgtattgcaataatcncncactttgngtnaatggcc

SEQ ID NO: 87416 - DNA, 648 bp, Triticum aestivum
  unsure (1)..(648): unsure at all n locations
  Clone ID: PAT_TA_87416
ggctttctgttttttgttagtttagtttttctcttttgtattttcttttccttttatttattctttcctgctttattgtatttgcattttattttagtaaaacatacacttagtatctaaattagtattacaacctagtccatagtcacaaaaagtctagaccccaaataacttagtttgacattttattaattaagtgaaggcatttaaataattagtttgctactatttaaacattatggtgtagttaagcatttcataaaagttggttcaccaccccatttacctatgatttattccgacacatttagaacatttnaagtttatttntgggaaaactttgttgtttgccttggatttcaaattgaatttgaaccgtttccgaactaacacgagattagcgacagtaacggaggtgacgtggtgtcattagcagagntactgtacttgataacccgggcgcanaatctctccacacaagaaactcgcccgagattaagcggggagtaatggggaaagggctggtacgaaaactaacgagctcncggctggtgccctgcaaaaggtgtccntcatganggcccantcccgttaaggcccangggancggtttttttttntttttggaaccacgattacaaanaangg

SEQ ID NO: 87417 - DNA, 578 bp, Triticum aestivum
  unsure (1)..(578): unsure at all n locations
  Clone ID: PAT_TA_87417
ccgagaacggcaccagcgacagcgacggcgacaagcacggcaaggaccggtacgacgacgggcagcacgacgatgctaatccggaggagccggggccggggcaagccacgccgacctcgtccacggagacgatccgcgaccccaagagggtcaagaggatactggctaatcntcagtcggctcaagagatctccgggtgangaagctncagtacactcccgactccnancggtgcgtcnacaacgctgcaagaacgangtgtccgtgctgtctccccgngtggatttctggtnaagcagcggcatcctcaancgtctncaacancacctccnancacggtttncactccttgcgcaagacaacttttccaangacggcaagatccctttnccaccnaatccgaatcaaagtccatccatcctgcatgactccntggaggatnaccaatcctttttatctgcaccaatcaggagggcttaacgntgaattnanaggtgcggagtgtncaacnacagactcataatttcgttcggcgcngctcgacacggnggcgcccttgcgccggngaagantatact

SEQ ID NO: 87418 - DNA, 483 bp, Triticum aestivum
  unsure (1)..(483): unsure at all n locations
  Clone ID: PAT_TA_87418
gttttttttttttttttttacatcctatccaggctaaaccagatgttatttttaaggaggccacttcagattccacattgaatttgcaggtccttccatagcaaaaacaccatgcaaatatggacttccgtgagtattatttcgtgcttttagaaacccnacccgtgctttgctctaaaactatgttttctttggtgtttagaacaagcctcttatcccaaaagttacccttctctatgtcctgncctcgatgcggctttatacatgtctcantccnacctcctttcttctttgaangagtgtggcantccaaaanctattctaccttcaagtttgtgcttaanncagaagactttgaatttngtggncaacagtttntggtngtccagggtnaccactattaatcgnagacacnatcccggancattcacacatcatagggntagcttaatttccttngcggngtgnncaagttanaagcat

SEQ ID NO: 87419 - DNA, 435 bp, Triticum aestivum
  unsure (1)..(435): unsure at all n locations
  Clone ID: PAT_TA_87419
gcaaaggattctacccgccgctcggagggaattatacttcaaggcagcccacgcggcgcttccaccgcgaggacttagccaacgacacgtgcctttggggacctaatggcccctactgcgggtcggcaatcgggcggcgggcgcatgcgtcgcttctagcccggattctgacttagaggcgttcagtcataatccagcgcacggtagcttcgcgccactgggcttttcaaccaagcgcgatgaccaatgtgcgaatcaacggtcctctccgtactagttgaattactattgcgacgcgggcatcagtagggtaaaactaacctgtctcacgacggtctaacccanctcacttccctatnggtggggttgaacatcccacacttggtgattctgcttaacaatgatnggaanaccnacatccaaggttnaaaaaca

SEQ ID NO: 87420 - DNA, 573 bp, Triticum aestivum
  unsure (1)..(573): unsure at all n locations
  Clone ID: PAT_TA_87420
ccaaactctaaattttggaatgttatattaaataaataattgtgattgtttgtttgatttttttgtgtgattgattgtgtgaaactgagtggaaattgaaactttttgaaagttgaatganagggaataaaaggactttcccaaaactttcatcttgcattttgatatccaagaattcaaattcatttcatcacaaaaccctagagtgtagagaatatgacctgttccatttaaagaaatganaaggggttcaananattatttgaattccatttgnaatatttccaaatttagaaacttcaaacaactcnaangattccatgagggaagataaaagactcctcaaattttacgaaaganaattggnacgtttcaaangaaataacttanaatcnctttccaattatttcaaacccattggggattatttgggttaaaatccattattttttcccaaaaaaaataaatgtanttagggnaaaanatcccttaacnggnatttcaaaaaaaattgnacccatngcnattaaaaantttanngattaatgcccatacacgttgcttttaggtttn

SEQ ID NO: 87421 - DNA, 334 bp, Triticum aestivum
  unsure (1)..(334): unsure at all n locations
  Clone ID: PAT_TA_87421
gcacnaggtgaactccaanagaccgancgaggaaagttgccgtgtgaaacctgaaagttagggaaatatggctgggattggtcctaacaagcaaggactgggaacccataatggcnccgnanaaagngcaaaangccgccgacaagaanggccaaaaaggcgtnnaagctgcccgccgctccggggccnaaatttacancacccagnaagtttaaccccgggaccaacaaagggtgnatctaacgggaattccctcaaaacaancgggtccacnaacaaaccgggggaaacntttccaagagcgtgttttaatngcccgtnagaaaaacctttt

SEQ ID NO: 87422 - DNA, 583 bp, Triticum aestivum
  unsure (1)..(583): unsure at all n locations
  Clone ID: PAT_TA_87422
tttttttgcccattcctcactgacaagattcgagtttggacgatagtcacattcaagattcacaaaattcatgtgctagtcatgcatgccccaaagctttccaaagcgtctaggaacaaacaaggctcgaaacccatctcaaaagtccccacagaacaatagccagattcaatataaaattgtgcagtttggaaaattacagggaaactaactgctggaactgagacaaaaatttcactacagaatatatccattggagtggataccaaagatctgttgctattcagccaaacttgcatccccatgtaacatcatatactgcagattcacggttaacattctatggtcctgttcttccgttttcctgggcttgatccccagctttctccggctgccttttttccctggtgcttgggaagaanccttctgcaagacatcaactcatacaacttgcgcatgatgttcctctcaacctgtagttaagcaactcaagggaattanccgtagttcaatanggnagattgctgtcaaatccggnatttacnaaagcttggtcatngacaacactnacgctccccactag

SEQ ID NO: 87423 - DNA, 379 bp, Triticum aestivum
  unsure (1)..(379): unsure at all n locations
  Clone ID: PAT_TA_87423
gttgagtctgccacaaagtatcttcttagcaagctcaaggaccttcagttctttgttggcgagagcatgcatgatgatggcggcgtggtgttcgcctactacaaggagggagctgctgatccaactttcctgtactttgcacatgggctgaaagaggcaagtgctaatcccactgtatgctaaaactatgcggcctcaatattttgntctgctctatggttgtcaatcgatctccaatgttgtgtccgtaactatcaaatgttgagtgtcttgaaactttcctnaaattgtggatttgctttggtaanggaaccngtaatttgggngggtaagtttttgggcnatgcctccggttttactccccctnanaaaaaacggg

SEQ ID NO: 87424 - DNA, 337 bp, Triticum aestivum
  unsure (1)..(337): unsure at all n locations
  Clone ID: PAT_TA_87424
actactcgaggttcttcaagggcaagtgccccgacgcctacagctacgccaaggacgaccagaccagcaccttcacgtgcccagccggaaccaactaccagatcgtcctgtgccccgcccgaaatgatttgcacatggatcagtaagtagaggatgtattactcctagtagcttcctcttacttattatgatcatccatcattctgcgtgtgcccatattatatactcccgttatataatgtcacatatgtgccgtgcgttgcatgggccggtgcgtgccattcaagcggaataaatgttataaataaaatggaagtgtatttcctacggttnnaaa

SEQ ID NO: 87425 - DNA, 263 bp, Triticum aestivum
  unsure (1)..(263): unsure at all n locations
  Clone ID: PAT_TA_87425
gttgtcgccgcgggtgagcgggccagccgcgagctgtgggtaccgcagatgcacgcgggggcggcgtggaccggcagcaagcgacctcggccgtcgtctctcggctcctcctcctactgggtgaaaacgtgcgctttccagtactaagtactaagtagcggataaaatcaagataagatcaagaaaaatgacctgggaccatgaatttttgtttgattctgtagcttgtccnttttgaatcctacngcatttttttaaaaaaa

SEQ ID NO: 87426 - DNA, 443 bp, Triticum aestivum
  unsure (1)..(443): unsure at all n locations
  Clone ID: PAT_TA_87426
ttgacaagaagcagtttatctctcacatgaagcgctacatcaagaacctctctgccaagcttgaaggggatgacctagatgttttcaagaagaatgttgagtctgccacaaagtatcttcttagcaagctcaaggaccttcaattctttgttggcgaagagcatgcatgatgatggcggcgtgnggtgttccgcctactacaaaggagggagtgctggattcaactttcccggtactttggnanagggctgaaaagaggtcnaantgctaatcgnactggttggccnaaatccnagggggncggccaatatttttgccccgggcccaagggttgtnaatcaaacccnccaatgtttgtgncgggaacaacaaaattttnagtgccctnnaaattttccngnaaatnggngaatttgcttttnnaaagggaaccntaaattggg

SEQ ID NO: 87427 - DNA, 167 bp, Triticum aestivum
  Clone ID: PAT_TA_87427
gttatattctcatgggctcagaggcgtcaaacagctccatttcttccaggcgaccacttggtgttctttatgctgaatgtgttcacggttatcggtcttatgctcaccttcagaccgttctacgctagaaatggcacgtcgaatcattaatgtagtgacaccaaaat

SEQ ID NO: 87428 - DNA, 403 bp, Triticum aestivum
  unsure (1)..(403): unsure at all n locations
  Clone ID: PAT_TA_87428
aaaaatctctctccgctccccgctccgagtcgcgtcgcgtgaggagaaaggaagggaagccagaaagggttctcgccgaggcggaaggaggagngncccgggaaagggaaggcaagggcctgctcgcggccaagacgacggccgccaagaccgccgagaagcaaaggggaagaaggcccccatctcccgctcgtcccgcgcggggctgcagttccctgtgggccgtatccatccgtcagctgaagcaaaggatcaaggccaatggccgtgtttggtgctactgcngcggtctactctgctgctatcctgggattacctgacagctgagttctggagctngctgggaacncaacaaggtntcaaggtcaagcgttaacctnctnacttcaaattggcatccttg

SEQ ID NO: 87429 - DNA, 628 bp, Triticum aestivum
  unsure (1)..(628): unsure at all n locations
  Clone ID: PAT_TA_87429
gtcattcagcagcgacctagcattgatttagcttgctttgaggatgccgctatttgccatggcccgttataaactttatatgcactatgaatattcacaattgcgatgttttgatagtgatcaacgttcgctgcatacttcgtgtggtggaaccgataacgacagtgtgacacacattcattaaaaatcatgaattctatgcaatgtttctcccctccgaagtaaaaccacattatacttaaatgcctacaaaatcttaaccatactttaccaaaataggttctcttgttcttgcaaggtaacggcgtacttcctgatgtccgcgttgtccgctgcatccccgtttacaaacgcatgccggganggtccggacaacgtgttcactggattccgtccgctgcctccgattaacagggcttcnttgcctttggtttgcctcncgtctcggtctcatctcaagnttcaagcgtccaagcaagactacatatgaccttgtgaatatgggcaagccgctcatcgggccattggtcctctcaanntgtaatcaattggtctccgagtaannaaactgggttcttgngcccgacaanggggttcttactgggntantagngttaancncccaatt

SEQ ID NO: 87430 - DNA, 524 bp, Triticum aestivum
  unsure (1)..(524): unsure at all n locations
  Clone ID: PAT_TA_87430
agaacaggattagatatgctggcaaagcactatggagatgcttcgggttttgaaattgtcttcttcttaccggacagtgaagatgattttgtgtcttacactgaatttctgcggtacttggggctcaaaaagtcgcgcaggggttgttaaggttgatgcaggaaccactttgtttttgggcccgccatccggattcctgacgaatgttctgcaagttggatggtcccggagcgcctttatgcgtgggactgcaattccacagatgtcccaatgctgctgtccaanaaactgtactgactggcccaagatcacagcttattanaangggggggaancaancaacnaaccaaagaantacanatggcccgctaanggaacacacaagagccgatacggaacttacttagaaaatcacaggnacacttccataccaatcagcacaggancaccaaccgaantaggcaatggcaactagcaatncacaaatcacaatancaggggaactaaaatcggcacatcgagaa

SEQ ID NO: 87431 - DNA, 448 bp, Triticum aestivum
  unsure (1)..(448): unsure at all n locations
  Clone ID: PAT_TA_87431
ccggggacttctttcagaatctcagacgctgagattttcctccatgcgggtatcgatgcgtcaggcgtcagtgaaagaacgagaacgagaacaagaacgacctcattctctagtgtgggcaagagtgctgaacttggaaccctggggcctgggtcttaagaggctgaattccatgcagagcgcggcaaggcatctcaaaggtcctgctcaagatggccgcttcncaaaggggaaagaatcaacccggcagccctaaggatccngacgacgaagctcctccggtggttccgtcaagactggaccatgttggagacaacccgaaccgttntaggcagagnatccaaggtantccctgtttnggaacaacgacctttgggaaccatcnatggaagatgagnccgggactgatnaaaacngcctgaaccctttgggttnggcnccgggcttc

SEQ ID NO: 87432 - DNA, 508 bp, Triticum aestivum
  unsure (1)..(508): unsure at all n locations
  Clone ID: PAT_TA_87432
cgaagctgatgggttccgttgtctaacacaattcgtcttgggggccgattcgccgggccaagttgtgttccagccaggagctttgcccaaggcggaatatgttgagctccgtaccggtctgttggtcgcaaaagaggaagcagccggcaacaatggtggtgattgggttgacactgggcatcaggaacctgccgtcccttcnagtccggcccgtgtccgtattctgtacttccgctactgcgacaggaggcccgagaaagcgaatctgcactccnagactgcaccccgtgcccatccctaacanccccgactattacgtattccgtagaagacgacgacactggatgacggatgtngggagtggaagaccattttaaagttcccagactatttatatctgncattattttaccccgaactttcctgcgtctgggatatggctgacggaaatccattggcgaatcccatcccttggactccttccctggggtaanagaaaaaaaaaaaa

SEQ ID NO: 87433 - DNA, 512 bp, Triticum aestivum
  unsure (1)..(512): unsure at all n locations
  Clone ID: PAT_TA_87433
gcaatacccaccaaaagagataaaagatcggattcgccgatttcttcgacaactccactcaccaggtctgggtcactctcaaagaagccatccttgctcaagacatcaagtgtaagggtccagacaccttcagatcccaagagattggcaccgctgcggtcatatgctgacagatacaacgatgatcccaaggaaagtgagcagaccccgaagaagagcaagaattcctcaaagtcgctgctcaagttaggcgcaagtcaaagaaagaagaacactgccctgctactttggatgactactggactccctggacaccaagatggcaccacatttcctgaatacttctgctccctcaatctttccaatgggcaaagtgcgattnggcccttngatataaagttcttcaatggttatngcaacacaattcagtccgttaangttataatatatgcncaagacanggattcccgggaaattcccgttccccttaccggttccccaaaaaaaaaaaa

SEQ ID NO: 87434 - DNA, 662 bp, Triticum aestivum
  unsure (1)..(662): unsure at all n locations
  Clone ID: PAT_TA_87434
cggattttcatctcaggctgggtcgaacccgtctcgtggatttaattctggattttcatcccaggatgggtctaacaatattcctcctgggttttcttctgcgttttctgctgggttttcatcccagaatgggtctaaccaggcgtatggctccacattctcagaaactcgtctacttgataatctttttggtagccacaccaatcaatatcaacctcagatatctagacacacgagtgacatagaatttattgatcctgctatattggctgtgggcaaagggcggatgccaggagttagtgattcagggttggatttgaaaaacgctccttttccaagcacaattgcagacatcaaataatgatccaagactcaactacttatgcagcagagcatgccctctcatcaaaacctcagatatactgacatgttcgagatgcatcaaccctatcagaatgataatatctggatcccgactctgcaanagaacatggtctcatcccttagcacagatgtcacccaacaactagaaccacagcttcaaatggcactgggatggtggatgattnanaanggataagtccatacggnagcaggagtattcaatgaagcananttaaagcggtaaagnagtaaaaacttgcttatncntagggaatgcc

SEQ ID NO: 87435 - DNA, 388 bp, Triticum aestivum
  unsure (1)..(388): unsure at all n locations
  Clone ID: PAT_TA_87435
cggagctgctgatccgcaagctgcctttccagcgcctggtccgcgagatcgcgcaggacttcaagacggacctcaggttccagagccacgccgtgctggccctccaggaggcggccgaggcgtacctggtggggctgttcgaggacaccaacctgtgcgccatccacgccaagcgcgtcaccatcatgcccaaggacatccagctcgcccgccgcatccgtggcgaagagggcctaagctgccccctccgccgacgccgttagtgatccngaatgtgttgattctgggttgtatttgttcctaattgctgtgctangtctctctgcttttgtgtagaagaaatatggttgttggtacaagcaaaananaaaaaaaatcccaggggggg

SEQ ID NO: 87436 - DNA, 627 bp, Triticum aestivum
  unsure (1)..(627): unsure at all n locations
  Clone ID: PAT_TA_87436
gaaaaaccaagggcatggatctggtgcctccagttccgtggacgactcacaatcggaactcaatgctttggtgctcactggaccatacaaagctatctcggcggatggaagcttcgtccttcaagttgataccagtaccagtgcaactgcgacagctgatccatccagggaccaatctaggaatgttggtgcggccatgttctgggatggctatgctgaatacacacggtgtaaccangtcttggcgcacaacttcaccaagggccccccaccacaacatagaggtcacctatgcggtgctgactaatgccgtnggaggccaatcaagttatcctgttcaacaacaagntcccggttcgacaacggcaaacctgcccgggtctatggtaaaancacacaccncaggngggggccccggtaccaattcncctaaaatgatcctattacccccctaatggcctcntttaaactcntaacggnaaacctgggttaccaantaatccctngaaaaatccccttncaaantgggtataacaaaaggccnacgttgccttcaaaattccacctatgnaatgaacccttcggcatacccgngttttntaccantncntaattcagccnanccnc

SEQ ID NO: 87437 - DNA, 473 bp, Triticum aestivum
  unsure (1)..(473): unsure at all n locations
  Clone ID: PAT_TA_87437
ctttcagcccgcttgcttgttgttaatgtccatctttttagctatcctgcagaaactttaatctattgaatacatttcttcagagaaacaattgttgtgtgcagaatatatttcttcagagaatgtgttattgtgcataaacttcaatgaagttggcagcgganatccagtgaactcacctacaccaggtccttcaaacagtctattgtgtgtcgaaggtcacgttcatctctgggcaaattccaccgcatcctcggtccgtacgtgtgctcgatctaatttcttatttttttcttggggcgtttgacaaatgcttcacagactaaagctcaaggttaacatngcacttgcagtttgacatccattgccaatttgtgttgtttctaaacgaaatgacncctcctggtcaanggattatctannactgaacgatccccctgtacaaatggccttaaaagctttganaaaggggt

SEQ ID NO: 87438 - DNA, 380 bp, Triticum aestivum
  unsure (1)..(380): unsure at all n locations
  Clone ID: PAT_TA_87438
gatagttcttcggacgatgttgcaaaaggttgggcaggaatccatgcaattcctaggacgatttggttagacagccatggcaagcagctgctgcaatggccagttgaagaggtcgagtcccttcgaggaaatgaaatcaaccatcaaggactanagctgaagaaaggaggctgttttgagattaanggagctgacatttccaangctgatgttgagatanacttttgctgactccaaccgataacccgttcttncattcccccngggtttttggctccanaaacatncccggaacnggtgaacatcaatngggggaanagggcattttgatnttncccngccnctgnaaaaaaggngggacanatgcntgnattcccggg

SEQ ID NO: 87439 - DNA, 303 bp, Triticum aestivum
  unsure (1)..(303): unsure at all n locations
  Clone ID: PAT_TA_87439
gtctgtttcagcatcgttaatttgtatcctggccctnggctttggaaagaaaccttttaattttgtccatttttngcctngttaccgaggtggtttnatngtgggtaanaggcttgtatcaatttttnatncctngcttgaagttaacacttgagctacataactgtacngtatnatgctgaaggcnactagggtctgaacccgggtttattggaanaancctttgaataccctgggcaaggtaaaanaaaangcnccnaggggggggggggcccnggnnccaattcccccnaaagggagccc

SEQ ID NO: 87440 - DNA, 526 bp, Triticum aestivum
  unsure (1)..(526): unsure at all n locations
  Clone ID: PAT_TA_87440
ggagggcttcctggaggatcatctcctccattgagcagaaggaggagagccgtgggaacgaggcctatgttgcttcaatcaaggagtaccgtaccaggattgaaactgagctcagcaagatctgtgatggcatcctcaagcttctggactcccaccttgtcccctctgccactgcagcagagtccaaggtgttctatctgaaaatgaagggtgactaccacaggtaccttgccggagtcaaaggnaggcgctgagaggaaagaagcagtggagaaanccttggtagcatacaancaacccaagacatcccgctngctgatttcctacaaaccaaccnataagnttgggctttnancaattccaaggntcnacaagaatcccggancnccaaacgngcttgaacttnccaancaggatttatgaactatgctgactggcccctcggggaggacctacaaggananactngataancactctcnggnnactgancccggactccataccaangagtgggtaataagaa

SEQ ID NO: 87441 - DNA, 333 bp, Triticum aestivum
  unsure (1)..(333): unsure at all n locations
  Clone ID: PAT_TA_87441
aacgtgccggctctggcactggaggaggaggagccggccgatcatgccaagctggggctcgccgtggaaatgcagtttcccgtggtggttgacttccgacgttgaaatctaacacaagatatttacgtcgctagagccttcgtcgctacatcatgcatggccggccgtgcagcaggcgcgtgacgaactggctgcnctgacgcctgttcacgcaagacgccggcatcaaagagcactccgccggtgtgggtttggcgtgccccaaagcggatatgctgaactgctgtccctgganactttccntgggtgaaaccggttcnaccgtcaaggaca

SEQ ID NO: 87442 - DNA, 394 bp, Triticum aestivum
  unsure (1)..(394): unsure at all n locations
  Clone ID: PAT_TA_87442
ctcatctggnacattgctaccagccttttgggcangaaatgcccgctgcagaataagacctcnatgggagctcatcnccagntggnagtcacgctatccgggtactgcacttacttggtgagcctcatatccggagctgcttccaagacaataaggacgggacgacccacgtgtnacaaggagatgcaanagcatttgaagaatgcgctgggaggtgtttggaggtaccacctgtcttttgncatgcaccaaggnatnacaactggtttgnnatttccaaaagagcaaganggagacancgatgtgcaagaggggncacattttggggatnttgttcctgggagatggacaaaagaagagagttttgggactaatggtgctttggccgactcaa

SEQ ID NO: 87443 - DNA, 355 bp, Triticum aestivum
  unsure (1)..(355): unsure at all n locations
  Clone ID: PAT_TA_87443
tggaggtgaaggtggcggtgctcaagggcgtcagggtcgtcggcgacttcggcaagaagacgtggaacaaggtcaaggccatcaagcgctgatcgatccatccatcgcatctcacccgatgtgtgcttccgttccttccgctccagtccactaagttgcttcatgtantactgcctggataggataccgtctggcttgtgctcttttttttttccggttgtggttgtgatttggttgtttgnttctnttttgaggcactttttgatgcatgttnaaaatgtctgccatgtnattcnaatttaccttgtttnaaacccccttgatnataatatatatttnncttcctggtttttaa

SEQ ID NO: 87444 - DNA, 393 bp, Triticum aestivum
  unsure (1)..(393): unsure at all n locations
  Clone ID: PAT_TA_87444
ccaccacccacctaaacccgcgaactcaccaaggcggcggcggcggcggcgacagcagcagcggcgatggggagcgacacggagacggagaagaagaagaccccggtggcgctggcgcccatcgccaagccgctcgccggcaagaagtctccaaagaaaacctcaagtcgttccgccgagctccggaggcaatgccttgaagcgcggggtcaaggagtggtcaaagagatccgccgtttggaacaaagggttgtgttttatttcccgggaaantttttctanncgattgtgtttacacaacttcccanaattttttanggaacntanttcccaaaanatatnttancctcaaanangagtttngaagngnggaaaacnanagggcaattttgt

SEQ ID NO: 87445 - DNA, 604 bp, Triticum aestivum
  unsure (1)..(604): unsure at all n locations
  Clone ID: PAT_TA_87445
gtgagttctgctctacaaaagacgtcacctgtggtgagatgctgatagtaagtacaaaacaattcttgtagttaattcttgcgtagtaaacactgaccgaaatatagttgccaacactcatgcatcacagcgccaggagtaacctgttaaatagcaggaatatcactaattattaacatctgaagaacaaatgcgcgtacaaggaacataatctaaatccttacactaaagtggcaataatataggagactttgattttcaagtangagctggtagcaatcacacatgggaatattccctgcaaaaacacacatagatgaagtactcccagaaataacaattgggcaagcatgttagaacaaaatacatccagaaaactgaagtngagaaagagggtgacatccggttccttgctacacccgcaattgtaagcatgcacaaccatcatgttgttgagcaatgcttataaggatgatggatggtgcaaaataagacgaangngaaacatattatcaaattgacaaatcaaatcaccatgatcacatgaactgacttgaaccgnttgtcgtagaattgcatcatagtagttgnacnctcaagngag

SEQ ID NO: 87446 - DNA, 557 bp, Triticum aestivum
  unsure (1)..(557): unsure at all n locations
  Clone ID: PAT_TA_87446
cagcaaactcacagcccccaccaccgaagctcccaaccccacccgaagcggcagccatggcccccaaggcagacaagaagccggccgcggngaacaaggtcgagaaggcgacggagaagacccccgcgggcaagaagcccaaggccgagaagcggctgccggcgggcaagacggcgtccaangaggccggcggcgagggcaagacccggggccgcacgaagggcatcaangcnaacaanggcgtggatacnttcaagatntacatcttcanggtgctnnaagcangtgnccctgacatcggnatctcctccaaggcatgntcatcatgaactccttnataancnacatncttccanaanctccccggggaattctcccaagcttngccncctcnaccangaacctanatcactcccggganatncantctncggttgcntngnctctccggggactnncaacnaacctctccctggcaacanggcntctgnattacctcncccgcaangncatnctccnttttcnaaattcngctgtcctatttccntntaaaccta

SEQ ID NO: 87447 - DNA, 248 bp, Triticum aestivum
  unsure (1)..(248): unsure at all n locations
  Clone ID: PAT_TA_87447
gagtttttttttttttttttttttttttaaaaanaatcatcatccnangcatacngaagtattttgttggcgtacaaanaacannatgntaccangcaagtgcaacgaaaacatanangncaggccctacacactggtcaaatgaatggcantagaaanaacantctgcaggcacgaacctanggcttcagnagtaagtcaananccgaacaagagctanancaactctcatcataccaaccatctta

SEQ ID NO: 87448 - DNA, 430 bp, Triticum aestivum
  unsure (1)..(430): unsure at all n locations
  Clone ID: PAT_TA_87448
ccagaagccccgacgctcaagcccccagacgccgcagcgccgccactccacccgcagcggcaaccatggcggtcggcaagaacaagcgcatctccaaggggaggaagggtancaanaagaaggccgtcgatccgttcaccaagaagnagtggtatgacatcaaggcgccgctgctgttcancanccgcaacgtcggcangaccctcgtgtccagnacacatggtancaatattgcctnatagggtctgaancacagggtgttcgaantatctctagctgatcttcacaacnatgaggacnangcctacangaanatcacactccgtgctgangatgtgcatggnatnaatgtcctcacaaaacttctgnggcatggancttcacattganaagctcaggtctcttttacgaatngtatacatnattnatg

SEQ ID NO: 87449 - DNA, 248 bp, Triticum aestivum
  unsure (1)..(248): unsure at all n locations
  Clone ID: PAT_TA_87449
ggtacncctgcancngaagcncagatggncaangatgttgtgncattcttgtcgtgggctgctgannctgaaatggaagagaggaaactgangggtgtcaantggntcttcctactgtcacntgctcttctccaagccgcanacnaccgtcgcatgangtggtcngtcctcaantcncncaagctggncctggatgtcntcaantgatgaccattgattcttctttntattgcaacgttgaggcttta

SEQ ID NO: 87450 - DNA, 410 bp, Triticum aestivum
  unsure (1)..(410): unsure at all n locations
  Clone ID: PAT_TA_87450
cagacaccagtcttcttctttctttggaaaaccttttgtggcgtgatttgtttaggcgtgaggtctgccaatcagttaagcaaaaataagtttatgttcaatcatggagtacgtagtatttggcgccccatcgaaagcacgctgcatgcgcttcttcaagatcaaggaggccaccgatcggctgcttcatgcacccagcaagtctccattcagttaactttttttaagaaaaggttcactggaatgngagacttgctgtgctgtctcatgcacgacaataccaatgagggtcctgctcaacttcctgggagggtcagtaagcgtttcccttctttttttccctttttccttttttttggtgataaagcgttccttttttcaacaangacaaaagacttcattttcattga

SEQ ID NO: 87451 - DNA, 263 bp, Triticum aestivum
  unsure (1)..(263): unsure at all n locations
  Clone ID: PAT_TA_87451
gagctttggtgcaccgtcgcgccggcgcaggagctggtgctggacgcaggcgagggccctctatacaggccctactcctacggcgaatttctcggtgtgtacgtcgccgaggctggggacagggacgccgtcatggcgcatttcaagcactgatcacttgtcggcttaattttctgtacacgcatgttttttggataatactgtaattcttcttgtattacgcaaagaattttaagggttacaaataanaaaagaanaaaaaa

SEQ ID NO: 87452 - DNA, 410 bp, Triticum aestivum
  unsure (1)..(410): unsure at all n locations
  Clone ID: PAT_TA_87452
ctcggatgactaactacacccaaggcttctgttccctatgtatgtgaaataaaaaagggcgtgtgagacatcactcagtcacttggtaacgatgaagaagaagtgaggctggaatcatggaattgaattatcaagcagattttaactgttggcgtcagtagcagcgaggaagaggatgatgctgcctgctgctttgtaatatacgtatatagcaagagagtgctgtcttcttgtcttcngtgggtgcatttattttctttacagaatgggaccgggacaatgagaattatgcttggcaagatactganactantgaacccagctncataagaaccttgcacggagatgcaatgcatacangttaggngtcatgggactcaaantcccaagtactgaattttcnactgatt

SEQ ID NO: 87453 - DNA, 319 bp, Triticum aestivum
  unsure (1)..(319): unsure at all n locations
  Clone ID: PAT_TA_87453
ccctcctctgcgctcgccctcgacctcctcgtctatggacgagctgtgaccatggcaggggaacggagccctccacttcttcggccggcgcggatctcaacctccccggcgacgcgtgcgctgcaagggccagttgcccagtttgtcattgtaaattagagtgttttttcagaagttgaaatagagtagttttttgattgataagtaagtgatgatcaatatactgtgtaaatagactagttctatcttgtaaaatctgttctttagtcattgattcttatactgttaanaanaaangacaaaaaacccnngggggggg

SEQ ID NO: 87454 - DNA, 389 bp, Triticum aestivum
  unsure (1)..(389): unsure at all n locations
  Clone ID: PAT_TA_87454
atggaactcccaacgtcatcaaaaagagttgcgccatcgaaggactctgtgtctgctccagtgacttgcattgtgctccggagcagggctacttatgcaagccagggaaggtgtacaaggaggctcgagtctgctcgttcatcacagattattagaggtgactcgcgctttgccacgttaagtcttttttatgcagcctgtcagttgcttcattattgttgtttcacctgagttggactagcttttaattacatcaatgatttgtttttgattcacttttatctgatgaatgtggaagcagtatgttatgtgtgaggtggagtaagtcttatatgtgtggttgtgcattctatttttaacacagaanacaacatatgtgtgccanaaaa

SEQ ID NO: 87455 - DNA, 443 bp, Triticum aestivum
  unsure (1)..(443): unsure at all n locations
  Clone ID: PAT_TA_87455
gtgacacgacaatacggtcgggtcattactcaaactgttttcccacaaccagccctagtgcatattgcgaggcggtttcctcggcacgtcttgtcaaagcagagatcatgtccccttatcacgggattcccatcaatacgggtatgggtaacccaaccatgcaatcaatcgtggcgcttgggaaataagcgattctcaacaggaaagtggggatgcncaccgttcttgtcgcctctataangggataaggattcccattttcacccacgccttcttcctcctctggcttatccattctcacaccctcggagctcccagcgccctaattcacgctttcctccngcatagccaaacatgttccaagagcaaggatgcatgtgggtggctccancgtggaaggaggagcatatgccaactccgggcggccngtactnggncgaaga

SEQ ID NO: 87456 - DNA, 261 bp, Triticum aestivum
  unsure (1)..(261): unsure at all n locations
  Clone ID: PAT_TA_87456
gtcgaaacaagacgtggtgaccgcccaactatcagaattgtgttgtccaatttagtcagcttgaccgcatcacatgttgtgatgtcttgacaaatgcaggtgaagatacacgaaggggcagccctcctgcaatggagcactatatagtatgtacaatgacgaagtttgttaggtattgtaaaccatatgatatatatgcgtgcgatcttcttgctcaacaatttgattgacccaatattggggtgtgcgttcatgaaanaa

SEQ ID NO: 87457 - DNA, 654 bp, Triticum aestivum
  unsure (1)..(654): unsure at all n locations
  Clone ID: PAT_TA_87457
gattcactagatatgctcatttcattccattgtcacacccctatacagtaatgagtgtggctcaagcttttgtagacaatatcatcaggttgcatggaccacctaaacttatcatttatgacagagacagaatttttactagcaagctatggaaggatatctttactgcactcaagagtgaattgaggtacaacactacttaccatcctcaaacagatggccaaacagagagggtaaatcagtgtgtgggaaacttatctaaggtgcatgactactgatcaaccaaagaaatgggctcttgggatttccctagctgaatcctgggtataacactacttatcatactgctcctggaagatgtctcccttccaagctttaatatggttttccccaaccactaatttcctgaacttgctatacctgggcctggaggatgaagaacacactccttccttagcaagagaaacaaaatanttgggaaaactccaagacaanttgcaacaantcangacangatgaaaagtagcagacatgaaacaatgaaagatgttgcagtaggaatatgngttctaaatggtcctaacgactggnacattggttcgggngcctgaacncaaacaagtttanggcantngattncagaagtagnagggg

SEQ ID NO: 87458 - DNA, 640 bp, Triticum aestivum
  unsure (1)..(640): unsure at all n locations
  Clone ID: PAT_TA_87458
ctcaactgtatcaagagtacgggggacatcatcaaactaaatgtgtgatgaacatggaggtgtcgtacattcggtgcttgattggttggattgcgaagaagttcgactacataaaccgcgttactcaactcttccgctttcagtctacgagggtacatggacatactctcccctctcgttgctatgcatctcctagatatatcttgcatgatcataggaaaattttgaaattactgcgttccccaacaatatagacatcatttcttacatatttcgatgctcgttcaacttcgacccaaccaatactacgggtctgtctcactttctcacgattgagtcaactgcatttgaatatgatgggctcacacttgttaancacaatattgcagctcataaattcttcaatggtccatantagnatgtcatctgtcctanacaatagacccactaatgattgactttgatgggctccaacagtgttacagntggagtataccaatcagtctaccttaatgctggatcgtatcaaactttggtaatcctantcgcgcatanaactctgatatncacanntatngatatgnagtatacnaacatgcggaatagaacttgagtttntaatagaattcttccaggggng

SEQ ID NO: 87459 - DNA, 217 bp, Triticum aestivum
  Clone ID: PAT_TA_87459
ggacacaggacgcgagctgtagggcgagactcttgggcaactcgcctggagccagagttgattaatcacatgaatatttggggccgagtatataaaaatatgctgccaagggctagttgtgttggtctcgattttcttttttactcccttcgtccggaaatacttgtcagataaatgaatgtatgtagacatattttataattctaaaaaaaaaaaa

SEQ ID NO: 87460 - DNA, 590 bp, Triticum aestivum
  unsure (1)..(590): unsure at all n locations
  Clone ID: PAT_TA_87460
ggaccatagtgctgcgggtgccacgtagaactgccaggttggtcaggacggggtggcctggttgtcggctgatgtgctagacgtggacgtggttgatgtcggtgcatggagtgacgcggctgctcctgctggtgctgaacaacatcggttctccgggtgcacgtgatagcctcgtacacagtccgtatcttattctgaattctttccaagaagggctataccactggacgatgatgaagaagaggtccagacgatagtgatcgtccaaaggtggtcacgtcgtcgtagagtttgcntgtcaaggtancctgcaaatttccatgacgattaataatgtctgtctcttgcacgtcgaaagtatgtgacaacattacgtaaagaaaatatatcctaccgcgtactgcctanagcccgaagtatcatagccgggtacatatcnacagagtaggatccggtatccctctgggtgggagtactcaacatgctaacgtttccggtcattacgaccaatngagattgatcaccanatcaaatgnatccctgcaaaatttgttgactcaananggctgctcnttaggtgcaaatacccg

SEQ ID NO: 87461 - DNA, 606 bp, Triticum aestivum
  unsure (1)..(606): unsure at all n locations
  Clone ID: PAT_TA_87461
ccacaggcctgtatacagcattttcacggcagaggttaaactgccgagccaggcccaattcggcagcttcacccggtccagctccctaatgggggtggatgaactgccatacccaacttatccacgcagttacacagatatcaacttttactgattgtgcatccccatggagccaagacattctttcttcggtgccagagtaggggcagtagcttcattcctcccaagattccagcaactgtaatatttccaggcaacagattgcagatactcaagaagatgccatctaattctagatttttaggaagatttgcaccgtccgtccgttctgcacagtgttgattgattctaaccgtcatccctgngcgggcacacatttatttcaaaccagaatccagaatgcangactgctctggtcgtgatttaagctagtanatanggtaggagtcactgacagcgaagctaatttgtggcntgccgtttggattcctttccggagtggttgtatcggaaggaatgctgtttctttccttcnttttccatattctggncccnagtacaaagcnttgcnggtncgtcggcancatcattttgcanttnaaagac

SEQ ID NO: 87462 - DNA, 630 bp, Triticum aestivum
  unsure (1)..(630): unsure at all n locations
  Clone ID: PAT_TA_87462
gaactaggtagctacaccaataatggaggcggaggcagcgagtggtagcgccggcgagagcagttggtccaaggtgggaacatcgcttcccgtcacgagcgtgcaggctctggtggcgtccgccggcgagctgacggtcgacaagatcggacggtatatccagccggacatcgacgcgcacgccgttctccccgagctgtccgacgaggtccggtgatccgacctcagcaagtcttngagcgccgatcaagctgaagctgaagccgccaactcaagnttgcctgtgcgnattggggttctttcaaggttgttaaacaatgggataccggatgaatccataacgggtatnaagaagcatcaaatttctttcaatcccctcaaattaagaatgatatccaacnctaggatnttcaagggtatgcnattttgttnccccgaagatcaaaaactanaaggggganagttgcctctcatcaacaaccaacncgtgatataatacgggcaagtaacccatacttcaggaatgtntgaaatanctaaagtgtgaattaaattcnctgcactatnaaaacaaaattntcnaattggaaaaatttgccaatttanggaaaaacccaagngtanccaagg

SEQ ID NO: 87463 - DNA, 287 bp, Triticum aestivum
  unsure (1)..(287): unsure at all n locations
  Clone ID: PAT_TA_87463
ggcaacggnatcannccggcnaggtcgctgggcgccgncatnatctacaanaataagcaggcgtgggacgacnattggatcttctgggttggcncgttcatcngcgcgannctggtggccatctaccacgtgntggtgatccnggagatccccttnaagagacgtgactagtccaccaatcaatctgccgactgtggatanacntcttcttgtttcngttggattttctccttgcncttgaaatgtatttnccancatatancttattttctnatttnganacgctt

SEQ ID NO: 87464 - DNA, 318 bp, Triticum aestivum
  unsure (1)..(318): unsure at all n locations
  Clone ID: PAT_TA_87464
gagttcatcaagattcttgttggtggagttcaagtatctttcttctcgcgtctcgaagtgtaattaattctccatattcttttcaagtggagttttccatttcttcgttcttctaagctaaccaatcatttccgtttgaggccgattatcaccttatgatcttgagatgttacctataggaccanaactagcttattcttttcgttgttgattttttcaacaactccgttcgaaccttccttctaaanatgctttcantttcattcgtggcacaagtgtcattttcttctccgttcttttcattcaacacntcanttc

SEQ ID NO: 87465 - DNA, 311 bp, Triticum aestivum
  unsure (1)..(311): unsure at all n locations
  Clone ID: PAT_TA_87465
gcgacgctanatccgcancgggaggggatgaagccgacnngacgctcgcgtgaccggcggtcgatgggatccagcggccgcgagccangcgacgcgcgcgaggnaaccgncagaggatcnagtcnacncatgccgngcgagggatccagtgctcnagggatccaancaacgcttgcctgcctgagtgcctgaccgcttgcancgcgcactaangacaatcccctcgaggagacaggagtacccggtcttgccttnatcnganctccttgggnccntactcnactttctggnccaacgancgatttttgcta

SEQ ID NO: 87466 - DNA, 643 bp, Triticum aestivum
  unsure (1)..(643): unsure at all n locations
  Clone ID: PAT_TA_87466
atttgcttcgatgactccatttctcattgggtcagtggtgctggactccactcagggagtcctgtcaggggtttcaagaggctgtggttggcagcacctgggtagcatggaccaacttggtggccttctacataataggcttgccattgtctctcctacttgggattcaaacttggctttcatactaagggattatggatgggccaagatatgcggctcctttgccagaacgctntctcctgttcatcacctcccgaacaaagtgggaaaagattggnactgggcgacaaacacaaagagggtgaccttatccgtttggaaatttataaacttgttagtttaacttnnaacatggggctgaagttttagaatcaatggttgtaangtanacantaccaacacataccctgaaanctgggtgttactagtacaantaggaaagctgaataaatgcccccattttgtgtganaanaaggggggcccgtaccaatcgcccatatgagnctataccncnccacggcgtcgtttaaantctgacggaaaacctgcgtaccactaacccttganaanccccttccacgggtaaacaaggccccactttccctccaaattccccctaagnaagngccccctntcggaatn

SEQ ID NO: 87467 - DNA, 540 bp, Triticum aestivum
  unsure (1)..(540): unsure at all n locations
  Clone ID: PAT_TA_87467
actggttctcagtgcttacaagtcgttgctagtgccttcgctcagaatcccagtgcattatgagagctctttgcttattcgttttgttcacatccatggtgaagagaaagatcctgttggactcgattggagtgcaattgaacagtcgattcgggatggagatctgcccttcgatgggcagagcttgaagtttgatttgcacagtgtcaagtactctgagtgctcaatttgctcatttgcaattgcccgctcaacacactcattcacatccaggtcttgtttgagaattacacgatgatagtcagcgagtacttgggactcccaagcggatgaagcaagtgctgtcagaccatccggatgagatgcacangtggctgggatcaaggatgacaatgacnagacaaggtgtgcaattaaagtttttgattggatttcnacaactctggtggtanatagtacaacaagcgggggttccctgaaanggggttgcgttagnaaaaggacccaaacgncattgctaancgtaatgccggatgtata

SEQ ID NO: 87468 - DNA, 494 bp, Triticum aestivum
  unsure (1)..(494): unsure at all n locations
  Clone ID: PAT_TA_87468
gtgttcacggccggggagcacagcgggagcacgctggccatgctggggcctgttctgagcttcacgggtgccatcgagcgcgccgtggtgggcggcaccggcgcgttcaggatggcgcgtgggtactgcgtcatgatggccgcgggcaaccccacgcctgactccatcgtctacgaggtcgacctattcgtgaagatggattatgcctgatcatttccctcttctcgtaacctgtatcgatcattatcgtgtactaccatgcatgctgtagagtgttgtacanggaagaatagcatttgccagtgcgcancccattgcacatcgttcangagaaagggctcagtctctttccgatctgagcccatctgccgcttttttttgatgctcanaanaaaanantgccgcttttttcgcttttttttccccatttangccctatacttatnttgtatcctgtacaagcntaattgncatcttcagtgtnntgtgttaat

SEQ ID NO: 87469 - DNA, 535 bp, Triticum aestivum
  unsure (1)..(535): unsure at all n locations
  Clone ID: PAT_TA_87469
atcccccattccccgcttgccaaatctaggagttgtattactaggtaataaggattgggatcgcttcttcctgcttgcccatgatttgtgttacagattgatatggattttgattgcaggtgtgcaaaattgttgctacgtcatggatctagtagcacatggatctatcacttttgctcttggtcttgtgttctccagtgcgtgatgaatttgtatgatgcgggtgctattcaactattcttccatttattctgtttcttgcttctgatttgatctttctaaacttgcctactttcaaggatgatgatgaaatggaggctggacgacgtctgccacacgagttaacatgccaggctcctgacttactttagttcatgtcttcatgaccagcaagttgtcctggttcctgcatanattgtaattttgtnggcagaattgtacaagaactttccggatgtccaccatactttgcanaattttgacgaaggacttgtagtttaacaaaacctgtttacagagtanacacccgaaaaaa

SEQ ID NO: 87470 - DNA, 656 bp, Triticum aestivum
  unsure (1)..(656): unsure at all n locations
  Clone ID: PAT_TA_87470
agcagctccagctgcggacatccatcgccgggtgccttatggtctccgacaacctggaaggatcctcacgccccctccatggcagtggcaccatcgccacgtccggcgaagccggtgcccgctgggtcacgtcggcggcggtgagggagaaccaggcgctcagggccggcatggacagcatgcggctgcggctggcggagctggagagggagtgctctggcatgcggcaggacatccggaagctcggcggtgccgcggggaaggacgggtgggcggcgcgggtccagcggatgttcagcctgaagatgaagctgcagatgtgcagcaccgaggangggaagatgaacgaccggcacangancgccagcgccaagctggtaagctgcangccaaggtgtccagtcacaagaagcactcancattgatgcatgagctctgaagcttttacctgcctggaactcctttggnttcatggtttcctgcggaagcttaaggctgatntgcagtggaanagttctcaggtgnaatgtcatgataattcgaancatgtatgtttggtggacaacgtgcaatggacancaattattttncattntactntactggcagatgacaggccggttccgaatgtnnttagatcaaanctttgttcnttt

SEQ ID NO: 87471 - DNA, 336 bp, Triticum aestivum
  unsure (1)..(336): unsure at all n locations
  Clone ID: PAT_TA_87471
gatccgttggcctcctgttcatccgctcccccctcccgccgccgcctccagcctagggtttcctcccgccgtccgccacacccgccgccatggctcgccgcagcggaggaggaagatcttcccgccctgctccacgtgctgctccagtgagaaacccaccagcgccagcccgtcaagctcctccacctgctactacccaagagcagcggtggtgggtatcatgangcggatttggnccnacnatggctcaagggnatggttttgggaacngaattnctntgngccaaaagggtttnacnctnaaaagggncccccttcaattaaacananactttt

SEQ ID NO: 87472 - DNA, 243 bp, Triticum aestivum
  Clone ID: PAT_TA_87472
ggcatgcgctcctgaagcgggaagctccagcctatgtggtaggaatgtgtcgtagttttgggttctccacttagataccacaaaatacctagttgttctttttagtcagagaacggtgctttttttgtccagtttcctgctcatggagcacaatgttgcattttctaagtgaccatgtcaaatttttggtaacaatggcatggcgaaattatttcttttttgcaacacggcaaaaaaaaaaaa

SEQ ID NO: 87473 - DNA, 428 bp, Triticum aestivum
  unsure (1)..(428): unsure at all n locations
  Clone ID: PAT_TA_87473
gacctgcatcctctcgactaccagcaaaacatgaaggcgtccactcttgtgtccctgttcctcctcgcctgtctgatggtggtctcggctttggctgccgacggacccactgccggcgcgaccgacgacgacatgcagaccctcttcaggagcatcaacggcaacggcggcattttgggtgagcagcagatggcgggcattcgccaggcctgcagcggcaacaggggcctcaaggaactcgagatcaacctcgacatcaagctgggtgctgggtgaagatcaacgaccaatgggtaccgctccgtagaagaagaatttcaatccacagcatggcggagaagacaanctcgcctttcaacttctcccgttctcaacacaaaccgtacatacattaaatcgccgaagagtctcagggtaaaaaaaaaaaa

SEQ ID NO: 87474 - DNA, 436 bp, Triticum aestivum
  unsure (1)..(436): unsure at all n locations
  Clone ID: PAT_TA_87474
gcaccccaggaaggtaagttcaagaggcttttctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggatcagcacccctgggaaggaacaaattagaccaagtaccaagntctcaagtacccgctttaccactgatctgcgatgaagaagattgaagacaacaacaccttgtctcatgtcgacctcaaggcgacaagaagaaaataaaggtgctgtcaaagaaatgtatgacattcaagccaaagaagttaacacctcaatcaagccngatggcaagaagaagg

SEQ ID NO: 87475 - DNA, 226 bp, Triticum aestivum
  unsure (1)..(226): unsure at all n locations
  Clone ID: PAT_TA_87475
acgctcggagtgaagaccgacggcgtcccgtagntcctgccgcgcgacattagaagcggactcgtggtgcttcaggggagctggaaattggaatgccggtgccgaanagtgtgcctttgatcaactagttgttcttgtgtggcatcaccganacaagtcttggttttgttttaagttattatatcncatagttattcatttgattgggtactagaaaaaaaaaaaa

SEQ ID NO: 87476 - DNA, 595 bp, Triticum aestivum
  unsure (1)..(595): unsure at all n locations
  Clone ID: PAT_TA_87476
gtaaaggtcacctgttcgctctgctttgagtttgcttcgcccatgctcaccttgctctccaagtcattttgcaagatatacacagccagtcctcacagtatccgcaccgaagactttgagatttcactctatggtctgtttcggagggcggtcgaaggtgatttggccggcctttggtggctaccagccggaagcttggaatcagccgaaacagctgctgtgaatgcgattgggcaagatctgcgatgtgatgaagtcgctccatgttgacccgttgaagttcttttcctggtgattctcctgatatggggcttgcaagacgacaccaaagtgttcctaatggattttgggtgggacaactgctgggcaacaatcaaagggacaacccntccaaattttcaaggtacgaagccaannaaggggtgcttttcatttgaanacaacgggaacaatgcaactccttgggcacaanagggcnaaactggggtacggaaagttcccatgatcaagnaaacnggttacaaacnaanacnggttgtangccnttccggaatcaananggcgnaantnaaaatccgaacctnattnnaacagn

SEQ ID NO: 87477 - DNA, 615 bp, Triticum aestivum
  unsure (1)..(615): unsure at all n locations
  Clone ID: PAT_TA_87477
gcgccgcggctcaacgctcaccagcgtgccgccgccggtgatcgcgtacgcttttctcacaggattactgatttgatctcacttgcgccccgtcgacgtttttgtctgaaggtgtattctagtgcggagtgcggagctgaaaagacagcgttggcctagcagctatagtcattttcaagcggcaagtggataaaacaccctccgatcttgtgcaagatcgcgctgcacaagcttgtgggttgcgggggagcattattgcctgcttgctccttttgggctgcctgcctaaccggcgtttttcccggtaaggggggnaacctcctcaactggggcaacaagaattgcnccgaaatncctaacacgggaattnggatgaagccgtgtnaacaaaactgaaggtaactccccctaaagggaaaangatgatattataaactgggcatgcaacgatcacaagattaagnaacgacancattaaagatggnagagttacaaggngtgttccaatgcaacaaaatncaattgcttccttcaantntgttccatgnccctntccnctcctngcaagttttcggtnnaaaaaatganagttccgaaacttccaaaaaaaaaaaa

SEQ ID NO: 87478 - DNA, 351 bp, Triticum aestivum
  unsure (1)..(351): unsure at all n locations
  Clone ID: PAT_TA_87478
ctcctctctagcatttgcatcgtctgggttgtggcacatccaatgctttcctccctgcaggcacgatttttctctacactgcttgctcngtgccccgtggatgtctctgtactcgttgttctggtctgcgaagtacctccggcggcttggtcttgtttgctttgtactggcaattttgcactttggtctgttgaagtgtgatctcacttgtaatctttcagtttttctccaagctttgccttgtaataatcagcaccatggtatcctaaccggttgatgggcttcattaatttgaagtcgggctttatgccttcaaccnaaaaaaattaanaatgnaaaannaaggggggg

SEQ ID NO: 87479 - DNA, 349 bp, Triticum aestivum
  unsure (1)..(349): unsure at all n locations
  Clone ID: PAT_TA_87479
ctacgaggagacccgcggcgtgctcaagatcttcctcgagaacgtcatccgcgacgccgtcacctacacggagcacgcccgccgcaagaccgtcaccgccatggacgtcgtctacgcgctcaagcgccagggccgcaccctctacggcttcggcggctaggctcttcctcgccaccccactgcaaattccnaaanntttgttganaccgcaacttgtgtaagttcgctagtctcctgtanttncgcnatttccccggtatttcgtactgaatccttggancaaaanttattcncaatttgttagaaatcaaacatgtctcctgaaaataccttggtcaaaaaaaaaaaa

SEQ ID NO: 87480 - DNA, 621 bp, Triticum aestivum
  unsure (1)..(621): unsure at all n locations
  Clone ID: PAT_TA_87480
ccanagtcgtgcacacatccatcatctatgtagcactttcgttccggtttatagggctcatctaaaaaattcgttttcccgttttanaagtctcaattctactagtagtagtagtaccatcacatgttggattttgaggtgcgttaaatcacccgatgcaagcagtgtcaagagaaaactcaccaatgcatgtagaagttcatggnaatttagtggtcatgcatgcactcgttctaattaatgcctcggtaaacataacttcttgagaaaaacaagcatactaattacttgtgcaactatgaaattaattccaccacttaccgtctaccttggttggagagattttgaaattgagccatanactggaaaggagggagtagtaatttttgtctcgattacnattatggccctggtatagatgcaaaatgtattttacaangggcctgtccaantaaatggngagactacnaatggaatatatccaacaatgtgaaancccccaacaaggtaggacnagattaacgagganataaattcccttgccaacaacacccgnccttgcanggacggcntangggtcnatacaagttaccaantgnagcacgaanccccaagtttatn

SEQ ID NO: 87481 - DNA, 634 bp, Triticum aestivum
  unsure (1)..(634): unsure at all n locations
  Clone ID: PAT_TA_87481
ctgtgatcctgcgagcactgggatacacaagggaaacacagatatatgttgcatcagggcaagtgtacggtggcaaaaacaggatggctcccctcagaaacatgttccccaacttggtgaccaaggaggagttggcgagcacggcggagatggagcacttccggaagcacgtgacgagcctggcggcgctggacttcctggtgtgcctcaagtcggacgtgttcgtgatgacgcacggcggcaacttcgccaagctcatcatgggggcgcggcgctacagcgggcgccaccggctcaagtccatcaagcccgacaaggggctcatgtccaaatccctcggcgacccgtacctgggcctgggcctccttcaccgangacttcgtcatctcgcaacaangcccgcggcggctccccgaaccaacttccccggctacgactctgggagaacccctcacccctgcatgtgcaaagcatgagacagacaganaacggcagacaatgacagcatgcaactagtatacgctttcgtgattcccctgatttgttanacgaactactactacataagtgcccgcggcttgcnaccaattttggtgngnatacaaatcatanggtcacganaatgggntccccg

SEQ ID NO: 87482 - DNA, 655 bp, Triticum aestivum
  unsure (1)..(655): unsure at all n locations
  Clone ID: PAT_TA_87482
tgctcatggagacatcaatagcagagtcaacggacttcctccctgaggtgcaaaccttgtccaaagttcatcataagaatctcgtgactttaaaaggatattgccagaacaagaagtgcctagcactcgtttatgacttcatgcctggtggaaatcttcaacaacttctaagaggaggagacatatgtagtttgaattgggaacaacgacttcatattgcacttgatgctgcacaaggattaagagtatctacatgagttatgcacaccgtcaataagtgcacaagagatgttgaagaccccaaacattcttctgggacaagaacctggtggggaataatatcngatttggggtttcgccggntttttaacgatgctcacacacacatatcaactgttgctgctgggatcctgggtactcgacctgatacaagcaactttcaaccaacgtcaagacagngttanacttgggatctcctctgggggatancacggcaaccccaatattgatggactcaaacgccactacgatgggtgcccaaattactaaggaacatcacatatgtnacaaaggngtggttagnagagnaatccttaaatgctnanatgcttacgntcaaagntcacacgcgcanncagtttaggcaagtggacgg

SEQ ID NO: 87483 - DNA, 511 bp, Triticum aestivum
  unsure (1)..(511): unsure at all n locations
  Clone ID: PAT_TA_87483
ctgtctgccgccgccagtcctctctggcctcctctgctgtatccttctcaacctccgacttactactcctgtgtcgtgatttgaatgggaaattggaggctggccgtgtgcttctccaacaaaaattgatggagtgcctgacccggatttgattggctgctataagaaaagggttctcggccggaatctccatcanagaacgaagcgccgagttcnccggaggaacangaacgtctgtcnagccgtgcattgtctgctgtgggtggctacacnagaggccctcaagatgagtgatcaacatctgtcgagccgtccaatattgcatatggcagctacaccagaagcatggatcccttcatanaattgcatatctgntgtcccntagactcacgtcatcgtctctgccatttcnccgcaagacatccgccatcgcttngcngacttgccggnaacatcaatgtnccanaccactttggtaagnactaacggttaantgatncacacatcagat

SEQ ID NO: 87484 - DNA, 587 bp, Triticum aestivum
  unsure (1)..(587): unsure at all n locations
  Clone ID: PAT_TA_87484
ggatcgcctccgccgatctccgggagacgccgtcaccgccgccgtgtctccagggcagggtggtttcaattccggccgcctggatcgccctcgccgaaccaggttgggacgaatcgactgctgttggatttattaacttgcagttgcaagtgtgctaaacctctcgtcctctggcaacgaacgttgcctcccgctagggtatgcgggcgacggtcgttactcaagcgccagtaggttgccccgtccaccaattggatgatggcaggatccctctcctttgattttttaatttgttttaatcaaaacgggtgcactgttgttgacgaccccgtgctgactttggcaacgccctgatcttttttcaactcacttngaactctgcaattaaggatcacatgatgggattggcggagggctcaataaccaatgggacaatggtacactttaatgaacatggttcaataagcangtncacggtanatgtggctccaaggcataggctgaacaacaanatgggcntgaaacgtccactacatgatgncgtctcangtaggtcctaaatacacgaagatagtnttnaaaaaaaa

SEQ ID NO: 87485 - DNA, 564 bp, Triticum aestivum
  unsure (1)..(564): unsure at all n locations
  Clone ID: PAT_TA_87485
ctggtaacttaccctacatttcggacaagcgcgtccctaagcttggctccccctcccccttcacccccnccccccgttcgtacaccgaggccgccaaaacccgtgaaaccccatgctcctccgtcggcctcccgaccgtcgcctagccggagactcttccccgactacgtcgtccaccgcaacagctcgccgtccctcatccaccacaccggatgaggatccgttgtcgatctcatcgtcccgccggatcagccaccccgtcctccacctccaaggagctgccccgacgttcgcctcgtctatcgcgccaccgcaatcnccacagcgccgtcttgacctgccccaccggaancgcggaccgtcacaatcctgcgatgaancaaggcaactcggtgcaacaaagagttctgcactcacactacatttaactttaatccattcangggctctggtgctcataccgagnaacatggnggtctcatcganggacntcgggggcaaatcattangngtnctcccaangnnttgctcncggggnnactcaaacggaacagngaacgncaa

SEQ ID NO: 87486 - DNA, 577 bp, Triticum aestivum
  unsure (1)..(577): unsure at all n locations
  Clone ID: PAT_TA_87486
tggagattcaatctaatgtcacatcctacaaccaaaaaagactatgctccagttttaactcttaccacttatttttatttcatgtagctacttgttcatgtctttaatttaggttatttgcttctgccctccctgtgattgcaggtttaatttaagcccagaccatgctggcagtgagtcagaatcagttatgttctcaagtgtttctcttgcccacagatacatttattcattttccgctgacctgctatgttctattgtaattcaagttccgaatgtttaatttgtaaccctgctttggtgctgtccctaatcaaattgcgccggcacaaaagctccnaatttaacggctggtaacgcaacaataaganacgcaagnggcacgcaactaacccanatggaacgtagcctgttgnacctcccangcattacaaccaactaacaaaccaancanataaccggataatgnngaaaaacttggtaaagaatacgggcgtccaacgtctaatgnaagagaccngcggcaaggtcaagctccaanacaaaanggtggccncnctgttaggcaggggtacat

SEQ ID NO: 87487 - DNA, 654 bp, Triticum aestivum
  unsure (1)..(654): unsure at all n locations
  Clone ID: PAT_TA_87487
tcattttgtatcggaacaaacagcaagcggtggactgcgcatctcagaaaataaaccagatgtagtgcgtctaacatttgctccaggtgctgtgccagcactccgacgcctccgtctttacttgaacccgatggagatggcgtccgacttttttgtagacttgggtgtccagcatctttcaggccttgcacagctcgagttcaaaatcaattgtaacagagcagctcgaggcagggtggaggccttgggagtcttccgtttgaaaaagcaatcaacctgcaccccaactgtgaaaccatgtccgcaagatccctgaactcgcatgtttaaggatgaaaaggagtggcaagaggcgtctcaatgggaaagaagganttggaagatcattggcccggagaatgagaacgggcaacaagacaactgctaaccttgtatcaaaaatatccgtccgnggntcaaattaaccatcatatggagggagantacacgtgtccatccatccacactacgcaatctnaatcaatgggtggcacaacattgatcatggtatnanagagttatcgcatccccatctacgggtttgcttanaanaanatatgtggngtggananccgattcattacgcgaggaaaaccgtatgtcctagntanacga

SEQ ID NO: 87488 - DNA, 586 bp, Triticum aestivum
  unsure (1)..(586): unsure at all n locations
  Clone ID: PAT_TA_87488
cgcagctcctcgatttccccgccgtctcgcatcagctgcgcatccgcatcgcccacgaaacagggcagcacagccaccccagcgcctgcccgcaccagatccagcaaggccgtcggtctgttgaccgtcacgaccagacggtcggacctttgctcgtgcggccatcgcaagtagttcgagatcgcctgctcctgcgacacggcaatccagcgatctgaaaccgaggccgccgcattccgcagcctgtagggcgcgtaggcaacatcgccggttttgatcgcagcgagattgcgttcctccggctcgaacgcacggatgccgatatcgtgctcgcgatgggcagtgccgctctttgttccgcgataaacagtcgacgcgaaaacgtctcgctccgtgcagtttgccgcgaatccgccgtcaagaagcacgcatccatttccaagcgcgataccacaagagaagaaccgcagacgattttgcaattctcnactctttcgcggatctcatgcctgaagnattnacaggcctgcctccggggtaanaaagacaaatctgaaacccaagatcggtaaatgataagggaaaa

SEQ ID NO: 87489 - DNA, 251 bp, Triticum aestivum
  Clone ID: PAT_TA_87489
gtggagcggctcgcgggtgaggaagggctcgccgtcggcgaggggtacttcacggatttctcccaggagaagatcgtcgagctctacatggagaaatcagctcaggctgaggcttaatttaatctcaaggtcaagtgaaatcggctcttgtttgttgaaatataatcctaaccgatcaagaatgagtacttaacattcttcatgtgaagcaaatgcattgtactctatgcattttccacaaaaaaaaaaaa

SEQ ID NO: 87490 - DNA, 390 bp, Triticum aestivum
  unsure (1)..(390): unsure at all n locations
  Clone ID: PAT_TA_87490
ctgaactgtatagaacatgggtgatggttttacaacatccacaacaacaacatccaacaatgagaatttggttggtataaccggctagtatcactcttacagtctacaattaaaacaatggcaagccttacaagctgatagggttgcaacccttatctgtcgccccattcagccgcctgattgctgttttgctgcggtaacaccacatctcaaacgcctcggtgaggtcagggtatctgaacttgtctgctttctgcatccagtccaacaggatatccgactggtcacctgaagcaatgctaaatcaatgaaacaatgcgcncctcnaagttccnggnacaacccgctcaatctgaggaaatgcccctcnttcnccttggaatcaaggaa

SEQ ID NO: 87491 - DNA, 368 bp, Triticum aestivum
  unsure (1)..(368): unsure at all n locations
  Clone ID: PAT_TA_87491
gcgccttcctcgccctcctcaagcaagcgagaagccaagtcacgaagatggcagggcagttgaaggccaagatcctcgccgcggccgccgtcgccgtggtcgtcgcctcgtcactggtcggcacggcctccgcggccgacgcgcccgccgtggcgcccacctccggcgccaccggcgccgccccggccttcgcggcgtgtcggtcncggtngcggcgttcagctacctcttcngctangcgtncgtccaatatngcgccggttggtgccgnggtgcgcgcgnagnatgccnatcctttccggggaatttcttgttgtggaatnnatnacctttccggtncaattccgtttccttggttcangnccttt

SEQ ID NO: 87492 - DNA, 424 bp, Triticum aestivum
  unsure (1)..(424): unsure at all n locations
  Clone ID: PAT_TA_87492
gctgaggcagtcggtggaggccatggcgcaggtcggggccgaggcggagcagggccactcgcaggagaggacggtgaggttccagatggacagcgtgcggacgtgggccagcgcggcgctcaccgacggcgacatgtgcatggaaagggttccggggcgangctgccggcggcggcggcgtcanggaagccgtgcgcggccacgtcgcgggcctcctgcacctcacgggcaacgcgctttgcatcgtcggcgccatggcaaccaaacggcgccgccatanccccgggaatatacatgccttgtgtgtttcgcttctctcccttttccttttcaattgcatgtgttataactcgaagtgtacatgttccggtttcccttgtatanccanacaatacttgcaaatncncgtgttaaaaaaaaaaaa

SEQ ID NO: 87493 - DNA, 208 bp, Triticum aestivum
  unsure (1)..(208): unsure at all n locations
  Clone ID: PAT_TA_87493
gttttttttttttttttttttattanccaaaancncatccggattgaaaactagtaccgataatacagcacggagttagcttaaagcatgtggcgctcgtgctcaatatactagtacaacaaaagaatcacccgcaataaaatatcaagcgtgacgtgtggaagagaagcatttccgccctatttcacttgtagtaatacaaaaagag

SEQ ID NO: 87494 - DNA, 452 bp, Triticum aestivum
  unsure (1)..(452): unsure at all n locations
  Clone ID: PAT_TA_87494
agctgttgttacatcgccaacttaatagatccaaagtggtcgggcccttccctggatcctgcgcaagcgggagctacatgcaccgggctgccctttttttttaaatcgcccacttggccatgtgatgcagacccacacatcatgcttgtgtcaaatgggcctgtattaagtgaactaaggtaatgcaactgatctgttgggataaagtaactgggactattgaccctaccgtggtagcaaagagggacaactttaatttaatggnattaatggcatttgatatccggtttcccaattgccacnaggttctgacaaggantacatccaatcaatgttcaacccnatttccttgccaaatgtccgggcgaacattttgataacatttgtgagtcaanacttnccttgnnaacgcgtccaattnntagagacataccgggaccgatcaatcatga

SEQ ID NO: 87495 - DNA, 639 bp, Triticum aestivum
  unsure (1)..(639): unsure at all n locations
  Clone ID: PAT_TA_87495
cgagagcgtcgtggacaccagcggcgagggcggctggccgaggcaagattcgtggcgtgatgccggcggcgttgatcatggaggtttgtggcgtggtgtcggctttgattgcggaggcactgtttaattccctcgaggtatcatcgttgggctctgtagcatcctgaacgggggagtctgccggcagaacatttgtgttcaaccgtagatctgattgcactatggtggatgtaacgtagacagttgggatgcaactaagtgggctgatcggacgtaggggttatcttgtgtgcactttatggggtggacgtaagagaatcatgtttgggcctttaatagtagtatagatagattagatccctantgtatanttttggatgtaatttttccaaatgcagcaccatttttaagaacagaatttctttcttttttaanagtgtgtaccgcacccattttgtatagaacaanaccatacctttttccaactttttaaaaaaggggggccggtacaatcgcctatatgatcnatacccgccacggcgtcnttacantctacggaaacctgcgtacactanccctgagaaaccccttccactgcnacacaaagccgacntgcctccaantncaccgaggaaggac

SEQ ID NO: 87496 - DNA, 581 bp, Triticum aestivum
  unsure (1)..(581): unsure at all n locations
  Clone ID: PAT_TA_87496
cggaggcggaggcggagacgccggcgtgcaaggactgccccacgtactgcagctcgaggtgcggccgcggcataccctccttggcgtcctcggagaactggtatgcatgcaagggcccgtgtggctcggcgccggactgcatggagacctgcaagtccacgggccccgcgcggtgcacgggccgctgcagacgctcatgtagccacgtcgactacgaggctacgtgcaggaaaaatgctgcctttcacgccagcagtgcgaacgaacagttaaacagcatcatccaatntgcactgccggctgcaccaccggtgcaacacaacctgcgtcaacacctgaacggaccgaccggccgataattgtttccttcgtcaaaataatccaaggatgcttgtatcatgcatcatgcatcatggctcactttgtgtcnactattgctgcttttgttcttgcaagaagattgctnccgcatattctcgtcaagtgataanactaatattcacaacagngggagaaacagnaataagtnattataatanacatgattatanngcatgattcgtttgatcaaaaaaaaaaaa

SEQ ID NO: 87497 - DNA, 409 bp, Triticum aestivum
  unsure (1)..(409): unsure at all n locations
  Clone ID: PAT_TA_87497
atcagggagttcatctgatgattcatcaactgattcatcagggagttcatctgatgattcatcaactgattcatcggatctcgacacggattatgatgagctaactgatgattcatcaactgattcatcagggagttcatctgatgatatggactgctctgaaggaacacccccccctgaagggaatgaaagccgtctgataatctttctataggttccccgaagagaatgggaaaaatcacagaaacactttctatatgttccgttattccnagattcgaagaagcaagcaatttttcatatagttgtttttgggtantgatctctgtcaaggggatnacnaggccactgatacccatgtggtangtgggatanaanatgggcatgtggcttctatcaanaggaaaaa

SEQ ID NO: 87498 - DNA, 600 bp, Triticum aestivum
  unsure (1)..(600): unsure at all n locations
  Clone ID: PAT_TA_87498
ggcacgctgtgcgcctaagtgcgaaaagacagtgcaagctttgttatgccgaaacctaaatgtaaagtcagcaacacttctaaatgccacttcttcccgccgcatccgtcttcaggacgatatagtcacaggttttcacttttcagtgagtgaaagatttgtatccgggtctacgttcaaagcttctaccatagacctaattcgagaaggcttgatagtcctaanaaaggtganggtggggggttctatttangaagaataagaagaatctcaatcatgtgttcatgctaacannaagacgggttcnatacacatnagacttttttcaaggaattccctaaggtacggatgattgggatgtcancccncaaantaagtgcnaaggctccctacgagggantccaccacaagatnatttnagccgggagcaancccaaacctcaatttaggtttctncaaacncacncaaanaaaaacccaggggggccgtccaatnccaaacggagntntanccccacggnntcnttaaagtnctgantggaaacctgggtnncanttacctggnaaaaccnttcgangggctatgcaagnncccttcct

SEQ ID NO: 87499 - DNA, 565 bp, Triticum aestivum
  unsure (1)..(565): unsure at all n locations
  Clone ID: PAT_TA_87499
cctgctccttcatggccatctgaaggaaagataaatctggagaacttgagagtcaagtatcgcgaaaatgcgcctacggttttgcgcgggatcacttgcacatttgcagctggaaacaagattggagttgttggaagaaccgggagcgggaagaccactctcctgagcgcgttgttccgcctcatcgacccctccggcgggcgaatctcatccgacgatgtcgacatttngcaccataggactgaaggacctttaggatgaaactccagcatcatccctcaangagccaacgctttcaangggcagcnttacggacaacgtcgattctcctgggctgtttacagatttangtatccggggaagcattggtaanngcanttaagagacatcatgtccttccctgaattccttgagnacaatngacgatgacggagagaacnggacnccgggaacggaccttctcctcgcgngctctcctcaacaagaaaagtctggcctcgacaagcacgngtcatngatcggcacgancatctgaaaggcacaacaggantccaagggcacgtgt

SEQ ID NO: 87500 - DNA, 593 bp, Triticum aestivum
  unsure (1)..(593): unsure at all n locations
  Clone ID: PAT_TA_87500
agcggctttacctaccgagaagaagagagaaaaaaggttcgagtgcgttccagagtgaggagtgagaagagatggctccggtgaagctgtacggcgcgaccctgtcgtggaacgtcaccaggtgcgtggcggcgctggaggaggccggcgtcgagtacgagatcgtacccatcaacttcggcaccggcgagcacaagagccccgaccacctcgccaggaaccccttcggccaggtgccagctttgcaggatgggtgactatacgtcttccgatcacgtgctatttgcaantacgcgtgccgcaaagaacaancagactgttgaaggagggcgacatcaaggatcagcaatgggtggtgtgtggtccaagtggagnccatcaatacactgccgtctgaacccatctcttccaatgccttatccanccaatcttgggggagcactgacanaagcatcgacgacacttgttaagnnaagaactgctggggtgtacaagcnactgacaatcaaatactgctggaactccaatctcggnctaacanttccgtaccntcttgggganactatcnccttcacctacncantaggctgggg

SEQ ID NO: 87501 - DNA, 623 bp, Triticum aestivum
  unsure (1)..(623): unsure at all n locations
  Clone ID: PAT_TA_87501
ggaaggtgctcttcctcaggtacgaggacatgctgcaagaccccacagacaacaccaagaatctcgctgcgttcatggggtgcccgttttcttgcgccggaggangaggcaggggtggtgcaggagatcgtgcagctctgtagctttgagaaactcaagagctcggaggtgaacaagaatggcagcagcgccatgatgggcgtcaacaacgacgtatactcaangaagggagcggtcngcgactgggaaaaactacatgaccccggagatggcggcgcggctgggacaagatcgtccaaggangccttcaaggtcaagcctgactttgggatctccaatgttgaaaggatggggaagcgaattgttgcatgaagcataatttcctatttgacatcccaaagaaataagcctatgattaagaccacaantgatattattattattncgatcacaagtgatatccttcaatcattatttctaccnatgaaatgcatgtntaaataataaatactgctaaaggggggccgtaccaattcncnaaangatctatanncccaanggctcgttaaactctgnnngaaaaccnggttcaacttancccttaaaancccnttcatggggta

SEQ ID NO: 87502 - DNA, 588 bp, Triticum aestivum
  unsure (1)..(588): unsure at all n locations
  Clone ID: PAT_TA_87502
gggaattagagaacactttcaacatgtggaaggagcggttttgcattagctttccaatgccatattatttgcctcattccgataaatggtttagaaatgcaatcgaaaatacgatacacgttttttgtgtgaagaaaaacagttttcaaaactgctcttaaaccgcttacattttgccaaaattaacttgggcatgatacccgtgccatagcttccaacggtatatcgcaagcccattggggcaatgttgggcgaanttaactaacaccggggaantcaagccaaacaactcaagcataaaattgcaaaagaccaagtncacacnacccgagagcaaatcccnccaatgagcgaatcctgttaaaatggcattaatttcaaaaccatttcaaaatacactncatcanntgaacangctacanaaaatttcnccgggaancggtgtnanaaaccgangtgggttgtcaaaggaattaagtggtaccaggatccaagtttgttaaaaaatccgtcctgataaaaaggttaaaanaaaaaaangcatntcaagttacaaaattacacccnggaaatttccggtccacttaa

SEQ ID NO: 87503 - DNA, 606 bp, Triticum aestivum
  unsure (1)..(606): unsure at all n locations
  Clone ID: PAT_TA_87503
cccgcaccccaggaaggtaagttcaagggctgtcctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggatcagcacccctggggaggaacaactccattcaatatcagtnctcaaantacccgcttnacaactgattctgcaatgaagaagatncnaggacaacaacacactcctcttcatcgtccnacctgaaggccgacaagaagaaattaaggccctgtcaanaaatgtncgacattcangccaagaagttaacacctcataaggcctgatggcaanaaaagggtacgtnaacttacacaaactacatccctgattggccaaaaatttgnacattatcanagganggcctgcatagccctgttctggntctgntatggaattgtattgtactacaaggggcaatggncatgcncaaacctgaactttntaattntcaaccagnactntnt

SEQ ID NO: 87504 - DNA, 481 bp, Triticum aestivum
  unsure (1)..(481): unsure at all n locations
  Clone ID: PAT_TA_87504
ctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccaagctgcngctgctcctgctgcagctgctagttcatcatcgatcatgcatcacctnccgtgcctgcatcatcgattgtatcgatttaactactacaataccatgttaccgcaactgattgaagggcctttatttcgcacctgacctgcatcancatcaagggtccatgccatgatgttaacaggccccctaaataaaactccctngattaaaaaaaaaaaa

SEQ ID NO: 87505 - DNA, 446 bp, Triticum aestivum
  unsure (1)..(446): unsure at all n locations
  Clone ID: PAT_TA_87505
ccgaagccaagccgaatcccctttctcccggagcctcaccaaatctcgaacgacgacgcaaggctgccgaccggccggaacccagtcgactcgagctccttcaacagtgcgcagcgctcgagctcgaagaacatacaggtatgggcaccgctggggaagaagcgtgacatccgagcgcatgaaagagactatggagctgatnaaagacaacatggtgaaggcgcggcaagggatgatggctgcaccatgaactcctcgttttgctantttaacccttgatgtttcccatttgtgatatccaactgtggtgcatctccttaactantcttgagcaatgtgcncgtttgacggtctttaatttggcttgttananccaggtgtngattccgcctgggggtttattaantttaaanccgaccagctacnctaagttcaaaaaaaaaaaa

SEQ ID NO: 87506 - DNA, 616 bp, Triticum aestivum
  unsure (1)..(616): unsure at all n locations
  Clone ID: PAT_TA_87506
acgcaaagcttttgtgtgttcccgggagggaatcctctggctcgacaagagaagaaattgatactgaattcatacctcttcctgggttgacgcttggacagacatgctctctaccaaatgaaaccattagagatgtgactaacatatatggataacttttgggctgcagtttttgtaggttaacacgggataaatctgctgaagatttattcagggcattacataatgcacgtgcaaagcatattgttgattggaagtatggggccataatacaacaaaacttccggtaatccatacctcattcaattctatcatgttggccataatgttctcctcgctgaggtcaattgtttatgaataaatcataactagtgctgtcaaaagtgttccggggttgacaaactatgtactnctcnaaggggggggcccgtaccaatcgccctatntgatctataccgcgccacggcgtcgtttaaactcctgacgggaaaacctgcgtaccactaacgctncanaaacccttcgcanctggctatacaanagccnacgntgcctcaaattcnactaagcaatgacccccgtcggcataccgngttggtaccactacgnactcacc

SEQ ID NO: 87507 - DNA, 654 bp, Triticum aestivum
  unsure (1)..(654): unsure at all n locations
  Clone ID: PAT_TA_87507
ccgggaagtccttttttaggcaagtggtcatggagcaacaatatatgctgcgtggcattgcaggttattttccgccccggtcgatccaggcacggcatcggatgggagagagcaggggaagggccaagaggccagcggtgtgggttggagtagcgaaggcccgaacaccgggcagcggacgctacaaggtgggaggaagangccggcgatagggaaaagcaacacttcatggatgagatcctgacggctgaagatggtgttcacgggaaggacttngaaagatttcaaagggcccacgaagagttggagttaagctaaatacctgactggtggttcattttttggntcctttacaaattttcccgacttcaaatggggtatctcatagtttnaaccaaatggtgggctgaacaacagctcttccgtaattccttggacacgtttgatacagcaacaagcatacattgctattacctatacaaaatccatggcatataaccatngcacactatgtactgaatnttncaacacttgatnaaacgntnatcaaaagggggcccgtaccaatccccnaatgatctatancccccatggctcttttaactctacngaaactggtacactatnctgaaaacccttncacngtaaacaagg

SEQ ID NO: 87508 - DNA, 615 bp, Triticum aestivum
  unsure (1)..(615): unsure at all n locations
  Clone ID: PAT_TA_87508
atttaatctggtacacacacagcataggcagtacaactgttagtcgaaacctgaattaccctactatctggctaccttgactacattaacaatgtcattcttggtgctgcagcagaagcgcaagtcgtcgagcctgaaggacacgagcccagtcggcctagccatcgatttcaacaacacagacgcatgcagccaaactccctagactgtagggtgcacaagaagtgaacccagccgattgtcctaacattctcttctaggtagcttgaactgaagtgaactgaacaatccacccttatgcatctgggctgcttgcctcatctgactaacttgctgggttaatttggttggttcttgttggtanaacctcggtcatgtagcctgcattttccattttcctcttcctgttgganctgcctgtgtctatcatgatacttcatgagaaaattaggagtgttacttggtaacgccacacatcccgtctccttcccccctgcaatcantcnnttaaaatatcattcctttcgctctgtnactctccataggaactggtactgccantattgancacttacatatcatacttaacacgangagcaataattgcgattgtca

SEQ ID NO: 87509 - DNA, 554 bp, Triticum aestivum
  unsure (1)..(554): unsure at all n locations
  Clone ID: PAT_TA_87509
gcccaaccgaacatttctacccanacaagatgtgctttcacgcataaagaccatggtatcaaccttgcgaagcctcaacatccctatccgtgtttccattggcgaccgcacaaacatgtgtccttcgnctggcctcgatggtagcctatactttggtgactacaagaccttcgntggngacaatgagaacaagcgcgangtgttgctcccgacccaagccgtcttcagtcttacgcccattgcctccatggttgacgaactcactatacagtaccctgccgacgtgcctgncgtctccggctggcttcgcgcancgaaacgccctacccctgccgaggtgggctctcatgcaacgcgaaatgattggctggagaccttctgggccgctatgcntccaagttcaagaacctcaanangttgacagnanatgtccccaatgacatctanangactggggcagaagcgaactgacaatcttttggtaacancatggaaagctcgaagtcatgataacagacacatcttcaagaggtactcaatcgtngnanattctc

SEQ ID NO: 87510 - DNA, 641 bp, Triticum aestivum
  unsure (1)..(641): unsure at all n locations
  Clone ID: PAT_TA_87510
ctcgagtttttttttttttttttttttttaacacatccatcaaaatgaagattttatattatccatatgtattgtcagggagaacaatcagctataggctggtacaaagttgtcatgaattcaacatcacatttgcaagatttgacattcctagtctaagtctgctccattagcaaccattgcgtcttcttcaacggttttttcagcagttgtgttattccaacattatacttgagagcctttggatagaacgacgacggagtgtagctattgcgcgagtaggtggcctccagttcgctcttcgctccctcatgttgatgcctaccacatccttttacttcggttaggattctaggcatcttgcacctgtacaaggcatcatccctgtttgaagcaacaatgctttgcagtgccatcttgactgaagctcttcaagcatgcangggggagaagctatgccttttaatgttcacanaacacctgccaacancaatcaattgactcaatctgtncaaacagttaagaacttggntccnancctcacttctcaatgtcaaacaaataancnactctgcgaccaanttggggatccaaaannggggggccggaccaatcnccaangatcgatanccncacngctg

SEQ ID NO: 87511 - DNA, 482 bp, Triticum aestivum
  Clone ID: PAT_TA_87511
ctccgtctccgcgtcgccccaactgatcgcgcaacaagatacccgccggtcatggctcctgccacatcgccctgcgccgtcctccgcttcgccgccgacgaggcggccccgccggagaccctccacgtcgtgcggctgcagcggctccgccttcgccgtgcagcggagggatgcctggaccccatcgccgaggaggaggaatacgctgggagcaggggcagaagcggcggcgaacacgacgacgacatctccaccggctcgccctgcgcccacggcggcagcagcagcgccgccgtcgaccttgccgagtgtcgtcgtcgataggtcggatctattagacacagtgtttggtaatactaagtagcgagtcaatctcctctgagcagtggtgtgtgtattaccgtgcagttcatgtcgtgcgtactgtaattaatccatgtcatccatgaattgatgatcgaactgcttaattgatgccgaac

SEQ ID NO: 87512 - DNA, 623 bp, Triticum aestivum
  unsure (1)..(623): unsure at all n locations
  Clone ID: PAT_TA_87512
cggcaaggtagtcttgtccgtctccttgcctactgcaacgaaggcaaggagcggatactcatctacgagtacatgcagaacaagagcctaaacttccacattttcggcaatgttaaccttcgtgcctcactgaactgggcaaggagactggaattaatccaagggattgcgcatggcattgcatacctacacggaggatctggtgacaatgttatccatagggatctcaagccaggcaacattctgctagatgacgaatggaagcctaaaatcgcagactttggaactgccaagttgttcgctgtggatcagattggggcctgatcaaaacaattgtagtttcaccgggggtatgcagcgccggagtatgcgcggcaagggaacatgacacttaagtgtgacctcnatagttcggagttatcccttggagacaccaatgggcaaaggaacgtggatcaaggcccccttcgcannctggggatttggaaacaaatgatgcagaatctggcaaacaaggtgcacncccatncnaaccaactctgtcaactgaacatcaccaattgggcccctggtcaagaaancattgnaacgacaatcnccttntcaattacaaannggtccan

SEQ ID NO: 87513 - DNA, 627 bp, Triticum aestivum
  unsure (1)..(627): unsure at all n locations
  Clone ID: PAT_TA_87513
ggactgtcccgctggggagacgggactccaccaccgcaagtgcctcgctggcgaacagtgacctccctggcccgagctctagccggtcacagctcgaggccgcgttcctcaagaagaaccttaacacggtcgacatggtcgcgctctcaggcgcgcacaccatcgggaaggcccagtgctccaacttccggactcggatctacggcggtgacaccaacatcaacactgccttcgcgacgtctctcaaggccaactgcccccagtccggcggcaacaccaacctggcgaacctggacacgacgacgcccaacgcgttcgacaacgcctactacaccaacctcctgtcacagaaagggctcctgcactcggaccaggtgctcttcaacaacgacacaaccgacaacactgtccgcaactttgcgtcaacgcggcggcttancagcgccttcacgacggcatgatcaagatgggaaaatgcgccgctcaccgggaccaaggcaagttaggtaactgctcaagngaatctnatggctatgctcggnagacaacgtaatgataggcccaaaagtgcanncactacatacanactgatcnttttancaggananaatatnatgntaacttntt

SEQ ID NO: 87514 - DNA, 629 bp, Triticum aestivum
  unsure (1)..(629): unsure at all n locations
  Clone ID: PAT_TA_87514
cgcatacttgcccaagactgaaacggaggaggggtaccccccgcaggtctccaaatcgagcagtggcaggttcagcaacggggccaacttggctgacaccgtcgcgacatctatcggcttcgagcagagccctccggcttacatgtcgctgaacggtgggctcaacatatggggagccaactatgcctcagcgggtgccggtataaaaatctccactaatggagagcggtctatctcattgccgaagcagctggagaactttaaggtgacgagaggccagatggagaacaagctgggcggcgacgccaagatgcgtgagctcctttcgaagtccatcttcctcattagcatcggtggccaggacctggatncaagatggaactcgagtccggatatccgcgggagcagaccgagctccangagctcattccctgtacggggatttatcactcctctatgacatgggcgccaggaactggaatcgtcaactcggctcatcggttcatgcacacctacagtataatgcgacanacctgaacanaagcacgcttcatcggctcaancctaaggtactnctcaaaatcggctccaaancanagnaatnaaggttacacgctcttcaacanaat

SEQ ID NO: 87515 - DNA, 545 bp, Triticum aestivum
  unsure (1)..(545): unsure at all n locations
  Clone ID: PAT_TA_87515
aaagagtcagcttcncacaggcaaatangacagaagcaatctaatcatcatccgcagcagcannatnaatatgttcaccatgtgtatcagtctgaatcttaattccccccagtgtcancttcttcttcattctcaatgtcctctaatgttggcctcttatccatcanctctcgtacgtncatagcccgnnaggaaatcttttcgccagcattattgatntgatgttctcanngatactacgagcatctatggaatcntcgacatcaggagcagtgtaagcatcatcntgttgngcaacttcnttaaacganttcctcngntcanaccnttgcantactctccaatcgtcggatcatgcanatgtgtcttcnaagatnaatatctgtgttgcttaatttgccaccnaaanagctcatcagtgtggtactccgcctagacattgatggatttgncatannatcancttgggttttgngatctannaaacagtttacactgtanacanattnacanaccgannactcgatananagttcnacantgac

SEQ ID NO: 87516 - DNA, 334 bp, Triticum aestivum
  Clone ID: PAT_TA_87516
gtgaagatggccggcatcgaggtcaagaccggcgatcagggacagatcaggaagaactgccgcgcaatcaactagtacaactaagtgcatgcatgtgcgtccacgacgtgcatgcatggtgaaggatcactccatctccattgcttgttttcatccgagttacctctgtaaagtttgcttgttttagcatccatcgttgttgtcttttttttttgttattccttggttcaattctcgtcaactgaattgtttgtctacatgtgtaaatgtgctgcaaaccaattttctttgatttgggaaaataaagttacatttttgctgtaaaaaaaaaaaa

SEQ ID NO: 87517 - DNA, 232 bp, Triticum aestivum
  unsure (1)..(232): unsure at all n locations
  Clone ID: PAT_TA_87517
ccctcctccaattccccatctccccaaccccgaccccgatctcaccaatcccccggaaccgaaaccctagccagcggcggcggcggcgatgggcaacccggagaagctgatggcgcagatcttcgacctcaagttcacgtccaagtcgctgcagcggcaggcgcgcaagtgcagaaaggancgagaaggagcagaagctcaaggtgaanaaggccatcganaagggcancgt

SEQ ID NO: 87518 - DNA, 629 bp, Triticum aestivum
  unsure (1)..(629): unsure at all n locations
  Clone ID: PAT_TA_87518
gtttcccagggatttctcaaggacacgagcgatgctggcaatttgggtctggtggggagagaggctacagcagccggagccgcagatttgacatcaggagcacagtggttaggccattaccagcagcagattgcagctgcagccatcgacactcatcagcatggccagcaaattgtgccagctgcttatatgcccattcagtttgtccctcagccgctgaatgttgttggccctggtgccactctggggtctgcttactctgatggccaagagtacatcaccaatgatcagtccaatctctgattctcagacacctgggagaaagcgtggtgtatcaagagatgtccccaataagtttgtggagagaaagcagnagangatgatcaagaataaggantccgctgcacgttcaagggctaagaaacangcctacaacaatgnactcnaaaacaangtatccgtttaaaaagngaatgagagnttaagaacnaaagngttgacatannctnctcgggccctacaaaaccaantccaatcagggaaatccggcgcttntaancntcanaaaatcncctgtnatttaacggtccccctttatacngagcacantcgnttaattgaccctattn

SEQ ID NO: 87519 - DNA, 503 bp, Triticum aestivum
  unsure (1)..(503): unsure at all n locations
  Clone ID: PAT_TA_87519
gcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtccccatgttgaccgccaagattatcagctgattgacataactgatgatggatatgtcagcttctcactgagagtggtaacactaaggatgactgaaacttcccactgatgatgttctgcttggcanattaagacggatttctgatggaaggactgatctgtcgtgatgtcgcangggtgaaaa

SEQ ID NO: 87520 - DNA, 537 bp, Triticum aestivum
  unsure (1)..(537): unsure at all n locations
  Clone ID: PAT_TA_87520
cgtgttactaatccgtagacttataggattgatggattcaagcctcagttcagtttctactactttcgtgtattcataaatggcctcagattcttgatattgtgatgattgagtggttatgccaccattttgtaggattcctcaaatctttacgagcatttacatccgttatgctgtccgagtcatcccaggtttttaaacaatctgatgcacttgcaaatcctttccctctagttctgatgttcctttgggccaggttaaccacactaactagtgtgttgaggtacttcattgcctcggcatttatgttggnactattgttatgacctangtatcttaggggatcactagtaatccaaccatgtttgtgttccagtgtgatgattctggccttaatctcgaaagcatcccctggatgccacttagtntaggtatctactcctgggtttgaacccngattaccnactantcangttgatantgttgcnagtcttangatatnanaactttgcatatccccaggggggcnggactaat

SEQ ID NO: 87521 - DNA, 210 bp, Triticum aestivum
  Clone ID: PAT_TA_87521
ccacgaagctacagaaataaataaaaaaacagaaatgaaaagagagagagggaactaacctggaagcccaccagccagcccacctagccggcccagcccagccaccgctccagcgagctgcttggcctcgccaggcagacagccaaggtgctcgacgtcggcaccgcagcgcgccacgcagctgcctgccgcgctgcttcctcctctcat

SEQ ID NO: 87522 - DNA, 471 bp, Triticum aestivum
  unsure (1)..(471): unsure at all n locations
  Clone ID: PAT_TA_87522
gaggagcctggacgccgggctggacctggggctggacctggacacgctgatccgggacgcggagacggagctggcccgggcggagcaggcgtggaggagcaaggtcggcgccgccatcgtccaaaggangaaggagtacaaggaagctgctccgtcggtggggcaagcggcgccgccagggaccgggaccgggagcacctcgccacctccaactccggctgctcctggggcttcggcttcggcagccccatctagtgcagccaactgaacatcatatatacttactatatatcgtcacatcacccatgtaatccatgcatgcatgcattgggtcattgagcctaataaaagtatgtgttaaatattaatantacgatttgcntttgtaatantgcaaagaggaaaggaacacgaancaatcaaaaggntgctcctgtcttgggtnatgcaacnaacacgggcaaacctggc

SEQ ID NO: 87523 - DNA, 494 bp, Triticum aestivum
  unsure (1)..(494): unsure at all n locations
  Clone ID: PAT_TA_87523
cggccaccggcggcgtcaagaagccccaccgcttccgccccggcaccgtcgcgctccgtgagatccgcaagtaccagaagagcacggagctgctcatccgcaagctccccttccagcgcctcgtccgcgagatcgcccaggacttcaagaccgacctccgcttccagtcctccgccgtctccgccctgcaggaaggccgccgaggcctacctcgtcggcctcttcgaggacaccaacctctgcgccatccacgccaagcgcgtcaccatcatgcccaaggacatccagctcgcccgccggatccgtggcgagagggcctaagctgcaacccatgcgtcgtctgttaaattcctgttangctgaattctccgcggaaatgtgtgtgctacgtataatgttccaaaatgtactgtgttcttgtcatgggtgatccttggcccatctganggaacctcctgttgcatcagcatggaatgaaaatttggtcctcttcc

SEQ ID NO: 87524 - DNA, 488 bp, Triticum aestivum
  unsure (1)..(488): unsure at all n locations
  Clone ID: PAT_TA_87524
agaaggctgaggtaggaaggaagatggtagacagtttcttcaattgtgaggatgtgctcctgaatttcctgtttgcaaatgcaagctcaatgagcatggtggagtatgtaaagccagcttgggcaatcgatatgtctaagttttcaggagtagccattagtcgaaacacacaagcacattatcatgttaggagcaaatgccttgctaaattttcagaagtctatgggaacttatctgctaaaaggttgtttagcagccgaggtgatgactgggatgtatagtagtaacagggataactggatacttttttcttgagacttgcatagtctgattagctaagtttccaagttggtaaagcagagggcttagtagtccaaggtgattagtgcaacactgaagtgctttatcctgctgcccgtttgtataagttaaaaatattatcccttcnaacatctccatagataacatttttattcaaaaaaaaaaaa

SEQ ID NO: 87525 - DNA, 633 bp, Triticum aestivum
  unsure (1)..(633): unsure at all n locations
  Clone ID: PAT_TA_87525
gcacttatcggcgtccaacttttatgtttcaaaaaattctaaaaatatatataactaaaatttcatgatgaaatactttgaaatgcgacctctaaaaaaaagacaaattcatggcctaggagggtgaatagtaaaccctagatttgtttttttacacagctctcatttcaacgtgttttgccctgaaaattgacacatgtgtgttatgcctatatctgtattttttcagaattttttgaaatgtgaaaatatgaattttgatgaatttggaattttgaatctagaggcctctagtgagcttgagcaccaaaggcaatttctgctttttcatttgctccctatgcagctgaagccttaatgatggaagcaatcgcaatgagaggactcctaactttctggattgccataaaattatagctgaatccgataattgaagtgtatggagagagcgttgctgcatgcacgacattgacagacgaaatcacaggatatgacatatccacatccaatatgcacangacaccgggttacccctcccccaaantggttcaaaaaanttaaggattttgactattaatacaactatttgatangcggngacaccagtcccaaccatccnagtaggttaatgca

SEQ ID NO: 87526 - DNA, 614 bp, Triticum aestivum
  unsure (1)..(614): unsure at all n locations
  Clone ID: PAT_TA_87526
aatagctggagcattgaacggaagttcattggttgtaatgtctaaaggaactccttacactcaacaatcatacaaggttagcgaatcattccccttcaagtggatcaataaaaagtggaaagaaggttttcatgtaacatctatggccacagctggaaatcgctggggagtagtcatgtcaaggaactctggctattctggacagattgttgagttggatttcctgtatccaagtgaaggcatccattggcgatgggagcatggttacagaataacttcttcagcagctaccggtgatcaagccgcttttatcttgagcaagccaaaacgggaaccaattgaacgagacacaagaaanctacggacctcaacctttcccagcaaccatgtaaaggataaatgggccaaagaatctgtacattgcntcaatctgctacgggagaactgtcagttgaccaacgtaacttgaagccaaaggaaggacgttaatactttggaaatgacacantgatgtgagatacaagagatnccatgatagatcaaaacagantgatgtgatggtaatcaaccaatgtaaacgatcagtttggactcccatagaactactatcaann

SEQ ID NO: 87527 - DNA, 393 bp, Triticum aestivum
  unsure (1)..(393): unsure at all n locations
  Clone ID: PAT_TA_87527
acaatatcagaattttatttttcgccatcttcacctatttcctattgtttctattcaatgtacgttaatgcaaattaattcgaagtaaattattctttgtagccaaattggacacatacatacggtatgaaaatttacgcagaagacaaggacccatcactccagagtctaggaaagttgggcaaatgtaatctttttatggaaaaatgcaaaacctgtcagccatcaaccctagcagaggggcaagcgctctttatctgtaatgtataatccttttatttggcgttgttgccatgccgctatagctggtcttttgctgttctccttttcctgtagccagttgtacttggttttccctatcctcataacaatgaaaatcancaattnattaaa

SEQ ID NO: 87528 - DNA, 631 bp, Triticum aestivum
  unsure (1)..(631): unsure at all n locations
  Clone ID: PAT_TA_87528
gccaactcctgcttctgctccgtcgataggctctcccacatagctccagagctcacggtcatggttgacgtggtgtggttgcgtgtcggaacaggagacaacgtttaaatagcgggcaccggccaggacacgcggtgtggtgagttaatgtgggcgttggagaaggtttctcggccgtcgcgctagttcaatgctgccgggccgatggataggatctggttagaatgcggagcaaagccatccagtcctcttcggtcatgtgtctccgacattgaaacagggtggagaccaggcgacgctctccgtcggcccgccgctttagtgtcgactccaatgaagangttacgtccgctctgggccaacatgaatacaacatancgctctggagtggcactggccggcattaatttgcggaactgcttcgtgtgggagatggtgcgggcatgtatagttttctggtgggtctgggttantggacgctncacggaatggtccgaataacacaaagcccctaatttcgtccggttacaatantcncaantactanaattataatatcatgcanatacacatnaaananttggggncttaataanttttgcaattataacacggcaatcatanggttttt

SEQ ID NO: 87529 - DNA, 564 bp, Triticum aestivum
  unsure (1)..(564): unsure at all n locations
  Clone ID: PAT_TA_87529
gctgggtgagctccggcggtaagttaaatccaagctcacgtctcagaggtatctaatgttttggagtggatgagaaattagaatagaacaagggtctaaagagaaaatgacactacccatatgcatgcaacaatcattatcacaccaatcattcatttattccactcaatcatagttcaaactcgggatacaagtcttatgacgaaattaaaacatcggcctaatcgatcaatggtaaaataaaaataatatggcggtcatgactaagtgtcgtcctgagatatccttgtgtcctccagtggtgcgtcttccggtggtgcgtcctccggtggtgcgtctcctctttatgcgtccttcagtggagctctcctcgtgatccttgtcattgctcactaagggtccatcatcacactcggaaagagtcttctcctaagtccatcttctcctccatgtggaatgtaagtctcaaagtttgtanctttcaaaaatccttgacttctctcagtcatgaatcccggtgcttacctcaattcaatnacaganataatcccgaatactcaactc

SEQ ID NO: 87530 - DNA, 570 bp, Triticum aestivum
  unsure (1)..(570): unsure at all n locations
  Clone ID: PAT_TA_87530
tctaactctaacctctaactgagttagagttctcctcgtctcggtccatcagcttcatactttccccattcctgtgttttcagtatcctgcgaatcaaagaggcccttttttgcgggaaaaatcaaagaggcccttagactagtttaggtccggacattttttataaacgtgttatgtccataattcaatgaacgtgctccgatttctacgaaaataatccggtttcatgtagtaattcatttatttatttattcttctacggggggtttgcatgtaattcgcgaggtctgaaatgtaaagtacccggcatatgctccgagtcgtgcatgcactacgaacccagatgctctaagtccacatgtcggtgaaatgggaacacgtggaaatatcctaggggtacatataggaggataaatgcgtgaaaaatattactgtgaagcgtactgcggttagaaaaggagactaaagtgatgacagctatagtcgcacnaaccaactagtgatacanacatacgacaatttcccnaaaaagagtacaatgctaatacccaatcaanaacaaagtcatc

SEQ ID NO: 87531 - DNA, 598 bp, Triticum aestivum
  unsure (1)..(598): unsure at all n locations
  Clone ID: PAT_TA_87531
acccaggactcgccggctgtgagggtttctatagcaggccggtaagcattgggattttggggtatttcaccgagtcgggcgggaagcttgcgcgggaacgggctcatcgacgatttattggtgctacttcgagccaccgtttggccaaaagaacacccccgcgcactgcgcaagcttgcgctcaaagccgtctgtgacagcggggtgacaagagttnggagaggaggacgaaaggacacgtacacatacacatacacatatgattaataaaaaaagtttgcaatttaattacgtactacccccatcctggtttataagtcgtctttgtatttttgtgccaaattttgactatgcatgtctccaaagattatatcgttggattcgtatttgaacatagttccgattatataacttttannacatgccctaacantttttagttaaattaaggtcaaaatatgcacanaatataaagggactaatnnacaagacgnggtaatacaatggcnctctcaatcaacgtccaactgccggccggctnttaatacaattccgctgttaacgcccaagtntttgttgnccgnttagnggcccgncc

SEQ ID NO: 87532 - DNA, 417 bp, Triticum aestivum
  unsure (1)..(417): unsure at all n locations
  Clone ID: PAT_TA_87532
acggcgtcggtgccgaaggagatcccccacctcaccaccctgatgaacatgggcggcggtggctccacgacggaatcccatgaagtgagagctgcttgcaactgaggatctcgcagatagcagcgacacgatattctttctaccggagatcatgtgggcatccgacccatacaatatccccccttatccctgtcaaagatgttagacatgggaattgcctgaaaaccgaangggcgcttcccgaaaatttccccanttcaacggcaaaagccccgctgttangtttgtatatgttcattaaacaaanttttgggcctcatattttgtggttgtttnaggattaattcttcatttgtttggnggtanaactggtnccttaaacgtgttnccnggaatcaagggnggaaagggttttcc

SEQ ID NO: 87533 - DNA, 634 bp, Triticum aestivum
  unsure (1)..(634): unsure at all n locations
  Clone ID: PAT_TA_87533
ccgggacgaagcagatcggcggcgcgtcactccaatcaccggttaggataaatggcgacggtttcggattctctggtctgggagcttgtcaggaagaacaactgcttcctgatcaagcagttcggcaacagcaatgccaaggtccagttcaagcaaggagcccaacaacctctacaatgtccactccctacaagtactctggcctgggcaaacaagaagactgttgacgggtgcagccagcttgctgagaaggagatgactgtggcctctcccacaaccaaattcaaagaagccagaacaagctgctgcgttcaaccacaagactgtcatgcgcaagganttccgccaagatggccaaggctgttcaaagaccagtccantgacaactactaacagcctgactttaccaacctgtccttgcnagactgagcnattttaccgcactccaagttgccannccggtgtcaaagaagaagacagcattaanangaagggcaatgactgtttgtggtctttgggtaaagttcaanctttaaattgttcaagataatgaggtgatatgatgaatgtgtcnctnatacggccaantttccagnggtcaaacgtnccatacaantttaacccctaacatttc

SEQ ID NO: 87534 - DNA, 597 bp, Triticum aestivum
  unsure (1)..(597): unsure at all n locations
  Clone ID: PAT_TA_87534
gccgccgcagccgcanccatgggcgcgtacaagttcgtgtcnganctatggncgaggaancagtccgacctgatgaggttcgtgcancgcgtgcgttgctgggagtacaggcatcancccgccatcgncngcancaccaaggcccacccgccccganagggcacaccgtctcggcntcaaggccaagcangggtatgtgcgtctaccgtanccgtgctcagacntggtggcangaancncccagtgcccaagggtattgtttatggcaagcctaanaccanntattacccaactcaanttcccanaggaacaagacgtctgttgcctgaggaaagactgggcgcagttngtggcttcgtncctcatcccnaacngggtgaatganganccacctacaatactttaggcaccttgttgaacttgccacacnctgtccgcaacatcaagatnacngtctcaaccttgcacancacgttacncttgccactcggcggaanantcntggcgcttgcanggtacgcacanacanagcccaggaaaccctgaaaggacaaacgttcctcgcgtactaactanncgtanttcgtgaccgccanc

SEQ ID NO: 87535 - DNA, 617 bp, Triticum aestivum
  unsure (1)..(617): unsure at all n locations
  Clone ID: PAT_TA_87535
gaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctccgtctccgccaccgccacccacaaggcgagctccggcgggatgggagatggcggccgagaacggcggctgcggctgcacccaatgcaattgcggcaccaagctgcngctgctcctgctgcagctgctagattcatcaaccgatcatgcatgcacctnccgtgcgttcacatcgattntatccatctactactacatacaatgttaccgcaacctgatttnaaggctttatttaccaacctgacctgcatcaacatcaaggtgcatgccatgattgtaaacagccccctaaataaactcccttggattaanaaaaanaaaaaancccaggggggggccggtaccatnccctanatgatcntntaccncctaanggcgtctttaaantcngacgggaaacctggttccaaantaaccctgnaaaatccccttccaatggtatacaaagccc

SEQ ID NO: 87536 - DNA, 605 bp, Triticum aestivum
  unsure (1)..(605): unsure at all n locations
  Clone ID: PAT_TA_87536
gcgccatccgcgtccacgacgacatgctcctcgccgcctgtaagtatctgcatcatcccctctcgcgcgtttgcggcggctggtgactgaatctgaatctgaatctgatgggtgcagcggaggcgctggcggaggaggcgacccaggagaacttcgacaaggggcttatcttcccgcccttcaccaacatccgcaagatctccggccagcatccgccgccaaggtggccgccaaggcctacgacctgggtctggccagccggctgccgcggccggacgaccttggtcaaagtacgcccgagagtgcatgttaaccccgctctaacgcagtacaagtnagcctngcggcantttttccgcgaangacngacggancatcaaaccaataancatctcctttcccccacatgccaacaactcaanttntaacgaccaacctaaaaataggcttntttctccgttccgtccatgctaagtgtccctggtgctgtccacttgcttgccgtacgnaangtacgnttacgggacacggaccacgtcaacgtgtcaagnccatctntntcaatcttgcagatgagtaaacatgatagttgtaaaaaaaaaaaa

SEQ ID NO: 87537 - DNA, 542 bp, Triticum aestivum
  unsure (1)..(542): unsure at all n locations
  Clone ID: PAT_TA_87537
ctggaccaacgtggtcgtcgcctatgaaccagtgtgggccattggcaccggtaaagttgcatcaccggctcaggcacaggaagtccatgccaatctgagggactggctcaagaccaatgtgagccccgaggttgctgaatccacgcggatcatctatggaggatctgtaactgggcgcaagctgcaaggagttggcgcgcagcccgacgtcgatggttcctccttggtggacttcctttgaacctgattcaaccgacatcatcaacgccgccaccgtgaatctgcctaagcaaatntccactggtcctttccggcgtgggagtaagacaacgaagatgaaaaacccttttttcnccccgtgtttataangtgtacaagctatatttgggggtggacaactgctacgttttcctcccctgattaactncaancaataatgaaatgtttgcnacggactatanaacaatanccttaacctgttgcgtttaacaagtctgcttcncccaatggcctcctttggaaantataacngaaaaaaaaac

SEQ ID NO: 87538 - DNA, 394 bp, Triticum aestivum
  unsure (1)..(394): unsure at all n locations
  Clone ID: PAT_TA_87538
cacgccgaggaccaccaccatcaccatggtcaccaccaccaccaccaccacaacgatgatgactgctgccttggtttcctcaaaggatggttggccgctctatgctgctgctgctgtctggaggagtgctgctgctgcttcctgggtgatgttgcatgcttataagctattccgtgtccttgcatccttccgaaatggtgtgccagttgtcctagggaatccttattgcttgttattccttccctcctatatgaaggatttcagttacctgttgttcaaataaacggtgtttaattggatgaactgctttgaccatgggatgaaaatattgtgcaaagtgtacatgattcagactttatatttaacaatccggtgatttgtggnttaaaaaaaa

SEQ ID NO: 87539 - DNA, 351 bp, Triticum aestivum
  unsure (1)..(351): unsure at all n locations
  Clone ID: PAT_TA_87539
gctgaatccacgcggatcatctatggaggatctgtaactggcgcaagctgcaaggagttggccgcgcagcccgacgtcgatggtttcctcgttggtggagcttccttgaagcctgagttcatcgacatcatcaacgccgccaccgtgaatctgcctaagcaagatctcgacgtggtcctttcggcgttggagtaagacagcgaaagatgaagaatccttttttctctcctggtgtttantatgtgtactatgctanaattttgtgggtgggagcaactgcacnggtttcctcccccctaatttaagtttgcaanncaaanaaganaatgtttggcnacnganatatttcaa

SEQ ID NO: 87540 - DNA, 443 bp, Triticum aestivum
  unsure (1)..(443): unsure at all n locations
  Clone ID: PAT_TA_87540
agaaggtgctcgaggaggtctccatcctccagtcgaagcgcctccgcaacaaggtggccggcttcaccacccatctgatgcgccgcatccagcgcggccccgtgcgcggcatctccctcaagctgcaggaggaggagcgtgagcgccgcatggacttccgtgccggagaagtcggcgctccgaggtcgacgagatccgcgtcgacaaggagaccatggacatgctggcgttcctccggcatggccgacctccctggcgtccgagccgcgcccccgaggcactcctccgccgcccctaccgtcaagcgttcaacgggcccgtttgtggcaaccgcgcctagtcctcccgcatctcgtctaccctatattatgctttaagtcatttaattcgntactngtggcaanaatttttggactcaaacttattcnagngtttgatcgcta

SEQ ID NO: 87541 - DNA, 267 bp, Triticum aestivum
  Clone ID: PAT_TA_87541
ccttagccttgatgtagacgaaagaccaacaatgatggagatagctgagcagctactcatactgagccgctctcgtaaggtgtaagatatttggtaggctgaatgtctgtacgctggattgtaactgtgtttcaaagtgttgtacttttaaacaaacttgtaacagtgttatggttaggcattgttttcaaaccgctttatacgcagtaatgaaaatatttgcctcaaatcaagaacaatctcatgttggaatccaaaaaggggggg

SEQ ID NO: 87542 - DNA, 165 bp, Triticum aestivum
  unsure (1)..(165): unsure at all n locations
  Clone ID: PAT_TA_87542
gctctgtccgcctctccgttgccgtgatatagccacgggctttctccgagaagagcgcgtcgcgggcgaggcgaggttccgggganagggaagggaagaggatgtcactgggggcngtgttccacggcgcgcagctgatgctggatctggcagttgncgggctgt

SEQ ID NO: 87543 - DNA, 506 bp, Triticum aestivum
  unsure (1)..(506): unsure at all n locations
  Clone ID: PAT_TA_87543
gtccctgacccggaggcacggttggtggcggctcttcacatcaccccagactggacagtaccatacttggcttacatgacccggggagagttgcctgaggatgaaactttggccagacaaataacctggcggtctaagtcaatgataattatcaatggtgagctacatcgccgcagtgttactgggaacttccagcgttgtgtttcccctgaggaagncaagatatttgccgtggaattcacgaaggggattgtgggcatcatgccggtcaaaacccttgtggccaagttttcctcatgttttaattggctgacgtcangctgatccggagacttggcaataatgtgacggtttcaaagttcccncnacggtcatttcccggtcaaanactgaggatgatacaacacttggcatttcggccnggggnttananggttggcttttaaaaggccaaggtaanaaaccactcttggnggaatngcaatcacaaatggtgaanaaaccct

SEQ ID NO: 87544 - DNA, 491 bp, Triticum aestivum
  unsure (1)..(491): unsure at all n locations
  Clone ID: PAT_TA_87544
actcttttgtagaaccagattgttgatatttcctcagaagtaaaatgttaccttttcctttactcgcttacttgaatccagactattaggtacccaccttccaagatatataaacaaccaaaaatatcacgtcaggctatgctttgggttattgatcaaacaaccaacactctgggtgtataggatctctgggataaacaagctccgaggaggccgttgtttggtgcagcccatgacagcaactacacgattggaccactggaagcaaggtccttatatgggcaactggaagaaacatctttccctcccgaccggaagggactttccttgaacctaancagtgtccggtgtatttaacancatcccctaaaagaaaacttnattccgtgttgccgtccttatctccnatggtttaatccaaattacnacngtgacatgataacatatatgagcaatgggaatatcccnaagaacggcanaaaaaaaaaaaa

SEQ ID NO: 87545 - DNA, 618 bp, Triticum aestivum
  unsure (1)..(618): unsure at all n locations
  Clone ID: PAT_TA_87545
cttaaaacgaacggtggaaacacaatcatcagagaaaatcaatgcttcagctacaaagaacgagatattaaaaaaagtatggtatattctgttgtggatttttggcactatgggtcacaaattggtcaacttttacaactcacaagtgtgtaatttttttttgtgaataactcacaagtgtgtaactttgtcatttgttaatgttcaaacttttccgcagtgcacacttgtgtgataaatttgaaatgtgcacctccccttttttgcaacactggttatgtacccatgctcacctttgcatttttacatatgtaaccacttttattggaaaaagaaaagatgtttaccaacttttggggtgtgtnattgtacagtgggagatcatgatctaagtaccctttcaactgggaacggaggatgggtccaatcattaagctaccgattgtccatcaagggcacnatggacttngggggnaattgctgggtatacacaaggntatgatcacanctcactcccacataaaggnttggcaacgtcccgaatnaaccaaagaaccnggatcanacaacggcgttgnnaaagtnaatgacatcaatttgtacattactattttttca

SEQ ID NO: 87546 - DNA, 398 bp, Triticum aestivum
  unsure (1)..(398): unsure at all n locations
  Clone ID: PAT_TA_87546
agcgccttatcttcgctggcaagcagctagaggatggccgtaccctcgcagactacaacatccagaaggagtccaccctccacctggtgctgcgcctgcgtggtggcatgcagatcttcgtgaagaccctcactggcaagaccatcactctggaggttgagagctccgacaccatcgacaatgtcaaggccaagatccaaggacaaggagggcattcccccgggaccaagcagcgcctgatctttgctgggcaagcagtggaggatggtcccaccctaagcagactacaacatccaagaagganccaccttcactggggtccctctnccgttggnggccatnattgccctgcgtttatcacctttaaaagggcccttcnccgtggggtgtggccttat

SEQ ID NO: 87547 - DNA, 620 bp, Triticum aestivum
  unsure (1)..(620): unsure at all n locations
  Clone ID: PAT_TA_87547
aatttgtacatcccttcgagcatcatgccgaagaagtgctgaatagttcacggtccttccggattgaactcccacatacagagaggtcgtcgctggcatggcaggacctaacgaactagcattacttggattactttgacaagattgatgtccttctcattgagatctcgaatgcggctttgaagtgtctgcacatcgtcaagcgatccccaatccagtcccttgttgacccacgatgcaagctgggggcagagggccagattgaaagcaagggtgggcccccactttctacgttggggagctatnatataaaacactcccactggcatagattcnggaaacttcccnggaangacctttggcataaacattacacatttggtatttagccctccgcgtgttcccgtcgatnacctttggcgtcacatngaagnccttgagcacatccnaattccgggtatgccgaggaggccaccacacatnaatgacagattnnaggagaacccgggcagtnatnaancaatcaagatgacatancncaaaaggagagcaagactacccgnggatggagtaaaaaacctatgattgatnggaaactncctacagaacttggnttccgc

SEQ ID NO: 87548 - DNA, 309 bp, Triticum aestivum
  Clone ID: PAT_TA_87548
atcccctcagttccaattactattccatccatcccgatcacaataccaacaactatccctaccgttcctgggttccagatgccacctattccattcatgtccccatctccacaaaccaccagcccatgaaggttgccatagcatgagactgctagtcaggggtttgattcgtacacatagttattatcagtgttttgtaagtttgttctgttggatgttttattactggcttgcgtttgggtgttgattgtaaatgcagataatttttgtactgtcctgtttgttaataaagcatagcttggtttgcat

SEQ ID NO: 87549 - DNA, 600 bp, Triticum aestivum
  unsure (1)..(600): unsure at all n locations
  Clone ID: PAT_TA_87549
cagacctatgaaaggcccacccacattggttccttcagtttgtgtgactcgagcgcaagctagccggaaaccatctcccctctcctcctcccgtctcaccaagccagccacgatggccgccgccgccgccaggtcgatgctccgctcgtccgcttctcttctccgcgctgctccggcgagggcctcttcctctgcggcgcgaccgtcccttcgccgcgcgttgggcgcgccccctcgcctactcaggtcgccagtcgaggcgagttctgcgtggagtccgctgctgccgctgcacagcgccaccgccgcggcgcggatgacgtctaagctcgccgtgcctgggccgangcctcngggtggctcaacggaagggaaaagacganactagatgaagacaacttgggaaagctgaaatggaggatatgatgctgactgccaacggaccaagaattacantcttncagganaattngacaaagaaggaacagctttctttccngtangtgaacncatgaattttaataatgngttganatgctaaactaattccaactaactcnataacaganatangtnagtgtanaattgcaaggggtaatg

SEQ ID NO: 87550 - DNA, 626 bp, Triticum aestivum
  unsure (1)..(626): unsure at all n locations
  Clone ID: PAT_TA_87550
tctcgagtttttttttttttttttttttttttggagcagagcancattacttatacaagtagtagcatcaagaatttacaaatcancancggcggcagcagcagcagcaatcatcatcatcggaatcacaataccctcctggaatcccagaanccactctcgcggtaacaatccatccatccatccagtaattaatcgcccttatttccccgagcccaacgccatcatgtcatcatcaatctcccccatcagaggcgaggctggaatggccttccgtgttcccactgttgatgtttctgttgttgatctgactgttanacttgcgaagccagcaacctacgatcagattaaggctgctatcaaggaggagtccgagggaaacctcaanggcattttgggttacnttnatgangaccntgnttcactgacnccanggtgacaacagtccagcatcctcnatgccaaggcgggatgctctgaacgacaacttgtcaagctgtccccgggacgacaacancnggggataagacccgcntggcnactcatcgtcanannacagtacaantanatggcggataangggaaatgttgccanagaggtcaaagccctctcgaanaattgttgg

SEQ ID NO: 87551 - DNA, 588 bp, Triticum aestivum
  unsure (1)..(588): unsure at all n locations
  Clone ID: PAT_TA_87551
aagggggtcacgtgatatacaaaggatggtttctcatcatgagataatccaatattaataaagacatggctacctactctggaataaacaagacgccattgacaaaattctgcagaaccatgtttctccatcagatgagggttcatcttcaagtccatgctcaatacactttcttccgcgaccgacgaggccgaaacttacatacacttcctggccgacgaggcaggatacatcatgttcgtggccgacgaggccgaacgatccactttattttctctttgagacttgatctatatcccttgtttgatttggtgcatgaatccataaatttttaacatggcgagattattgttttgctcanagcgtttgcatatcctttggcctggngacagaagccaagnagtttggataatgatgatgaccgtttgangcagcttaatcggagtctttcatagatatgctatgatgtaataactanagtnccttcnaggtccagganccagataccnatgtcctttaaagtangtgcatncnagncagtaaatngatgttacctncantaagntaaantcncgcaaaaaaaaaaaa

SEQ ID NO: 87552 - DNA, 628 bp, Triticum aestivum
  unsure (1)..(628): unsure at all n locations
  Clone ID: PAT_TA_87552
gggacgcacgggtcgtcgtcgcccatcttcctcgcgtgggggaaggggtcgccgccgccgttactccgctcgaccggagatggagatgccgccgttattcctccgacagccaggaacgacacaaacacggacgcacccgtcctcctcaaccacaacagctcagcaggtttgctcaggaagtgacaataatttcatgggtgatcaaccaaaagggcgttgatcctccaccactagttctcctatccaaagcagggattcctaagaatttattcatgggtnaangaaattataatgtgtgactttgtaattaacaagatnaaacaagataaatggatgatgcatggctcaaatgttgattgcaagtttaagaatggggctaccacaagacaattaatttttaatttttaatatccaatggaatcaagcattatattggattgcaagnccaaggatggggctactacaaatanttcaccaaagataatngatgatcagggtcaaanttgatgcaagntaagaaggantactacagacattagatgtcatttanggtaatgatcagatatatantaancaggcaagaatgggcacgcanaantttactctgtaaccttggaacttgaagcng

SEQ ID NO: 87553 - DNA, 418 bp, Triticum aestivum
  unsure (1)..(418): unsure at all n locations
  Clone ID: PAT_TA_87553
aaagtatgctgttgagcacttctctagctagatttgttcttgtttatgcccctcgaagtaaatgattcctcgcagtcgaacttttgaaagtctatactgcatttttcgtaactttagtgtagtgagaagatgggggcaccaacaacggaccagcggtgaccgggccttctctcatccagatccccgcggatgtgtgtcatcaatgccttgagctgggcccgctcaacctaagtctccaggacgaatacggcgctgcccagcaggaagggtaacaaaaaattgcaaaaaatgcgagtgcagctgattgcctcctctgtgttgtgatgtacatgtgttccaattttttttaantcaagttgtgaaccaactaatttngagcacaaaanttaaatggngacggttgatttctcccattgca

SEQ ID NO: 87554 - DNA, 392 bp, Triticum aestivum
  unsure (1)..(392): unsure at all n locations
  Clone ID: PAT_TA_87554
ggcatttatctaattaacccttgtgtttttgtttgatctatctatctatctatcaccatacaatttaatcttgcttgtaaccatcgtgggattgacaacccctttgcgcgttgggttgcaaggattggttgtttgtgtgtaggtgcttctaatgaggtgtttcttggttttcctactggatttataacctcagttattaactaagggaaatacttatctctactatactgtatcatcctctcctcttcggggaaatcccaacgcagttcacaagtacttgatanatgttgatgatgtctatcaagtactatcgcatatacttcatctccttgaatatacattattttccatttcctcctaatttcatctcccccactccaaaacgttttcaa

SEQ ID NO: 87555 - DNA, 605 bp, Triticum aestivum
  unsure (1)..(605): unsure at all n locations
  Clone ID: PAT_TA_87555
gagacagaaaatgtggccactttgttcctggtactcgtaagctacagccaacaatagactagtattgtttgctacttccttttttcttctctcaccatgcgagcactagtagtgtagaatttgtgagatccgctagttagttaagcaactaataatttaataattaagtgcccatgagatgcttctgttggttccttgggatttttcttcttgtggaataaaagtaatccattaatctcactcaatccgtttgaccaagagtaagattgttaactagggctgctattacactgcttctctcttatatatttgtgcaaactttctatctgatatcatcattttgttgatcagtcctcctctcctactcttgctcctgcgctaattacgtacaatttagtgtcaagatccgtgaaatgtacttaataccatcatttgggtgcagcaaatatacatatttgtcaatgcacctgtcgtactcacaatatggtataattgctgcatcttggattgtaacaaatgggttantacataacctaagatttccaagcaagttctgtttcagcnaaaacaaatggntcatgaaaaaanaaacggtcatgaggatg

SEQ ID NO: 87556 - DNA, 592 bp, Triticum aestivum
  unsure (1)..(592): unsure at all n locations
  Clone ID: PAT_TA_87556
gcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactggggaagcatggtcacgcaaagtgtcactttgttgccattgacatctttaatgggaaagaacttngaggatatcttccttcatcccacaactggtgacgtccccatgtttgacccgccaaagattatcaactgattgacataactgatgatggtatttcagccttctaactganaatggcaacacttagggatgactgaactcccactgataagttctgcttggcaatttaagacgggtttnctgatngaaggactgatctgtcgtattccgcaggntgaaaacatttcctttaaggaacctggggaataacacgtcgtggtccactcatactggacaatctcggtttgnaaaatcatgnatagatacgt

SEQ ID NO: 87557 - DNA, 617 bp, Triticum aestivum
  unsure (1)..(617): unsure at all n locations
  Clone ID: PAT_TA_87557
gaacaaaagaacaaggatggcactgaagcttccagaagacctgaagaaggaaacaatgaaatccctgcaaatactgtcgggtattgagatcattgaagggccagcaactgttgtagcagaccttcatcatctgacagatttgaaaaagctagccatttacaagctcaacatcacaaacggggggtaagcttttcgaagaattaaactcctcaatcgagtaccttggtggctactctctgcacaccctgataattgatgacgagtcatctgggtttgtaaattctctgagtgctctctcttccccacccaagtttctcaaagctctcgagctgtctgggcaagctggttgtgctcccagaatggatcacagaactgggatgctctcacgaagttgacacctcggtgacggcgctgactaantgatgccttgcaacggttggagtnactcccgaaattgtttctccgaagtttcaacaaagcaagatcaagaaacagctgccaccgttgtggaaaacccgatggagaaacacantcaaccactggattgacnacnaaactctcgctctcgncctttgtcantgcgagcttcaataacgaancaaanncaangttgactn

SEQ ID NO: 87558 - DNA, 269 bp, Triticum aestivum
  unsure (1)..(269): unsure at all n locations
  Clone ID: PAT_TA_87558
nctnaagcngggtgtgtncgacaaagtgttnaancngctganccttaatatcngcgtgccggagaacgangagtgttgcccgctcctgggcgggcncgccgngcctctacgtcgacggngtgcctctgcagcnccatcatggccagaattctcggcatcaatctcagngtnccnatcgacctgacnctcctcctcatccaatggcngcaagaactgacncgccaacttcaactgcccnanctgatccanccatcnanggatgaanatta

SEQ ID NO: 87559 - DNA, 361 bp, Triticum aestivum
  Clone ID: PAT_TA_87559
tggacgtgcctggagccgatgggaagctgctcaagccgtcggcggacgacgaggccgcgctcaaggcgctctctgcgctgccgcctgccgctgccccgtccgaggcgctcccctcgctctcgcccggccccgacgacgacgacgactccgctgcctcctccatggtcgccggatccgtcctaggtctcgcggccgctttcatcctcctgtggctgtgatgtgatgtgagatgctcttcttcttcttcctcccatccatttcaatttcattttttttgtcaagatgagaaacatgaatttatttgtttgggattgggattatataagaattataattgattgattgattgaaaaaaaaaaaa

SEQ ID NO: 87560 - DNA, 635 bp, Triticum aestivum
  unsure (1)..(635): unsure at all n locations
  Clone ID: PAT_TA_87560
ataaaggaaggaaggaagcatcttcatggtcaaacggaattgtggttgtctttgggctataatgaaggtttgggcgaactaaaatggaagaataaattcctgaaacggaattgtgggatgtctaattcctattaaaaaggaaaggatgaggcgaactaaaaggaaggatggaactttgggctgcaagtatattcacatgcgcgatgatggacgtgcacgcacataccccgatattccggccgtgcttttttcacgccttcaacaattagacctcttttagcccgaacacatacgagcacaacaacaataaaatccattccaagataaacaagagcttgactcgcgcttcctgaataattatttgcctttcatccaagtcaatcgtctcaagcctacgtcgcatcaatttatgaattttaattctcacaccaatatctcanctagatgtctcaacctcctaaactatgtccaaagtccgacgttatcctggtccctgcacgcgttcacgcatcacgganttaacaaaggtgcaaatcatatcacatcanctagcatgaaagtgctccaagtaaantctgnncttgtancggtcgaaaattaatatgncccagtannagttnaagcccccnacatng

SEQ ID NO: 87561 - DNA, 395 bp, Triticum aestivum
  unsure (1)..(395): unsure at all n locations
  Clone ID: PAT_TA_87561
agcgaacgacagccgtgaagccaacgccatgtccggtacgctgcgcgcactggtcaacaacatggtcaacggcgtcaccaaaggcttcgagaaaaaactgaacctgatcggcgtgggctacaaagcccaagcccagggcgacaagctgaacctgtcgcttggtttctcgcaccctgtcgtgcatgccatgccagaaggcgtaacggttgttaccgccactccgaccgagatcgtcatcaaaggcatccgaccgtcaaaaagtgnggccaagtggctgccgaantcgcggcttaccgcgctccctggagccttacaagggcaagggctccttattccgacgaaatggttaaagcttaaaagaaaanncaaaaaactcccagggggggggcccggta

SEQ ID NO: 87562 - DNA, 617 bp, Triticum aestivum
  unsure (1)..(617): unsure at all n locations
  Clone ID: PAT_TA_87562
gttcaaggagcagttgatgtggacattggagccaatccctctgctgagggtggtggtgatgatgagggtgttgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgctttcaagaagaatgttgagtccgccacaaagtatcttcttagcaagctcaaggaccttcattctttgttggcgagagcatgcatggatgatgggcggcgtgggtgttcgcctactacaaggagggactgctgatccaactttccctgtactttgcacatgggctgaaagagtcaatngctaaccgcnctgtnatgcnaaanccaagccgtcttcataattttgccctaancaaggtgtcaatcgacccncaatgttggtncagtaactgtcaaatttgntgncttgaaaacttcnganaatgtgggattcttngtaaaaaaaaanaaaaaccaagggggccgtaccaatccctaaaggagcnataccncncccngcgtcnttaantccgcnggaacctn

SEQ ID NO: 87563 - DNA, 645 bp, Triticum aestivum
  unsure (1)..(645): unsure at all n locations
  Clone ID: PAT_TA_87563
cccgaattcttcgtccgccgtccctccccgcactcacgcacgcgtagacccatcttcctcgctcgcctcgttccgtggttcctgtatgattcttctcctccgcttatttatatgcttaaactcagcgggtccaccaccatgatggagctcgagatcgagctcaagaaggcttccgacaaactgaagtcctgggatgctacttccatttctctgtctgctgcttgtgatttgttcatgcgctttgtaacaagaacatcacatttgggagcatgagaaatttggatgcagcaaaatcacgcctaattgagcgaggggaaaagtttggnganatatcnattaaaaggccgtnagacaattgcaatgctcagccaagatttcatctcaanatggggtgcactatgctgggtcatggtattccagaatggtgttgggaatcctgaagctagctgcctcaaatngcaaatcttccgtgtantaagnacagagggaagacaagacagnacgggctacgaatgtcaaatgaactgcacattagnatcccggttaagggctaatgatcaactgttgctacccaggatgantgaatgganttgttgggcgatggttttaagtgagaatattnttgntgggantcacatacctntg

SEQ ID NO: 87564 - DNA, 652 bp, Triticum aestivum
  unsure (1)..(652): unsure at all n locations
  Clone ID: PAT_TA_87564
gcttcccattcctcgccgccgccgctccgtacccgctcgaagccaacccgaccatggcggacgtcgacgttgacacggaggtggccgcgggcgcgcagccgaagaagaggacgttccgcaagttcagctatcgcggcgtggatctcgatgccctcctcgacatgtccaccgacgaccttgtccagatgttccccgctccgcgcccgcagaaggtcaagaggggtctcaaagaggaagccatgggcgctccgtcaagaagtgcgcaaggcgaaaaaggacgctcctgctggtgaagaagctgagccaatngaggacacatctcccttacatgatcatttgtccctggagatgattgggaaccttatcngtgtctaaaatgggcaagacttcaacaagtttgagattaacctgagatgattggcattacttgcaaattctcnacncctaaaagcaatntaacacgtaggccngtatcngngcaaanatctccngtcatcccctaaatgattatcccttcacttgaagaatcatacggcatcngtggattcatcnactgtccctggttgacagttnaaccataattgtcgttacaaattctatncaatangntcccaaagngtaaacttttccttgagggtttnnncgggcctnt

SEQ ID NO: 87565 - DNA, 461 bp, Triticum aestivum
  unsure (1)..(461): unsure at all n locations
  Clone ID: PAT_TA_87565
gccaaggccgcggccgtcgcctccgtcgcggccgcagtgcccaccgtaagtacttcattacaagcaaccattcactctgcacggcaagtagagaataccgtctgatgtcgtccgtgcgatttgtctgcagctggcgagcgtgaggatgcttccgtgggcgagggcgcacctgaacccaaccgggcaggccctcatcatctccaccgtcgccgggatggcctacttcatccgtggccgataagaccatcctcctccatggcaaggaagcatcccttcnaaggacgcgccggacaactccaagaacactccttcaactaatcaacctatataatncnataagtatacggtannttcaagnaacacttatgtgatacaagcaggctncnaacagcattgnggaataccgcctttnctgccccaaaactttctgataatgncttgattaataatgcacattgtcn

SEQ ID NO: 87566 - DNA, 535 bp, Triticum aestivum
  unsure (1)..(535): unsure at all n locations
  Clone ID: PAT_TA_87566
gcgaagcacgcgatggctgagggcacccgcgccgtggcgaaggcgacgtcggcgtaaggaagagcgcggcgcgcgttcgtccgtccgtgtcccacggcagcacgacgcaaagcaccccccagcgtgttcccccccaccaccagcgacgaccacacatcacagcaaaacccaagcaaaaaacaacgaggaaacgcgccgccgacgacgggcgacgacataagaacaagaccaccaagcggcgccacgacggcgattcgaaagagagtggaaggcaacgggacgggcacggcaacgcacaccttgttttagagggaaagcagcttccggcgcgaangtgcgacgcttttcttcnacgccagcgcccgcntnggcggacgacgacggatttcgtttggccccgcatgttcccgcancgacgggccctcccgtggggcccnttttcggggncngcttcctcatctaattnggccnccctcccggcgnggctgnccccttccaacngggcatcnctgtcnacaacaacaaaaaaaaaaaa

SEQ ID NO: 87567 - DNA, 403 bp, Triticum aestivum
  unsure (1)..(403): unsure at all n locations
  Clone ID: PAT_TA_87567
cgaggaggaaccgaggaaggcgaggcaggagcaggaggaggagctccggactgtcatgtacatcagcaactggggaccaaataactagcaagcagattagtcatcagtcctctgttcttcatcttcttagatggccagaatggtgcaccgtgcacaagctgcaccagttccgtctggctggatctgaatgtgtgggaacacaccacgcgcattctccgagcttgtgtaaagacacgcccacagaaccgatcacatcaaatacgagcacgcgcacacaagaaaactggataaccaaagggcctttgtcctgcccttgtttctcctcctttattctttttttttgnttttccccngtgttacataactcaacaaccgtgcatatancttccctaaaaaaaaaaaa

SEQ ID NO: 87568 - DNA, 442 bp, Triticum aestivum
  unsure (1)..(442): unsure at all n locations
  Clone ID: PAT_TA_87568
agagagataggacttttgcgccgcacgccaaacagcangcaagcnaatcnagtcnttcccgttgttgcngccggcggaggaagaaatggcgaccaacatcnangacgtnccttcngtngagctcaataccgagctgctccgtnccgccaagttcaagctccaaagccccgacaaagcgcatcatcctcgtccgtccaactggctccttggaaanggaacacatctccccttaattaaaggatgaatattgttttgttgcaatttaaccaactgggcgatatncttaaggctctttccccgctnaanccccccnggtatccaaggctaaagaacttttgacaagggaacnttttcnaatacttggttntttngattaatggatgaanccattgaaaacctcnattccaaaaggtttaccctttatgttccccnanaacggtgt

SEQ ID NO: 87569 - DNA, 629 bp, Triticum aestivum
  unsure (1)..(629): unsure at all n locations
  Clone ID: PAT_TA_87569
caccaacggcaggtacaagagtgtcgaacacagggtgctcgtcgatgccgagagagaccgaaccaccatcgccacattccaagatgcatgtgtcgccgggatggtgaaaccgctccccgagcttgcggaggtggcacggtacatttctattgagaaacatgactatgtgcatcgccagtttcaggcactgactgaaagggcaaacatgtccgatagcctcaaagatatagcgcaagtccattgcctatgaagaggctcatgatccaattatgctatatgaaatcatgccgggcccgaagaaccacaaacgaagacaaggttgggaatgttatgcatctatttgctgcatgtttaanatcctcccgggttcaatttgtgttccnnaaattatatttgtcatgttgttgtccncacggtgataatgtgtacgttgattcatttccgtcttcctttggnagtaataaccaacctttacacaacactctcgantcgttccttgtcaagcaagcgtatagttcatctcnaacatatatgcanggacantnaacccaaaaaangggggccggaccaattncctaangatctttancgccaangcgtctttnaantctacngaaanccgnttccat

SEQ ID NO: 87570 - DNA, 514 bp, Triticum aestivum
  unsure (1)..(514): unsure at all n locations
  Clone ID: PAT_TA_87570
ctgataccaaagctcatcttcttctccttgaaatctttttgggtccacagatttggaggatgtcttgcaactgcggatcaggctgcagctgcggctcagactgcaagtgcgggaagatgtaccctgatctgacggagcagggcagcgccgccgccgaggtcgccgccgtggtcgtcctcggcgtggcgcctgagaacaaggcgggacattcgaggtggccgccgggcagtccggcgagggctgcagctgcggcgacaactgcaatgcaacccctgcaactgttaaactgcatcactcctacttataactgtatgngttgagaatatacgtgaataacaacgtctatntgaatgatcccacaaatttctttgtgtgtggttanttccccccnccntcaancnctgccttgnntccngtttnaagttatnagttncccggaatgctcaacnacccaacnangatgatggngaanagttagatgaaagattacnaattacancctaaaaaaaaaaaa

SEQ ID NO: 87571 - DNA, 500 bp, Triticum aestivum
  unsure (1)..(500): unsure at all n locations
  Clone ID: PAT_TA_87571
tgaatatatgccaaacggtagcttggaagagttcatttttggggtaagagcaaagaagagttggcccgtacgtcgtggcataatcgaagggatatcagaaggccttctctatctgcatgactatgcgcatgaatgcatagtccacagagacatgaaaccaagcaacatcctattagtcatgaaatgaacccaaaanttcctgactttggggattgcaaggatatgcctctccagccgtgacaagaatccaaattaccgacaacggctatgggaacatttgggtacatccgcaccggantactaccccccaaaatgttctactccaacaagtcctgatgttttcaacttccggatccctantcnccgaatncataattngaaaaacgccttcngtcccttacaattancccggaagattcataatgactccaaggaatatcctggcactgttgagaaacagangtcgacactggtggatgtcccttgncaaggataccggg

SEQ ID NO: 87572 - DNA, 548 bp, Triticum aestivum
  unsure (1)..(548): unsure at all n locations
  Clone ID: PAT_TA_87572
gctgcatctccccctggaggccatggctgtcgcgacaccatgtcctcgtccagatcggggccatggctgcctcccccaagctcctccttccctcgccggcgatgagagtacggggagtcacgctacaatttttctcttttcggaaccatcgatgaccgcggtgcaacccacatgtgttttgtttgaattttttgcatcggctgcattttactcaaagaagagaattcacattgttcttgaaaggtctgtgcagtcatcgccagcggcagcgtcggtttgattccnaggagcgtgcactcattccgcatcanggattcaaccccatttcctccaacccttcacccctcggcagttttttcctnnagaagaaactacggcattatcctgcanccgtcccattttttggccgttggtnaccttaaagtgagccacaacccncnaattgcaccactaacaaattgcacccggaataacanatccaacgacgtcaaatgncaccccggaccatggagtcaaaaatgaccctanggtactttaaaaaaaaaaaa

SEQ ID NO: 87573 - DNA, 640 bp, Triticum aestivum
  unsure (1)..(640): unsure at all n locations
  Clone ID: PAT_TA_87573
agcaaccgaactggaggtcctcaagcttgttaacagcgccactggatccatctaccagaagaagagcactgaaaagcccaaggctcctcctgcagtggaaccaccaagaacaagcctgtccaagaggccatctcttggagcttctgcaaaggtccagtccagggcatcacatctccctgctgcatggcctaaaactctggggcatgaacgagacggttgagcttgcccacaccttgtgccacgaagatgcatgtctggtttctgaaatttngtgaacgaggcatggatgtngggcttcccacctgttttgaaagaccaaaacatcgcaactaagggaaagcaaagcggcatatcacgtgggcctgtcncaattcaaaagntttaacgactgggctggacggatccngaaatnncccgacnaagatgcgaccaaggacaatgtggacgctttaaccaaatntacaattcgtcancaacccatgggnctcctctaaaacccgnccaattcaacaaaagactgaccggtgctaaactcngaaattcttctaacnccaattcataattttaggtgagacacaattggggtntgaatgganaattgtttaaagnctgcccgtanattaacgtttacaaaaaaaaa

SEQ ID NO: 87574 - DNA, 470 bp, Triticum aestivum
  unsure (1)..(470): unsure at all n locations
  Clone ID: PAT_TA_87574
agggctgccatggacttcggcttctcttggccgaggtgtcgggcgagccactcgtcgcagatgttatgtttaaatgcctctaaggcctcggcatccagacagtcgacaatttgttttttttaagttaggaatcgagtccagaatttcctagctgactccccgggctgttgggttatgtgactcaatcatcagcatccggtgttccgcacataagtgccctggaantatcaaggaatgctcctccaantctcacaactgccaatggatttgcccggcggctattcaaccaatgccgaccagcctttgantttatgggaagtacttnaaggatgtaattatcaccgcggcaagtgaattggaggaggaatcttcaacccataccgcgggtcntttgtacatcatatgatcaantcacggtttaaccttccggaatccngatcatactcancgtgaacanagggtnttcgggc

SEQ ID NO: 87575 - DNA, 534 bp, Triticum aestivum
  unsure (1)..(534): unsure at all n locations
  Clone ID: PAT_TA_87575
tctataccagcatgcggacgagttgttggtggcgatttccttcaccaaaaagtttacacaccctcgttttggaagggctggtgggggctgacaccaaacagccctatagtaaccaaagtgtcaaacaactatacttatgcaactaactatgaaagtgttcggtagattactatagttcattgtcatatgttgtcgtactagactcactagtttttcacatgctattaaaacttttaagtagcaagcagttaaaagtacggccttgatatatgtaaattatttcaactaacaactatttatacaagtttgtgtcttcttgttttgccaaactaatatactgttttattanctcattcgcgtacccgcaaatcnnagttaataatgtncttagattgataatttgatagattgtatgcttcttantggcaccntaaatgtttttantctggatgtttcatccaataagatgcaacacacgttgggtttcccaattataggatcgagggagtnnccgtgaacttgngcacacccaca

SEQ ID NO: 87576 - DNA, 196 bp, Triticum aestivum
  unsure (1)..(196): unsure at all n locations
  Clone ID: PAT_TA_87576
acgccacggtgacggtgtgtgccgagccgaggnggangggnccaatgaanatgtantctccgtcgggactatggtangcncccngtcnatgtganagttctttcngggttgtgctgcgtgtgtgcntgtgtatctccatgtatatgtgtttgnggganttgagattnatagatgncancatacaggncgttcttcg

SEQ ID NO: 87577 - DNA, 628 bp, Triticum aestivum
  unsure (1)..(628): unsure at all n locations
  Clone ID: PAT_TA_87577
gggccaaacacattcattaaaaatcaaaataggtgatgtagttgtttacatgttcccgaaggaagagtatgacgtccatcaaacacatcaaaagcaaacacaacactacatggtttcatttgaaccattacacggactcaacttcgcataggggatacacgacctatcctaccttatgggttacacactatcatatcctaagttgcgaatgatgcctaagtggtggaatgcttgggtcgcgtactctgggctcctccgggtcttcttctttgtcgtcttatgtcttacttccttcattactccaaaggagtggggggagtggangggagcacaacacggntcacttttgtcngtggtgtgatgaagatcttgcaataatcccttgtcgtcaaacaactctctgggtgggttctcaatngttggnaagtgcacttccnggggggcttccngcctcnatatccacgtggcatccaaggggacttcttctgatccaaccgtcttcctngcctgggnaaaaatgcttaaccnngggntcctttgggccaacgancgaggcaatgtttgcaacntcgnnaaggtgattggncggangntgaatctcccatgngactggcttcccacccncccn

SEQ ID NO: 87578 - DNA, 261 bp, Triticum aestivum
  unsure (1)..(261): unsure at all n locations
  Clone ID: PAT_TA_87578
caagtacccgacatcaccgcttccgccttggntcactgaggatgacattgactactttgtcacctccttcgaaaanactggnttcactggngccatcaactactactgcaactttgacaataactgcgagctggcggcaccatgggcagatgccaaagtgcangtgccnaccanantacattgtgggagacggtgacatcacgtacaactttgnggggatnccaagnatacatccatgggcggtgnnttaaaggagattcg

SEQ ID NO: 87579 - DNA, 602 bp, Triticum aestivum
  unsure (1)..(602): unsure at all n locations
  Clone ID: PAT_TA_87579
gcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaanttgctgcggtccatctgggtggtggtggtgttggctgtttcaactgctgcccctgctgctgngaggtgctgctgcccctgcagctgaatcaaaagaaagaagagaagcgttngagaagaagagatgatgatgacatgggttcatccgttcnactaattgtggggcacttgtgtctgaatatcaacctggcaagaaacagatcaagantttaaccttaattancgatttgaaaantggaaganaagtttgaaagtaataaccctggntgcggtgattacggggaacanacttcancaanttggcctaanaagcgtgtttagttcgccgtcagtacctaaacccgncaatttttgg

SEQ ID NO: 87580 - DNA, 591 bp, Triticum aestivum
  unsure (1)..(591): unsure at all n locations
  Clone ID: PAT_TA_87580
atcacagagatcagcccacacacgcgcgcgcgccaagaaagccaccgatcgagctccactcagcatggtttcctccaagaacgcccgctgcaccgcgcttcttttcttggccgtgctgctgctctcgtgcgtcggcatgggccgcgcggcacgccgcctgaaggaggcggcgcctgaggacaattacccggccgaggcaccggagtcgtcgcctgaggacgattacccgtccgaggcgcccgagccgtcgccggagcacgaactgctgccgccgttcccggagttcccgtcgtccccgaaatcgagctgccgcccatgcctaagatgcctacatcccgggttcaactttcccgactcgaaccggagccgatgagcatgagccatgatcaatgacgagggcagtgacatgaatccggatcgtcatttcngagaccaagttgccttcatgcccttcatagtaacgccgattgttccgcnttacnacgataaaaccgttaaaatgtaaatgtccgncgtacacttgacaccaatgaaaaaaaacaaaanaaaaaatcaagggggccgtncaantcccnanatgatctatacccc

SEQ ID NO: 87581 - DNA, 634 bp, Triticum aestivum
  unsure (1)..(634): unsure at all n locations
  Clone ID: PAT_TA_87581
gtggatccgacgggctttcttcatgtagatgaggagctgcggtcgaggccgagaacccttcgaagatcaagtctccttggatatcagcgatataattcaggctttcgaacctgatctagtgaccaggagcgtaactgtcgatctattcaaggtgaccagttgaattggcacgcaaagcgaagccgccaaacacaaaaagttgaccagggaggaatgtttccccggaaacagcatcgttgtcgatgatcaaacgagccatcgaaccttctgccgacaacacagtgggactctcaaatgaaancaccatgtcagtgtcaaaatcgactgatctcgggtaggggtcacgaactgtgtgcctaagatccaaggtaacaagggacaagtgggacacaatgttacctaaggttcgggcctcctaaatggagnaaaacctacncctgcttgatgtattgacgattatggggttacaagantgatnacgaaggggggggcccgtaccaatcgccnaantgatcntatanccggccaacggcgtcgttaaactcntacgggaaanctgggtaccaactaacgcctganaaacccntccancgngtatacaaaggcccacgntnccttcaaattccaacgatgg

SEQ ID NO: 87582 - DNA, 258 bp, Triticum aestivum
  unsure (1)..(258): unsure at all n locations
  Clone ID: PAT_TA_87582
ccgggtcgtcgtacggcgatgttgggcggctgatggaggagttgattgctcgccgacggacttaagggtggttggaggatagacgtcggattcttcgcttgggcagcttagttcttgtcttcggtcttccgtccgtttgcttttgtgccaaagttggagaaanttntgggtgttgttgttaataaactgtaattgttgggtgttgttgtaataaactgtaatgggccnttttgggtcctggggtgcaaaaaaaaaaaa

SEQ ID NO: 87583 - DNA, 235 bp, Triticum aestivum
  unsure (1)..(235): unsure at all n locations
  Clone ID: PAT_TA_87583
gctcattggagcggtctgtgtaacagctctaatgtgatagcgatgaatatggttcataattatagggtcgatagatgatgatgcttatatagggaacgatggaaattgtgtcctgctttgngatggcattaacgcaaatgtaggaagaatcatgcacgtgcaagaaaaaacaaaatgataaccnagttaacgaaaaagangcattgagtctgataatgccgtcttctacattgtg

SEQ ID NO: 87584 - DNA, 331 bp, Triticum aestivum
  unsure (1)..(331): unsure at all n locations
  Clone ID: PAT_TA_87584
cttgcctacgactatttccacgactctggcaatagcccacatggcccatactacctgtgcatctacgactccaaaacccaggtttggacccgcaagccagctgctattccacagccgctgctgccattcgactatatctgcgacatcgacatggtcatcaccatcggtggtccagccgtggatcatgggctgggtccactctggaatggatacaatctcctgacgtgcttgcagacaaanaccctanaacccgcttcgcnattnnccctttccgaaacccaagganccncaaattgcnccccnattcccctgganattgggggcccttttc

SEQ ID NO: 87585 - DNA, 636 bp, Triticum aestivum
  unsure (1)..(636): unsure at all n locations
  Clone ID: PAT_TA_87585
gttcccgaacgctgcccgctggtatgacaccgtcgccgcggctgttgcttcaaggttccctggccagtcctctggggtgagtgcatcatcggctcctgctgcagctgctcctgccgcttccaaggatgaagacgacgatgatgacatggatctgtttgggcgatgaagaccgaggaggacaagaaagctgcagctgagcgtngaggctggccaacctgcaaagaagaaagaaaantggaancctctgncctcaatggatatcaancatggggacgaatgagactgacatgaagaanttggaggaagctgtccgcaagtgttcaaatgggagggctcacctggggtgcatctaactttatcccgtgggnttaatggatcaagaactccaaatnatgctgacgattcattggacactccttccnnccgaacccttattagggaangctcctgccnanaccccaccaacgantatccanccntgtgacacntncctncaacaagtctanaacctggtcaccacctgtgccgctggatcctggacgggattttcatcngaaanttattgctccaattantaccccctaaaatcacggtttgtttgatancctggcctaagtcgcaccttaaattacgcgg

SEQ ID NO: 87586 - DNA, 603 bp, Triticum aestivum
  unsure (1)..(603): unsure at all n locations
  Clone ID: PAT_TA_87586
attcatttccaccacaagaaaggaggtgccgataagttcaaggcattgcaacatataagggtgaaatcatacaagctacgcgcgaatttggttgattttggtggaactgcacaaaaagaacagctggtttatttagcacgaggtgccatgtcaatgtctgaactgatggcaaaccctgcccattccacaatcgtaggcatttgatattttggaatgggacaaccttgtcaaattttgctcattgattttagcaagatatgtgtttgatattttcgaatggggacgccctttgctgtcagcagcgtcgatcaattttttctttantctttaattgtgaaagtaaatattgcctctgacatgtntagtcnctgagatgcatatcatcgatggttttgaatntccctaagaattgccagcctgtgtgttgnttgcnatgttcagaaacgctnaaaaaatgctcaaacccttgtacncctcggttccttttactcncanattggnaaagncanacttttggataaatggncanagtaaganattgacncgaaaactttnnaagcnggaagnccgngggatcagtaacgctnaacagngttacctgga

SEQ ID NO: 87587 - DNA, 542 bp, Triticum aestivum
  unsure (1)..(542): unsure at all n locations
  Clone ID: PAT_TA_87587
gccacatcatcgtgctggctcccacgcccaaggaactgctcgacaaactggaggagtactctcctcggcacgaggaggtcgtgcccaggacgaagtgggagacgacggagcagctgagctgctgcaagatccctgcactgaaagagggcacggtgatcctcccggcgcagcgaggaagcatgctgttgactccgcagtccccgaagggggggtctnaataacctgttgccggtggatgcgcaagtgcaaacctaaanacccgttgcctcattgccttggtttnattccctggtactccgggtaaaacntactaagtccattgatcactggatgtacctancatgtgttaattnctatnagtgttnaactaaattcaaatggatggtttaattttgaaccgtggtccggtatctagtngtgtncaancaangtcaaatgtntattccaacgtcnactgnccctttaatangcatanatatggacctaaaatacatatcatanagtagcccaaatcntttaccgtgaaccgtatgaaaaaaaaa

SEQ ID NO: 87588 - DNA, 235 bp, Triticum aestivum
  unsure (1)..(235): unsure at all n locations
  Clone ID: PAT_TA_87588
atcacatcaagattatgccgcagatccaaatctttccaatactccaagtcccacaaagtggacctgcgggtaaacaataatctctcttctaccctgcnacgcttccttttcccgctacnattacaagcatggtttcctggggtaatatgcccgaccttcncnaattcnacttgcaactcancggcggtgagccnctttggngnancacggttttaangctttgnatggaanacag

SEQ ID NO: 87589 - DNA, 567 bp, Triticum aestivum
  unsure (1)..(567): unsure at all n locations
  Clone ID: PAT_TA_87589
ctcacaccatgtctaagaagattgtgatcagagccgatctcgtcggcaagaagtgcacgagtgggatcctgtcaatcgtttccaagctcgaggggatcaagtccatggtcgtcgacgaggacaagtgcacgctgacggtggtcggcaccgtggacccggtgtgcgtggtgcaccagctgaggaatcctgcttcgccgcgtccatccgtcagcgtggaggacgacaacccaaggagaagaagacaccctgccangaggcctgcgagaagcctggaaggaaaattacgagaagcctgcaaggagagtgcgagaaggttgcaaggaccnttctgcgacactgcgcacaaggacccttacggcgttacggtacgctcacccngctcatcaaccctgcggctccaactcaatactaaanccggtacgtacgtacgcttctcccccctgggaaactggtacataaagncccggaacgagatatcncatcgcgccaagacacgtatgccttctgcnctacaattacantttccgttgtaactataaantgtccatgtgtttattcttttacnan

SEQ ID NO: 87590 - DNA, 597 bp, Triticum aestivum
  unsure (1)..(597): unsure at all n locations
  Clone ID: PAT_TA_87590
cccaatcatcactagctaatacggtgcactgttagctacagaccaagaagtgatcatggcccgcgctcaggtaatgctcatggccgtcgccttggtgctcatgctcgcggcggtcccgcgcgctgccgtggccatcgactgcggccacgttgacagcttggtgagaccctgcctgagctacgttcaagggcggccccggccgtctgggcagtgctgcgacggcgtcaaaacctccataaccagcgcgattccagacgatttccaaaangctttcaactgcctcaaggggattcctccgtggatccacaatctcaacgangacaacgcccgcanatccccccaatgcggtgtcaactcccatacacatcatctcaacatcgactgcacaggtgttatggggacattcgtcaactggtgtcaactcaccatcactggatttaacgccacctctaccctatgtataggcacaatttcgnttatactgaatatgataagatcctcaactggctgctggaanctctgagaatatancgttactaaattaanttgncatggcacccatgttangcttanaaaaaccctngtaaaaaaaaaaaa

SEQ ID NO: 87591 - DNA, 603 bp, Triticum aestivum
  unsure (1)..(603): unsure at all n locations
  Clone ID: PAT_TA_87591
gcgagtgaagcgtaatcgaccctcgtgccctgggaagcacaaaaggctctaaattcgtcggagttgaagttcgatccgttatccatgatgatgctgtgcagaacaccatatctgaatatcaattctctgatgaaacttacagttttacttgcttcaaggtttttaatggcttgggcttccgatccgatttaagtaaacttgtccgaatgccaccagcacatggggtaaatccaccctgccatcctcaagaggccaaccatgtccaaccccaagacagcgaaagncagacgagtgggatanccttaaagtccaccagtttatggacattttggagcaaaactgataccttcacactgtccacnattatttgccanccaattngaactgggcaattaaacccgtccgtagctttngcacnatggccganagaccatggtgacanancccagggggggcccgtaccaatcncctanatgatcnataccgcccacggcgtcgttaaantctgacgggaaaactggtaccactaanncctgagaanccctttcactggtaaacaaagcccacattcctccaaattccactatgnaangancccntcgg

SEQ ID NO: 87592 - DNA, 572 bp, Triticum aestivum
  unsure (1)..(572): unsure at all n locations
  Clone ID: PAT_TA_87592
ccaaaccgtagcagcagcagcagcatctctcccctctccaacaagcttcgatggcccgcacgaagcagacggcgcgcaagtccaccggcggcaaggcgccgaggaagcagctggcgaccaaggcggcgcgcaagtccgccccggccaccggcggcgtgaagaaccccaccgcttccgcccggggaccgtcgccctccgcgagattcgcaattaccagaagagacggagctgtcatcccgcaantccccttncnacgctccttccgggagtttgcccaagacttttaaaaccgactcccgtttccatcctccgcctntcgcggananaaagggcccccccaaggctactcctcnggctccttnnnaggacacaacttctgcgccatccacgccaangctnacatcatgcccaagaatcaactngcccgccgcatcccgggaacgcgctaagtccggaagcgccctcccgctccgctggtngccgnaacttcaaggtcgtantgttgccncctgantcntggtgcaacattgtaatcncggttgtaatgaacccctcttttcaaaaaaaaaaaa

SEQ ID NO: 87593 - DNA, 618 bp, Triticum aestivum
  unsure (1)..(618): unsure at all n locations
  Clone ID: PAT_TA_87593
agaccagcttcttctccttcggcggcctcttcgccaaactcggagcataatttccgtcgctgatccttaccgtcgtgaaaattgttgtaaaatggccacagctagagtagtccgtatggcagctcttggtgtacttttctctaacaagtttccccatttcctcgattttttcgagcatccgataatctttcgaagagagagataaaggatcctttcccaagagggaggaggtgcgatgatgatgcctatatttttctcaaccccgcgtattttcttccattttttgggacttctaccttttcctaattcctcatgatttctaatggatataagggcatccgagcatttttttaaaaagggggggccggtaccaattcccctatagtgancctattacgccgctcacgggcgtccgtttanactctgacggggaaacctgcgttaccaactaacgcctgcacacaccccttcgcaactggcgtaatacgaaaggccgcacgatngcctccaacatnccaactgaatgcnatggaccgccgtacggnataaccgcggtgtgtggtacccantacgcanctncaagccaagccgtccttctctctcttcccantccggttc

SEQ ID NO: 87594 - DNA, 414 bp, Triticum aestivum
  unsure (1)..(414): unsure at all n locations
  Clone ID: PAT_TA_87594
gcccttcctcgtcgcgcacaagaaggtggccctctcccgccccaagcccggcgtcgagcgcctcgccgtctccctcgacctctacaaccagggatccgcaactgcatatgatgtggccattaatgatgactccgtggcccaaggaagcatttgaacttgtctctggagaggctcgaaagactttgggaaaggcttgaacctgggtgccactgcctcgcannntttgtattgggagagcaaaacacagggnagttccangttnaccccctgttatcantacngttttgccacaaaggtgcattcaagaggcnatantccaatcccccccctggaatcttgctgaaaacccaataaaaattttnaatgggtaaaatnnttcnaattacgganaggtngngtttcctctnggggtaa

SEQ ID NO: 87595 - DNA, 642 bp, Triticum aestivum
  unsure (1)..(642): unsure at all n locations
  Clone ID: PAT_TA_87595
cggctcgcaggggctgggcgtcccggccgcgcgcttcttcccgccggtctccgccgccgtgcccaccgttcccgccatcatctccaagcccaccgtcatggtgcctcccaaaggtaaccaacttgctctacaactgttactcctagctagattgatactgtagtaggattaatttaggaagagtgagatgaacgaaaaccagtagcggtattgctaaaacatcatgtcgcagcagctagcaaccaccaacgtgcaacacaacagttttgtacctatgggcgccatcttaatatttgccgcgaaagctgggagatctgatctttctgcactgtgcgtacgttttcgcaantggacaagtggctgggtgcaactgaagcacggtgacgtgccaggattntaaggaggcaaaagtgtcncccatttaaatntgtccggattataaaagtgctgcacaagaagaagaagaagaacntcctcaacgtcaattcgttaattcctctaatccgttcnccatgggtggcgnnggccaacaaatctgtanaaaaatnatcgccnnccgttacaantttttnatgggaaacctttacaatttcngtacccatcctcaagggaatnanctaaaaacccctancccgtaaaaaa

SEQ ID NO: 87596 - DNA, 347 bp, Triticum aestivum
  unsure (1)..(347): unsure at all n locations
  Clone ID: PAT_TA_87596
ctagtgccaagaccttcactgtgtgcattttcgggttaaagcttgtcgcaatcatttttgaatgacagacgaacaaacatcttaaaaattagaaataatgttaatttgtagaanaagaggtanaaggcggctgttgtacctcaatgggtgtggatccaataacaagttcagagtatttgtcagatgagtagcccaccactgtcaatttcggcgcagaaatgacattgattcttgttggaccttcttgatcaactacaagtaatctctcaagtgcangtgtatcctcaattaccataccatggtacacatctcgtgatgtcttcctgtcgcaccaagcaacacacaca

SEQ ID NO: 87597 - DNA, 525 bp, Triticum aestivum
  unsure (1)..(525): unsure at all n locations
  Clone ID: PAT_TA_87597
aagttggctgacgcagcacaggaaattcaaggagtttagggatgccaaatggatgagcagcaagcgacccagcgcggacatgtcagagataaagagggaatacggtgccagtaaaagtaaaagactgaagaagaaggcctcgcggtgagtcttctctgggtgattgcatggattggggcctgaagaacagaccgcgataccacgggagaacagtgacgctcaccacggagccttgtgtatatatagttgttatgggctccttttagggaaagacctagggatagtttgttttgctgaagtgctgattagtggatcgttttaaccgttaatatctgtgctgtactctcctgaagcttggcatgtatccgtgtccgtctgttgaaatgtatctctgtgccgtacaagncnggatattactgccccactcctagtntgagatttgtnantttgggttaanacaaatcntctnctcccngngnagaagaaaaacccanggggggccggtaccaatcncccatntgagtc

SEQ ID NO: 87598 - DNA, 330 bp, Triticum aestivum
  unsure (1)..(330): unsure at all n locations
  Clone ID: PAT_TA_87598
gaggacgacgccttcacgatggacttccggcatccccctgtccgcctaacaagcgttngccatcctgcctcaacaagctttggnacnaaagctggcctgtgaataagtgccatcccctggtgatgttaacctnttaatcaatgtggcngatggcatgaactcctggntctgttaatcccgggaagaaangggcggcactggtgatactgtactcccaatctctgctcctctctttctcngtcctgatgatggatgttggatttgactcctatggctgttgntgttgttttgtaaagggcactccaatttctttccgggtgattaaaaaaa

SEQ ID NO: 87599 - DNA, 612 bp, Triticum aestivum
  unsure (1)..(612): unsure at all n locations
  Clone ID: PAT_TA_87599
gatccatccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctggattgacataactgatgatggatatgtcaagccttctaactgagagtgggaacacgaaggatgacctgaactcccacngatgagttctgcttggcaaatcaagacggttgctgatngaaggactgatctgtcngtaagtccgcaanggtgaagaaatntgcctgtnaggaatcgtggtgggaataacagtgtgctggtgctacngnatactgaacangcttcggggttggaaanatcatggatagtnt

SEQ ID NO: 87600 - DNA, 317 bp, Triticum aestivum
  Clone ID: PAT_TA_87600
cgaacgcggtggcgcgggcgctgagggtggggacggtgtgggtcaactgctacgacgtgttcgacgcggccatccccttcggcgggtacaagatgagcggcgtggggcgggagaagggcgcctacagcctcggcaactacctccagaccaaggccgtcgtcgcgcccctcagggacccggcttggttgtagcggcgaaacttatcatcgtcgtcctccggcaataccataggaggtggaaaggacaccgacaacaacgccggcgaactcttaacttaagcctgcctttgaataaatggtgtcgtcaaaaaaaaaaaa

SEQ ID NO: 87601 - DNA, 404 bp, Triticum aestivum
  unsure (1)..(404): unsure at all n locations
  Clone ID: PAT_TA_87601
ccgcctcgtcggtccaaccatctcagcatactgagatcttgttaatcacctctgtcttgtctatctttagtttggattgaaatgaagtgtatggcaagttgcaggagctgcaaacgcttgacgcaagtgttgttgtaagttggctaagtagagcaaccggatggataatcgtttctcgaatacgcacaagcgtgcgtatcatatattctggctgggataatcgtatttccgtaaatctgcgtgctaaagtttcaagtgaagatcatgtaagcaagccggtattgacccgggtattgctacatgatcgcacaatgtcagtgtcttccaaagtgtgacgatcctccccgagtataaanactctaatgatgaccttgtccctccccttggctggcaaaaaaaaaaaa

SEQ ID NO: 87602 - DNA, 414 bp, Triticum aestivum
  unsure (1)..(414): unsure at all n locations
  Clone ID: PAT_TA_87602
caaacatgcgctccactcatcgagaaaggtgttgatgttttcgatgcggagcttctgctgaacggtatggtcacccagaagctcgattacgagaggcaccgccttttcttggaccgtgtgaagcagacccgctcgacgaggtggctgaaagacggtgcccacgggcggtttgtgcccatatcgaagagttgataccatagcagtgtaaatgtatggtgtggtacagcccatgcctgttttatgcccatcctcgggttctagctcggttgtgattaaaatctgtaagttgtagggtgtttatattctctccggttgcnttaaacctttgtttgcatgcatcttgggcaacgcttgtagctgctcaatgattangatggcagttccaaanggctggcttgatcccccannaaaaaa

SEQ ID NO: 87603 - DNA, 235 bp, Triticum aestivum
  unsure (1)..(235): unsure at all n locations
  Clone ID: PAT_TA_87603
ccaaggcttgctcgccgtccangccactgcccgctgccaccccgctgcccgccgcaatcctactgctacgtcgacgactccggcccctgcatcatcgtgtgagcgataggggagatcatcgacccggggccgatcgttgntgctggtgcaaancangccantcctccangncaggcacaccaattaattcgtgngtncgtcntgttcancgntcacgaanattcanagcttgcag

SEQ ID NO: 87604 - DNA, 535 bp, Triticum aestivum
  unsure (1)..(535): unsure at all n locations
  Clone ID: PAT_TA_87604
ctgacacattagccacagatggcttagccacggcgactcacaggaccgagaaggcgaggcggccatccggctccggcgcggcggaggcgagcgagctcgcgccctccaagccaccccgtccctgatgcggggctctggaggccggacggccacgtcatgcgcgcgagcggggagcggccggcgactcgtctgactccctcaggtccgcctccctcgccgtcgccgccaccggattccgttgaatcactcgcccaccccagcctgggttccacctcgcttctgctcatgcgcaaaggatgccaacacgagttgatctttcctagcttccaagacgaacatggcggttgatgcattatcgtgagaagaatggtggntgtgccgtgggtttattctttcnatcctgtgatgatgcatcattacattangagntgtnatgaacatcatgtggatcnttgtgcctttggtggttnaaaacacaattattatggtaattatttggtaaggagaaaaatgtantggttgcccgcaaacaaaa

SEQ ID NO: 87605 - DNA, 477 bp, Triticum aestivum
  unsure (1)..(477): unsure at all n locations
  Clone ID: PAT_TA_87605
aatgaataaccatattgcaataaacatgatcaaatcatattcatgctcaatgcaaacgccaaataacatatatttaggtttaacactaatcccaaaagtatatanggagtgtgcgatgatgatcatatcaatcttggaaccacttccaacacacatcgtcacttcaccctcaactagtctctgtttattctgtaactcctgtttcgagttactaattattagcaaccgaacaagtatcaantactcaggggctactataaacactagtaaggtacacatcaataacgtgtatatcacatttanccttgttcactttgccatccttctntccaccaagntattcanggcattgccgtttccagtgaccatttcctttgaagtgtatcactcagttcaggctttgngccaacnttgggcttcttccgggagtgaaaactgcttgtcatccagtcangtcccntgtctncttnngccttt

SEQ ID NO: 87606 - DNA, 383 bp, Triticum aestivum
  unsure (1)..(383): unsure at all n locations
  Clone ID: PAT_TA_87606
ttaccatcatgcagttctctgttgtcttggataaagtgtaaacaaatagtttaatttccatctttggacccattttactaacaatctttatcagcttcctcacttgatgctggttcatcgatatctcattgccccatacgcagaaagggtcgaagcgcggatctttaccaatgacatatgtacctaaangcaccaataatagatctaaatagcaattgcacaatgatgtaggtacaacactcttttataatatcttataacatccaatatactcacatattanatgaattaacatcttatattatggcctgggaaggagtttantgnattccttacaaattancgggctgattaacgcctgttgtgtcnatgggttanaatta

SEQ ID NO: 87607 - DNA, 392 bp, Triticum aestivum
  unsure (1)..(392): unsure at all n locations
  Clone ID: PAT_TA_87607
catttctggacaggctctatatgcccactctccatatatcacttgccttctctcttttgggccatgcacattacagcaacaacaaataaaaaatgaaacgaactcatgaacacatgtttacgtcaaatgtcgtggtggcggtgagacctgcttagggtgcccgtcaccggtaactaaggtaagaatcttgtacttatacgaccgctggagatctgcgactgcatgggtccggatatcagtcttgactccactgcaaactcttatcatgtaaacccngctttctcaagtttccntaantcttcttctactacaacaaaactgttaatcctctccactgcangcaaaactggtnaatncttcttcaatgganacgtaactgtgggnccaanccg

SEQ ID NO: 87608 - DNA, 430 bp, Triticum aestivum
  unsure (1)..(430): unsure at all n locations
  Clone ID: PAT_TA_87608
ttagcttcgatgcttggcaatatactagtttttgccaagactaccccactaaacgaaaaaagttacgttgtccgctgccgaatgaaatgctaacagcaaaaatggaaaactacagtggccacgccaagcatatataacattggggaggaaagcaccccgcatcaggatcacataaaggagttaaaacgatcaaaaaagtcatgttcccgaagtcacttccatttccttctccataatcttcctggattgaatttatgcattggaagtttgaatgaatgttgggttgacacgcactgtaaattgtgctaactcctantccngctaatgaaatgttttactgcctgggaatcctggctngctactaagtttccccctcnaaactaaatggaatgatactggctcagctttgacttcnaanaaaaaaaaaaaa

SEQ ID NO: 87609 - DNA, 243 bp, Triticum aestivum
  Clone ID: PAT_TA_87609
agaagggttgcttgcaaacaaaataaactgatgtccatgtagtgcaactgtttgtttctgctcgagttatattatgttccttgtgtagcatgtatattctccctgttgtatgaggggtttcctgcgtatttaccatctatatatgtatatatgtactggccattggccccgaggaaagacaagttgcatatttcctaacatggtattagagccctaaggtttctttttccgaaaaaaaaaaaa

SEQ ID NO: 87610 - DNA, 335 bp, Triticum aestivum
  unsure (1)..(335): unsure at all n locations
  Clone ID: PAT_TA_87610
gcgccacctgctgctcgccgtcaggaacgacgaggagctcggaaagctgctggccggcgtcaccatcgcgcacggtggcgtgatccccaagatcaacccggtgctcctccccaagaggaccgcggagaaggagggcaaggagcccaagtctcccaagaaagcgaccaagtcccccaagaagaccaccaaggcttaatcgacgcgttccatgtccgtaaactgtcntantgttcttccgtaatggcccggtggtgttcctgtattgtgttgttttancntgttgngtgcatgtttaaatggggaaaattcaagaaatctcctccnaattncccaaa

SEQ ID NO: 87611 - DNA, 613 bp, Triticum aestivum
  unsure (1)..(613): unsure at all n locations
  Clone ID: PAT_TA_87611
gttcatcggcgagggcaagttcggcaaggtctatctcggccgcgagaagcagagcggctatgtggtggcgctcaaggtgacatacaaagcgaagctgcagaagtaccggttccacgcgcacctgcggcgggagatcgagatccagcatggccttgaccaccccaacgtgctccgactcttcgcctgggttccacgacgccgagcgatcgtcctccgtcctccgagtatgccgccccgcggagagtctacaagtcctccgcagcgtcggccactctccggagcggaccgccgccacctatgtagcaagccttgctgggtgcattggcgtactgtcacaagaagcaagtaattcacagggacatcaagccggaaaatttgctcccttgatatccaaggccgacttaaattgcaaactttggatgggcgntcatnaaatgctaaactcacaactctgtggcacaatagattactggcacaagagatggtanagaaaaggtcacgattacctttgacactggacttaggaatctgtcacaattttgtaggccncancnttgaactcagaaagnagatacctgatagntatcaaatggctcgtcctaaacanaanang

SEQ ID NO: 87612 - DNA, 374 bp, Triticum aestivum
  unsure (1)..(374): unsure at all n locations
  Clone ID: PAT_TA_87612
ggggaggatgtcgtggcagacgtacgtcgacgaccacctgtgctgcgagatcgacggccagcacctcacctccgccgccatcctcggccacgacggcagcgtctgggccgagtcccccaacttccccaagttcaagcctgaggagattgctggcatcgttaaagactttgaagaacctgggacaccttgcaccaactgggtcttttccttgggaggcacaaagtacatgggtcatccaaggtgaacctggggttgtcatccgaagaaaagaagggcaccggtggcattactatcaaagaagaccggcatggcctgatcctgggatctacaatgacccataccctgggcaatgcatttggccntgnanagtccgg

SEQ ID NO: 87613 - DNA, 307 bp, Triticum aestivum
  unsure (1)..(307): unsure at all n locations
  Clone ID: PAT_TA_87613
cgtcattctcagatttgaagaccgaagaagagtttctctttaatcttgctccattctcttcaagattcgtgattctagcttgttgccatcctctcataattattttcgattgtgggaattcttttcacctattcggagcaaatcaagagtcttctcagtttgttatccggagttcatcaattcagggttattcattctcagctttcagctctcgttctccaaatcttactggtgcatcgttcaaacattctcttatcagctcgtgatctttttgttctcatgtatctagatgtcccanggtctncgt

SEQ ID NO: 87614 - DNA, 333 bp, Triticum aestivum
  unsure (1)..(333): unsure at all n locations
  Clone ID: PAT_TA_87614
ttaacccttcaatacaattttgctcaatgattttctcctgaacttttaaatgtctccagaaattggcaggcacctactagtgcagttttgcctaatgcaagtgtcccttcaatgcagtgcagatctttcaggatgatgccaattctaacagctaccatcacttgctcatccaagaagaagcaacgacaaatacactgaaccacacttctcgttcagcacatgctgcacaatgacaagccgataactgaattcacaaacaaacacccatctaattatgcaccctcaaattaggggaacagcagtaattttggatgcgccggctgancnacctac

SEQ ID NO: 87615 - DNA, 622 bp, Triticum aestivum
  unsure (1)..(622): unsure at all n locations
  Clone ID: PAT_TA_87615
aaggcaggcgtcctccgtccctctgtcctcgccgtccccaacctctcgctgcaaaaggttgcttgtcatggcatcaaagcgcatcctcaaggaactcaaggacctgcagaaggacccgcccacatcatgcagtgcaggtcctgctggtgaggacatgtttcattgggcaagcaacaattatgggaccccctgacagtccctatgccggcggtgttttcttagtgaacattcatttccctccggattaccccttcaagccaccaaaggtatcttttaagacaaaggcttccatcctaatatcaacagcaatggaagcatatccttggatatccttaaaggagcaatnggagcctggcttttgacatntccaagnccttgctcctccnactgctcccctngctgaaccgttcccaaccngatgatcccctggttcccnagattgcccacatgtncaagacggaccgncnaaattacaaacganagccccaactgggaccaagaatacccaggggtttaagaaactgcatcctggnaatgaaagtcctcaagaaaatttatggcatggtctccattgtgcggtggtgtatcgtccaagatgaaatnatcgggtcggctacataat

SEQ ID NO: 87616 - DNA, 606 bp, Triticum aestivum
  unsure (1)..(606): unsure at all n locations
  Clone ID: PAT_TA_87616
gcaaaccctcgcccaaatccgccgaatcccgcggcccaggaaccaaggtagatcgatggcgaagagctcgttcaagctggagcacccgctcgagaggaggcaggcggaggctacccgcataagggagaagtactctgacagaattcctgtgatcgttgagaaggctgggaagagtgacattcctgacatcgacaagaaaaagtacctgggtccctgctgaccttacagttgggacattccgtgtacgtttgtccgaaagcggttcaagctcaacgctggagaagcgattcttcacttttggtgaagaacactcctcccaccgacaagtgccctgatgtctgccattttatgaaggagaacaaggacagggacggttccccctaacatgacctacagcggcgagacactttcggntgctcctaagatggcgctggtgccnacggaatcgctccngatgctcctggtaataagngtgccatcaactgggtaanaccggtttgccccncctaggttcttaaatgnacnacaagaaaactatcgtnccngattanctattcatgtctgactaataatangtnagtacgancaatccgtaaaaaaaaaaaa

SEQ ID NO: 87617 - DNA, 352 bp, Triticum aestivum
  Clone ID: PAT_TA_87617
aacaagctcagcgtgagcgccaacatgccaattatgggcggcacagctagctacgtcacctccgatatcttctccaccgactgcaaggtcgcccgttttggccgcgcttcaggaatctccatggtcactggcatcgccacttaagcaccatgcccgacggctcagctctaagctagtgtcttaacccgacatcctagagttagctgacgaataattaacacctatctgcgacaacaggctgctaccaccatgatacacacgatcatgtcatcttaatacacacacaagcatatggtatgttcaattgattttcaaatgaaataaaggattcacccaaaaaaaaagggggggc

SEQ ID NO: 87618 - DNA, 503 bp, Triticum aestivum
  unsure (1)..(503): unsure at all n locations
  Clone ID: PAT_TA_87618
acgacatcaccaacgactcccccatcgttggcctcgccgccggcggcctcgtccacgccgccgacaggacaccacaggcctccaccgctggcgccaagaaccgccccaggccccgctgcacgcccggctctggcgaggcgctgctgcgcggccaggtcaagacgctcctgcagaaggtcgacgaggagggcgctgccgccgccgtcatcaggccggtccgcatccacgcgctgctcggcgtcaccagatcgccggcacagtcctcgcgcccacgccgttcaacacgccgcagctctgggccgatccgccgcccgtggggatccgcgctgcctgatggccggaccgtgctgccctgcgtcctggagcaagangaactgattcctaagctgcaagtaccgatctccgtcctaactccgtgaacaatcaaagatcattttgtcaattcgttttgcttcttatcaaagtcaaaccttgcattgtatgatatcaanaaaaaaaaaaaa

SEQ ID NO: 87619 - DNA, 637 bp, Triticum aestivum
  unsure (1)..(637): unsure at all n locations
  Clone ID: PAT_TA_87619
gctcatctccccctaccccgacacggccgcctacatggcccacatgtcgctcgccatctccaacctctcctccctcgaggccttcgtcagacaggcagacgcgctgaggctgcagacgctccataggctgccgcaggtgctgacggcgaggcaggcggcgcggtgcttcctcgccgtcgccgactactcgcagcgcctccgtgcgctcagctccctctggctggcgcggccgcgccaggaccagcccgccccgcccggcgccggcggccggctgttcatccatgaaatcctacatgcatcgtcacctggccggccaactagctagnatatacacagcatagaagaaaaggtaatangtttcaagatagagtgtcagatatggtgatcatttcttgcccttcgaaagtggttggnagtactcnggnaattggtanaatataagagaagtttaacgttcaactgcaattggaatntaaaaataagaangacatccnacgnaatcgtggtttgaatctggatgatcngctccaanatgtaacaactatgcaattacaatcaagatccnnttttgtaaaaaaaggggccgnacaatnccaaaggtcataacccnnaggctctttaatcganngaaactgtt

SEQ ID NO: 87620 - DNA, 642 bp, Triticum aestivum
  unsure (1)..(642): unsure at all n locations
  Clone ID: PAT_TA_87620
cttgggcttgcgaggcgttcacccatcagcatggacaggaactcgtgcagaaccctagactacgatggtgctggcgggtccttatgatcaagctctggaaccacggcctgctgaacggccgcaccatgaacatctgcaacaaacatcttgaggtcttggaaagccaacgcgccgaccccaagcaatcttgacttggcaggaaacattgggcaggttgagcagggccggtcctcggttcccgccgacggtccaggcgccaatgcttgtggcctggtggggcgacatgacacacttttgatttctggcatcctcgtcgaggctcgcagagctacacccgagggcatgatctcttacattggggattaaattgggttggccgaatcggcaaatgttgttgttgttgttgttcnatttggataatttttcaattctantgatttgtttcaagcattgcttgaaacacctattaacattgggaccggccgcggatcccgggtgatggaaacacaaaaatggggggtcgtttattggacggtgncggacaacaaagatggngatacttttacangggcaacatataaattgtnaaattaaggnantttgggggccggtncaattcccaaaggnnctatacccccacgg

SEQ ID NO: 87621 - DNA, 440 bp, Triticum aestivum
  unsure (1)..(440): unsure at all n locations
  Clone ID: PAT_TA_87621
gaggcagcgcaatgatccgggcgtggccagaatgttcagattcagagagagcagagcgtaccagcacggctcaataattcgggccctagcagcagcggtaaattcctttctactgttccgcggcgccaccagcatcacggcccgcgtcgtggccttttcggccttctccgacgtgctctgtgtgctgcagcaggtaaaccaaacaaaaccaaacgacacgggggaatggtcagggcaggagtgtcgcggacgggagcaaactaatctgactgtttcaacgggactaccactagtcagttccaagcaaaggaaagcaaagcctctgttgactgccgtagttctacttctatatccgtgtgtatgccccgataccaatgatggcgagaacaatgcactgtaaacaccaacacaactgcgtgcttatactgtaaaatatccan

SEQ ID NO: 87622 - DNA, 285 bp, Triticum aestivum
  Clone ID: PAT_TA_87622
ggctctaagcgattgcccgatgcattacgaaggcgataggctcctcaagtgagaacttcatctataatgaagggaccctcccatttgggcttgagcttgtcccttttcttctccggtaggcatagaacgagttcaccgacattataaatcttggcccgcacttctctgctttggaatcttcgagcttgttgttggtagaatgtggaacgagcttttgcgacatcgtgctcctcctccaaggccatctaagtcatcttgccgatcgagctcggcctctttctcctc

SEQ ID NO: 87623 - DNA, 525 bp, Triticum aestivum
  unsure (1)..(525): unsure at all n locations
  Clone ID: PAT_TA_87623
gcaaggaggagattgagcgcatggtccgcgaggccgccgagttcgaggaggaggacaagaagatgcgcgagaaggtcgaggcccgcaaccagctcgagagcatcgcctactccctccgcagccagatcaacgacaaggacaagctcaaggacaagctcgaggacgacgacaaggaggccgtcgaggccgctgtgaaggaggcgatcgagttccttgacgaagaaccccaacgccgagaaggaggagtacgaaggaggcccgccaagaagctccagagcatcaccaacccatcatccagaaggtgtacggcagcanccggctcggccggcgaagggcncggcggacnatancgacnctcaaccgacnattgtaaattgaagggctgaacggaancnaaaattgaagacnaaaattantgnaaggttnaaaaaaanttgtnctncagcncncanaaaaattggacgtttaacggtcctcattgtaanataccgtggttttccccttaaaaaaattttctttattcgg

SEQ ID NO: 87624 - DNA, 606 bp, Triticum aestivum
  unsure (1)..(606): unsure at all n locations
  Clone ID: PAT_TA_87624
gcgcaacctagtccggcggcacgtatgggtcctcgtaactgctcttcgagtgagcgtcctcggggggcggcgactcgtcgtcggcacgtgggcagaccggcggcgccatggcagagatttgagagagagagagagagggcgagcgaggggaggatgtagatgagaatgcaggcgggacgacatgagcaaggtagtatttattggcggccggaatctagatcgataggaacagtacacacgccggtcaccggaatttccgagtactgtagtttgaattacacacgattcccgcagcaaaatccatgtgtgcacttaatagctgacggtttccaatacagaaccgtgtctgattaataaccccgccactcacctaccaaacctcaagctgcgaaatagatgccaatcctgtggtgggccggtgtcctgccagtctttacatttcctttttgaacacanatattacatcatctgatgattttaaccncacacaagtacacaaaatatgattttaacgttatggtagcnttcatgtaatgtagtaaattgatacgncataatggcnnaaacactaattcttaaagggaaanaccaagattcaatttaana

SEQ ID NO: 87625 - DNA, 658 bp, Triticum aestivum
  unsure (1)..(658): unsure at all n locations
  Clone ID: PAT_TA_87625
acatgatcgaaccgaagttagctggtaccaaatttctataaggtttttgtaattatgtttatgttagaaggtttagatgccatactctgcatggactgttactaaaagaaatttccgttgttcttaggtactaatcaggttaatgacgccgccgaatagctgtcgttggctataatgtgattaggtaccaatcctgttattaaagctgttatggtatatgctgctgctacataattatactcttatgtggtcagccaagtgttcttctagatctacctttgtgtaatgtataactgaagtacgaccattttcttgcataaactaagcatactaggaagaatacaatgccaaaataactgttaaaatttgtgcggcaagagtaaattgccttttctgtgctcaagagtagattgctacaacagaatgtcacagcacaatccaaagtttttgtgtgcagctgtcaagccttaagagtaaatgccttccgtcatccgttggccgttggttgttctggnggtcaaaaaagacctggaagttgtctgcaagganccncttggcagacattgggtaaaaaacataatgactaatgataaantaaannctttgatgagcctcagangcacncagngcatcatagcacccctaaggcaacccnagn

SEQ ID NO: 87626 - DNA, 212 bp, Triticum aestivum
  Clone ID: PAT_TA_87626
agatgatcggtgtgcatttacagaaagttgatcgttcgcttggatttgtgctctctgtcattttcggtccagtctcccattagatgatcgttgtttcgctagatgcagatgattagtagtgtacttgcactaaaatgttacccaggacaatctcaaaacaaaggccaagcagcaaaactgcaattacggtgtccttttttaaaaaaaaaaaa

SEQ ID NO: 87627 - DNA, 655 bp, Triticum aestivum
  unsure (1)..(655): unsure at all n locations
  Clone ID: PAT_TA_87627
gaaatacacataacataattggttttctttcccacgttatttgcatgtttgtgtgaaaatatatacagcatacaactactgcaggtcacacacatcaacagttaaatggagaacatatttctagactcatgttacttattacatagttgaaggatagctattagaccaacttgttttcataatacaattatgtgtcattcaaatagcaatggtctcctggaagtcacaagatcggaagtttatttcctaagaagatactttcctttatcaactaacacacagatgaccaaccccttggtatgccattnaaccctaagatttatttcacagcataccctccttacagtgctggacaanggttccttcaattgcttccaacacagatatataagcagcactgtacccataatagttagatatctggaggtaactttccattnatgaatgtccataacattcctccctgggattggcatccccattggaagactaagatcaatttcctgaaaccaacataggctacaatagggtggatataccaangatcaagttgcaacaagcaaacntaanagggcactaancaactaaatagggtacaaccacgacgggtacattnctcaatcaacaagcattangctcaaattcnttctcaata

SEQ ID NO: 87628 - DNA, 597 bp, Triticum aestivum
  unsure (1)..(597): unsure at all n locations
  Clone ID: PAT_TA_87628
ccacaacgtgctgtcgtccgagatcccgagctcgctggggcggtgcacgaagctagtatcgcttgggctgtccacgaaccagctgaccggctcgatcccgccggagctcggcgagctccggtcgctccagacgctgacgctccatgataaccggctcaccggcacggttccgacgtctctggacgaacttgtcaacctggacatacctgtccgctcaagcaacaatccctgtctggccggtgccggagaaatccggggcntccgggatctccnggaagtcatcaatccaacagaaatcgctgtccngccaatttccgggtgaagaataaccaactgnactttgctntcnaaacgcgagnaattcaatcnaangaattttnaaaggaacctgccngctggcttggccaattnaaggnccccntttttttnnagggggaaaaacccccnnaangaaaatncnaaggactgccaaanggttaactcggaanctggcctaacaacaaattnaaccggnggctgtggaaaatnntgccttnaaantgnaaaattnagttaattncagaaaacatttccaacatatnttataaaaaaaaaaaa

SEQ ID NO: 87629 - DNA, 631 bp, Triticum aestivum
  unsure (1)..(631): unsure at all n locations
  Clone ID: PAT_TA_87629
ttttttttttttgcaaggacaattcatcacaatgaaaataattgttgctatgttatcctagtttcagacatttctttcaaggaaaaagcactgcagcttgattcaagcatagctgtcttgactttatcgacaaggaaaacactttatgaagttacaaaacacggaagcctgacaaacggagtgggaccagaggaagccatgaatagcatcacctttcatttaatccccggagccagcaaacacatcaacgacccacataaatccaccattggtgatgggggactcctcaagaagtggcgctcccacaatgcgctccctttcaatcccaactcccgaggcagancanccgttatttgatnnacttcatctcccanatcctccctgtgaggcactctccngcttccgtccncattccggggaacatcaaatcncncttttggggtccgacgttcccaaagagtttgcaactacagaaatcagattcggngcnccgcgtgcgtgttgggaacnctccgttggcactcatacaaaataaggtgggtgggacacaaaaagngttctcacaacanaggangancatgagctctcccgcngaactgantcttaaccaaatcgcccgattgcnctataa

SEQ ID NO: 87630 - DNA, 507 bp, Triticum aestivum
  unsure (1)..(507): unsure at all n locations
  Clone ID: PAT_TA_87630
cgggaagctattgtgccgacactacagggatcctaaaatttactgcttaattttctcgccattatttatcgtctgggcttataaaaggagacaccgaggctctcgtccagccatccttgaaatcgccactgcgcaaagtgtataacacattttttttcagtcggtatgagtttgccttgctcggatcaaagcattaggccgaggaaaatgaagaacgcaatttgcctcctgggggtggcatcctgcgatgttggtgtggcgatctttgcaaggtgaaggangtgacggatttcaagatggttgggcatgaaattttcaagtgcgccaatttatgaggaagattctgccgcaactattcnagagtacgacaaacctccgtctcctccgcctccgtgcaatgtacaacaatgggattgacacggaaaaccaacttggcaatgacggaatcntgaaanaancccntgtgtggaaaattatttgcggaanacacccanaagnggaactagg

SEQ ID NO: 87631 - DNA, 448 bp, Triticum aestivum
  unsure (1)..(448): unsure at all n locations
  Clone ID: PAT_TA_87631
gcaggctccaccagcctcatgaaggcaacgatgatcagagagtggagcagaaagggctagcagctagatgtgtcgttatgtaagatacgcgcattgcaatgtacagtgttacactgagtagcatcagaacgcagaagctgaggaaacccaggaggaaacatgtaatttgacagtccgctagtccgctacttggatcgaaactgctctattgccgaaataaaatgccaatgactccgttaacaatcctgcacagtgggtgtaaccctttatccctcattttaccaatatccaagancatgtgcttgctgttcctttccggttagtccttgggacttctttcctnatcattccatgggtttcaatcaanggaaccactggtttttacccacaagactgcaaaccagattccctaatgaacatatccatttatgactttcctagattccca

SEQ ID NO: 87632 - DNA, 499 bp, Triticum aestivum
  unsure (1)..(499): unsure at all n locations
  Clone ID: PAT_TA_87632
gcaaggcgaagaagggcgtggagacgtacaagatctacatcttcaaggtgctgaagcaggtgcaccctgacatcggcatctcctccaaggccatgtccatcatgaactccttcatcaacgacatcttcgagaagctcgccggggagtccgccaagctggcccgctacaacaagaagcccaccatcacctcccggggagatccagacctccgtccgcctcgtcctccccggggagctcgccaagcacgccgtctccgagggcaccaagccgtcaccaattcacctcctcctagactgacgatgcctcgcttgtttgtgacagatgtggctgnctgatgtatccgcaattagaattataattcgtgtggtagaagattgccaacctttgttggcttctgggttgtgagaactgaactgttgctttgcaaacggaaaccatctaaaaaatttgcgtggtggacaacnaatccgtgacaaggagttcttacaaaaaaaaaaaa

SEQ ID NO: 87633 - DNA, 626 bp, Triticum aestivum
  unsure (1)..(626): unsure at all n locations
  Clone ID: PAT_TA_87633
cccaactatctgcctctcctgcattcttgtctcagcgttgtgtcggctcctgcaacgctgcttctaacttctttgtctgtgttacttataagaagggtagtgcgaaagtacaggaaacgtgtgtgccggtttcgatcgaatggcttcttcaaaactacaagccttctggaaccaccctgctggccccaaaaccantcattctgggctccaacatttaaatggggaatcaagcatagcaaacgttgccgactttgctaagcccatgaaaagatacctatccacagcaantattatgcttgnactggaattaattgggcacgctatacatggttncacaccggaaagattacttctcgggngctgaaaaggaaggcgctggcggcacacgggaacgggaatttacaacgggaccganccacttaataaccnacggaaangggcctgtgcctnggatccnttaagtcatccgggccgnggaaccaanctttcttcaagtcaaanacattattccnctnatanacggtggcaggaaccaaattttgaaaccagcattaaaacggttganatanacngtgaaaacaantttgcaagtaatccaacgangncnttactgtaaaaaaaaaaaa

SEQ ID NO: 87634 - DNA, 394 bp, Triticum aestivum
  unsure (1)..(394): unsure at all n locations
  Clone ID: PAT_TA_87634
gcctggcgganttcgcgcccggggacnaggtgcgcgtgctcccgacgtgcggccacggcttcnacgccgcctgcgtcgacgtctggctgctttccaactccacctgcccctcctgccgccgcgccctcgtcgtcgcggctgcccaatttgccagcggtcaccgatctccccctcctcaaacgtgctgttcccgccgccgacgccgtcgccgctgnacaagcctccggccgtatggnaataagcattatgctcccaacgtacatatacgacataccatgttataatggtcganacgtacacccgtngaaatgcaaactgntcagcgtgcgacgatcacacttgataagtgccggtacatttcctcatgtgttaatacttgtcatcacttaanttn

SEQ ID NO: 87635 - DNA, 551 bp, Triticum aestivum
  unsure (1)..(551): unsure at all n locations
  Clone ID: PAT_TA_87635
gtcatctcattggaagatggtacattgaagttcctcagcttacctacaatagccaatgatgtacctgtcaccggaaggccattcgctgggactaaaactcagggcattcatacttatcaattatcagaatatttgatatgggacgtccatgtctcaagaaattacaggtcaagcagcttattgcgtgggtagatgggtactgctgtgcgcttccagcttactaagagatctgggagaagaaacctgggaggaacgtgtaccttaattcctctgtgggtcactngcaagaggaggggacaatcattaaagattggtggcacattgcaaagtctcctttatcgaatgttcccctggtcacgaaaaagggccaaaacatgccaagatgttgattaaacggacgacatgttgaaagaggactacggcctcactaatcanacatgtnnatcanaatcaaagatggtgaactanatnaaggccgagaacaatgcccaattaactgatcnctaagcaanaaatgtggatcacaacggcaatnatgaaangctaataca

SEQ ID NO: 87636 - DNA, 576 bp, Triticum aestivum
  unsure (1)..(576): unsure at all n locations
  Clone ID: PAT_TA_87636
agaagatgaacaagaacaagaagcttgtcaagaggcttgccaagaagtaccatgctttcttggcctcggaggctatcatcaagcagattccacgtctccttggtcctggtctcaacaaggcaggaaagttcccgaccctggtttctcaccaggagtctctggaagccaaggtgaacgagacgaaagcgacaatcaagttccagctcaagaaggtgctgtgatggggcgtcgcggtgggcaacctgtcgatggaggagaagcagtccagcaagaacatccaagatgagcgtcaacttcctggttccctgctcaagaagaactgggcagaacgtgangtgtctgttcatcaagacacatgggggaaagccggnccgggtgttccnacccnntgcccctgccgccctatacaatgctacctacaatactgggactccttacaagttcaacttaaatagtcnactgtcgtanttttatcgaatttgccgttcctggtaatgaagatgatgaaaacatacgtttccctgacttgatctgagggaaaaattncacaagtatcatacgtntaaaaaaaaaaaa

SEQ ID NO: 87637 - DNA, 651 bp, Triticum aestivum
  unsure (1)..(651): unsure at all n locations
  Clone ID: PAT_TA_87637
ccagcaagcgtgcctttgcctactttgttctgagtggtgggagattcgtatatgcatcactgctgcgtctccttgtcttgaagtttgtcttgagcatgtcagcaagtaaggatgtgcttgcacttgcttcccttgaggttgatctatccagcattgaacccggcagcacagtgactgtcaagtggcgtggaaagcagtcttcatcaggcgacggacagatgatgacatcaagctgggccaacagcgtggatgttgcatccttgcgccacccaagagcaagacgctgagcgttttgaaaaccaagagtggctggttgttattggggtctgcaccatcttgggtgcattccccttcccaactcctgggaacttgggtggctggtctgcccgtnccatggtcccaactatgaatctccgggcaaatccgcaaggccctgcccccgttcaacttnnagtgccaactaaattccttgggaaatacaaatctcaatagctaagacctaaacaatactaccgacatatatcccgaangatgatctgtgcncgtaattgttnatgtggcagantttgttcagacatccaacgggtcacgtacacgagtcattatcaanaatgttnccagtcacgatgnattgttaacgattcgaacnac

SEQ ID NO: 87638 - DNA, 580 bp, Triticum aestivum
  unsure (1)..(580): unsure at all n locations
  Clone ID: PAT_TA_87638
ctagtggagtgtgaaacttaccggttcagaggccactctcttgctgatccagatgaactcaggaggcctgatgagaaatctcactacgctgcaagggaccccatcacatccttgaagaagtacatcatcgagcagaacctcgcgtctgaagcggagctgaagagcattgagaagaagattgacgacgtcgtcgaagaggctgtggagtttgccgacgcgagcccgctgcccccacggagccagctgctgggagaacgtgtttgccgntcccaagggcttcggcatcggccccgacggcaattacaggtgcgaggacccaattcactcaaggcacggcgcaatctaaggactccaccgcagaagcacttgtttacccttgtttctcatgtactactctccaactacctcaanccctaatttgtcgaaccgcttcgattctgtgttgttaaagcatatacacgtatcaatgcccctgtcaatgcccgntccgatcccaatttttnaccagaattcccnattatgtcaataancaaacaacggttgnanatggaaaantgaaaattaccttaaaaaaaaaaaa

SEQ ID NO: 87639 - DNA, 627 bp, Triticum aestivum
  unsure (1)..(627): unsure at all n locations
  Clone ID: PAT_TA_87639
cattgttgtcaacattggcacacaggatttagtggaaggaaggttttgggccatcagatttccctgagaatcaagggaaaggaagaggaaaggaaaatgttgatacatgctctgttgcaagtgttcacgtcgcgcagaaactacaatgaagttgtcggggagaagatccantgaactcngctacatcnggttgggtcaaagtgactgtaattcgcaacagcagtgccacggtcaattcaacatggggaccaactactccacaatgtccatccctacnggtctcctgactgtcaaacaagaagacatggtgcaactaactactgaaaaggagatgaccttggccccttgacaagaagagatgacgaaagaccaacaaacaaactttgcttctccatcctcaatnacaagggantcccaagatggcaagtttntangaccaancactggaacacaaatggtgactttacaaacccncttgcaagatnaattacgnaacnggttttttttaaagggtncanaactggaatgtataaagaagtnccatancggtgtcaaangtaaatttcccatacgngttcaaatngtggnatcccnttctaaataaganatncccccaaaaaaaaaaaa

SEQ ID NO: 87640 - DNA, 641 bp, Triticum aestivum
  unsure (1)..(641): unsure at all n locations
  Clone ID: PAT_TA_87640
gcctagtagactgccttttattccagtgactgatgtcgcaggagtaattgttgatgttggtcccggagtgaatggtctcacagcgggtgatcaggttgtcgccaagttgaactctcttaatggaggtggacttgcagagtacgctgtagcatccgcaaacctgactgtcaaaaggccagctaaggttctgcagctgaggatgctggcttcccattggctgcaagcactgcgctccaangcgctgaggccattnggagccaatttngacagcaccnggcagctctcaaagtgctgattaccgctgctccngtgggtttagcctgttaccccgtgcaactttcaaagctggnaccttcaantttaccgcaactggcgggccccaaatgntntttgttaaaaaccttggngcaaacaagtgatggctaaaagaccccananggacgaccttcaaaccctcctngcgggaataacacgngtgntcaacgcgcaaccgttcaactggcctcctccaaccctnccgaattacctggaaatgtanananaaccgaaatntaacatannaatatntctgacaggtaaanttcaanaagccnccgnccaaggtcnttcccaaaaaaactgggtnttggcngttcccaaaa

SEQ ID NO: 87641 - DNA, 437 bp, Triticum aestivum
  unsure (1)..(437): unsure at all n locations
  Clone ID: PAT_TA_87641
gtgatcacccgtacatcaacccggcggcgtcgccggaggagtggcgccagctcgggtccggccgcgtgctggtcaccacggcggagttgtgctggttcgtggagagggcgcgcgcgtacgcggaagggatcaaggcntgcgggtgggccggcgagctcganttctacgagaccaagggcganagtcacacctacttcctgttcaatcccgactgcnacnatgccgccanggagctcgccgtcgtggccgncttcgtcaggcgctgctgactctgcttcgcttgctcatccantgagtgattgtgattcagtaataaatgaacacctacngtaatttctacgaagtccgtaattgattgcacttnnaagtgcaacacgnnccgaaacantttttgctcctctgaancagttgctaactgcngcttctctnnatagttg

SEQ ID NO: 87642 - DNA, 637 bp, Triticum aestivum
  unsure (1)..(637): unsure at all n locations
  Clone ID: PAT_TA_87642
gggtgctcgtgctcgtgttggtctgactggtttgactgttgctgaacatttccgtgatgctgaaggacaagatgtgctcttgtttattgacaacattttccgtttcacccaggcaaactctgaggtgtctgctctacttggacgtattccatctgctgtgggataccaaccaactcttgccaccgatcttggaggactgcaagagcggattacgacgacaaagaagggttctattacatctgtccaggctatttatgtgcctgctgatgatttgacagatcctgcccctgctaccaccttcgcccatcttgacgctactactgtgttgtcacgacagatttctgagctgggcatttaccctgctgtcgatcctttggactcgacatcaagaatgctttctccccacgttctgggtgtggatcactacaacactgcccgtgtgtccagaaggtctcagaactacaagaatctcaggatacantgcaatttgggtntgatgagccantnaggatgataantacgttccntgaaggaagtcagaattccgacagccttcaagtnccgagtttcncgggcccaggaatattggtcaaggagggncnantcaagtgttggcgnaatcanaaccgacanctnt

SEQ ID NO: 87643 - DNA, 426 bp, Triticum aestivum
  unsure (1)..(426): unsure at all n locations
  Clone ID: PAT_TA_87643
ggccggtcggccatngangaggcggncgtggtgggccaggtgggcgtggcggcggcgccganccactgcccccgtggaggaggtggcaccgccagcagatccatttgccatgccanaggaggttctacatggagccaatcctgaactggtggtaacctacaatggcctggaagaactattcagactgattcacgagtctcanctggacctgtagatcnaacgccaaaggctggtgcggtcattcancangcagtctgttgaaccancccagnccctcattcaggcgtgcgttgatatcgcacttcaagagatgnaaaaggtcncagnactgggangagaccaggtnccgattcntnagctaatctctcagtcttcgggaactaagacctttcgtnggagtaatcagattgccataaacgtagcctg

SEQ ID NO: 87644 - DNA, 617 bp, Triticum aestivum
  unsure (1)..(617): unsure at all n locations
  Clone ID: PAT_TA_87644
gaggagtaacagcgaatttcttcatgtattttggagcacatacctgtactccctccactcttttgcccatctcctttctatcctctgaatgcgcaccttgcgctgattcttatcttcctcagggggtgtgcagtacccagcataaatgtcctcaggtatttcaaaagcagtattgacctcaggcctctttcctcctttatgtggctcttttcattagccattttcaggaattgaacaatggaaccccctggaagaagatgcaactttccttcaaaggaacgctgcaaatgantaagtngatgagaactaatgatcaagcagcggacatgattacctgtggaacagagtatagttgccaagaattnggagaaggcatagcgtccccaanaaggttttcaaaaaagaacaagnttttaggattgacaagatancttgnagattcactaagcgtcctgncctaagtccanatgtataancaagntcacacatngagganctgaagaaattatgctanacaaacaacagaaaatacagtagngttatgtgtagaatganaataacatttaganttgngaaattancaagngnagaagtactttatacctgcaaaancacac

SEQ ID NO: 87645 - DNA, 631 bp, Triticum aestivum
  unsure (1)..(631): unsure at all n locations
  Clone ID: PAT_TA_87645
agcccccgaggcgcggcctcaagccaaggccggataggagcaggaccagcgccgggtccgcgacccggatgcagcagacctagggaggagccggcgaggccacaagcggatcacgcaccagcaacctggacgcggcggtggatgtcgtgcgccagcagttcaacgacaaccgcagcggcctagagatctacgctcaggcgaagcggggccggatgcagctgttgtaggagatcattgcggtgaactcttgcccttccgtgtttcctgcgattttgcttgcttcctcctccttccgacatcttgggccgctttcaagtggggggcgcgccaacacacctaatgggtgtaaccctttaggcccgggcggtgcctntgctggcggtcaggtttaaagacttttctccttccaactttcttccctacaagaacnctatgacaananggcgnagctacaacgcctccactataaaaaaagnactacgtgacatttnaacnaacaaattttcgtcaaattatancttttaaaaaggggggccgtacaatcncctanatggtctatacccccacggcntcttaaagtcctgacnggaaacctggttaccacttatcnctgagaaacccttcaagggnt

SEQ ID NO: 87646 - DNA, 534 bp, Triticum aestivum
  unsure (1)..(534): unsure at all n locations
  Clone ID: PAT_TA_87646
aggacgaagtggcttcacgcatgtactggtggcagtcgacangttcaccaagtggatcgaagctaaaccgatnaagagcctcgacaccggtactgctgttagcttcatcagggaactggtattcagatatggagtcccgcacagcatcatcacggataatgggtcgaactttgactcagaggaattcagaaccttctgcaactcccaaggcacgcgggtcgactacgcgtcggtcgctcatccgcagtcnaatggacaagcagagcgagctaatggactgattctcaaggggctgaaaccgcgactggatgcgtgatctcaaacacgcggctgggagcttgggtcgatgaacttccatctgtgctctggggactgcggacaacgcccaatcggtcgaccggaagaatccatcntcttggtctatggagccgaacaatcttgccaagcgattttctccacaagcctcaaggggggggcccgggtaccaattcncctatagtgagnctntaccncctaatggccgtctttaaactc

SEQ ID NO: 87647 - DNA, 472 bp, Triticum aestivum
  unsure (1)..(472): unsure at all n locations
  Clone ID: PAT_TA_87647
aaaacctacatcatgcattagaactacttggcaccctataantttgacatgcaagctccagaacaggatcagggttagcagcaaagnaattcaataaataaggcactagaacaacaactaattggaccattggaggagtcgcataccgaagaacaatcccccaaaacagtttccgtgaatgaagctttgagcaaggcgatncgaaaatcgcagcaaaacgaagctagaacacgagtttgagctgtgtggtgattttttctgggaggaagacgaagtgtgtngggtgcangaataagtgaggggggggcacgttngggcccaanaggcangggcgcccccaanggggcctgaacctcntggccaatggtgttggccccgatgtgttcttagggcaaatattttaaatgtccncannaatcatattcnttttcnggactttgggnnactttattttggggnattttttttcngg

SEQ ID NO: 87648 - DNA, 630 bp, Triticum aestivum
  unsure (1)..(630): unsure at all n locations
  Clone ID: PAT_TA_87648
gcacaactttttgacgatgagcgaagcttacgtcgatcttcctcatcttatcattccaccttgaacaacaagcttgaagccgagcttgtgtcgtacgtggttccaatagcctttgcttcatcattccttttgcttgatgtcgttgctgctcgatggcatcttcatagagcctctcaacaaaatgtgtcgtgatcaccatcaatatactgccttgttctaagatatcaatcgaattcttgaggagaaataccatccttgcccgtcgatgattcgtgttgtcatcgacaccatccttgacttcctgccaatacagacttggtcatgttttgattatatcttacattccttgacattcttggaattgttcctttgtactcttgtgaccttcagatttaatcctgcttgaaacaccatgttaatgttaccttgaagcatgactgtggtacccgaacaacaagaacattggaagtgcantgccaaagttctgcctatatcaaacacgttgtatggtaacacatgaatccctgccctttatcaaatggngatgtactgtgatcaacagtaacanccnacttcctnggaaagaaacccaaactgngtnaanaatccctcaatggtgctaacttcgnn

SEQ ID NO: 87649 - DNA, 426 bp, Triticum aestivum
  unsure (1)..(426): unsure at all n locations
  Clone ID: PAT_TA_87649
ggccgtcgagctcgacgtcgccgccggagggtccgccgtcgnggcngcggtgcanagggcctgggacgcctngggncgcatcgacgtcttgatcaacaannntggcctccgatgaggtgttcattcntcactggattggtntgangatgantgggataaattcatcaagananaccttaccggattatggttcntcgccaancatgtatgtanacacatgcgtgatgccaagatnaagggtttnntttttaacatttcgtctgttgctggnctcaancgttgtaatctgcctggctcnattnggatacgnatcttcnaagtccgccgtgcattctgtnactaagataatggcttttgnactaaggngcatattgaantanngtgaacnagttgngcctggtatnnttcangttaganntaaactgt

SEQ ID NO: 87650 - DNA, 510 bp, Triticum aestivum
  unsure (1)..(510): unsure at all n locations
  Clone ID: PAT_TA_87650
gtacacngagcncattncctttcagaanagatagtttacaaaanccaagacccagaanaatatgttggcttggnaactgagtgcaatgaaccagaagcatgccaaagcactgaaccatatgacaacacttacatatnacataaaatatattctagagtctgcaacattaacaacaccaaagcaagctggggaagttgggctacantcaatttcaaaaacaagaggacaacgatacactttccttccnaaanttccttcccaaaattttntggaaaacgatcccctaaaggaggttgggacacaatttgaagtggttaanaacaacttggttcaacatacanttaccaatatcaaccccnaaacaaaggacctggggnaantttaagggctttgggaccaaccccanggnaataaaccttggggccccacaattgggggtccaggnanctccantgnatnccggttggggggaaaanagntggnaccaagnacttttatcccccttaaatc

SEQ ID NO: 87651 - DNA, 654 bp, Triticum aestivum
  unsure (1)..(654): unsure at all n locations
  Clone ID: PAT_TA_87651
acatagttttaaatagccggctatagtcccgctatagctgtttgagtatgttgcccctaaatgattccatgtacaatttgccgagcctatagcccagctatagctgtttttaagggtcgccgctaaatgccatagcccgatatttaaagcattgggttataaatccgtacaatacgatcccatccgcgtatatacataagcgagcctactcaacctctgcgtttgacgtgacagcagaactaaggatactacacgtagtgggccccgaacccaacgtaactgtgggcggagtccacggtatctggttccctggctgctgtatgttgcccgagaatgggacagccccgacgcccgacccgccaacccaagcaattatacgccgccgcccatctccaacaacagtcctcgcccgcagctcaagcgccgcgcttccgcccgaagtaaanggcacgtcngaacgcnaagctcgcataccancaggcgtacacttcacaggggggggccggtacaatcccctanaggatctataccccccaangccncntttaaantcngacnggaaaccgggtacaantaccctgaaaaancccttcaatggnaaaacaaaggccnacgntncttcaaatncnccaatgaatgaccccgtcgcatacg

SEQ ID NO: 87652 - DNA, 688 bp, Triticum aestivum
  unsure (1)..(688): unsure at all n locations
  Clone ID: PAT_TA_87652
acgccacaacaaaacaagtctagaactgaaaccacttcagaagagctcaagaaacaatancctgggtacccataatgctggcaagatgcttagcaagcttatgaactttctcttgtttggcacttaaatcctccagcacatgctattgcaccagaaagtatgcatctgaatctgcaaggactttctcatccttccggcttcatgtcgcataacatttgattcgatgtctttcnaactttgaagttngagcctcaaagaagctgaactggattcnaggaagcganttcnaaaagctgggtgccaagcagttagtagcaattaccccaacactacatccaagacaggatgtcccggggatataccccgcggcgttaaccngccgggaagttnacccaancaagacttgggcggttatcctgaagacccgctgacacttgggaattactggcgacccccctaactggcggttaaaaacaaccactgggcattatgaccacggggntccgggcacgganaatggnnacaaggcaagggcaaaaggcggtaagttaangnggccggtaagaaaaancaaggaantccttaatngggaaganatncccctntaaagnaaccanccaanggcnccagtacnccctcaatttagggggaggncccanggggaattgaattcnatnnaattgttaag

SEQ ID NO: 87653 - DNA, 354 bp, Triticum aestivum
  unsure (1)..(354): unsure at all n locations
  Clone ID: PAT_TA_87653
gcaagccagtgctaggaacgaccaaatcacatagagctagatagagctggtggcatttgtacgatttctttccaacatgagcaagccatgcgacgccaagacagagtggcctgagctggtcggacgcacgatcaaggaggcggaggagaagatcaagcgggaccggccggacctcaaatcatcattgtcccgggtaagaatttttgtgacaacagacgtccatttngaaccgccttcgcctcctgggtccacaccgtggcggaggtccccaaagatttggctaagctaacttnatttacctatcaactgggataaaagcccatcaatctccactttggtcaatttaattgggcc

SEQ ID NO: 87654 - DNA, 597 bp, Triticum aestivum
  unsure (1)..(597): unsure at all n locations
  Clone ID: PAT_TA_87654
tgaaggccaagattcaggacaaggagggcatcccgccggaccagcagcgcctcatcttcgctggcaagcagctcgaggatggcaggacccttgctgactacaacatccagaaggagtccactcttcaccttgtcctccgccttaggggaggcatgcagatcttccgtcaagaccctcaccggcaagaccatcacacttgaggtgggaatcctccgacaccgtcgacaacgtgaaggcaagtncaagacaaggaaggcatccccgcccggacaacaacgcctcatcttcgctggnaagcactcncaggattggaagaccttgctgactacaacatccaagaagganccancttcaacttgtcctccgccttaangggaagnatcaatttttcgncaaaacctcaaccgggaagacatcacactttaattggancctccggacacatttcaacttgaangcaaattcaagacaaggagggatcctccngacaacaanttcancttnccnggaacactggaggatggcgcaccttgctggataaaaatcaaaagggtcanctccactgngnccccncctggggcataatncccaactggc

SEQ ID NO: 87655 - DNA, 350 bp, Triticum aestivum
  unsure (1)..(350): unsure at all n locations
  Clone ID: PAT_TA_87655
ccatgacataggagattccaatttcagccagatccgactcacccatgttgctacttgggctgggatgctatacgccttccctgttgatgcagcaactccatgggaagaagataacagcagttcaaacgaaagcgcaaacggatgaaataaaacgatgatcgatctgcaccgctgcttctacgtgatgatcagttgtaccaagtatatatcaagcgagcatgctgctactaatcctactaatcaaactatttgctactgatgtttgcatgtagtangtttccacgtctaaaaacttgttataaatgatccgattttttttantannaaaaaaaacnncccnaggggggggg

SEQ ID NO: 87656 - DNA, 562 bp, Triticum aestivum
  unsure (1)..(562): unsure at all n locations
  Clone ID: PAT_TA_87656
ggcatgcatgggcaggtacgacgacgtgaaccgctacgacgagagggcgccctacggcaaggtggcgcacccatcacccgaacattttcatccgctgcacgtcgcgctcggcgccgcggaggaagggtccaaggcggagctgatccaccgtagctggaccaacaccaaccactccgtatgcgtcgtatcgtttcaccgccaagaactggatggccgcgagctgtgccgctcggtccatgccgtgtcaccttcacctcacagtagctggtntatgcaaccaacggcagctgctccaagaccgtgcctgatcgtactatatgtattgcttgtacactccttncgtcccatttattgggcctaaatgctnnaaaaccaactgcgctatcncttgttccgggaccccagatcggcaanccttgtattgcatgttctgaccatcnggtttttacacaacagatgatggantgttaaggacgccccactncatgggataactacgctccatgcatatatgtcnctattatcgtttattattttaaaagcaaactttaaaaaaaaaaaa

SEQ ID NO: 87657 - DNA, 512 bp, Triticum aestivum
  unsure (1)..(512): unsure at all n locations
  Clone ID: PAT_TA_87657
gttacaggaaaattggacaaataatgaggggcgtggctaatcgacatagcgatgggcaaatgttgattgtccaggaagggggttaccacatcagttattcagcatattgtctgcatgcgacactagaaggcgttctgaatcttgaaggccccattgctgggacgacccaaatccgcatactatccccgaaggatgaagaaattacaccatgggaagctgtccgacgtcaacgaaagaaacgctgggaaagaaccatccccttccttgaaagacattttnaaggacgccttactctcctccctnccnacgcaaacgggcaaacgacgaacctccngtcccccnatcatgtcatggtttgntatccccccggattaaaccgcactggtccaagaaaagatgacgcactcaatgttngatgacattaaattttttttttccctttggccctttaaaganaatgnatgaaaccaaattttccttgagcattttgtttaactgngaaaaaaaaaaaa

SEQ ID NO: 87658 - DNA, 493 bp, Triticum aestivum
  unsure (1)..(493): unsure at all n locations
  Clone ID: PAT_TA_87658
nccgcctccaaggagggcggcggcgagaagaggggccggaagaagggcaagaagagcgtcnagacctacaagatctacatcttcaaggtgctgaacnagntgnaccccgacatcggaatctcctcnaaggccatgtcnatcatgaactccttcatcaacgacatcttcgagaagctcgccggcgaggccgccaagctcgcccgctacaacaagaagcccaccatcacctcccgggagatcnagacctccgtccgcctccgtcctccccggggagtccgccaagcacgccgtctccgagggaacaangccgtncaccaattcactcctcttaattccatngctgtatccaatactgttcgccctgnttatcgccaattagaatantgctatgctggttcggatngctgaatctngcgatgccncctccctnttagaacaanattatgaactatgggccgcttttgaaactgaatttanaacgcccctaaaaaaa

SEQ ID NO: 87659 - DNA, 659 bp, Triticum aestivum
  unsure (1)..(659): unsure at all n locations
  Clone ID: PAT_TA_87659
taaaatgcaacattttattattatttttcgtgttgtctgaaggacaaggtgatatcctgattacattgttccatacacaaccaccacaagcaaacaaggatagtacacatgtaacttgtgatagagctcgtgctaatgataataggcatgtaacttgtgacattctattactagcatgtccgcgtgcggaattaaattataaaacaggaagtcatccttggactgtatgaaggaagataataanttccctggaatacacgccaagctccgaacgcgaccaaatatatgtccaacaacatacagggtgggccctgtcncaagacagcaagaaantaccaatcctgaatccaacgaagaaaaaaccaagtgcattcaaggacaaactttatcaagaanactcacacttctgtaganatccccatagccgttncatcaagtacacaaanactgagatcaacgttacacattagaatngtaaacattcaaaggnaacaagaaactagtgtcaagcacagaactcaactagtaaacacanggggggccgtaccaattcgcctaaggagtctatagccgctaacngcgtctttnantctacggaaaccctggtaccactacncctganaanccctttcaatggaaacaaggcnacntttcctnca

SEQ ID NO: 87660 - DNA, 669 bp, Triticum aestivum
  unsure (1)..(669): unsure at all n locations
  Clone ID: PAT_TA_87660
aagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccaatggcaagtgcggcaccaagctgcggtgctcctgctgcagtgctagttcatcatcgatcatgcatgcaccgtnccctngcgtgcacaacgattgtatcgtnctactactacatacatgttaccgcaacctgattcgaaggctttaagttccaacctgactgcatcaacatcaagtgccatgcatgatgtnaacaagcccctaaataaactccctngattaaaaaaaaggggggccgtaccaaatcgcctatntgagnctantaccncgctcatgggcgtcgtttnaantctgacnggaaaacctgcgttacaacttaacgcctnagaaatcccctttccactgggtataacaaaggccnaacgntgccttcaattccactatgaatngacccctnncgcataaccgngtttggaccatn

SEQ ID NO: 87661 - DNA, 364 bp, Triticum aestivum
  unsure (1)..(364): unsure at all n locations
  Clone ID: PAT_TA_87661
ggcagtcccgcaggaccttctgaggcaggcgtctatgcttatacaaagagtttggccaagtatagacagaagcttgacggcatggatcagtaagacggtaaccattgctttattttgcagcggtggtctgaggcatcctcacccgtccgaacatgcatttctcccgccaaagaagtgggttaacttcacatactattganaactgtactttnnaaatgtaagggtttgctgcatttggnacttcncccccngttcttttttaaccattgcactttttaacaaggaatnttnggaaaaatatnggcaacggcctgaaaanttaaacnggaaaaaattttgggcacaaagggttcacccctttttt

SEQ ID NO: 87662 - DNA, 422 bp, Triticum aestivum
  unsure (1)..(422): unsure at all n locations
  Clone ID: PAT_TA_87662
tgcgtctgcgtggtggcatgcagatcttcgtgaagaccctcaccggcaagaccatcactcttgaggtggagtcatctgacaccatcgacaacgtcaaggccaagatccaggacaaggagggcattcccccggaccagcagcgccatctttgctgggcaagcagctggaggatgggtccgcaccctccgctggactacaacatccaagaagganccaccctccaccttgtcctgctctgcgtnggtggcatgcagattttcgtgaaagaccctcaaccggaaagacatcatcttgaggntgggntcatctggacacatcgacaacttcaaggcaagattcaagacaaggaggattccccccggcaacacgcatcttttctgggaaacactggnggatggcccacctttnnggttaaaaatcca

SEQ ID NO: 87663 - DNA, 412 bp, Triticum aestivum
  unsure (1)..(412): unsure at all n locations
  Clone ID: PAT_TA_87663
gtacagatcatgggctcagagacggggatacagagtcactataatagaagaaatacctggtgaactagcaggaatcaagagggctactatcaaagttgatggtgagtatgcatttgggatatgcgaaatctgaaataggagttcacagattaagtgcggatttctccatttggacagtggaaagcggcggcacacttcctttgctgctgtccgctgtcatacctatccttggtgaggctctagcccgataccaagatnaacaatccgttcttccggtagaccttccgttccgggnngacctggcggcaacatccaacaccaacagaagtgctgtttagattgttcacatccccaactgggtacaacggaactttttccaaatgnaaggncccacnttttaattaggggatcc

SEQ ID NO: 87664 - DNA, 469 bp, Triticum aestivum
  unsure (1)..(469): unsure at all n locations
  Clone ID: PAT_TA_87664
ttcacagcaattttctgttgaagtaagcataccctgctcagatgatatcatgtcaagaagtggctctcactgcaattgccctgtacattttacatttaccgttgaactgggaaacaataatgatgaagcacatgatatcgatttgtttcatgacccaatctcctggagtagctcagaatcattccagtctcatgggaaacccagttgtgtcgcttttgatcagctaaatatcaccagtgccttggttcaagaggagtcaagatggaatttggatagactatctgatgaaatcgaccttttcaagagatttacctgatgagaatagtaaatttgccaaattgacactagcacggctattgcttgcttgcgctgcaataaatcccncggaattctttnnttnaaaggaagggaattgcaaaaagggccaaggtcctttagncttgnaaattggttctttcccaaaanaaaa

SEQ ID NO: 87665 - DNA, 386 bp, Triticum aestivum
  unsure (1)..(386): unsure at all n locations
  Clone ID: PAT_TA_87665
ggcgagccttcggacgaacttagttcaggcgaagcagaagcgtgatcacgacatgggagtcgccttcgtcgccccggcgactgcagcttccgggtggtgctactgagttttgatcaatctcacacgctagctatggctaatttaagataagatgccgggctcgtgtcatcgtgacagaccgacgggagatgtcacctctctagacctgattcatgtatgtttgtccattttaataaattacgtttgcagtaatttgaggtactcggggcccggggtaaacgtgtgttgaacgaccgtgtgctgtaaataatgggttttctgggtangtaggcatacatttacatccggntactgtanttgnacaatcaattatttntaccaatcng

SEQ ID NO: 87666 - DNA, 472 bp, Triticum aestivum
  unsure (1)..(472): unsure at all n locations
  Clone ID: PAT_TA_87666
accttggagtattaccatcttttatgtcaagtatgtcgtaagaatttcaccacctcgtatgacatcttggtacagtgatacttctccccatcaccattctttcttggtccccgtgttgtttctaaaaggaataccgaccaatggtctgtgatgtgtagattctaaacttctagcaaccctaatgctttgaagttattggcctatagtttcattctacgcctatggcttaatggatcatcattcgaacattgatcgtgctacctagcccatatttcgggtgcacctttcaaccaatgtttaactgtgtatgttttcctcgagttttttttttttttcttgaacagcatgtgctgttgatgagattaagtagtggtgaacagaggggcancaaaggagtccttgcccttgggcaagtttctaccgcanaagcatcctctccggcagtgggaatgcaaagaagtgaagcctaaaa

SEQ ID NO: 87667 - DNA, 311 bp, Triticum aestivum
  Clone ID: PAT_TA_87667
gcaactacgacccgcccggcaactacgtcggcatgcgcccatactgaataccgatggccggccggtgcagccgccgtcgcacgttgccgctccgcctcgccggtcttcttcacattcacagccccgttgccggccggccagcgcgtgcggcgatgcggcgcggcgtagcactatcttgctgtcccattcattgttgctcatcgagagttcaagacgaatcgatggcgatgccacgagtgtacaaaatattttttactgctatactactgggtactgcattctaagtatttatccttgccaaaaaaaaaaaa

SEQ ID NO: 87668 - DNA, 460 bp, Triticum aestivum
  unsure (1)..(460): unsure at all n locations
  Clone ID: PAT_TA_87668
gttgccacccactccggcgccagcgtcgggactgatatcatgcaacgactgttattcacagtgctacttttcctgcgacgcctccattccctcgaagtgcagcgcattatgcaacgtcgaagttccctgcaactcctgcaagaccagcgccatcgaggaatgcaggaccagcaaaaactgcaccgacagctgcgacgagtgcaacgacgctcccaactttaaatgtgccttctcctgcaccacccgaaactgcatcgggtgtcattacgggatgggccagatgtgcaataaacgttgcaaaaaaggattgctccgnaccnaaatgcgtaccctaaaaggcctggaaactagctaaagcaagttaggagtacgtccaaggtcaaagcgtctcctggtgatgcatcaagtgcacattgtgtatganatgctatgacatcaataatatggaagtntatgtttt

SEQ ID NO: 87669 - DNA, 294 bp, Triticum aestivum
  unsure (1)..(294): unsure at all n locations
  Clone ID: PAT_TA_87669
gaactagtctcgagttttttttttttttttttttttgctgagcacatatgtgagctccggatttgtaagcgattaatcataatgttgtgctgtacaattgaagatggcctctccatttttctgaagaagacatacaactgatgccatgttcttttctgctgatgcattcctggaaggattcctggtcaaggtacaagatgtacacacaagtgcttcctaatttccctaagttaagtggntcacacatgtcccaaccttgcaatgttcccctttnaataaaaatgcatttttggt

SEQ ID NO: 87670 - DNA, 419 bp, Triticum aestivum
  unsure (1)..(419): unsure at all n locations
  Clone ID: PAT_TA_87670
gtcccatccggacacgggagagagtctccggtcttgtatcttcaaagcccattagtccggcccatgtccaacaggccggacgcctgaggactccttagtccaggactccctcagcagcccctgaagcaggcttcaatgacgacgtgtccggcgcgcagattgtcttccggcactgcaaggcgggttccctttttccgaatactctaggatancttccggacgcaacgaaatgtctgggtttgcaacacaagtaccacacacacagcctagagagtatatatttcgccgagccatctgctgacatttttgtaacgtgactcaccttgtccgnctttatttccaacgttttcgtcnacgttccgtgtttccaaatgcatttcaattgggacncttgtcnaacanaatngtgtcccttatgc

SEQ ID NO: 87671 - DNA, 310 bp, Triticum aestivum
  unsure (1)..(310): unsure at all n locations
  Clone ID: PAT_TA_87671
ccgaatcgccgcagcagcagccggagaagaacaaatcgagagcgccagcagccatgtccgattggaaggangaggntaacgccgccgagctcaagatnggcnaagagtttctgaaggccaagtgcctgatgaantgcgaggtggngataatcctgnagcacaagtgggagcaactgcaacacatgtnggacggnggcgccgancaagtctcgcangtgttcgagaatcgcangcctacgtcaagcgcttnaagccgctacaanaacctgacccgtgcnncaagtncgcnagacnctctcccgctacagct

SEQ ID NO: 87672 - DNA, 456 bp, Triticum aestivum
  unsure (1)..(456): unsure at all n locations
  Clone ID: PAT_TA_87672
gatcgatggcgaagagctcgttcaagctggagcacccgctcgagaggaggcaggcggaggctacccgcataagggagaagtactctgacagaattcctgtgatcgttgagaaggctgggaaagagtgacattcctgacatcgacaagaaaaagtacctgggtccctgctgaccttacagttnggacantccgtgtacgtttgtccgaaagcggttcaagtcaacgctnagaagcgattttcactttggtgaaagaacatcttccaaccgacagtgcctgatgtctgcatttatgaggagaacaagacgaagacggttcctctacattacctacagcggcgaagaaactttccgnttntcctanattggcttngttgcaacggnatcctccttaatgctcccngtaatnaggngtgcaacnacggtgtaaaacctgtttgcccnccnaagtttttaa

SEQ ID NO: 87673 - DNA, 457 bp, Triticum aestivum
  unsure (1)..(457): unsure at all n locations
  Clone ID: PAT_TA_87673
ttaacatctgcgtcattttcttggtgtcatgaactcgagatacctacagtgccaatcgacatcaacagtagcagcatgggtttctcgtccctgacagatctaatccttcagtggtgcggcagtttatcaagtctcgaacagcttctaagatccggcttatctaccaagtcatcaaagaaaattataataaaaaatgcgaagaacctaatacaatacccaccgaaagntccggagaatttcgttgcattngaaatatcgaggtgggagggatgttggaaaaaataaanccccaaagtttggntgcgcgttctctccaaagaactcaaactaggttggaacaaagatatgtactgggcaaatattnccggganctcaatggcagccatatccnaagntgtctctcaactnttttccttggtnatgccngggtccaaanccatcccaactacaaaggggg

SEQ ID NO: 87674 - DNA, 456 bp, Triticum aestivum
  unsure (1)..(456): unsure at all n locations
  Clone ID: PAT_TA_87674
ggcgatgatgcgaggatcagcaaacttgagttcatcgagagggtgaccggcgcgatcccgatggtccacatcgaacgacctctgccgcgcccgagctgttcctcgcccgaggaaaaggcggcgtccggggcggtacaactgcggcagcgtcaacaccaccgtcgttggggctcgccccgcttcctgggcggcaaagtaccccgcaatacagtgtcaaagaccgaccggtacnccngtctcaaccgaagaagcccgaganctgcattccntcggcgaaactcctcgggaaaggttttggattcaattaatnaagacctggnncgaaatatacacnacgtcgtccaantacggtaaggcctttgggaaccttnccttgccaatnatatggatgatcttatnaaccaaacaaccnttgcatggaaaacagcttaactcctttttcttacgggataanaa

SEQ ID NO: 87675 - DNA, 436 bp, Triticum aestivum
  unsure (1)..(436): unsure at all n locations
  Clone ID: PAT_TA_87675
tacacacacacacacattcatcaccagtcgatcgatccgacagctagctagccatggccgccgggaggaaggtgacgatgagcagcgccggcgttggccgccgcgctggtggcgctgctggtcgtggcggcggcgtccgggcgcgaccgggtaccatgtctgcaacgtggacacggacagctgggtcaacaactgcaancctactgcacggcgggcagtccggaggcatcccagcggcgcgtgtgcgggccggtgcgcggcggtgacttccactgctcctgccaattacaagggcgttctgcccaaagaacatcgacgccaaccgcgccatgcaattncccggcaangcggtacgggcggctcctggctatcancaaccactacaacantcnattnggccgtccccgttgactataattnnacttaagngttattc

SEQ ID NO: 87676 - DNA, 215 bp, Triticum aestivum
  Clone ID: PAT_TA_87676
gaggagctgagcgcgccacgcgagggggtggctccatcctgtctacctgaccctgacggacggctcggcttactctgcttctctttagaatttcatcgtctcgttgaatgaatctgcgcttctgcagtatagatcgggtgtaaagatacttgtatgcttatggacgccatttgctatgtcatagtggtgtttccgattgttctaaaaaaaaaaaa

SEQ ID NO: 87677 - DNA, 293 bp, Triticum aestivum
  unsure (1)..(293): unsure at all n locations
  Clone ID: PAT_TA_87677
gncgcctcctccctcctgcaccccgccagatctgacngggacnacaaccagctcctcanngggatcaanatctacanagcttcgctcaatgtcccggcgctcaccnagaacagcaatgccnantgcctgncccnancatctagcatagaattcaagggccaggagtgcactaacacnaccggcagncaacaccgtgcnncggacaccgaaccgcagttccccgatancccagttctcnaacgntgccagtcaanncgtcagtcaccgatgacggnaagtgatnccggatgcgt

SEQ ID NO: 87678 - DNA, 360 bp, Triticum aestivum
  unsure (1)..(360): unsure at all n locations
  Clone ID: PAT_TA_87678
cgagtggccaaatgggctattgatctgcccccctacaccatctactaccagcctcgcaccgccatcaagtcataagtgctggccgacttccttgtcgactgggccgagacccagtatttgccgcctacaccaagactccacccattgggcggatgcattttgatggtcaaaaatgcgcaccggtctgggagcgggttcgtcctcacttctcccaaaaggcgacaagttcaaatacttgttgaantcanttnggcaacttccaaacaacatagcttaanacgagganccatacaanggtctcganttcccaaggatccngatacacaggtntccgggcnataanacacccacntggggggc

SEQ ID NO: 87679 - DNA, 356 bp, Triticum aestivum
  unsure (1)..(356): unsure at all n locations
  Clone ID: PAT_TA_87679
ccgcggcgcagcagtcgcagcaccggaggcgcgcgggaggcttccgccccaggccgagccggctctccgccgtctccacggccggcgagcgccccaagcgacaactaccaagtaaacaaatcaacgtccgacatgccaagagcaaagatagttgtnagtacataattactgatcttgtggagattagaatcngtggggaattttnacccatcccgttcccggactgggcctttttacctaaccccgtnaggtgccagaaagaaagtggctcctccttccggtcnactgcggtgttnaaacaacgccttngtttttnggtatatatnatccacaatttgggngacaaanaaaaaggg

SEQ ID NO: 87680 - DNA, 492 bp, Triticum aestivum
  unsure (1)..(492): unsure at all n locations
  Clone ID: PAT_TA_87680
ttcatacccatccggagcatttcatgagttgtttccacttttttcctccgaaggccatcatttcataattcctcattctcagctttcagctcacgttctccaaatcttaccggtgcatcattcaagtattctctaatcagctcgtgatctcttccgttctcacgtatttacattctgtcaagtatctttattccgttttctaactcttcccggtgatccgtctctttccttcattcattttcaatccttacggtggtccgtcaaagataccttttcctatgtcctcaatattaattatccttggttcaatcctaccggtggtccgttggaagacttcccaagtttacgctatatctcctcttaacctttcctacnaagaataagtggcatgccaanccgttgcttggtcatcaatttanatggggtgaaggatacgcataacatatcctgggtcttgggtcaaccaaagtgatnatccttcngtgactggcc

SEQ ID NO: 87681 - DNA, 486 bp, Triticum aestivum
  unsure (1)..(486): unsure at all n locations
  Clone ID: PAT_TA_87681
ggcggcggcgctccgggcagcactggcggcggcggccgtggccttgcttgcgtcgtcactctagctaagacgcggttggagcgagtattaattaactaagatgacgaaggacgtgatgagcatcacattcttttgcctttagattgtggatagataagtggagtgtnggaacntgatgacaagttggcgaccagtttatagtatactttgtgcaacatctcttncgatggtgtccggtcaactantgcgctatgcatttngcttgatttatctcctcaacaatccttgctgctcaacttccttcctgtgttntaaacactgtccttttttacgtttanaaaactcctccttggccaaatgctgtaagctaattagtnaaattttacacttttcctggttacccaagatccaaggacnactttccaattnctcaaanntttgggatctttttnntaaccgntttaaangtaaatgantggnaaatnn

SEQ ID NO: 87682 - DNA, 346 bp, Triticum aestivum
  unsure (1)..(346): unsure at all n locations
  Clone ID: PAT_TA_87682
tgggggaccaggcggagatgaagcggcgggggagggtggccagctacaaggcctacgccgtggagggcaaggtgaaggcgtccctccgccggggcctccgctggattnaaggccaagtgctcccacatcgtccaccgctacccgcccgcccgccgtcttcctcttcctcctccttgggtggtcaacnaggcgggcggccgacccgatggtggcgaagaacggatgcgccnagggatgcaagcccaaggnaccganccatcgaacntccctttgcgagtnaattnatcactaatgtaagattcatccatgcatgcatgggcctttttcctnctttcctttttcccaa

SEQ ID NO: 87683 - DNA, 415 bp, Triticum aestivum
  unsure (1)..(415): unsure at all n locations
  Clone ID: PAT_TA_87683
tcgagttttttttttttttttttatcgtaatataatggcataaagttgcaaatccaacaaactcacttgaatgtaaactatgtttgcatacaacgatgcgtgtgaaaaacaatgctatttgtgaatagagcacgctcgactgtgcaacatggaaggacgcctccagccatctcctttcttgggcatgctctaccgcggccgcacgaagtcatccgacctatccacatgtttgggttaaatggtttgggtcttctcccatcttataaaaggaacaatgaggttactctcaccaagtacgaaccatcctgatccatttgtcattgccatcaacccaatancctcccctaactgtccgcccgatgcctanctgctgtccgtcctcccctgggtggcctggccgcaaccaaaaagttca

SEQ ID NO: 87684 - DNA, 174 bp, Triticum aestivum
  Clone ID: PAT_TA_87684
actgcctctgcttccggtcgatcgagacgaaccaccggagcaccaccagccgccgccgcgatggaggcggtgaaagagcctcctgaagccgaagccgacgccgcaagcagcagtccgcgagtggcagcgccgcctccgcaacgaagggcccgcaacatcgagcgccaaatttca

SEQ ID NO: 87685 - DNA, 402 bp, Triticum aestivum
  unsure (1)..(402): unsure at all n locations
  Clone ID: PAT_TA_87685
cgtacaagatctacatcttcaaggtgctcaagcaggtgcaccccgacatcggcatctcctccaaggccatgtccatcatgaactccttcatcaacgacatctttgagaaagctcgccggcgatccgccaagctcgcgcggtacaacaagaagccaccatcacgtcccgggaagatcnagcctcccgtccgctccncctcccccgggcgagttccgccaagcatgctgtctcccgaagggaaccnaaggccgtcaccaaanttcaacttcatcctaagtcctccttggtgttgatccttggtnttccttttcctcttcctccgtccngatgaattccnggtactagttgtgtgtgnttcttgacagtgtcatcttggttacaatggggctgcctggaattaaa

SEQ ID NO: 87686 - DNA, 371 bp, Triticum aestivum
  unsure (1)..(371): unsure at all n locations
  Clone ID: PAT_TA_87686
cggccacctacctgcccccgctcctcgcccccgaccacgccctccccgagggcgacgaaggcgaggaagacgacgactccgactccggctccgacgagcagcaccgcggcaagaacgtgggaaaggcgccggcattgccgccccttcggtcagcgttgaacacccaagaccggcgacggggncgaaaggaaggggccggnantttcaggtcgccgaagatttctatcactgtcagttntttcnaaacgnggtgaattnctngttttatcaagttacttgcgaattncgcagcatttatctctccttggtgtcccatagattttgtcactactacttactcccttnattntatatnaatttagcatccccaa

SEQ ID NO: 87687 - DNA, 366 bp, Triticum aestivum
  unsure (1)..(366): unsure at all n locations
  Clone ID: PAT_TA_87687
caacacacacacacacagcagccaagcgaagctcgccggagagggaagcgtcgaggatgtcgggccngaaaaggggagggaaagggggctcggcaagggcggcgccaagcgccaccggaaggtgctgcgcgacaacatccagggcatcaccaagccggngatcnggnggntggcgcngnngggcggngttnaancgcatctcnggggctcatctacnangangacccgcggngtgctcaagattttcctgnanaacgtcatccgcgacgccgtcacctacaccnnagcacgccccgccgcaaagaccgttnaccgccatggactnntctaangcgctnaaacgccaanggaccacctcttacgatt

SEQ ID NO: 87688 - DNA, 491 bp, Triticum aestivum
  unsure (1)..(491): unsure at all n locations
  Clone ID: PAT_TA_87688
cccgaggtgcctgcaggcctcttcggcatctcttctcctggtttgctctgtttcctcgtggatgccaaagggggtcgtattttgttactaattactaagcgttttggtgcagcccatccgtggatcatcccttgccaatttaattattatctacattggtttttgagcattaagatcaattaactgaactggcgttgctcctcttgttgtgtccctactgctcgctactctccttacctnatctaatcccatctagccgttgtagtctacctttactctgcctcgctnctgtacaatctgctcactgccgctgttgttcctcctctcctacacctcttgctgctgctcttctcccaagaaactgttgctcctctcttctctcaacgcttcctggctactctttttcctccaaccttctgatgctctcttaagattcaacaaaaatgctctctcctctaaacacctcctgcnnaactcttttcaaacaacgg

SEQ ID NO: 87689 - DNA, 344 bp, Triticum aestivum
  unsure (1)..(344): unsure at all n locations
  Clone ID: PAT_TA_87689
gtcagggtcgccgagagggtgaggatggtgatgctcggggaagaaggggatcgggcgagggagaaggtgcgtgacctcaagctgcaagcagaccagtgtgttgctgctagtttggccgtcgacaatctcgtgcggtacgtgctgtcactctgagtcgccggccggcttctctacacgattctccccgtgatattgaataatgatctcatcggtgaatcatcgtcaagcgatgccctgagaaaaaaaaatgacaccgcttcngcaatgtgtgcttgcagtatgtgttaaaacaggntcacacttgcaatagacacatcatctttcttccatgcaaaaaaaaaaaa

SEQ ID NO: 87690 - DNA, 494 bp, Triticum aestivum
  unsure (1)..(494): unsure at all n locations
  Clone ID: PAT_TA_87690
ggagtatgaaatatacaaggcaacaaacacactgaggaaatattgccaggtttctagattaaatcctgagaagtcaatcccatcatctatcctcaagggagcaaaggggcttgctgtgctcacagtggccaaagcaggtgcggttcttacatacaaaatgggcactgggtcttgtagtttctcgccgattaagatngatcatggtctgcgccatcagcgattttatctgttggatttgggatggggagtgcagattggaggagaattgacagattttatatttgtgctcatgatctttaagctgtcaaaggatttaagcaaccgcatcactttctcttgggggcagattgaatgcngcagcangaccaattggnaaacccttnaagcaaattttcgacaagtnaaaagtctgggaatctcacttatactcacaaagngcttttttggnccncctgaagaantttgacacagtatgcacaactcgctcntnggac

SEQ ID NO: 87691 - DNA, 485 bp, Triticum aestivum
  unsure (1)..(485): unsure at all n locations
  Clone ID: PAT_TA_87691
tttttttgttgcaatagacccgaatccttgtagtgagggcaagcgtcctgatgtggcaaccctcttcgtgcaagcctatccgaggtccagcaccgatctcgtantggtagccaagtgaagaacttgcagttggagggtgctcgggacgtccacgtcagctccgccatangcgccacctctcggccccaaaaccctaccgcatatgccgacctcaccgagtatcgtccgttcgtctcccaggaccatgttaccgtatcaggcacatccacctccggctcccacgtgtgcacacacagccatagggataagaactccccgcaagcttgctctccaaggtctgggccgacatccatagccaagaacatcctaattgggnccgatgccacatgcttcctaaatctgaccatcnagggatnatgccatatatagtttggtgcatctcctgtacctcatcccattgatnaacgtcttccaaaaaagtgctt

SEQ ID NO: 87692 - DNA, 188 bp, Triticum aestivum
  Clone ID: PAT_TA_87692
ctcagactaggcttcacactatctctttgtagtatcatgcgcatgtcattcgcctcctatgtgatatgtatgtagtcttatcggcggcaggttttagtcaccatctgttttcttttcctactgataaaagtccaacagttttggactcatgagaactcaatttacttacgacaactaaaaaaaaaaaa

SEQ ID NO: 87693 - DNA, 499 bp, Triticum aestivum
  unsure (1)..(499): unsure at all n locations
  Clone ID: PAT_TA_87693
accctagctcccaccgcagcggcccccgccccctcccggttcgccgcccgcttccttctcccgcaccagcgatccccctcccctgcccggtcgctcgctgaatcatccgcgcgtttgatctgcaggtgcgcgcttgctgctgcagacgagaagcggctgaggcgaagaagaggaatcgaccatggcgacccgtatccagtttggagaacaactgtgaagttggnggttttctccaagctcacaaatgcctactgtctgggttgcaattgagggttaagagatttctacagtaatttngagtcctgagcttgcaatgtaattcctgtgggcaaaactctatccggtggnactagaataattggccnctccggcgtttggaaacaanatgncttctcttgccaaaacacaaccactgatcaagagttcagatctgaggaacngatactgattaatggttgtcaanccanccattaaaaggtgtcgccttgggaattnatnt

SEQ ID NO: 87694 - DNA, 199 bp, Triticum aestivum
  unsure (1)..(199): unsure at all n locations
  Clone ID: PAT_TA_87694
ngccgtttctcttctgtgcaagattgcggcattaagatcattttcccttgngcgattgcagtacttganggaaanagaatctgggatgancacattggcatactttcttgccagggacacaatcgatcatttcaacacagctttaaagccaatcatttacctctccatgttttactacttcaacaatccgagatcatca

SEQ ID NO: 87695 - DNA, 344 bp, Triticum aestivum
  unsure (1)..(344): unsure at all n locations
  Clone ID: PAT_TA_87695
ggcgcacatgaggaggtggaaacgcacggataagaaattcttcgggaaggccaggaaggtgttcgacattgaggtgttgcacaaggatccaccccccgaaggctggcgccatggtccggtggtctaccgcttcacagtgaagaagcagcgtcacaacaagtgaagaagcagcttccaaaaggtaatggatgtaatgtatgcttgcttatgcccatgctgattctactgcactgcaagaattaaacacaaatgtttcctgtaaacgatgtgacatttgtgcaactggaggacaaattaaacaggaatctttcttccgagctccggaacagtanaaaaaaaaaaaa

SEQ ID NO: 87696 - DNA, 339 bp, Triticum aestivum
  unsure (1)..(339): unsure at all n locations
  Clone ID: PAT_TA_87696
tggccaaggtgaccttccgccacccgttcaggtacaagcaccagaaggagctcttcgtcgccgccgagggtatgtacaccggccagttcgtctactgcggacgccgcgccacgctctccgtcggcaacgtcctcccgctccgctccgtgcctgagggaggcgtcatctgcaacgtccagcaccacgtcggcgaacgttgtgttttcgccaanggnctcccgggtgactangccatcgtcatnanccanaaccccnacaacngtanctcaaaggtttaagtcncctcctngngccaanaanattnttccaancantntcgtntcangantggcaagtttc

SEQ ID NO: 87697 - DNA, 477 bp, Triticum aestivum
  unsure (1)..(477): unsure at all n locations
  Clone ID: PAT_TA_87697
gaactgctacccagcaagagtaccaccatttgtagatctacactgccaccattccacccacttcagtccgccgccgacagtttacaatcaaggggtcgctcaaacaacaacagtggtcagagtgatgaactggattctcatgttactgcatttgtccaagaaatcgcttaaacaagccaaacagatggttggtgaagtcatgcaggcaagctatggaaatgggtaatgaatctggggaaagaagcaacaccatgtataagcctggatctgagtctaccttgatgatgccacttcatcaaccctggatagagactgtgttctacagttattggcatcaangacttgagcnacacngcacccgcctgccaagatacaggttgctgggaggtgcttttttgatgctgcgcccagctgtccaaagaactcgcgatntacagcgagatagagagtacacnctgttgtcaaagaccagatann

SEQ ID NO: 87698 - DNA, 269 bp, Triticum aestivum
  unsure (1)..(269): unsure at all n locations
  Clone ID: PAT_TA_87698
aggagctgagccgtctgctgggctcggtcaccatcgccgccggcggggtgctgcccagcatccacaccacgctgctccccaagaaggccggcaagggcaagggcgacatcggctccgcttcccaggagttttaagattaagattaagtatggtccttgtgaatgtttgggttggtgtgtcatcgatgttggtggtggattctggttggaatggattgcagctccgcaatcctgntccttgttgttactgcctgnantttgtcaaaannn

SEQ ID NO: 87699 - DNA, 334 bp, Triticum aestivum
  unsure (1)..(334): unsure at all n locations
  Clone ID: PAT_TA_87699
tccagaaagtatcggacaggtgccttacctcaaaggtcatggttttgacaaccgcctcaacaattctttgacgggagatattttataacagcaactggaactagcatattctaatagaaaaattacatcttaaacaaagctccatgtgcttagaacagtccatcaaatgtaattgcagttcccaactgctaaccacattttcggcacgcaagaacaaacactttgagaagggacgttcaagcgacaaacttcaatttgaatcactgaccagtcttcacctgtgagtgggtgattcctattgagggcaatgccgcnncaacnctttccaaacctt

SEQ ID NO: 87700 - DNA, 484 bp, Triticum aestivum
  unsure (1)..(484): unsure at all n locations
  Clone ID: PAT_TA_87700
gccggatccgccgccgcgggttcaccgtgaacctgccacacgaccgtcaatcaatcaggttgtggaggttctcactcacatatcaaaaagggagagtttcgatctccccgcaagtttggcttacaccattgcgactcgatccgcgcacaacatgagggaggcgatattggctctggaggcatgcagagctaacagctaccccttcgtggatggacaagctataccgctaggatgggatggtgttcttgaggaactcgcagcagaaattttagaagattcttctcccaaaaggttanttttgggtacaaggcaagctccaaaaactttgggtgaatccgtgcctcctaaactggttctccagaaaccctanaantgttcctgaanggaatacatgctaacataaaganggatgttattacnggcaccctactacaataaaagttnccgctggtgccaattcantgctgaaactgggagaattacn

SEQ ID NO: 87701 - DNA, 453 bp, Triticum aestivum
  unsure (1)..(453): unsure at all n locations
  Clone ID: PAT_TA_87701
cagaccggattgcggcggcgccacgacaggttgccggcctgcagtcctcctcacgggacaagctgcgttcgtggtgcgctctcgctgcccgccggcttcgacggtgtgggccggggcgccgcccttccgcagatccgcaatcgagtcgtgcgtccggtctgccgcctcctctcgacgtccacggctctgtgctcttccgtgttctctcctagcgcaggctgtgggggcgctacgccgctatctgccagctcctcatacaagagcgatggacaaactgagccctgtgggaaacaattgcatcaactcagcgacgtccagcgtttctcctctctacgtttctttgcactcctcaagtcaaagcacgaagccacggcgagatgtaagtttcatcaacaatgcttgttttcctggncaagactgaatcctcctttgatcaaatatactgattactgc

SEQ ID NO: 87702 - DNA, 351 bp, Triticum aestivum
  unsure (1)..(351): unsure at all n locations
  Clone ID: PAT_TA_87702
gcctggcgaggaggggcggcgtgaagcgcatctccggcctcatctacgaggagacccgcggcgtgctcaagatcttcctcgagaacgtcatccgcgacgccgtcacctacaccgagcacgcccgccgcaagactgtcaccgccatggacgtcgtctacgccctcaagcgccagggtcgcaccctctacggcttcggcggctaggctcttccttgccccctttgcagattccaaaagttttgatnataccgcgactttgtagtctccacttcctccggtagttcgctattcctccgnanttcnaactgaatcgtggagcaaactattcccagttttgtttaaaaaaaaaaaa

SEQ ID NO: 87703 - DNA, 314 bp, Triticum aestivum
  unsure (1)..(314): unsure at all n locations
  Clone ID: PAT_TA_87703
attgtgtctatgttcaggaatgccttatcagcacaccgaaaccgcccttccgttgaacattggtccggtaaacgtgaggaggtagttcgagtttgactgccgcctcccagcctagtggcatccttgtcgatgtttaccatttctttagcaatgcaggctcagagctcaatcagagtggatgtcgaagctgagtgggtaaagtgccaacaatgcagaagagccttgctgctaagaaggaactgcacnttaagntgcananaanagagcaaccanaggaaaagaaggttnaacctgcataaaaaggaccaaggcaa

SEQ ID NO: 87704 - DNA, 476 bp, Triticum aestivum
  unsure (1)..(476): unsure at all n locations
  Clone ID: PAT_TA_87704
atgctgaagttggtcctggggaccggcaatgtagaagctgcacggaagctatacgaacggatgcaggagctgcagtgtaagccgaatgtggtgacttataatttgcttatgaagttgttcaataaggagaagtcgatggacatggtgctgaggataaagaaggacatggatgcacaaggtgtggagccaaacgtgaacacctacggagctctaatcgagtcattctgntgggaaggggaaactgganggcgcgctcatgcgacgccttanggaaaatggtccaaggagaaatcccttgaaacccacgaagccggtgtatgatatggtgctgatgctgctnaggaangccggacagctcangaagcacgaaganttgtggaatcaatggctgaccggggcttcatcaagcgcccatcanaggatgccttgtgggaaggnatanctgcttcgtaacattcttcccatacaatccaaaa

SEQ ID NO: 87705 - DNA, 371 bp, Triticum aestivum
  Clone ID: PAT_TA_87705
ccggggccagttcgagcacaactgcccgccgaccaactactcgaggttcttcaagggcaagtgccccgacgcctacagctacgccaaggacgaccagaccagcaccttcacgtgcccagccggaaccaactaccagatcgtcctgtgccccgcccgaaatgatttgcacatggatcagtaagtagaggatgtattactcctagtagtcttcctcttacttattatgatcatccatcattctgcgtgtgcccatattatatactccgtatataatgtcacatatgtgcgtgcgtgcatggccggtgcgtgccattcagcgaataaatgtataaataaaatggaagtgtaattctacggttaaaaaaaaaaaa

SEQ ID NO: 87706 - DNA, 478 bp, Triticum aestivum
  unsure (1)..(478): unsure at all n locations
  Clone ID: PAT_TA_87706
cacaaaagaagccaacaccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaggccgccggcgccaccctcctcgtcgccgccaccgccacccacaaggcgagctccggcgggatggagatggcggcggaggatggcggctgcggctgcacccagtgcaagtgcggcaccagctgcggctgctcctgctgcagctgctagatnattgatcatcgatnatgcatgcaccgcgcgcatgcatcatatctatnatcgattcatccatccatcttgtacatgtaacgcttccttatcaaggtcttgtagtagttagcactgcaacatgagcagacaagtcatccatcatttaaccgaccctnaataaactcccgtggttaacaaaaaaa

SEQ ID NO: 87707 - DNA, 488 bp, Triticum aestivum
  unsure (1)..(488): unsure at all n locations
  Clone ID: PAT_TA_87707
ggacgacaagactctgctctttggcgagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaaggtgggtcatctctgccccaagcaaagatgcccctatgtttgtggttggtgtcaacgangacaagtacacttaagacgttaaaattgtcctcaaaatgcnacntgaacaaattantngcctngttcccctagccnagattaattaanacaacttcccgtaataatgaagggtttntnaacantggtcaangcatcaattgcananaaaaaanccttttattgncccccccannnaaggactganaaggggcaangcccaagcttttacacattccannaacaattggngctgctaaaggtgtttgnaaaggtctccctna

SEQ ID NO: 87708 - DNA, 466 bp, Triticum aestivum
  unsure (1)..(466): unsure at all n locations
  Clone ID: PAT_TA_87708
acaaaagggagtggtaagagattgaaaaggggttcagagcaaacagtgaaccaaaagaagaagagggcaaatagcatccaaaaggttcctgataagtaggggcggtggtttcactaatttgatgttggaataattatgtgaagtcattcagctggctacattcttgctggaaatggcagtgatattcataggcgatgaggttttcgacttttgggtgcttccaggagctcacattttgcaaatgtgtcactgaagcatgcatatgttctatgtctgtaactctggatgtggtcactgttagcttcaggaagtcgctaacagtaaaccatgttgtcccattagccatgtttaaccaggaagaaaagattgtatgaccgggcaacgaattgctaagcctagcttaatgtagttttaagatttgggttgccttccgtgttantgtcccaactgtagccagcttgctata

SEQ ID NO: 87709 - DNA, 476 bp, Triticum aestivum
  Clone ID: PAT_TA_87709
atcatcccttcctctttggggaaataccgacatagttcaagccgcgtcagcgtgtcgctgaggtcgagcggtggacaggtagtgggggcttgccggtacggaacttgtcgggtcttcgctttgccggcaacttgatgcttgatcttcagtactaacttagtacttcttgacgacctacattgaggtcttcttcatgattttatcaaccaagtcttgtgtcttgtttgggagctatcctccgccaagcccttgtggtcgggtagactacaactggctgtacacaagtctggggtactaaagcacccctaccttagtacaccaacaattttcttagttcatgattaattttttaatacacaatgaatgttttttaatacacgatgaacattgttcaaatacttgatatctatcatccatttatctatctatatcctactatctatactatactaattgtgactccctaaaaattacaa

SEQ ID NO: 87710 - DNA, 450 bp, Triticum aestivum
  unsure (1)..(450): unsure at all n locations
  Clone ID: PAT_TA_87710
acggctatcaccttcaatgccagtgacaaacctaaattccgaacagccctgacaccagccgctttggtcctcagtccaattgtggacggctttcggctcactaaggttctcatggacgagggcagcggattaaacctcatttatgaggaaactctccacaaaatgtaaatagacgtcaactgtattgagccaaagcaattacactttccgaggaatcatccctagtttgggangcccgtttgcgcctgggaaaacacacttatgtggnattccggatcccagagattncaaggccaaagaattcattccaagtggcccntttantaacngtacangccttntanggncaagattcagattttttaagcatacccatttgggnacatnaaatcnaaagcccgnnccaaaggattcacccnactaggttcntnanacaccctttnnnaaaaa

SEQ ID NO: 87711 - DNA, 418 bp, Triticum aestivum
  unsure (1)..(418): unsure at all n locations
  Clone ID: PAT_TA_87711
ncaactcttgccctantgaagaatgccaaggttgnngattangtngttggatttgatgagctgggtggtaaagatgacttcagcactnaggatctggaggaacgcattgccaaagctcaagtgatattcctcgacggacaggggcctgcaaatccttccaagcaagctgctgccancaagctcaagcgttcgacnctcaagatactggcaactcaagactcaaactaatctgtncctgtattganaggcntgtgcaccaaangattttacaaatcaggattaagccanctgttatgctaccttaactactannatgaangaatttgtgttccgattgcgatttgaagcgcanttgtcactggtgtanatgcccttgtttaacaaagcgtccatacctggattgggntgtttaaaaagg

SEQ ID NO: 87712 - DNA, 418 bp, Triticum aestivum
  unsure (1)..(418): unsure at all n locations
  Clone ID: PAT_TA_87712
caccaaggccgcccgcaagtccgccccggccaccggcggggtgaagaagccccaccgcttccgccccggcaccgtcgcgctccgggagatccgcaagtaccagaagagcaccgagctgctcatccgcaagctccccttccagcgcctcgtgagggagatcgcccaaggacttcaaagaccgacctccgcttccagtcctccgccgtctccgccctgcaggagcgcccgaaggctactggtggggctgttccaaggacaccaacttctgcgcatcaagtaagctaactctgttancntcctcctaancagatgtctcatccgtggaaattgctgctaatgttcgttcttgcatgtgttaanttttggccggtcctgatncacanctgctncancaatactaaataaatttctactgtct

SEQ ID NO: 87713 - DNA, 466 bp, Triticum aestivum
  unsure (1)..(466): unsure at all n locations
  Clone ID: PAT_TA_87713
agaagctatctagcttatcaaccaagaaagaagagcagtagagccgtgtttaatcaaccctgagctcccgtccgcatcatctcatcaaggtcgaccaatggcgtttctgggaggatcgttgggcgtgacaaggagcatcggcagccggangnccggnagggggaaaaaagccacngcaggtccgggacgttngcgggcaagcgccccgcgcccgtnaagcagctgttctgggaggctgaaggcgcgctgtgctnaaggccaaaagcgccccgccgttaagttcggggtacnacctcaaagagtacccctaanaattcnntaacggctcgtcccttntaaccgccnctagctnccaactcgttnttccnaatgttantnccgcccggccgggccaaggtccaaggtggncttggnattgccccccnagctaactccaagtgtccatattaancagtatttttaagca

SEQ ID NO: 87714 - DNA, 217 bp, Triticum aestivum
  Clone ID: PAT_TA_87714
cacgtcttctacctcttcaagcccgactgcgacaaggccaaggagatgctcgacaggatcgtggccttcgttaacgcggcagcttgatgctctcctcaccggaattgcaactcggtgaattttagccatggcaatcctagacgtgtttgtgctccgttcttggattgtgacgattaaataaattggatttactgggagcaactccaaaaaaaaaaaa

SEQ ID NO: 87715 - DNA, 481 bp, Triticum aestivum
  unsure (1)..(481): unsure at all n locations
  Clone ID: PAT_TA_87715
aagacatggaacttctaatgagacccttactaaaccattcagatccaatatgcgcagacatgttaagcgaagcaactgttgggttcagtttacagaacgcaaacttcgttcatctgccttgcttcaatgacaaacagtggattgtaatcactgctaactttgacagtggcaaatctttggatataatgaaccctgatggatctgggaaacaacaaatcacttcaaattatcagcactgttacattcaactcaaagagcctgtttgcgaaaacataccccaattgcatccgcattcaacatanaagatttgactaccgttccgttccagtaccccggccatttaaggtacgacaccggatatcctcctgcaattctnaaaacataccgggatgggaatgccagatcacaaccaanactacaggccttaagagatttcccccaacaaattggantgttcaacatggnaattaaactacatggg

SEQ ID NO: 87716 - DNA, 485 bp, Triticum aestivum
  unsure (1)..(485): unsure at all n locations
  Clone ID: PAT_TA_87716
atgacccagaaaacggcaacgcagatggacagagcgattgcaaacctggatacaccgatgtgtctagctcccctcctgagccttcctctggcatcgagcagcgctgcagatccctcgacgagagcagagaccttcaacagaagcaccaagcaccggaagaactggaatttaatgatcagcttaaggccttcgattacgcccaagctagaaagaatacttcatttggagaagttagatntgagagaagaaaggacaatgcagtggccagcgctatcaatgtggattctggagataaacggaaaantttgaaacaaaccccggtgccggttgcggcgaaanangatgaagggaacttccaagaatccacgaaggcacagcttcccaccttctggnaacaggagtgctacgtacatngtttgtttanaaatgtctatccgancgangnattgtattgtacctaaagagncaggggaattggacaaccc

SEQ ID NO: 87717 - DNA, 442 bp, Triticum aestivum
  unsure (1)..(442): unsure at all n locations
  Clone ID: PAT_TA_87717
gttcgccgacgagaagttcgtccacaagcacaccaagcccgggatcctctccatggccaacgcggggcccaacaccaacggctcccagttcttcatctgcaccgtcccctgcaattggctcgacggcaagcacgtggtcttcggcgaggtcgtcgagggcatggacgtcgtcaagaacatcgagaaggtgggctcccgcagcggcacctgctcaaagcaggtggtcatcgccgactgcggcaantcaaantcggcccgcgcgcgggtcgcctttcgccgtcgtcgtcgccgccccntgtgtcccgtgtcntgtctcnatntaaataaaaaattcttgtgtcntgtctgtcttccctggtccgtcgataaattccgtggttggttaagaggtttaagnggacccttgggctgcgggnttcntcggcgcttggtaacttccggg

SEQ ID NO: 87718 - DNA, 486 bp, Triticum aestivum
  unsure (1)..(486): unsure at all n locations
  Clone ID: PAT_TA_87718
aagaaagagtggggtggaggggcgcgcgtgcgttcccgcttcctctcctccccctacttatagcctacgggctacgaagccgaggggtgggcatgggaacatgggattaactgtgcccacgaccccacacccccacctttaccgcgtgaatattgcgcgcattaactccacggagaagcccaaccgcctacctcggccgccgcggatctgctcactacctgaggcccgatggtggcgggcccggcctacagtcgcgtcccatcatgcgcgttgggcttggnaagcctacccagccaagccaacgccacgttgcatgcccgcaacagatggcaagcanagaagctatcaagcacgccaactgattccaacaaacgcantcaaaatcccaanaaggatcaactggatcaaccgattccgcccggcgatcctcataanccggcngngcttcttnangggaccacaanaggaaacattnaggtcccccgc

SEQ ID NO: 87719 - DNA, 490 bp, Triticum aestivum
  unsure (1)..(490): unsure at all n locations
  Clone ID: PAT_TA_87719
gccaaggacaacaagaagacccgcatcgtgccgcgccacctgctcctcgccatccgcaacgaccaggagctcggcaagctgctcgccggcgtcaccatcgcgcacggcggcgtgatccccaacatcaaccccgtgctgctccccaagaaggccctcgagaaggccgagaaggagtcccagtcgcccaagtcgcccaagaggaaagggcccccgcccccgcacccgccgccaagaaagaccccaaagaagaaggccgccgacaagaagaccgccgcttgacaagaagaccgccgccgctgacaagaagaacgccgccgccgacaagaaggctgccgccgacgcnaagaagaggcgccgcgacaataaanaggcaacttgcttccctaattctgatctgaaaagggaaanaaagnaaaaaacatggttctgtangtaatnctgtccggatccnaatnggggaancggtacgtcattgtttnatcacnctnat

SEQ ID NO: 87720 - DNA, 494 bp, Triticum aestivum
  unsure (1)..(494): unsure at all n locations
  Clone ID: PAT_TA_87720
cctcaatgctcgccacaccgccaaagctgttggcaaactggtcagctgttgcccttggcagcatgctaagcgccggccaaggtcacccgacgaatcctcctcagcacaagacaccattcaataagtcagcggatgcatgcccaagctgattggtaaactcctcccttgcgcatcctcccaggatccacatattcgtgagaaagattgtggcagtgtgcaagaaatgccaaagtttgagtttaatanggttgatttctctcgaaagatnaaggacatcatanagaaattgcagcttgtgcgcaaggatgttaatggccttttgcanagttgtganccttgaatgtcccgaacattgccaatgtcgtcctatcacaanggtcgaattgattagccaaaactgtaaaaaaggggggcccgtaccaattcncctatntgagtctatangcggctcantgcgtcgttanaactctgacnggaaacctgcgtnncaacta

SEQ ID NO: 87721 - DNA, 447 bp, Triticum aestivum
  unsure (1)..(447): unsure at all n locations
  Clone ID: PAT_TA_87721
cgacgaactaggggatgcttgatgcgagctaggggatcgaaaggtgggggaatgggctggagatttggtgtggttttagggcagtggctggcgtaggccgagcagcgaaggttctggtgtgaatagtggttccggtgacgaccggtcaatcgattttgactgtacatcgctcttgtcgcgttcgtgttgcagcccgacacgcttgaccctccacgtcgcttaccgaanggaacacgcttcgtcttgcattttcactcgcttgtgggaccgcagtttagagcaaaccgacntcccttcccctcccccaaccgcgtcattaataataccaccactcctccgtttatgcggngtaaataaaacagagggagtaactanggataaggatccctnanatggccaaacccattagtaactacaagcngggccnacaagcanggatccccttnt

SEQ ID NO: 87722 - DNA, 437 bp, Triticum aestivum
  unsure (1)..(437): unsure at all n locations
  Clone ID: PAT_TA_87722
atcttgtgcacaaggaatccgaagatcgccattactaaacttaaaatcagattcgtcttgatgccacatgtctctctcaccattggaagatctgttgcccgtgccatggcaacccagaaggttggcgcagctnagtttgagatcataacgganaaggcttatacggactgctctcctgccgatcttctccaatttgcgaatcagttnaatattttgttggtgctttcccagatncanttgctggactcaagcgcctgttgctgcgcaataanaagtttggggaacttgacatcaacaacatctnacaanttgcaaacccttggnanctttgcgttnaaccaatgcgactcaaggattnatctgtgctgcaagtnnaanatgctcagctggtttagcttgaggtagacnacgggaanttcaagagttagcttacagtc

SEQ ID NO: 87723 - DNA, 439 bp, Triticum aestivum
  unsure (1)..(439): unsure at all n locations
  Clone ID: PAT_TA_87723
atccaagtgaaggaccaggattgcttcgcctgcacagtacatataggcatgatctgaaaatatatagttcagatgaaggtcgtgtccagatgtctgctgcggctttcgctaagggtcttcttgatttggaaggggacttaacgccaatcctggtttcactagtgagtaaggactcgtctatgcttgatggactgcaggatggtactattgagataagtgaagcaaaggctcagttgcatgatattatcatctcttcaaaagttgcaaatggtggtgatcctgcggggtttccatggatggttgatggggctgatgtgtctacaaatgctgctcaacttctaacaaatttggctgagttaacaaaaaaaactcccangggggggcccggtaccaattcgcccaaaangatcctattaccncgctcaatgggcctcgtttt

SEQ ID NO: 87724 - DNA, 487 bp, Triticum aestivum
  unsure (1)..(487): unsure at all n locations
  Clone ID: PAT_TA_87724
cctcaattccttaaacataggattcgatgacaggtataacaattctgaggtgcgtgatttcaacccctgcagctatgcttttgtcgccgagcaggattggttcaggtttgaggcttcataccttgatgatgacaagttcagggataagttcaaggatnaggtccctgctgtgcttgactgggttgttgagacatgaatcctgtgatgaagcggtcaagaacacgacaccgtatgcctgcattagcaagaatagccactgcatcatgtcagcaaatgctacaggctatctctgcacctgcaacaatngttcgcaagcaacccctacctggaaagaaggatgccaaagattcaacagtgccgcttccaaattaanaaccttgccaaggnaccgcancaaccnattggggacacatttgttaagcaatctggactacaacatanttcaaagagagaaactgcaaacaatcaaattcaagaaagacttgat

SEQ ID NO: 87725 - DNA, 508 bp, Triticum aestivum
  unsure (1)..(508): unsure at all n locations
  Clone ID: PAT_TA_87725
gagcactctggtcactgccaggaccagcgagggtgcgtggcaggcattcagaggaattagttgggaacagacagacataattttttcaacaaaggtaatttgtgcttcttcagatcgaaaggaggtacatgtctttgtcccgccgagaagcacatctnaggagcaaaaaccaagctacatactccgtaggaaatccatctcgaaanagcatgcacgattattaaggggaaactccattgttgctcaagacaaatctccccntacaaactccaataagccgtctattccaaggcggaantttaagagtgacgatttaccccaggaaacgatacattcctgatnaatggcaatggtnatgacttncttggttcnaaaattacaaagtnatnagtacccngcattgcttttaanaaactnagaggatgatttaattatcctcccccaactgacaatgcactncngggccaaaaaagtctcanatgnacccaagcgtgccttttctacnggg

SEQ ID NO: 87726 - DNA, 493 bp, Triticum aestivum
  unsure (1)..(493): unsure at all n locations
  Clone ID: PAT_TA_87726
gttggaacagggcaatctggaccaaggcgagttggaaaaggcaaaagaaggtcaaaagaaggatttccctgatggtattcctgagtgtggtactgatgcccttcgttttgctctgatctcctacacttctcagtccgacaagataaacctggatatcaagcgagtgcatgggtacagacaatggtgcaataagctgtggaacgccatccgttttgcgatgattaagcttggagatcagtacactccaccaagcaactctcgcggtgcatactatgctgcccatctgcaattggatactctcagtacttaagtaaggctgttggcaagaccgtgtcatcgttagaagcatataaattctctgacgcnacatcctccatatacttttggnggcaatacagctttgtgatgtcttatagaancaattaaaccttactcaatggatctnaananttcgaatctcaaaagngcttctanaganaacannggcatgccn

SEQ ID NO: 87727 - DNA, 494 bp, Triticum aestivum
  unsure (1)..(494): unsure at all n locations
  Clone ID: PAT_TA_87727
gttcgactcagtgcggcggtaatcttcagccatcgatggtagatgtttgtcccataattgacggatttgtgttacctcacagaatactagtatagtcgcaaacaatcgtctaagagcagaaggcatttgaaatgttgctgcctccgtcatgcaatcatccagtgtcctgtcatgctcaatgaggcctaagtgctcacatgcctctctgaaggaattcatggcttccattactgttttaaatcatcaaatgaatggcactccnaacatgacttaaggacaaccgcaagtatactcctccntcancaaggtgtgcatacaccatcctccaatctgtgatcncctacttctccccgtttgccactttttaattaancggaancaacctataagtttctgggaancctttggtaaacatttcnnnccgctggnantctgtcaanccaaatacccgtaaacaggtttggaaaatttgcaacganacactccanattnan

SEQ ID NO: 87728 - DNA, 461 bp, Triticum aestivum
  unsure (1)..(461): unsure at all n locations
  Clone ID: PAT_TA_87728
aaaaggtcccgagttcaattctcggaatccccatgttgaaaacccttttgcaatgccattttgagcttttggtgctctgaggataaggttttggaccacagggttgatgaggttcatagcctcactatgcatggccattcctgttctgtatcttgtggctgtgcttcaactgggagaattttcggctatatctgcatgctgttgcaagttagcgctgctgcaatgatggagaaacagtatagtaaacataacattatatancctacttattaattccaagtataactcaaaagatatcaaaatnttttgggccaaatnggaaatcctgctaaccgaatgcctttaaaanatcaacgnacggtaaaaattttnagaaacttatccaaggcgntcaantnatggacngtaaaggacngtaannatcaaacgnacngtaaatgttaatnancatatnacagact

SEQ ID NO: 87729 - DNA, 467 bp, Triticum aestivum
  unsure (1)..(467): unsure at all n locations
  Clone ID: PAT_TA_87729
cggcgggccgttcggcgagaacatcttctggggttccgggcagtcgtggacggccgccgacgcggtgaagctgtgggtggacgagaagcagaactaccatcttgacagcaacacctgcgacgccggcaaggtgtgcgggcactacacgcaggtggtgtggcgcaagtcgacccgcatcggctgcgcgcgcgtggtctnaccgggggaaccggggcgtcttcatcacctgcaactacaatcccccgggcaacttcaacggcgagcgccgttcgcgttcctcaaccttnacgcccaacctatanttcgagtgagtgtgattatacatgcatactactgcgtgtgttaattttgtgtngttggatattatactccacaatttactnngtacttaattacacaatcccggctcaagtaccatgcgtccntttanntgtaaatgtntcaaaacttactttaaaaaaaaaaaa

SEQ ID NO: 87730 - DNA, 479 bp, Triticum aestivum
  unsure (1)..(479): unsure at all n locations
  Clone ID: PAT_TA_87730
gcaaatcaaaaacgcgttaattaactccactacgcctcgtcgctggatttaaaggctggtgctgctggatgcatgggatatatgctcatcgccaaggagcgaacaagttcatcatcatcttccgtcttaacttcgcctgcagataatttcattctcaggaagaagaagatcatcgatcaacaaggataagcctgggtgggagatagaagcagcatggatttgcaactccatttgattcnaaactattacaaacgattttcaagaggatcaaaaagtttgcagtggtgggtatggagaaagttttacaaggcggtttaataatggaaaagaattgctgtgaagaactcacccttgcaaggactttacgattacatttcacagtgatccttaactttccaagtgtctcacaaaatatatagatggggtggtactgcacnaacnaanaataatctcangcacaatgggaaacttatggcgaa

SEQ ID NO: 87731 - DNA, 484 bp, Triticum aestivum
  unsure (1)..(484): unsure at all n locations
  Clone ID: PAT_TA_87731
ggtaccctatgccagcgaacggggatattattattttctgagtcatgcagcacccggagaagttgcatcttttcccggtggacgaattgaaagagatccagtactggccaaccttgcccagtacgttatcgctcaggagcgtttgacccagcgggtaatgggttatctccagagcctcgctgatttaaatcctcggatcgctattggcagaccactggaggcctgaccaggagaggcgcattcatcgactgggtcaacccgcttcccccgatagaagaggagtgtgccccagtaccaagaggcgttctcaagacctgtccttttgccgttttcgttgtaaacatcaaccgctgtgtttgttatcccagtatttattatgtggttgaaatttgtgcgatggtcaaattttgggttcaattaagtgagcatttactgcaattaatttggtttaacaattattttaaccccggnaatttgtaatgag

SEQ ID NO: 87732 - DNA, 495 bp, Triticum aestivum
  unsure (1)..(495): unsure at all n locations
  Clone ID: PAT_TA_87732
ctggttcctgcgcgacgtcgccaacgagcaagatgcggcggataacttggtggtcgagcactctgggacaattgaactagctggtctgcgctccggggaagcacctgcagtggctggaactgcaattggcaagctggctgtttcaaaagggaggcaaggcagagaagcacaagaacattgttcgactttatttggcaaacatacgtctcaagaatgcaacaactgatgttnttatcaaccgcatatgaccactgttgataaaccttttgaattaaaatgcccaagcaatttcaactgggacaacaattaccgcaanaacaagcangatctttccaantccggaggnttcnaaactncaatgataanttgattccaangaattggactttttnaatgggaacggttnaancaaaaanggtaaacncaatgctaaatnatcctnaaaanggttctgcaaaaaatntttnggaangtnttccttacaaaaacatcnct

SEQ ID NO: 87733 - DNA, 484 bp, Triticum aestivum
  unsure (1)..(484): unsure at all n locations
  Clone ID: PAT_TA_87733
ctttcaattacattctaggtcatggcttccatcatcacccctgagttttggtcatcactgtttatatctttctcctccgtggagaacgtgtatctgttgatatcgtatgcctgataagtcgcgagtttggtcgaggggccatgtgctaaggcgtatatgagtgttccgtttggacaaccctcttccgggggattaggcagaactctctctttngaaccaacgcacgaaagtagagttgtgctctctaataactcaagtgtcctgtcctgtgcaccccacagtcacggtactctctgcaatggctcttttgtgcagtgtcacaaaatcttcctacaatctaggtgttgttacactactaatttgccctgtcaagnccttttgtccgncccagcttacacatttacaccatatactttgtgtgacttcgccttcgaccttccaaangcttgttnataacaaaccaacaacaagnccccngngccan

SEQ ID NO: 87734 - DNA, 470 bp, Triticum aestivum
  unsure (1)..(470): unsure at all n locations
  Clone ID: PAT_TA_87734
tgagacttctggtaattgttatattaccatattatcatattagcttccaatcaattcgactgcaagttttgtcacattagtaaaccatccacgttccttttgcagaaagagcagcaccaaaaggcagccgaaagctacgagtcatcacagtcgtcgacgaggcccaagtgggacaacccattcaaccgggcctgaacatactgaaaatggcctgggtgggacaagcgccatcctatgggacatgttcacggatcggagaaagcgcctcatggaagacgtgctaccccgangaccagaggaangaagggaaaaacggttggccgtcacttagcaaaacaatcgaccaanaaggcctnattgcggtcantaaaaccaatcttaaacaaagaaaattccncgggtatcatgggttgggaactaagcggtngcaacttnatccgaaatttccaatggtttaaaacatcaatgnc

SEQ ID NO: 87735 - DNA, 473 bp, Triticum aestivum
  unsure (1)..(473): unsure at all n locations
  Clone ID: PAT_TA_87735
ggactctatggaccgacgggcgtcacccgtgtatataaggggacgacccggtggcggttcaggggagataaccacaactcgagcctaggcgaagcttgtttgctccctagccatcgagatcatatcaattccatcacaactagacgtaggctttaccttcatcgaaggggctgaactagtataaaaccctcgtgtctttgtgtctgctttaaccccttcaagtaaactccgtagcgatggtccacgactaatcctttccgctaggacatctgccgttgacaaaccacgacaggcgccaaatcacttctccccgggaantccttctccccgagccgcgaacttcaacccaactccatggcgccccaaccgcacaatttaanancgcctnctcccttatgcccggtccaattgcctttttgcatgctcctnggctcttanccaagctacggggtcctcnacaacggcgcaagaac

SEQ ID NO: 87736 - DNA, 404 bp, Triticum aestivum
  unsure (1)..(404): unsure at all n locations
  Clone ID: PAT_TA_87736
caactatgcccctcggtacggttcggtgcgggggcaagtcatgtttcccccccacgcacccacacccctaagatagataaatggggcaaagtccatacaaggaagatgtgtcaagtacaactatgcccctcggtacggttcggtgcgggggcaagtcatgttcccccccacacacccacacccctaagatagataaatggggcaaagtccatacaaggaagatgtgtcagttacaactatgcccctccggtacggttgggtgcgaagggcaatcatgtttccccccgcccccacccataagatagataaatgggcaaatccatacaagaagatgtgtcagttacaactatcccctccngtacgtgcggtgagggggcaatcacgacctcaattactatataaaa

SEQ ID NO: 87737 - DNA, 460 bp, Triticum aestivum
  unsure (1)..(460): unsure at all n locations
  Clone ID: PAT_TA_87737
aagacttcaaaatggctgagaagaccgcccccaccaaccccatgaaggatctcaagatcgagaagttggtcatcaacatcgccgtcggtgaatccggagacaggcttacccgagcttccaaggtattggaacaactcaccggtcaatcccccgtcacctccaaggcccgatacaccgtccgatcgttctccattccgtccgtaacgaaaagatcgcttgtcacgttaccatccgtggaccaaggccgangaggttttgggagcgtgcttttgaagtcaaggagtacgatttnaagaagcgaaactttancgagactggtacttggtccgtacnnatgacacatcacttnggtacaantacaccccggtaccgacttccgnaangcttcactccttatggccacccgtatccanttccccaagatncaacacggcgatcgnttcaacacaagcaagaagag

SEQ ID NO: 87738 - DNA, 510 bp, Triticum aestivum
  unsure (1)..(510): unsure at all n locations
  Clone ID: PAT_TA_87738
gtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctnccaagcttgaaggggatgacctagattttttcaaagaaagaatgtttagcctgccacaaattactccttaacaagctcaaaggacttcaattctttnttttggcaaaaanatgcaataataatggngctttggngntttncccaacnanaagggnggaactgctnttccaantttccnggaactttgccaaaanggctaaaaaaggcaatngcnaacccnacggtnggcnaaaccanacgggccncaatattttgccccccccaagggggcaatncaaccccnaattttntccgggacaaaaaanttaatgtcctga

SEQ ID NO: 87739 - DNA, 476 bp, Triticum aestivum
  unsure (1)..(476): unsure at all n locations
  Clone ID: PAT_TA_87739
tttctctgctctcttcacaactgctagaggatccctcaagagtccgatcttcacgaggtatgttcttttaatttggaagttgattgttttcagatgctgttagaactccccatgttattactagttactactcctccgttcctaaatctaagtcttcgtagagatttcactatggaccacatacggatgtatgtagatgcattttagagtttagattcactcattttgctctgtatgttgtccatagtggaatctctacaaagacatatttaggaacggagggagtacatattttacctttgtttgtttgcctttgtgtggctgcgcgcagttttgatgccgtggctgcaagtcnaactcttctgtgtttgcatcaaccaagattaatggcactgaatcaataaaagcttcnattaagaganggggggcccgtaccaaatcgcctatagtgagtcgtatacnccgctcaacgggcg

SEQ ID NO: 87740 - DNA, 494 bp, Triticum aestivum
  unsure (1)..(494): unsure at all n locations
  Clone ID: PAT_TA_87740
ttagaccgcagacgctagacgaggaaagcgcatcatgccgcgaaaaacgcaagtttgctcttcctggagccacgcacagtgcacaagcttcataccacactccaaagtatcgcaaacttagcggtctcaagttggacctctccgactgcgaagttgaaagtccaccacagagaagcggcgtgcgaaaaggcagcatgcaaaccgagccaacacgcaaacccggccatcatgtggccacatcaagccacaacaaggacaaacatcatggaagaagcgacgccatatgcaacgccatacaacagtatgccatatgcatagctgaagcagttaaggacatatacgtcgatagtattcaagaaaaccaagacaggcgttttcttttcatctccacggccgagctaccaaacngaaatactatcatcaaaggagctancanggaatcatgggttaaaggtccccagtntgctcctaaaacgatatagccgactgctgga

SEQ ID NO: 87741 - DNA, 501 bp, Triticum aestivum
  unsure (1)..(501): unsure at all n locations
  Clone ID: PAT_TA_87741
atttgaataagatcaatatgtttttgagttaggtgaatttttttttgaaaaattgatgaacaaattttgaattccatgatcaaaatttgaattttatgaacaattatagaaatttatgaatatatttttgagaatgatgaacaaattgtgaatacgatggacatatcttgaattttgataaaagttttttaaatacgatgaacaaaaaatgaattcgataaatatttttttacattgatgaacattttttgaatgcgatgaagaaaaaaatgtacgcgaatttggnaataaaattcgcaaaaacacgtgaatttttttaaaaataaaaatacnaataaaaacgannaacataaaaataaatgtanaaaacgaaaaaagaaaagagggaaaaaacgatagaaaaaccgtaaaatgggcaggccatacgacatccagcgcgtcatcctttttttttgagatcctcaacgcgtcaacccaaaacccanggggggccggtaccaa

SEQ ID NO: 87742 - DNA, 489 bp, Triticum aestivum
  unsure (1)..(489): unsure at all n locations
  Clone ID: PAT_TA_87742
gtgggtggagaaattcaacatcactcgccggccagtagagtatcggcacgacgtgaggttctaccaggctggttgcttcgatggttacatcaccgcacactatcagtccccccagcacatgatctgtctgtggagaaagttgcagtccggtagcacccattgctgcaacgtgcgatgacgatggcgagaaatgcgagcactgtctgtccgagaggaagagatgatcgttgcatgcacggctcgcgtatcaaacgtgcgaatcatgagctgcgcccaanggaccgtttggcnaantgctctccgctggatttatcanatcatccttcatccnttgggttgggtggctgtttcnanctgctgctgantctggcacaaggntaccttgggatcctttnanggcngttaagtttaaccgcgtcaaaatttcctgananggaacttgcttttaagncctgggggctttgttataaaactagttaggattatttt

SEQ ID NO: 87743 - DNA, 439 bp, Triticum aestivum
  unsure (1)..(439): unsure at all n locations
  Clone ID: PAT_TA_87743
attggttcttaattgagattcgatttgataattttaaaatacgaggataagatgtcagaaatcttggtatccaaagaaaggtccctaaggggcattcttttttttttcaatctaagattcaagaagggactccacgaaagaatatcaagacttactaattattatacatttttttatcgtacatcttatgttacctacatacactaaagtaaggactacttaattctaacgaggaatcagataaatanggtcgattaaaaatcatttaanggagtgttataaagtctcttcattctttcatagaaggatcaaagcaaggctgcagggttaaggtcaaaattaaccataggtaaggtaggttncaattaattatttacctancgtaatttanngnaaatccggcntccttgctaaaaaaaaagagttacaaaagggatna

SEQ ID NO: 87744 - DNA, 423 bp, Triticum aestivum
  unsure (1)..(423): unsure at all n locations
  Clone ID: PAT_TA_87744
gccaacatcgccttctgggttgccgcctcgacatccatccgctctgccacatcctacatggtccacacacacagccttccaaggccgtcaccacgatatgacgccgctttctcttgaatcacaacgccgcacaacctagtgacccaaagcccaagctgcttagggcaaccacctgcagaccacgatgcatcacgaaattcgggtctgcgcatgtgtccacgacatactaaaatttctgattggaagacctaccatttctttcattagacaagcgccaccaaatcagcatcatgaccacacaccacttcccgcaacttcattcttgcattaagaactatcttgccancaagtacgaaatccaaattttaggcagcacgcaacggcttcaacaaggtcggtngtgtgcacactctttttaacaac

SEQ ID NO: 87745 - DNA, 422 bp, Triticum aestivum
  unsure (1)..(422): unsure at all n locations
  Clone ID: PAT_TA_87745
gacacagtggatgaggggattttttggttggtgcaagagaagctcacccacttcaccgacagctgcatgggttacatctacgtcatgtcgacccctaacacatacacgtcggacatgaaaatggttgactcatctgacacaaaggcaactggctacaagggatccaacaagtggtgcacgacaacctgcactaaaaacatggcatcaggcctcgacgaggccaataaaatgatcagcaaccgtatgcacagcaatggcatcatcttactcttctctgatggattgataaacaaaggagacttcttcgatngaaccaagaaattcatttccaaagtaccgtctacacgtttactctcggcggatacgcatatnacatgttctccactccgcttcagaaaatctcctggcgggaagttcacatt

SEQ ID NO: 87746 - DNA, 297 bp, Triticum aestivum
  Clone ID: PAT_TA_87746
gcttatttaggtgatgtaaactatattaatcagacacgagttttcggattagaccttccccggtaatcgttacgcagaatcacaagttcacccttggaacacaaacatataccaatgtgcaatcagtattttaggttgcacacgagcactttgtgcttcttgcaaaggaaaggtagcatctgcatcatgacttaaacccaaggcaatggactgaaagcaaatggtaaaaagtgcaataatcatatagaagtgagcatccatcgctagcaacgtagcatatgacttatatacttaact

SEQ ID NO: 87747 - DNA, 428 bp, Triticum aestivum
  unsure (1)..(428): unsure at all n locations
  Clone ID: PAT_TA_87747
gaaatctatgatgtacatggagtgcgtgtgatactcgagaataaagctgattgcttcaccacattagaagttgtccatcacttgtggcctagaattcctgggaagtttaaagactatgtcagcagccccaaatctaatgggtaccaatcgctgcacacggttgttctcagtgaagaaacactcccattagagatccaaattcgtactgcggacatgcacttgcaggcagagtttggaatcgctgcacattggagatacaaggaaggcgtacgtaactgctcttcatctctgcctgaaatggttgaatgggttagatgtgtcgttacatggcagtgtgaaacttgcacatagacaaccttcgcctcctggacttggtctccccaagggcaacatgcancttcccttctgactctaatgntgtccttctc

SEQ ID NO: 87748 - DNA, 419 bp, Triticum aestivum
  unsure (1)..(419): unsure at all n locations
  Clone ID: PAT_TA_87748
gttccttttaccatcaaccttagacgcacagtttgggaccccctacccgagatccgccggtttggacaccgacattggtgctttcattgagagtttcactgtgccactgtcgcataggtcgatggctcgacttatcatcaaggaaaatatcatcttaggaggagctctggcctcggtccaaaccctccggctgggaggttttaccatgatcgcccgctcggcctctgagccgacnaggatgacctctcgagtcatcgaaaaatgcatctaccttgattctgaatacaccaaacggatggatncagcanaattatcgtccttgaacgaactcctagattgcatcgcccccctgggagtcactacagactacaatcggattgggcttaaacccgacaagagagagattaattctccatcnn

SEQ ID NO: 87749 - DNA, 368 bp, Triticum aestivum
  Clone ID: PAT_TA_87749
cgtcgacgagtccaaggcgctagggctgccagacctgccgctcgtcggaaccgttaccggtaccagcaccattaccggcccgctggtggtgcttcctgggatccctgctcacccatgatcatctcgtgttcatgtgcttacaagatgaagctcaccttgtggctttagactttaggctctagctagcaccgtccggaggaaaaatgccggtgtttcgctcatgtccatgctccttaatgggcgtctgtatcaaccagcctgtcgtctgtatttctttgcagttctttgttccaataattttcgttccttgatgtgccacatgtatcatcaaagtaataaatactactccttttgtcaaaaaaaaaaaa

SEQ ID NO: 87750 - DNA, 511 bp, Triticum aestivum
  Clone ID: PAT_TA_87750
tggtatgctagttcaatactcttgtagaaggaactgttgattgagaagatagaattatgaatgacattcaaagcatatttcatgaatgctattcatcttgcgacatgctcttcaatttggcatactgttgtatactcaatattgaataccattgtgttttttttttcattcctgagattcatatgtaggagtagtaagttattctcttccattgaaagttgtgactcggtgtacggtatgaacattcatattatgaccaggatgccacatattttatagatagaggcaattctacatgataccgaattaaagttaagtgataagtacagataatcctagctcaaggaatgtaaggagaattgccgttatagccaacggcacaaacactatgataaggtttactatgtaagcatgaatgtatgtagagagttatgggctattccacggttgatgcagattatgggctacaagttttggcatgttttttcctgggtcctatattgcatgaact

SEQ ID NO: 87751 - DNA, 295 bp, Triticum aestivum
  Clone ID: PAT_TA_87751
ctccctctcaccgctcttctccacatccggtcgccgccgcggcgaggccggcgtggcggcgcgccaccagcaccttccaccaccagccgcacctcacaccgccaccagcaccacctgcattgcccagcgccaccgctccaccgccgcacctcgtgcgcccgatcagacgggcgtctggtcctccctgcgactccactccttctccatctctctctgctacctttcttcccttacctccgctgctccctgctgtttcgcctcgcctacctcaaccttctgctgctcctcccatctt

SEQ ID NO: 87752 - DNA, 518 bp, Triticum aestivum
  unsure (1)..(518): unsure at all n locations
  Clone ID: PAT_TA_87752
gctcgagccctccgccgccgccgcgacttcagctctctccttccttctccgatccaagatgaagttcattgctgcctatctgcttgcttacctctctggcaacgccagcccctctgcagaggacctgacatccattcttgagtcagttggttgtgaaattgacaatgagaagatggaactcatgctgtcccaagtgaagggcaaggacatcaccgagctcttggctgctggtagggagaagtttgctgcggttccatctggtggtggtgggntggctgtttcagctgctgcccctgctgctgggaggtgctgctgcccctgcagcttgagtcaaagnaaggagagaagcgntggagaaaggaagagatgatgatgacatggggntcancctgtccgactagttgtgggggatcctgggtcctgaanatctacccttgggcaaagaaactaganccnaggagttttaancttaattaaccnagttgtgaaacgctggnaaaacaaggttggananttan

SEQ ID NO: 87753 - DNA, 242 bp, Triticum aestivum
  unsure (1)..(242): unsure at all n locations
  Clone ID: PAT_TA_87753
ttaaaccangacggcctttctctctggaatttaattgtgtgtgattctgaactcaaataatcgcatggatttcgtaatttgaaatagtgtataaacgggtgcatatgagaatcacccggactaagaatgacaattataactgtatgcggaggctgaggaaacgtgtcatcaaatgtttgctgtacacacaaaagcccacattgatcatctctgtacatattttctcaaataaaaaaaaaaaa

SEQ ID NO: 87754 - DNA, 416 bp, Triticum aestivum
  Clone ID: PAT_TA_87754
ctcctctgtcctatttctcctctatcaaaaatacgaaaactaccacgagaaataagtgatgcttgctgctcttcactgctaaatatcatgatgaagtatatcaagtgacatcgtcccagaagaagagatgagcattcaatatacaaagaaaaaaaatcaggtccaatatttgcatgaatactgattctggcaacatgttaatgattcataaataatctcccgtttcctctaacctatgtatgtctttctatattaattcataaaaatgaatcagcatagttcatatttgatttcaagataaagaaatttgaaagatgtataagaggtgaatcaaatgacattatttcaaagttgtacaacatatatcatcactactagaaaacattttgtaggagggtgcatttaatcttctgtac

SEQ ID NO: 87755 - DNA, 328 bp, Triticum aestivum
  Clone ID: PAT_TA_87755
gccggccacgctgcccaagaccgtcgtcgtcgccaacggccacgtcaagaagacggagctcgagacgcagaagtcggtcacggaggcgtggaagaagtttgtgcttgccaagaagaccaacggcgtctgctagtcacaatcaacagtctccaaaacccaaatcatcaagctacccatcttatagtactattattatgtgagtcgagtaaaactattattataggctgatttaggccgagtttgtaaccaaaattttgctgtggcttttatgacttgcgcacttgcgctgcagtgatggtactattttctgttaaatggttctgcaact

SEQ ID NO: 87756 - DNA, 435 bp, Triticum aestivum
  Clone ID: PAT_TA_87756
ccactacatacacatcaaataacttgatttctttattatcgtaattagtttattaacaattgtgaacaacacgtaactataaaccatacattttgacatgcctgcagccccgcaaggtcgatgccgaatggaaaccggagtacgtatacacactcatattcggtaaaaccaaccaaataaaggaccatcaacttcctagaaaactcaaagattacaaaccagagactacaaaccttttttcacccatgaaaggtaatataactattttcatttttaccatcagtcaacattactagagcttcaaatatttcttttagaaacaacagccataattttttatctgctttgacagagcgagacgaaaaaaccagcatcaattagagagcagcaagaaatacccgcaacaccggcattcgtttctacacgtggataagg

SEQ ID NO: 87757 - DNA, 412 bp, Triticum aestivum
  Clone ID: PAT_TA_87757
gcctcatgtgtatatcagctagctaatgtttctgcaaaaattagtgtttgtatatagcttgtatgtacaaacatagatttagcccattttggcactacaattgcatagttttggtagttctacttgtacatagttcatacaatttgtttctttgtctactgatggctatggcaaatacgatgctacatgggaaaattgtgacgcaccttcgcttggtgccgccacaggaccagtgcgccctcctgtcctctgcttttatctgtgcgcagctatgtgtctcgcaccatggcttgcccctgctgctgctgggaacagtcaaatttgtgattggcttcgaagacgttccacgaagtcccactacatgtatacgtcatgttcttcagagatgttccgtgaagttctactactgctg

SEQ ID NO: 87758 - DNA, 430 bp, Triticum aestivum
  Clone ID: PAT_TA_87758
cgacctgtcggtcatcgacggcttcaatacgcccatgagcttccagcccgtcggcggcgcgccgtgccgtgcggcgacctgcgccgtggacatcaccagagagtgcctgccggagctgcaggtgcccggagggtgcgcgagcgcgtgcggcaagttcggcggcgacacctactgctgccggggccagttcgagcacaactgcccgccgaccaactactcgaggttcttcaagggcaagtgccccgacgcctacagctacgccaaggacgaccagaccagcaccttcacgtgcccagccggaaccaactaccagatcgtcctgtgccccgcccgaaatgatttgcacatggatcagtaagtagaggatgtattactcctagtagtcttcctcttacttattatgatcatccatcattctgcgtgtgcccat

SEQ ID NO: 87759 - DNA, 420 bp, Triticum aestivum
  Clone ID: PAT_TA_87759
cgagttttttttttttttttttgagatctaatataatctttaacttttctagatgttacacgtatgaacattcaaataagaagatgttgatattacaatacaaaattagtacaaccatgaatactaaaaaattgagcaaactttatacgcgagttctcggggaagtaaaaaactagggagttctcaacgattgctatcctcaagttttgaagcatttcgctcctcgggctttgaagcatttcgctcctcgggattgctatcctcaggttttgaagcatttcgctcctcgggattgctatcctcaggttttaaagcatttcgttcctcgggctttgaagcatttcgctccccgagattgctatcctcaggttttgaagcatttcgctccccgagattgctatcctcaggttttgaagcatt

SEQ ID NO: 87760 - DNA, 332 bp, Triticum aestivum
  Clone ID: PAT_TA_87760
gtagccgccacctctcctcggctcccagtgccaatcgggtccgcggtgttggttcttcgctattgtcagtctacgacgtgtttggtttgattgtttctgtagattttctcgttttttgcactgtcgccatggcgcatgtatcaaaggatgagcaaatactgcaacaatatgatccatgatctgattcttagtatttaagtctctgatgatctctctgccaatgcgagttttcaatcttgtttttcgtttctttataagtgggatgtgatgaagaaaagttggtccgtgtttctgatttacagtgactgattaccatccttaaaaaaaaaaaa

SEQ ID NO: 87761 - DNA, 407 bp, Triticum aestivum
  Clone ID: PAT_TA_87761
ccgaccgctagctatctggcaccctgcacatcaccgaccgcccgacgtctctagcacaccgtcaccgtggtagcaaggttgctgccctgtctccttcatcctcctgcactcacactgcttagcccccaaacacttctaaccctagctcgtgcgctggagttcggggagagaccaaggcacggtggtggacgccgccgtccctctcagatccggggctgagagagagagagagaggtgggtcacctgcgagagagagcactcgcaccctcgctcgtcaccagggagccgctaccatcgccgccacgccatgggcttcctcagatctgtgccagccagttcgtttgaagagggatctggccgttgactgttggtgcttcccctcccccgacgatcagcatgacttggga

SEQ ID NO: 87762 - DNA, 528 bp, Triticum aestivum
  unsure (1)..(528): unsure at all n locations
  Clone ID: PAT_TA_87762
tgagattgataaagctgaattaatcgcgttctactccaaatttattgcgccctggagtatcaagatcttagttgccctgctgatttttttcgtcgggcaattggttgccaaattcgtcgcccgcatactcggcaaagtactgggccgcaccaagctggatagaattctggttgagtttatccagtcgctggtaaatgccctgctgctggtgtttgtgattgtcgctgcgctcgatcagctgggcgttaacactaactccggtcatccgccgtattgggtgcagcaggttgggcgattgggcttgggcattgcaaggccactgcaaaattccgccgccggttttatgctgctgattttccgccccgttcaaaaggcgggattttggtggaacaanggggaacggccggtgttatcgaaaaattgggatttttcaaacgacctgcanaccggcgatacaaagaagtgatcatccccaacggngcatctacagcagcaatatcctcnattaccaaaaccccgacccccgca

SEQ ID NO: 87763 - DNA, 340 bp, Triticum aestivum
  Clone ID: PAT_TA_87763
ggagtgcctgctggtgacggcggcgtggggcttcttcttccggatcctcttctacttcagtctcgtgctcggcagcaagaacaagaggaggtgatcacgccgccgtgcattcgtacagcgcgcgcggatgcatacgtttgatttgaaccgtccaaggaaagaagaagatgatgacatgattaagcagacgccacactatcatctatcggtttctgtaattgttaaacagatgtgcttttgacttctttttttatctacttttcttctccttggtgattttgcaagtcaaataattaagtgggtcatacatatgctttcctatccaaaaaaaaaggggggg

SEQ ID NO: 87764 - DNA, 505 bp, Triticum aestivum
  unsure (1)..(505): unsure at all n locations
  Clone ID: PAT_TA_87764
ctgcttgagcgttcttctgggcgcatgccttggtgccgaggtccgggtggagaagatcagcgaaatgccacacaaccccaaagtacaaggcgcgtggacctattctgccaaagtcagtttctacatcgaacacgatgatgggacgctgagcgagccgctgtggacgactcgggcggaagaaggcggagaaggcaagccttactacttctctctcagtcaacaactgatggagggcttccgtattgggtatcaaagaggttcgcgaaggtgaacgggctcggattcacgtcccaccccgatttgggtttgggttcgaagactccaacatggcaactatccttcccggtggntcaaactccttttcnatgtccagctttaaaacctgcgaatgggctttgcatcaagatgagaacancctgtnggagatgtcntcaacaagaanagntttcggttcaagaaggaaccaaggaancccccaagcacaaagacnaagaaggacaagcca

SEQ ID NO: 87765 - DNA, 517 bp, Triticum aestivum
  unsure (1)..(517): unsure at all n locations
  Clone ID: PAT_TA_87765
cagagtcaaacttactgaaaagtttccaggcatcaaatttgtggttgccaagaaagctgatagtctctaccctgttgttagtggagcaagtatagttgcaaaggtcactagggatagagccttacgaaactgggtatttgatgaaacagctcagaatatgcacatgaacactggatcaggttatccaggagatcctaatactatacaatggttaaaagatcataagcatccagtatttgggtttcccaactttgggtgcgttttaagttggggaacttgcacggcatacttcanagaatggagtttgaagcacatgggantcggacgaagttngatgaagatgcagctggctacggaagcgccaagcgacagncacgttgtccagcttaggttcacagggttcaaaaggaanccgaggagattcnaaccnagttggaaaaggcgttgtaantcttcccaantccgtnaacttngacttatcanaaattccaatggacttgcactagnccatggnact

SEQ ID NO: 87766 - DNA, 359 bp, Triticum aestivum
  Clone ID: PAT_TA_87766
gactcctcggacctcgacgacaaggcctcctgcctctacgatgagctcctttccttcttcgagacaccctgcgatagctgctacgatgtcattgacgacgaatgtcagcttgctctgatggagtatgcttgcgctgcgaccttccagccttgtgatgtcgacggctttatcgatgcctctatctgcgtcgacaagtgtactgctgtcgaagctgcttgcccctacagctttgttcaggctgggtcttcccaaccttggactgcggtcacgctcgctacagcaccaagcaactgcttctaaatttgttgtcccttctttgaagcctgattaaactcaactttgctgggaaaaaaaaaaaa

SEQ ID NO: 87767 - DNA, 499 bp, Triticum aestivum
  unsure (1)..(499): unsure at all n locations
  Clone ID: PAT_TA_87767
cttcccttggtttgaatactatggtcagatttttttcccgagaatccacaagttgtgctggtcttgaagaatgtattaagttcattgcaaacttaaagttcagagatgatatgcaagggcgccgcctctccctcaccgtccatcgtcactagacacgacgtccatttcatttcctccaggagatgatggagaggatcaagtagaaggatgaagatggtgtaggccatggaggcatgaacccacgttgtgggcaaggttaaggacttgctgatctagaaaggagagcgatcaagaagagagcattcataattacggaagaaccttgtggtttgccaaaagactngaagagatagaagtatcaagtgtggtttggtcacaaaaaaggatcctgaancctcttnaanggctttcaaagggtatgtagtacaaagatagacatattgattgaaacacaangggtgccttttttaacttcctttccttccntttgananaaagt

SEQ ID NO: 87768 - DNA, 465 bp, Triticum aestivum
  unsure (1)..(465): unsure at all n locations
  Clone ID: PAT_TA_87768
aattgctccattcacagtgaatattgacccgagcatccagttaaatgctgaagattttccctggctacggcgcaaagggacacacgagaagaaaaggtttcacacccaaagatctgggatgtgatcggcttcactatcatcactttcttctgtgtttcacacccaggagggaatgtctgtaatagttagggtagttaattgtgagttttggcatctgaaacgcgaagaaattttatctgcaaacaaattctttttcatgcatttactgatttgaaacgaactcagaaaaggttgaaagttggcatggtatcataatttcatacaaatagcatgtgcaaaaaagtagagagggttacggcaaaaactgganacacttcgngtacaaaatggccaatctttttcgaagtatcagggtttccgacgaaaactaaaatgttacaaaggcatttcattttttcantaacc

SEQ ID NO: 87769 - DNA, 400 bp, Triticum aestivum
  Clone ID: PAT_TA_87769
gaagatgtccttagcaataactaccgtgggtattactagtgcacaatcatactatgaagacacaccaattgcacactcttaaactgaagtgtgtgtgatgtaaccatcacaaacgggagaaaaattgaaccgtctgccagaaaaaaaagtgtgcgatggccgatccatcgtacacgatttagaaaaaagatgcatgtatgatatgggacacacagttttatcaaagacctgagtgcaataagttgaaataacacatatgattccaccacacaaaccatgtgtgctgcctggcaaacagttgcgaggaaccacttatctgcgataatgggaacatggcaaacggttgctaggaacgacgcgtgatggtgtaatcatcacacacgtgtctccaagggggggg

SEQ ID NO: 87770 - DNA, 496 bp, Triticum aestivum
  unsure (1)..(496): unsure at all n locations
  Clone ID: PAT_TA_87770
cggaggcgctgccgcccgccatgaagcacgccttcagcgtcgttgtcgcggaccctccttacctgagtcaggagtgcttggagaaggttgccaagacggtctccttcctcgcacggcctcaaggctcattcctgctgttactcacaggcgaagttcagaaggaccgcgcgctggagctcttaaacgtgcgcccctgcggtttcaagcctcagcactcgaacaaactggggaatgtgttccggctgttcacgaattatgacccggtagacagacttggtggctgggatcagagcgatggcgcccccatttagccttctgatgaggttgcccatggtgcttgtggaaatgtgacagcgattgttcatcctaaggatgctctcgtatgatgcatctttcagtccggtaaacacgaatttancacttaatgttttttgtttgataatctgtgtcaattaccccaagtattaagcgaaccaaattcntcncaaatgtaacc

SEQ ID NO: 87771 - DNA, 492 bp, Triticum aestivum
  unsure (1)..(492): unsure at all n locations
  Clone ID: PAT_TA_87771
ggtgggaanggcgcgcgggtgatcctccccgacggtcgtggtgcggcgggtgtcgctgncggncacggcggcgganctgatgatngacgcgccgggccacttcgtggccgagacgcgccacgcgcgcgtcggcacccgcctcgaggcgctccacgccgacgaggacctcgagatgggcgtcgtctangccaccttccccatgaaccgcatcggcacgaaagctggccgcagctgacatggcccgcctcgccgccgcggncacncgggaggcccgccgctccgccaaggtgtcctccgtcngggtccgggccgcggcggngaaaggggctgcaacaaagccgggcataacttnttgnggccgccgnggaagcggcgtctcnaaggngccggtggacaaattgttgacnaaccgtggccccgggatttaagtggtcaancaccggtcaaaaancngctcaanngggcaacttcnnacatcacggggggatactc

SEQ ID NO: 87772 - DNA, 506 bp, Triticum aestivum
  unsure (1)..(506): unsure at all n locations
  Clone ID: PAT_TA_87772
aaagggcacgacgagagaatggtgcggtggtccctctcggcgttgatattattggctctaggcttctcactcgacttgtttggtggacgtgtacggttacaagaggccggttctcccaatggagttgatgggaaagcatgccctgatgatttttgttctggtagcatgcaacgtcgcgccaatcctgctccaggggttctactggagggtaccaaataataaccttttgaaactcattggaagaggcgattgatcttcccagttgcaagctagttcaactaatgctcnaaggaagcatattatcaactatcagtgcgcaaagccatcatcnatttcacttgaagtcaaatgcaatttcgtgaactcaaaggaaacntaanttttgggtgtgaaattgacccctatcgtccgggcctcatgataacattcgtaaataatggtctccaaacantgctagctaaatcntgtaagtgtaattggtggnantttttttaaattaaaanttt

SEQ ID NO: 87773 - DNA, 404 bp, Triticum aestivum
  unsure (1)..(404): unsure at all n locations
  Clone ID: PAT_TA_87773
atgcttctccccaagatttgaatctggagcctgacgcaggtgttgcagggatggttggatttttattgataatgcatctggaattaactcactcggctctaactcggctctatctctcttgggaaggcaaccccttgatagtttatgattttgggtgcatgtatagatagcatgttgtaacaagtttttttgatactcagcgtgaccaacattgcttgtacatattggtcaaggtgttctacttgcaataactaacttcagctatagctatattttttgaatttggctttaagttgaccatctatctnatgtangtgttcattcattatgaatttgatgtgtatgatgaattttggatgtgatttataaatttgaaatattgctttgaatttaaaaaaaaaaaa

SEQ ID NO: 87774 - DNA, 453 bp, Triticum aestivum
  unsure (1)..(453): unsure at all n locations
  Clone ID: PAT_TA_87774
gcngacttcacctgggaggttgtgaacccccncaagtttganaaggcctctgcttgagaggtgggtatganggngtctatcattcctgctgctgccgcngncggttgnatcntggntaantganttccttcnctttanaaggaagcagggtttcaanatctccgtgganacgctnnattggcgtcagtgnttggtattttggtatggcacacagaaatatgtgcngagttaatantangtcggntcttttgatgtcatctgtnctttgatnttgctttttnagtctactgaaacggcagtactcgttncggtttcctctaacggtccgtccaagttattttttaagnactgcatctntaaaaccatatgtgntcctaagnacctgtncatccatanggngngcccngtaccaantncnccgatanagatcgtttacncgcnccaacnggagtg

SEQ ID NO: 87775 - DNA, 485 bp, Triticum aestivum
  unsure (1)..(485): unsure at all n locations
  Clone ID: PAT_TA_87775
cacaaaagaagccaacaccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaggccgccggcgccaccctcctcgtcgccgccaccgccacccacaaggcgagctccggcgggatggagatggcggcggaggatggcggctgcggctgcacccagtgcaagtgcggcaccaagcttgccgctgctcctgctgcaagctgctaaatcattgattcatcgatcaatgcatgcaccgcgccgcatgcatcatatcctatgattcgattcatccatccatctaagtaacatgttnacgctactgatttaagggccttgtatgtatgttaagcacctgccaaacatgagcaaagcaaggtgcanccccatgcatttttaaaccgaccctaaataaan

SEQ ID NO: 87776 - DNA, 472 bp, Triticum aestivum
  unsure (1)..(472): unsure at all n locations
  Clone ID: PAT_TA_87776
caccgtcgaggtcatgctcgccaacctcgtctactgcttcgactgggagctccctcacgggatgcgggaggaggatgtggatatgacggaggagtttggactgacgacgcgcctcaaggagaagctccttctcgtccccacaataccaccacaacatgcgcaccataccagctagtatagctgcaatgttcttgcagctgcggtggttgccggttacaaggagaaaggcaagcagagaggtggagaaacccgcggcaatgatcgtcgcacataattnaagtcaggcaccatccatctaaggtgccgggaccctagtcttgttggtcatcttttgcttgcctctgtgtgggcagcaatgatgccattatgtatgaaaactaatctcctcaatgtgtggggatttgcaagacttgtgggtgggttacagttaacttcataattcaaatccgggcatgctctgaaaaaaaaaaaa

SEQ ID NO: 87777 - DNA, 557 bp, Triticum aestivum
  unsure (1)..(557): unsure at all n locations
  Clone ID: PAT_TA_87777
gttccaccatatcctggtctcctgaggacaatctctgggcgaggaggctggcatcctcttacgatgctaacaagagacccgtgtcatgaaatttgtgccggtaagtatgagtcttgtttaaactgatcaaggagattggtctaccggtctgttgcgtggttttggcatgctcttgaggccggccaattgctggtgatgcaattcgtgacatcattcacgggctagcacctcccgcgcatccttcgccgggttttgacaagctcttgaagccaatagcagctgtcaaggatcactaattttgcatgagagttgatggtgacgaagattgaaccacatggctcacctccactcaattcattattaattttctcctcagaactgtcttgcttcaaatgataagaatattttttttcccgctatgcatatgtatgtatgtataatgtatgaatgtatgtatacaaggactgtgggaatgtaaggatcacanaatgacatggtaccaaaggcattgtaaacttggaacncaaagtctcncctgttgagtcaaaaaaaaaaaa

SEQ ID NO: 87778 - DNA, 563 bp, Triticum aestivum
  unsure (1)..(563): unsure at all n locations
  Clone ID: PAT_TA_87778
agcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaagtttgctgcggttccatctggtggtggtggtgtggctgtttcaagctgctgcccctgctgctggaggtgctgctgcccctgcagctgagtcaangaaagaagagaagtcgtggagaangaagagagtgatgatgacatgggcttcagtctgttcgactaagttgtggggaccttgtgtctgaagtatcatccttggcaggaaactaagtcaatgatgttttacctttattagctanttgtgaaacactggnaaganatgtttgatangaatcaaccccggttgcgggtgattacnggggancaaacnttgcaaca

SEQ ID NO: 87779 - DNA, 576 bp, Triticum aestivum
  unsure (1)..(576): unsure at all n locations
  Clone ID: PAT_TA_87779
tttagatctgatgttgttgattactttgtgcaagtctggggttagcagttctcaagttagggaaagtatgtacgtttgcttttgatgttgtaggccacaagaaccggtatctagcattgcccctcccactgcttgggagttttttaggatcgcaagatctggaagggtgtcacgccgacggggatcagagtaggcaaatagataggacaaggtcttctcgatctcgcctggctggcccaataggaaaactcgaccttaatctgcacgtatgtactattcttaatatagtttcatccaaattcgatccatcggcaagccgatctatatgcatgcattcctgtgttgcagctatatgcaacgtcgacacgtgcgaaggtggccgtggcaagtttactcntgggctgatagctgatggccggtaacaacgttgtcctccatgggtttgatctcaccntttgatgcacgaggcttggnacggtccgtaataaacatcatgtccttcntccttttttgaaaaaaaggagcatcttcaattntcaangggaaaatgcaagtgaaaatcanggaaaaggtnan

SEQ ID NO: 87780 - DNA, 460 bp, Triticum aestivum
  Clone ID: PAT_TA_87780
ctgatccggtgggcttgtggcgacagaggtggcaggggaagccgacggaggggatgtaagcagagataccaaccatcaaaattcagagagcaacaatatcaatgaagacctggaccaaacttttcatggcaatgtttctaaagttcaggcctctaacattgatttaacaaaaccatatgcatcaggtagcatgttgcttgatggtatcagaaaaatgctgcaaaagagtgatgaaaggaaacagaggaggaatgttttgaaggagcaaagcagaaagaggtcaagggctcagatgggtgtttgcataaaggaagagcaagaaaaagaacgcctacttcctttgtctttttttggcaagcttgtttgacaagaaaagtgcacagacctaaactgggcacaaggccaacatctgttcccaatccttttatttacaacaaacaattattacaaaaaaaaaaaa

SEQ ID NO: 87781 - DNA, 541 bp, Triticum aestivum
  unsure (1)..(541): unsure at all n locations
  Clone ID: PAT_TA_87781
gatttctgctgatgctctttcatctgtttttttctcgagtgcattagcatatgttatatatatagtcaanctcatacaaaggactgttgtaaaacaaatagtgatccattttttatatgaaaagtgcacccttatgaatttgcaactagcagacgacaaaatgtgtggccatttgttgacatcagtgtggcccatgtggtattaaataaaaaagctacctgcatttttaagatacccctgaatcgttccatttactgatttagtggataaacttttgatcacactgctaaacctattatttgtgttaatacttaatacacaccccgagctccangtctagggaaccacctttccattgttaanattttccttgccgagaagatcatgctaaaacaattccttcngatgatngcaatcctacatttttccanggccaaatatttaaggttgcaaaccgcatacactcntttgaaaaggggcgatgcancaaggacngcctaaaangtaagnagttccggaagcctcgtggactaaagttgcc

SEQ ID NO: 87782 - DNA, 596 bp, Triticum aestivum
  unsure (1)..(596): unsure at all n locations
  Clone ID: PAT_TA_87782
ttttttttttttttttttttttacacataccattttcagtaaatttcacttctatatgagtgaatttgagagagaaaatgactattacaaagtagtgacatatgcattttcagtttaaaagagtgaaatattcacatcacgtatataagtttcacaaatctgcatttcacatcacatatagcagttccacatctacatatctatttcaattttgaaacaacaatttaacatatatcacataatcctggctncaaatcttcactttgattcaatttgagaccttcacttccatttgctgaatattttggtagattccacaactgaaacatttatatttcaatctcacaagcatggggactgtccatctggtgaaaaagcaacgagggcaagctcanatcatatagcatgaaacaaaaatcaagaagttcaagagagaaagagagagagatgttangggagttgtgcttaactgggggtggatccnggctgctccctcgtccgcatcggcggnacgggtctgtccactaggagnggatccatgatttcagtccaaaaaagagtacacancccccgtcacaacattaaatactgaaacc

SEQ ID NO: 87783 - DNA, 220 bp, Triticum aestivum
  unsure (1)..(220): unsure at all n locations
  Clone ID: PAT_TA_87783
cattcattcaattatgagtgtacataacagtttctggcgactgttactatgtgagttttatttatttggctgacggttcaattttctctcnaatggatgagaaaatattctctgtttgagtatcgagtaatgtgcaatgcgtacctgatctatctatttcnttgggtaaatttgggtttattcgataaatgccactgcaatttttgccaaaaaaaaaaaa

SEQ ID NO: 87784 - DNA, 491 bp, Triticum aestivum
  unsure (1)..(491): unsure at all n locations
  Clone ID: PAT_TA_87784
gaagctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgaagctccggcggcatggagaatggcggcgggagaacggcggctgcggctgcacccagtgcaagtggcggcaccaagctgcggctgctcctgctgcagctgctanttcgatcatcgaccatatgcatgcaccgtgccgtgcgtgcatcatcgatcatatcgatctactaactaccaatacaatgttaccgcaacctgatccnagggccttaancaatgcaacctgacctgcatcaacaatcangtgccatgccatgattgttaacaagcccccctaaataaatttcccccggattaact

SEQ ID NO: 87785 - DNA, 493 bp, Triticum aestivum
  unsure (1)..(493): unsure at all n locations
  Clone ID: PAT_TA_87785
gagccctccgccgccgccgcgccttcagctctctccttccttcaccgattcaagatgaagttcatcgctgcctatctgcttgcttacctctctggcaacgccagcccctctgcagaggacctgacatccattcttgagtcagttggttgtgaaatcgacaatgagaagatggaactcatgctgtcccaagtgaagggcaaggacatcactgagctcttggctgctggtagggagaagtttgctgcggtaccatctggtgggtggtgggttgctgtttcaagccgctgctcctggctgctggtggtgctgctgcccctgcagctgagtcaaagaaagaagagaggcnttggaggaaggaanagatgatgaatgacatgggtttcattcngttccgacnattcctggggnacctggtgtccgcaattatcnaaccttgggcaaagaaactaaanncatgangtttaanctttattaacctanttttggaaacccg

SEQ ID NO: 87786 - DNA, 505 bp, Triticum aestivum
  unsure (1)..(505): unsure at all n locations
  Clone ID: PAT_TA_87786
gtggttcagcaagtcagagctccaagtactgttatgttacatatatgcgaaattccaaatttcatggacaaaccttgttttcttgccatagaattagatgcagacgaatctggggtttaccagaattagagtcaaggacaaacactctctcactgtttacctgtaaaaaaaagaatactagttatcattggagcagtgagaattagacgcaaacaaaatcaactgcttaagtatgttcttactggagctactaagacagcatgcctgacgatgttttggtgtgacgcctctcctaattcaagtattttttccctgggtataatcnaagttccgaattcagggaaatccgtgattaaangtnatattgggaggaaagattgtgctccctaaggtttagggagttcaccccatgcctagtttaagcaaatngagactcccaactccctaatgctatgcatataaggtgggatacaaattccaagggacaagccggntttgctgccaa

SEQ ID NO: 87787 - DNA, 486 bp, Triticum aestivum
  unsure (1)..(486): unsure at all n locations
  Clone ID: PAT_TA_87787
ccaccatcttcaccaagcaccgcacatccgtccaagtcgagcacacacacagggagaacacaccagcccctttgctttgcacattgctttgttatgcatgactgctgatggatgcagcaagcgtttatattagtttgatcttgtgcaagactcaattttgtctcggttttcgtggatgctagctggcaatacgtccaacattcttgcggcgatagcggccaccactaagggcatttgcgtccaacactccgagctacatgctcgacggtcgcacactgccgccatggggcatgcacaaagatattaagtagaanttgttagtcagtttttaatgattaccttgnttaaagtagtagtgcaacaataaaagggtagtgtacgaagtttagtgctatatgaggaccagaggcattatttggtttcaantcaactgncnggtctttccggcccggtgcttatgcgcaaaacctgaggacccaagaaaca

SEQ ID NO: 87788 - DNA, 488 bp, Triticum aestivum
  unsure (1)..(488): unsure at all n locations
  Clone ID: PAT_TA_87788
atcgctcgagccctccgccgccgccgcgacttcagctctctccttccttctccgatccaagatgaagttcattgctgcctatctgcttgcttacctctctggcaacgccagcccctctgcagaggacctgacatccattcttgagtcagttggttgtgaaattgacaatgagaagatggaactcatgctgtcccaagtgaagggcaaggacatcaccgagctcttgggctgctgggtagggagaaatttgctgcggttccatctgggtggtggtggnttggctgtttcaagctgctgcccctgctgctgggaggtgctgctgccctggcagctgancaaagaaagaagagaagccgttggagaaggaagagagtgatgatgacatgggctcaatctgttcgacnatttgtgggnatcttgntccgaanatctaccttgggcaaagaaactagancnaggatgttancttattaacnaattgtgaaccc

SEQ ID NO: 87789 - DNA, 453 bp, Triticum aestivum
  unsure (1)..(453): unsure at all n locations
  Clone ID: PAT_TA_87789
gcgcgctgatggttggtggcctgtacaatgttctctgggggaagaggatagagcaagtaactctcagcaagcaaggaggcatcgaaacaaatgcagcaagctttgatttggaggaacaagaaagcggcgcaccagttccattaacgcgagattcgatcaagcagtgtgaaagagaagactgacatgtggcaagctttttgaggctatacattaaacatgaatgtgtgtctgcaattattttcaagaatttttgaacatgttttgtctcctaatttagcttaagtatggagtatcaagcgggtattagcttaagtttaatgtacctctggttanctccngcctatgtatgcaaccaaggccaagggcgtatggggtgtgcaacacaatgagatgggacaaggcccctatttaaccttggcaatncccaatttacttccggggaatgaaaaaaac

SEQ ID NO: 87790 - DNA, 363 bp, Triticum aestivum
  unsure (1)..(363): unsure at all n locations
  Clone ID: PAT_TA_87790
ggcaagtcagcatgccttctagaaggagttctctgcaggcactagcgctatcttgtttgcttttgtcaagtaaagttgagcgtgaagtaattgatagttgatagagcgtgaagccccatatctaatcaagcagaccatttctttctactctcatcaaatgaagaaaagaaaaatacttaagggaagggcattctattgtacgactactttgatattgtaacaaaagtaacatgtacgtgactattgaatcggtagtatagnaaagggagagaagagctcggtttgttagagtgcatgtacaactctccaccccctttccccctcatcaaattctaattcctccgcaatgaaattcgttttggt

SEQ ID NO: 87791 - DNA, 190 bp, Triticum aestivum
  Clone ID: PAT_TA_87791
gccatgagtcgttttagtttgctttgaatgaatccatccatccctgggtcgatcggtcggccagtagtcgagtcagtttgtggtgcgttcgtgcgtggagctgtaaaagcgtggatgatctcgatctgggacgaccgaccctgtcaatttgcttctgtaaaactgtgaattcgcccgcaaaaaaaaaaaa

SEQ ID NO: 87792 - DNA, 528 bp, Triticum aestivum
  unsure (1)..(528): unsure at all n locations
  Clone ID: PAT_TA_87792
gaaaatcatcaggtcctttatcaaatcagaatgtgaggttgcagcggcaccactaggatcagcttatgaggtacaagaagattatagttgtgacagcttggtacaagtattgagtggaacagggactgcagagctgacttcatgtttaaacatgtcaatcctggctatgggtaacgtcaaaaaatttcgggacggtctgcccataggattgcaacaacatcagacacttcatgtccatcaaaggcaagatgaattcacctgtgtacgctctgtcttaaatgctatcattgatgatttgagtggtccgtctaagaagcanattgaatctgtgtcgctgacgttacttatgaatgctttgggaaaatgttggnccggacacaaaagacttactgatggtcnggcgaaattatgctgccaaaatttttgagccgattcnaaaactccnacatgaatggtacacngtttgtngngtaaacaccggntgantccttgccantggtctggcanaaaatcnggttaacaattgaa

SEQ ID NO: 87793 - DNA, 520 bp, Triticum aestivum
  unsure (1)..(520): unsure at all n locations
  Clone ID: PAT_TA_87793
catgaacaagctccagaccaagaagccatggaacctgtccttctccttcgggcgtgccctccagcagaacaccctcaaggcctggtccggcaagacggagaatgaggagaangccaaggcggcgttcctggtgangtgcaaggccaactctgangncancctcngganctacaanggcgangccanccttgccganggcgcctcngagancctccangtcaaggactacaantactgatntgccccccncnggatggtttgggnantcctgcttantaactccgtcngaaaataagtgtcngacacntaattttggacngagtaatancngtttgggttcanaatcctgntaattttaaatatcaatccctggttttaataatataagcctccacctaaaggtnaattttggcgttgaatcccccggaaaaaanttgccgagcaaaangtttttgccnaaaccgggaatgaatttttcgcctaaaagnaatggaangggnaaccccccttttccccnaaa

SEQ ID NO: 87794 - DNA, 558 bp, Triticum aestivum
  unsure (1)..(558): unsure at all n locations
  Clone ID: PAT_TA_87794
gtttttttttttttccctaactcagccttaagtaacttaatatatgaattttggtttggccctgcatttttgaaatttgcctcaaatgggnaaatcctgaaaatgggggtgaaagaacatgggnatttgngngacnggttaccaaatgttgnaatagaataatatgtgatctggaaaaagaagacgacttaanaatacgggngcataataattatatgtaccanactancaaattgtgantccngggngaantatgaccacacaaacttattttaaagttgggcatatantatgagataaaattatgaaatcanttgtcnaaacccngttaantgggaattgacntaaattgggntgttggnaatttgccctaangtttcccnagtannaaattcccgtgaangaaaatgttgccttaaaaatattatagaagcggggatttaaaagggggtgttaaaaatggcaaagggnaccaaaatccccaaaagncttgacaanccctttcaaacnccccaaaacgtggcaccaaaaaagggttccncaaaaatgggntacccc

SEQ ID NO: 87795 - DNA, 519 bp, Triticum aestivum
  unsure (1)..(519): unsure at all n locations
  Clone ID: PAT_TA_87795
cccgccgtctccgggcttctacaccccgcgcttcgacctcnacctcnacctcnccggcggcggagccanatggcgtcgacgacgttccggcgcttcggcgtggnggcggcggccgccgcgttcancacgctcncngncttcggatncncctcngcgtccaaaacggncttcgtcaagtccancgtcaanggccacgacgtcgtcatcttctccaaatcctantgnccntattgtaaaanggcgaaagctgtgtttaangagcttnaactgaanaaagncccanatgtcntcgancttnatnatcgacgaggatggtggggaaanccaagatgccttatccnacatggnttgnaagcgtantgttcctcaagnttttatcccnngaaacacttnngaagntctgatgatacnggttgatgcntataaaatggggaactgggaaaattctnaacatcaatgtcaaaggnatntttggagaacantttttacaaanaatgnccctcctgttttggggggnna

SEQ ID NO: 87796 - DNA, 539 bp, Triticum aestivum
  unsure (1)..(539): unsure at all n locations
  Clone ID: PAT_TA_87796
gtgcatcgagaggtccatttcgccggtgagtggtgttgggtatctatcccattcccatatgctttctgtcaatatgtcctctagtaagttggggctagtattagcgttattgtcatctctagtcttaacaaagaaaacgatttggttaactgactagtcagctattattgagatctatagtagtacgaacttatgaacttaactatttcaatcaattgtttgcagcttagggaatcgaggatgagcgctgtcgccccaagatcccttgccggagaggagaagaagacgtcatggccggaggtagtggggaagtccgctgaggaggccaaggagatcatccttaaggatatgcctgacgccgacatcaacgttcttcctgctggctccggcaatgaacccttgacttcaaggaccaaaccgtgttcgcatcaaccgtcgacaaccgttgcgaacaatcccttccaattgggtaanctaacntttttgancaaaaggaacatanatgcaattatgcatggttgatgaataccttgttcaan

SEQ ID NO: 87797 - DNA, 550 bp, Triticum aestivum
  unsure (1)..(550): unsure at all n locations
  Clone ID: PAT_TA_87797
cgacgatgacgactatgaggctcctccggcggcggcatctgcagccgctgctttgggctctagtcggcgccgcgtagccggtgtcaacagcaccaagtacagacgcgtacgccgccggctgtcgggcagatgggcggcagaggacacccagcagcggcagcgtgtgtggctcggtacgtgcggcggcgacgccgaggaggccgccccatcgtacgacagcgaaacccgccgggtgcgcgggaagagcgccaggctcgactccccgaacgaaggctgttctcgccggagaagcctgccggggatcatcgacctcaaccacccgcccgccgtttccggtgaccacgtgatcagcgcccatgcggacgcgtgcatgacgaagatnatgcggctgaacgccganggtcccncgacgagcggatggcganctcctgtctaactggtggacggagccacaagggaacgaaacaaagcgtcgttgtggtgatccgtgttcgggttgattcaaatcaaccccaaatggaaaaagtnctgcctaagagggctcaaaaac

SEQ ID NO: 87798 - DNA, 535 bp, Triticum aestivum
  unsure (1)..(535): unsure at all n locations
  Clone ID: PAT_TA_87798
tgacaatgtgaaggctaagatccaggacaaggaaggcatccctccggaccagcaacgtctcanctttgctggcaagcagctggaggatggccgcaccctggctgactacaacatccagaaggagtccaccctccacctggtgctccgccttcgtgggggcatgcaaatctttgtcaagaccctcaccggcnagaccatcaccctggaggttgagtcctctgacaccatcgacaatgtgaaggcgaaaatccaggacaaggagggcattcccccggaccagcagcgcctgatcttcgctngtnagcagcttgaggatggccgcancctgggcggactataacatccagaaggagtccanccttcacttggtgctccgtctcnttgtggccaataagtgnctggcaatggagcggttcnctntggttgggtcanaagtctgtgcctttatattccccaatggtccngttctgtctcctggncgttcnatttcctncgtatgggatcacctttgttcggttgttttgaaatgctctct

SEQ ID NO: 87799 - DNA, 553 bp, Triticum aestivum
  unsure (1)..(553): unsure at all n locations
  Clone ID: PAT_TA_87799
cagatcttcgtcaagaccctgaccggcaagaccatcaccctggaggttgagtcctctgacaccatcgacaacgtcaaggccaagatccaggacaaggagggcattcccccggaccagcagcgtctcatttttgctggcaagcagctcgaggatggccgcacgctcgctgactacaacatccagaaggaatccacactccacctggtgctcaggctccgtggtggcatgcagatcttcgtcaagaccctgaccggcaagaccatcaccctggaggtcgagtcctctgacaccatcgacaacgtcaaggccaagatccaggacaaggagggcatcccaccggaccagcagcgtctcatctttgctggcaagcagcttgaggatggncgcactttggcggactacaacatccagaaggagtccacacttcacttggtgctccgtctgcgcggtgggcaataactcctggcatggatttgcttcgtctctgggtcanaagtctcgttgtcctcgtgtctcaatggatctggtcgtgtcgttgatgcctgaatgtctt

SEQ ID NO: 87800 - DNA, 666 bp, Triticum aestivum
  unsure (1)..(666): unsure at all n locations
  Clone ID: PAT_TA_87800
caacgacggcatggtgctcgaagccatcatctaccgcctgctgaagaagtacttcgacgaacagccattctacgtcaacctgctggaaatcttcctcgaaaccacctaccagaccgagctgggccagatgctcgacctgctgtcccagccacagggcgagggcaacgtcgatctgagcacactcaaccacaaggcctactcnaagatcgtcatctacaagacggccttctactctttctacctgcccgttgcgctcggcatgctcctcaccggctaccagtttaagaaagaccgcgccgccttcgacgaagcctctctattctcataccatgggcgagttcttcaagattcangacgactatctcgactgctacggcgaccaaaggncattggcaaggccgtcgcatatcgaggagaagaagtgtggtggctggccgcactgcatcgcaaggntcgcccgccgatgaaactcttgaancaactatggcgcgaagttccgctccttgcctgataacactcatctaactcgactcctgngatacacaatgnaggaantctatncaatactcaagtaacaacaatctctccgaactgttactcactctgagaattanacacagctannacaaaaaggttcgcaagaacatggaacanaaaaaaaaaaaa

SEQ ID NO: 87801 - DNA, 392 bp, Triticum aestivum
  unsure (1)..(392): unsure at all n locations
  Clone ID: PAT_TA_87801
aatggttaatagtatagccagctgctggctataagccagtgccatgtcatctacagcccatcttatagccaacatgtacaataatagatcaaaagagtgtactacttttttattatgtggcccacttctcattctcacaaagtgcctaggagcacgtgctagagctggctcttcacgaagagcccgcttaccttctctctcctcttctctttcctccaactaagcaagaaatatactagtttatttcttatagcccgctgactcagctctattgtacttgctttaataatgcaagaatccactaaaatgcaagaaactactaccacttgcatacgtggcagacttaagataagactaccttatcaaccantgtcatgctcctacaacaaaat

SEQ ID NO: 87802 - DNA, 415 bp, Triticum aestivum
  Clone ID: PAT_TA_87802
cggcggcgaagtgcacggcgacacgctcagcttcttcggggtgcaccagttggcggcgccggagtcccgcatcgccgtcattggcggcacagggaagtacgagaccgccaagggcttcgccgccatccgcacgctgcaccccggcgaccagcacgccgccgacggcgtcgagggcctcctccagttcgacattcacctctcctgagctgcttccctaactagtgctaccacattccaagtgtttgtccttccaggttatatgatgctctgccgtcgcgctcaacatttgtaatctgaatttcacggcctatgcattttactaccataatactcctatatgtaatgcgaactaagtgtatatttatgcatattttatgaagaaaactaagtatatttgtgctcgtgccgggggggg

SEQ ID NO: 87803 - DNA, 492 bp, Triticum aestivum
  unsure (1)..(492): unsure at all n locations
  Clone ID: PAT_TA_87803
accgcgcagatcgacggagagcattgttgcgcctttcccctcccacagaaaaaagctgctcggtcccacgccattgcgctcggttccgacggcagctcttatgctgcgttcccccactcacttttcccttttcagtcaaagttgccttccatcacaattgcgtccctcgttaggtcttcaattgtcgtgacgacgccgacgagtgttggagaggcacactgaggatcgcggcctgtcgttatctcctcgacagctgaaagcttgcttctccacttgccactgtgatgctgcggnaacggngctctgttttccctggaagtcgaacctccaatgnttcaanggaaatggtgcccncgttgcngctccgttttnacgcccggtccaattccttcgttcctttcttttcttttcctctccccgcgcttcctctaatctctctccgtctctctcgtctctgtcacttggttgacgccnaaaacttcaaaaaaaaac

SEQ ID NO: 87804 - DNA, 679 bp, Triticum aestivum
  unsure (1)..(679): unsure at all n locations
  Clone ID: PAT_TA_87804
catggctgcgtggctgcaagatctggtcgctgtcgggtacaggcagccaaggttgatgtcattggagatcgaccgcccgagagcggccattggtcatggggataagcaggagtttggccccaagaagctgccctctgtccatcttggggtggaggagattggggaagtaagcactgagattggcaatctcataaaatggaggaagcactttggtgatgttgtgctatagtgcattgcaccgggacctgtggaccggactgcactagagtggaggcttctttatgggtcggatattccgtgcantaantantccttcaaaacaagggaatcaaatntcgctgttgaatccacaacttgcacatcatacaagtactncccaaagngtttgatcgnttcaagcgctgaaggattgtatcctcaagatanatggcctaaatattggaactattggtgctgataatccaactctggtaaacaacaaggngaaggatcanggccgatntccnctacgggaaatacatgaatggtattaacaaggaatatggaaaaagnggtgaaatttcaatcacacaancatttaganaacaaggnaagtaatatcattnccatggnatcaanacnnacggacatgcttccaccntaatncgaacaaacanaacattggccnattctcanggtc

SEQ ID NO: 87805 - DNA, 530 bp, Triticum aestivum
  unsure (1)..(530): unsure at all n locations
  Clone ID: PAT_TA_87805
gcgccgaggaagcagctggccaccaaggccgcccgcaagtccgccccggccaccggcggcgtcaagaagccccaccgcttccgccccggcaccgtcgcgctccgggagatccgcaagtaccagaagagcaccgagctgctcatccgcaagctccccttccagcgcctcgtccgcgagatcgcccaggacttcaagaccgacctccgcttccagtcctccgccgtctccgcgctgcaagagggcgccgagggctacctcgtcggcctcttcgaggacacaactctgcgccatccacgccaagcgcgtcacatcatgccaaggacatcaactngcccgccgcatccgtngcgagaaggctaaggcgcatntgnatcatgctctcngtaaattgttgttagaagtgtgtgtgctcntaatgttcaaaangtgctgtgttgttctgtcatggtggtcnttatgcctatctatgnaccttcttgttgcancaactatggaatgaaaatgttggttcctgtttcaaaaaaaaaaaa

SEQ ID NO: 87806 - DNA, 378 bp, Triticum aestivum
  unsure (1)..(378): unsure at all n locations
  Clone ID: PAT_TA_87806
gttttttttttttgaacatggcaatgtgaagttttgccatatttgagcaagatatgacccaaacaaattatgagaattatttgggaatttttggagtgatggaaatataggttgcttcacaacctagggcaatttgagttattcctttaatagaaaaggaatattcccaataaaaagaatattgggatgtggactaggatgaaaatgacagggtctagggaaagatttggaaatgacaagccactctggaagcaaagaagaggtcatcttcttcagtttccagaccacaaagccacgaaaaagaaaaactcangcaaaaacctcgggaaaacaaaagaaaaggaaagggccaaaatcaggctgtcacaaaccttaccc

SEQ ID NO: 87807 - DNA, 338 bp, Triticum aestivum
  unsure (1)..(338): unsure at all n locations
  Clone ID: PAT_TA_87807
ctgccgacgacctgccacctcgacgcgatgaacgaaatccgtaggcgcgcatggtaaatggtactaccctaaaaagttgagtgatgaacgaaatccataggcgcgaatgaacgactgccatgggtgatgtcgcttgctacttgttactgcacttaccaacataagccatactgagacagagtacggagttacgagtaccatcatatatatatgtactcccaaccgaaaaatacagggggtttgtactgcaataaccggtcaagaataaaanggattctcctccgtgtgtancggtggggtgcnaaaatctctcgccgaaccgggaactttaaaaagtt

SEQ ID NO: 87808 - DNA, 672 bp, Triticum aestivum
  unsure (1)..(672): unsure at all n locations
  Clone ID: PAT_TA_87808
attaaacagtgagatgtgagccatatatttgatatgaagcaagttgtctgaggatgttcactacccacctaatttgagctctctgtttccatatgcaggtaaatcctagaatgttgggatatattgacatgtgcacgtagacattcccttggcattcatgatatttatagatgtattcaccctttagatatggcatcattattttctcttactcatttccttcacttcaaaatatccaggccttgatttccctagttaccttgctgctgtttctgttgggtatatgattccataggtgccatttaatatgaactgtgggacctaatgggtatactgttgttggtggtgggtgctggctgggtaccaaaacaacaaggttcgtgtctggtgtctcgatnactatcaaggcaanggnnttattgccaacangtccgcctaaaatgggaaagatgctaattttgggttgngcanattttaaccaatttanccaacaacccaatccggatggtancaattaggaagattaagagtcaanntataatgacntntgtcaagaataaggagtacttaaatctaaaactcgtnatggactttggaatatcggttatccgggatggctgatatactaaancattgnatttaaagttaaataactncaggcatactganncc

SEQ ID NO: 87809 - DNA, 311 bp, Triticum aestivum
  unsure (1)..(311): unsure at all n locations
  Clone ID: PAT_TA_87809
gaagtatatgtactgtctttctttgtcacattacgctagtctgatcatgccttgtgactaaaatcgacgtacactaaaatcaaccagacacgtacgaagtacaccacattacgatgaagtagcatcctcacgccctctttctatgtaaagtgtttacatgtatttcaagtttttttttaagtttgatcaatacgtcaatagtgaatcacatcaaaagttttcgaaatcanaanaancaaaanaaaaactccagggggggggcccgtacccaattccccccaatagngaggcngattacncncgctcaacng

SEQ ID NO: 87810 - DNA, 420 bp, Triticum aestivum
  unsure (1)..(420): unsure at all n locations
  Clone ID: PAT_TA_87810
agatcagaaagaacgaagaagacgatttagaaaacttcaaaaccaagcaaataactcttgcaacataaaacaatttctaacagtaccaaaattatgtgaatttggccttatcagaaagtttaggtcaagagcttcgatttgcaaaaagaatcaactcaaacggagctacgaaactcaagttatgatcaaacaaagtttgaattcaaatctgctctaattcaaattttaaaattttcaaaaacatgtttgagtttgattactggatagaggagatcataacgaagacgtgggcgttggtttccgttgggatttggntnaaccaattaaaaanatgtggtcgtttgaagtacagggactaatctgtaaataaactattcacgaacgggtccctgggccgaaaaataaaanaaaaaaaaaaaa

SEQ ID NO: 87811 - DNA, 554 bp, Triticum aestivum
  unsure (1)..(554): unsure at all n locations
  Clone ID: PAT_TA_87811
gatgtgccccggcatgggcgtggcgatgctccaccttggctacttcgtggcaaacctggtgagggagttcgagtggacggaggcagaaggcgacctcgctgtcgacctcgagccgcaggtcgggttcttgaacgtcatggagcggccactccgtgctctgctcaagctgcggaataaaagggcctgagcttctggagcgagcttcttcggacccataaacagcggttaagagaagcactgacaaaccacggtctatctttcttttgcggcttccattatctaagtttatttattgtctgaattgtttgatcaaaagtctataatgcccgactgtaactgtaattgtgtcccatcataagtctgcgcggcaagggtcaaccgttgctgaactgtattatactgaaatcattttaaagggttgggctatatctnanctnaatatgagataatacctcacgtctaagtntacctcaacactctcttaaaaattatgatacaacactgttgtcaatgatcnaacttaaaacgtgtgtgtnaggggtaaaaaaaaaaaa

SEQ ID NO: 87812 - DNA, 480 bp, Triticum aestivum
  unsure (1)..(480): unsure at all n locations
  Clone ID: PAT_TA_87812
caagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagattgcggccgaaaacggcggctgcggctgcacccaantgcaaatncggcaccagctgcggctgctcctgctgcaactgctaattattgatcatccattaatcaagcaacgcgcgtgcagaaccattaaatcatttactactaccaaaccaagttaccctacttatnnaaggcttatctntgcaacttaactgaacaacaatcangttcaanccaagcttgttntaaanaggccccctaataaacnccctggtttaaaaaaaaaaaa

SEQ ID NO: 87813 - DNA, 162 bp, Triticum aestivum
  unsure (1)..(162): unsure at all n locations
  Clone ID: PAT_TA_87813
atcactaatgcgcctcttctatcacagaagcttccgttctggnncgcagggacagacnganagntggatatcattgtcaatgggaaagaaggncananccttactggaagctcccaggttnancgcattcngggaaaangatgtngcacagncngtgcgcca

SEQ ID NO: 87814 - DNA, 535 bp, Triticum aestivum
  unsure (1)..(535): unsure at all n locations
  Clone ID: PAT_TA_87814
ggtcaccactgacctctgagaagcatgaagtcattgatcttcaaggacatgttgctccatgcgtgaagcatgaggggaatttctatgagggcttttatcggactcacgttagcacattggcagtgaagaataacctgctggttgctggtgggtttcagggagaactaatttgcaagtttttggaccgtgaaggaataagctattgttccaagtcaactcatgatgacaatggcattactaattgtctggagatatttgagaaacctagtggtccgtgcattttctaagcatcaaacaatgatgtggactaagagacttgacatggagaatttcaaatgtgcaacatttcatttcgattggggctgtgaacacacaccttggaccctgatggnaaaaccatgctgttgtgggagacaaccctgacgtgttctggttgatgctattccgggaaatgatcacgactcatgggcatttggatatccgttgctcngcatgggaccaaacggcgtacatcgcgacgggaacaagacaaaaa

SEQ ID NO: 87815 - DNA, 581 bp, Triticum aestivum
  unsure (1)..(581): unsure at all n locations
  Clone ID: PAT_TA_87815
caaggatggccagacccgtgagcacgccctccttgctttcacccttggagtgaagcagatgatctgctgctgcaacaagatggacgccaccactcccaagtactcaaaggcccgttatgaggaaattgtcaaggaagtctcttcgtacctgaagaaggtcggctacaaccctgacaaggttcccttcgttcccatctctgggtttgagggtgacaacatgattgagaggtccaccaaccttgactggtacaagggccctacccttcttgaggctcttgaccagatcaatgagcccaagaggccctcagacaagcccctgcgtcttccccttcaggatgtttacaagattggtggcattggaactgtgcctgttggccgtgtttgagactggtgtcatcaagcctgggtatggttgttacctttgggcccactgggtctgacaactgagttaatctgtttgagatcacatgatctctcctggaagngctcctggtgacaacttngttcaacgtcaagaacttctgtgaaggtctgaagctgggtttgttgcaccaatccaagatgacctgcaaggagggggn

SEQ ID NO: 87816 - DNA, 578 bp, Triticum aestivum
  unsure (1)..(578): unsure at all n locations
  Clone ID: PAT_TA_87816
accgcagcctgatccaaatccacaaccattaccagacccaaacacaaaaccattgccggacccacaaccaaacccaaaccctcagccattaccaggaccgcagcctgatccaaacccacaaccatttccagacccaaacccgaaaccattgccgaacccacagccaaacccaaaccctcaaccattaccaggacctcagcctgatccaaacccacaaccattaccagacccaaacccaaaaccattgccggacccacaaccaaacccaaaccctcagccattaccaggaccgcagcctgatccaaacccacaaccattaccaagacccaaacccacaaccactgccaggactgccggaccccgaatgcacaaccaaaaccaccacttgggacacaagcggaaaaggaaaatgtggaancacacatccaagaggagcgctgggatgagtgttcgagtacatcaaccgcgccagatatagtataccgtgacttatttgcctgctggattaaataatgggtgttgttaccacacatcaagtcatcgtgctatatatgtcangtnaatcaagatagggatgg

SEQ ID NO: 87817 - DNA, 548 bp, Triticum aestivum
  unsure (1)..(548): unsure at all n locations
  Clone ID: PAT_TA_87817
tttttaatgaataatgagttcgatttccaaacatcaaaccaaaccatgatagcaaaacaaggatcacacttcctatcttgtgcttcagcgcacgtctaacacacaagttaaacagagattgcacttccttatcatcatcagaccaaaccacgataccgaaacaaagaatcgatcctcccattcttgccaaataacagtgtcacagattcagttgctaagtccactccctcacaggccacaactaattcatatggctttcttccttacccacctttttgggcaaaccaagaagaagtgcctaaaaaattaaatccatgaagttactgacggcgacgacgaatatgcgcgcacgtcacaagcgaagaaccgttgttggaggancatgcccagcgccttngagggatgaatgcgtaggtgaagngccttcncgagtttctcgaactcccggacttgggagaatgcccaacaccaactcacactttaacagcaggaatgtctcngtttaactctctcaacttcgcanaaacttancaggtcggagtacanan

SEQ ID NO: 87818 - DNA, 541 bp, Triticum aestivum
  unsure (1)..(541): unsure at all n locations
  Clone ID: PAT_TA_87818
cccaggagctcactcctcacacgccacgcagaaacgcagcactcgacgactcagcagccgccgccgcggcgccacccaccggccacggggactgcggcacacatcagccgccgcccacggccggacagcccaccggcacaccgcacacagcagcagggcgagtcggagtcggccagcctacgactccacgcggccacaagtacacccagctaccaccggcaacacagtaggtcgttatgcactcagggatgccactttggggctagagttgaaagacgagttcttgggcangaagcataaactttggcaagagaatcccaccttttactagtgtacatatatgaagaatttccccaaaggacaactcatactgacaaagaagttagtgagagcaanggnagatgtgcatgccacaanggactacaaagggagcnaaagaatanttctttctgccnggggctcctggttccttgcaaaaatcaattttttttannaantttgaataaaanancaactccttatngcncaagtcaagnttttt

SEQ ID NO: 87819 - DNA, 529 bp, Triticum aestivum
  unsure (1)..(529): unsure at all n locations
  Clone ID: PAT_TA_87819
gctgaattcccatctggctttgtttaattcagtangaaaggaagttgctgcggtaaaacaaatactangtgacgtggaatgcctagttggtgagaaggaaaatgtagtctctgatttgaagtgtaaggtccaaaggatttctgtactcnagaaagattttgttgagaaacttagtttcttgggagataaaatttctagttaccagctcgaacttcgaaatanggcgaggatcatatatggattgaaggagcaacttgacgctgaagaagcttaaaaacaattttcatccccagctagaagaacttaagaaatccccggctggtgaaaggatgaaaattaccgagaaggttganttcagataancaaggaaatgccttgtggagcctcataacatgggaaactgcnctacaanaaattcaagacatantcancaaggcttgggcatganggaataaaaagttccctgccaatttctgaaatcaggattgtaaagtaatacatccagtagcaattatcgccnaatgaggaa

SEQ ID NO: 87820 - DNA, 535 bp, Triticum aestivum
  unsure (1)..(535): unsure at all n locations
  Clone ID: PAT_TA_87820
gcacaagttctaccacggccgcaccggccgcgtctgcaacgtcaccaagcgcgccatcggcgtcgaagatnaacaagcaggtcggcaacaggatcatcaagaagaggatccatgtccgtgtggagcacgtgcaaccatccaggtgcaacgaggagttcctccaaaggaaactcaacaacgacaagctgaaggnggagggcaaaggcgcccggcgaggtcatcaacaacaagagggagccaacaagggccaaacccgggggttcaagggttgaaggggaaccaaccatccaagaacggtcaaccccatccccgtatgaacgtctcaaacaattctcaaagggtgggtactaaaaaccgccttgcttccctgaanctgaaagccttgaagccaagtttcttaataaccaaagccttggttccccaatgtccttgggtaaccgagntanntccccctttttgctcccgcccnaattgtgaaanttccccggtgggttaacnattaaaanatttcccgggngggttgaaaaaaaaaaaa

SEQ ID NO: 87821 - DNA, 516 bp, Triticum aestivum
  unsure (1)..(516): unsure at all n locations
  Clone ID: PAT_TA_87821
aggggggttacgagctgctacctctctttcagatattcaattgtttgactgcccttctttagacttggcacatggagcaaattttttgccattatctcttgggaagctccgtatacagcggtgcatggttacaactaatttcttcagttgtgacttgccattcctgatgaatctttccatgtttgggtgcagaagctctgcatccttgtcgattggtcacctgacctcccttgaatcactatcactaggaggtatccctgatctgtgctttcttgaagcactgtcttccctgcaacttcgctatgtacatttgacagacgtcccgaagctcnacgggaatgcatttcacagttccgggtacaaaaatcactatatgttngcagccttatgatgctcaaacacatgctctcggctgaaggtttacaattccacaattctgtctcttgaangatgcaaggaggatctgtttcattcgangaacaacagattcacactgtcaagtgcctcaggtatgtg

SEQ ID NO: 87822 - DNA, 174 bp, Triticum aestivum
  Clone ID: PAT_TA_87822
ctgcagcggtgctagtgctatgcgcttctctgcttatctgaggagcactaatcattctttttttgccacctgttctattctatgtagcgagcgattcatttttccttttgctttgggtctcatttggggtggtggatgttgaggttaaatgttggatgattcaaaaaaaaaaaa

SEQ ID NO: 87823 - DNA, 543 bp, Triticum aestivum
  unsure (1)..(543): unsure at all n locations
  Clone ID: PAT_TA_87823
ggcacgcgccgcgggacgccgcctcgttcgacgaggagacgcgggccctcatcgcgcccgacgccgggagcctcccggcggccccgccctccgccgtcgaggccaacttcgcgcgctacttcgccgccgattatctcaatccaggacatgaccagtacgtgtaccgccatccaaacgggttgtgcgtggttggtttagctacagcccatgttgcactgaaagaggaagggggaataactgccattgacttcaatgttgggaagacagatcgcagtgagataaaagtcacagggaaacgcaaaaggaatgcacaacatttgcaagaaaattcagcattatgtaaagtctgcacaaaggataaaactttgtggtgaggtgttgcgtgaaagggcagcttttggagattaatgatagattgatgaaagcaacccgatttgcttaatactctgccgacagagaagntacatagcatcctcatgcagaaacaagtgacnggtcaaagttaagntaattctaacntngaggactacaaaactgagaagg

SEQ ID NO: 87824 - DNA, 549 bp, Triticum aestivum
  unsure (1)..(549): unsure at all n locations
  Clone ID: PAT_TA_87824
gccgggcgcagatcccgtgcataagtaaagctcatgtgctccgcacatcttgtcagtttcatgctttttactttacatttgcatgctttatctgacactttgtgcagcacctacccccggtaagcaataacgagccaaaaggccccgtatctttattttctcttctttctttttctcaaacaaaggaaaggaaggttccctcgcacacaagtttgccgggggaaggagaagataatggtgtggaccaggcgtcgtttaaggaagatttgcattgccgggaagcagacgacagaaaagctaagttgccaaagtctgagcaattagttttaatttttaaaagttatcttcctcgaacgactgtgctttgtatggaaaacctgtgcgcagaggaaccaactcgtagctagatgcgcccttacttgtttcgagtccgctcaacaacttaagtgtgttgcaactagtcgcgacaaggttcntgtcggagcggcaccgccagcaagctgctgactcccgcaccancgctcgcggtcgggtgcctgaacgacaatt

SEQ ID NO: 87825 - DNA, 538 bp, Triticum aestivum
  unsure (1)..(538): unsure at all n locations
  Clone ID: PAT_TA_87825
gcagaggcaacaccatgaaacttccaagccgaagcaatagcatggctcccccttcaacaatggctggtcatgcttcgctgcagatgaatatgtttctgagggcttggaaacagcgtccttcaaaagtaatgttgtctgatgattattcatggaagatgttttctagatcatcgaggagatctgcttcccagttccactacttgaatgaaatatggaagaatgaaaggtagacgggcatatcttgttgccgtcaaaatggtgctatttgggggcaaaacggcgcagcatactagcagcttacctctttgaattcagaagcaacccgttaaacataatgatcaggaaggcaacctgggtcaagacatggcaagaatgacattgtgaaggattggcagcttcacgacaccacgggttacagatcaangaacccataattacaaggntagtgtgctgtcaatttacccattcagattggcaaaatagatactggcccgtanatttaattacatggtanaagaagaactggtgtcaacgaaaa

SEQ ID NO: 87826 - DNA, 531 bp, Triticum aestivum
  unsure (1)..(531): unsure at all n locations
  Clone ID: PAT_TA_87826
gcccgtcggcggcgcgccgtgccgtgcggcgacctgcgccgtggacatcaccagagagtgcctgccggagctgcaggtgcccggagggtgcgcgagcgcgtgcggcaagttcggcggcgacacctactgctgccggggccagttcgagcacaactgcccgccgaccaactactcgaggttcttcaagggcaagtgccccgacgcctacagctacgccaaggacgaccagaccagcaccttcacgtgcccagccggaaccaactaccagatcgtcctgtgccccgcccgaaatgatttgcacatggatcagtaagtagaggatgtattactcctagtagtcttcctcttacttattatgatcatccatcattctgcgtgtgcccatattatatactccgtatataatgtcacatatgtgcgtgcgtgcatggccggtgcgtgccattcagcgaataaatgtntaaataaaatggaagtgtaattctacggtatgtggagtgcaactcngttttaattcctaaaaaaaaaaaa

SEQ ID NO: 87827 - DNA, 212 bp, Triticum aestivum
  unsure (1)..(212): unsure at all n locations
  Clone ID: PAT_TA_87827
attgngantacncggcnaanccatgtnaaaagttttagcncngatgtgnattcattggnagttacatgtggactaatgacgctggcanatttntttgttccgctgcaaaatgattttgcancttgaatcatgtatgaacatgggtgaacagancctacagttgttaacgaagcccnaaatggctccatgaccatatgaagcccaaaaacaca

SEQ ID NO: 87828 - DNA, 160 bp, Triticum aestivum
  unsure (1)..(160): unsure at all n locations
  Clone ID: PAT_TA_87828
gtagcattagcatacgagtgtgtactgccgcataggctgtgccccaggagtcttagaccaccagagtcaggtttgcagttacatggcaggttccaagcatgcctcgtcgtgcacctgcattctcataatcttgctagtgtcnagccacctngcgccgttc

SEQ ID NO: 87829 - DNA, 496 bp, Triticum aestivum
  unsure (1)..(496): unsure at all n locations
  Clone ID: PAT_TA_87829
gagacaccgaagaagagtcatctttagtgtaattgtcaccgcagttgttgctggtgtgagtttgcaaaacttcccggtgggtactgcagcatttctcggaaccgcaaagggattccgtgttggccttaacttggttattgctatagctctacactacatcccggagggtattgctgtagctctccctgcatattttgccacttgcagcaaatggcaagcgttcaaactagcaaccctgctggttttccggaacaatangngtaattatcctcccatactanttncgagcaactttaatccaaaaatattggaaggccacttgnttaagggaagggtnatngattttctgacacgtttgagatgcnaccatttcnattnaatacccnggacccaagnngcttttaanccttttccttgnaaggntttttnccnagagctttcttcccgggattttctccccaaagggatagcccttnattnaancctaacccannaa

SEQ ID NO: 87830 - DNA, 280 bp, Triticum aestivum
  unsure (1)..(280): unsure at all n locations
  Clone ID: PAT_TA_87830
gcttcaactacttcgagctggtgctggtgaccaacatcgccatgagcgggtcgatcaagagcatgtcggtgaaggggaccaacacggcgtggattccgatgtcccanaactggggcgctaactggnantgcctaacggggctgaaaaggnaagcgctcaacttctccantanctcctccggggggcantacaaagncctccaagaagttntgccngnctggtggntgttcggaaaanctttncaacctggaaaaatttcncnncaaccanaanaatttgg

SEQ ID NO: 87831 - DNA, 403 bp, Triticum aestivum
  unsure (1)..(403): unsure at all n locations
  Clone ID: PAT_TA_87831
ggcaactccacagctagctagctgcctcatcttgcaattgatggtgacacatttgcagcaaacacatgaggcaatagagatgactcaacatgggtccatattgtgcagttcccatgaattcatattcattgtcctgaatctgaaaagataggaaaacaatagctatacttaaatggtgttgcaaaacaatagcacatatcaatatctcggcatgacaaaacacgatcatccgggacgaaggggatactgacctacctgaggaatattacatataattcaaaatccctggtgattccaccttcaactgcactgcttgcttgccctccacacatgacagattttcccncactngcattcagcaanccaacgtncgaataactanttcaccctgccggggcnatgt

SEQ ID NO: 87832 - DNA, 510 bp, Triticum aestivum
  unsure (1)..(510): unsure at all n locations
  Clone ID: PAT_TA_87832
catctctcctcactgataatgtagtttatttgctgtttttagtaagtgcttaatttagtttgtttagtaagtacttaatagaagtagtttatttagtaagtgcttaatttagctatgttagatttatatacaaaataatttagggtttcgctaaggtatttttagtaaatgttagggctagaactaggatattttagacatagttgttagggctaagaactaagaaaatttaagtaataagaaaactaaggaatatttttggatataaaatagctttttgataagatagaaacncagtgaataaggataaattttttttgnaattttggtttcccaananagnaaggttttggaaatttatatttttangccatatcacttttccanccnaagaagccntangaaanttgngatccnaatccncccccggggaaaaacagctttttaanccctncnccctggggngttcnccaccngggnacccggtcnacttcnccnaaacccatccgg

SEQ ID NO: 87833 - DNA, 264 bp, Triticum aestivum
  unsure (1)..(264): unsure at all n locations
  Clone ID: PAT_TA_87833
gcaccacctacgccctctgcttcaccgcccgatnagcctcgcctcctctccttctcaaccaacggcaagctgtcaaagagaaagaacangatgccgaggtcctgcggtggctacggtanggcgcactggtgtagcccatgcgagcgacacgggagtgagcgaccaggaaccaagngatgctgccagtanttagtagtcagttcaacangttttttctcaggattgtaanttttgtcacaagganganattgttagaatgcnaca

SEQ ID NO: 87834 - DNA, 525 bp, Triticum aestivum
  unsure (1)..(525): unsure at all n locations
  Clone ID: PAT_TA_87834
tttttttttttaaacgtaagcaatttcgaattccaaaagactttgcaacgtaagatgcagaaatccggtgacagaaaagggtggcaaagttcatccatttcatcatgtacacgagatgcttctcccgggcttttacaagatgatgacatcttcgacaagttatagtactgctctagaaaaanggccaangggggccncaaattccacaaacaagattttcctctttctacttcaactgccggaggcacttttcagcaatttcgtcgtctcaggttctacctgcaagtacataggtctgcattacagcatcataagtttccgcatcaaggcattcaagactcttcaggcactccgaggaaagacccacaccagcaacatcctttgaccctcataagtgcttcagaaatctgctcacaagtctttcgatggggacccatttgtgcgccgtcacatgttccttgcatctcccaagattccagtgccgcattaacacagtttatccaaatagaanctgcaaatatcaaa

SEQ ID NO: 87835 - DNA, 534 bp, Triticum aestivum
  unsure (1)..(534): unsure at all n locations
  Clone ID: PAT_TA_87835
ccattcccctcaccgccgccgccactccgcctctgccgccgccgagatgggtcgcgtgatccgcgctcagcgtaagggtgcgggctccgtcttcaagtcccacacccaccaccgcaagggccccgcccggttcaggtcgctcgacttcggcgagcgcaacgggtacctcaagggcgtcgtcaccgatgtcatccacgacccggggcgtggtgcgccgctggccaaggtgaccttccgccacccgttcaggtacaagcaccagaaggagtcttcgtcgccgccganggtatgtncaccggcanttgtctaatggcgggacgccgcgcacgctctccgttcggnaaagtcctccccgctccgctccgtncctgaaggaagcgtcatctgcaacgttcgaanaacaacttcggcgaacgttgtgtcttcgccaagggctccggtgactacgccatcgtcatcaaccaacaacccngacaacggactcaaggttaaantccctctggngctaaaaatngtccaaacantgtcgtgcaa

SEQ ID NO: 87836 - DNA, 189 bp, Triticum aestivum
  Clone ID: PAT_TA_87836
gccagggtgagcttccacgtccccgccggccgcctcgacggccgcaggtccctcgccaacgacacgctcctcttcctgcctggcccgacctccaacctcagcaccctcgtctccggcttcgccgccaagggcctctccgccgaggacatggtggtgctctccggggcgcactccatcggcggttccaat

SEQ ID NO: 87837 - DNA, 257 bp, Triticum aestivum
  Clone ID: PAT_TA_87837
tatagcttctgcagcagaaatggacgccggtaaaagggctactgcgctagtgccgcgttacgacgagacgctgcaagtgtagcagcagcatttctgttctagcccaggcagaaactggtgatcctgtgtatgtgtagtaccggcgtgtcttttccttttcttttccaagcctccaatgccggcgtgtcattcatgtggaattctgcttgttttgccagtaaaaatataattaaggtgcttcgcataaaaaaaaaaaa

SEQ ID NO: 87838 - DNA, 441 bp, Triticum aestivum
  unsure (1)..(441): unsure at all n locations
  Clone ID: PAT_TA_87838
gcctgccgacgtggggcgccagttggcagaggtgcaaaagcagtttgcattgctcaaccagctgactgcagcgccggccacccagaccgccctggtggtggcggcttccgagcaggccgaccgcacgctgctgatcgcacaggccgtgaccgaatccatcgagaagatggcccaggcccccagcgcccgcctggtcaacctggcgggccgccagcgcatgttgtcgcagcgcctggccaagaactatttcctgcatgcagccaaggtggattccaaggtggtgcaggcacagttggcggccgatgcggccgatttccgccaggcgctgcagacactcaaagcaaccccggtgtcaacaacggcatccgcaacgaactggagtttngccgactcncaatggctgttcnttgnatcaancctgcgccgcccaaaaaaaaaaaa

SEQ ID NO: 87839 - DNA, 522 bp, Triticum aestivum
  unsure (1)..(522): unsure at all n locations
  Clone ID: PAT_TA_87839
ctaagattgtcatcctctccctccttttcatcggtactaccttcgctgctgccggtgcctccgtttattgctctggagctggtactgtttgtaagacttctgactgtggtactcttactggtggtgcttggtaaactttgggttctaccactcctgcttcttgttaggttactgactgtgctgcctccgtcactgctggtatgaccgatttctactgtgtctcttgtcctcccgctggtactgcttctggtactactacttatgccaatattgctgngtaacaagtgtgttgctgcttctgctacttgtggttctaccanaaaggccaacacttgggaccaatgctgactgtgctctctgtaacggtactgctgctaatgccaaccaatatgccgcttctaacgttctgcttgtcaagctactgctgccaaagtccaacgctgctctcctcgttgcctcntccgtaantttagtctctttacntatctgantaaaacaaataacaatgaatatctttaaatt

SEQ ID NO: 87840 - DNA, 536 bp, Triticum aestivum
  unsure (1)..(536): unsure at all n locations
  Clone ID: PAT_TA_87840
tcagtgtgaaggatctcgaggagggatcaatgtcatcagtggtggattgccttttggttctgagggacaatctgaatcctggagtggttgatgataattcacaggatgtttcaaagattccttcgagaaaaaaatggagagttcgggaaactgacgagtctctagttgctgctgcaccacaagggaaaacaccctcaggagagaacaggggaaatggggttccataccccaagtctcagcaagaaaactcctgccttcaatggaaaaaagcttccgtgagattttccagctaaaacgcgggtcctatgctgatcttccggctgccaagatntcaagagatgatgcattcaaacagtttaagattatgcatcaactcaatctctgcttaccgttnttaatggcattccnggacgaaanattgagaagaaaaaagggagaaatccacaccgtggaatttttctattgaggaaannntgcaagaaattaacgtcntcccgtgttnaaccagacacatagaatcaaaatacttcatcaag

SEQ ID NO: 87841 - DNA, 522 bp, Triticum aestivum
  unsure (1)..(522): unsure at all n locations
  Clone ID: PAT_TA_87841
gactgtcaccactgctgggagcagcgcaccgcaagcaaagggtattcttcacatgccttcaaaccgtgaactgtcgcacaagatcgtgatggcggccgggcaagccgccatggctcctgcccaggtgttaccgctgtccatgaaacctccagcaccgtcgccgtcgggggcggagaaggaagcggcggcggcgagcagcacgacgctgaatctttaggaaacatccatggcgcaggtgaccgcttgcattgtgtgcaggctgtccatctctgattactgcttccggaccaaaaacatccatgggtttangaggcttgttgctgccatggtgaaattgttgctgccggcttgactcgcctttctgtttggtctctctttgtccgtctaacattcaaatctctccaatatccgtaatggcgtgtggttgtgcgtcnttttgttgggaactgctcntccggactatataagttgttggacnattggcttgaaaaagaatatctgcatcctgtcatcttccaaaaa

SEQ ID NO: 87842 - DNA, 381 bp, Triticum aestivum
  Clone ID: PAT_TA_87842
tcgagtttttttttttttttttttgacaaaccgaatatgcttaattctcatatataggaacattttggaactggttcatttcaaacgctcgcaaatcgtagcacagacgttcagacaaaacatcagataatttattgcatcacactagagcactcgacctcatgctgtcatgcacgcagtacaaatctctactgacgaccaactaatcagcttgcggccacctggttggatcctgaagaagctgatgatctggggagaagatgatggtgaacggcgccggcactagtgacgttggtggggtttgatgaccctgcagttgcgcctgatctcgccctgtgccccggagagcactcgatctgccccatcttgaacatggacctg

SEQ ID NO: 87843 - DNA, 514 bp, Triticum aestivum
  unsure (1)..(514): unsure at all n locations
  Clone ID: PAT_TA_87843
cccaagagaagatacaccgtcaaaaagagagaacttcagcaggagatccaggcgcgcgtgaaggctctcattttttgctcgggtgccagtcagccatggacgtgtacatttcggaggagtacgtgatccagcggcgcgccgagaagagggcggcggcacggagggcggccatggccgacggcgacaaggaggaggctgggaggagccggtggacggcgtcgtgggcggacgctgagcagaagaagggcaatgcagatgccaacgccaacgccatcgccaatgcagctgggtgggagctccaaggggcggcgaatgaggtcattcctgcctaattatccggcgtangtgtctcctccggttgcctctgttaccaatggccaagatgtccagcaaggacaccaccaatagtagttgccaaattttgtgctcaacacttgctgaatccgcaaatttgcctggctgtacatgtataagtgggcaaaagtcaattcacttcnnggtcaaaaaaaaaaaa

SEQ ID NO: 87844 - DNA, 167 bp, Triticum aestivum
  Clone ID: PAT_TA_87844
gtaacctcttctctacctttgttttttgtttctgaattctgaactgctgtgctgaacttatgcttggccactgttgtgctgaacttatgcttggtcgctgtaagtaatgccaatgtaagtgtcattttgttcacaggctatttcttttacaaattaaaaaaaaaaaa

SEQ ID NO: 87845 - DNA, 439 bp, Triticum aestivum
  unsure (1)..(439): unsure at all n locations
  Clone ID: PAT_TA_87845
agaaagaagaagtggataggttcccgtccgaagtgccttcaggcgatgcagcgatggcggcaggggagaagccttccagcgatgcatctctgatggccagtttgagaggaatagctcccaccggagttctttttgtggcgggagtgatgtcggcgttgatcatgttcttcctcctatacaaaagcaagctgcgtccccatgtgaccacccaacagaaccagcctagctgccctgcttcattcgattagctaggcactcttcttcttcctttccgtcttgctcctattcttgtttttgcttcgcgtcaccaagtacctattgttgctnggtgctactcaattaattagctgttcaaatgtcnacttccttgtnatgattncgagctcctgggtgtnatcctccccatccgtatttntccggtgttactgtcaactcccaa

SEQ ID NO: 87846 - DNA, 523 bp, Triticum aestivum
  unsure (1)..(523): unsure at all n locations
  Clone ID: PAT_TA_87846
atttccagctgccagtaaatattgtatttctttagctggtagttgtgaagtgctatctctttgtgctgttgaacatggttgcattgtagaaacttgtctttctttagctggtagttgtgaagtgctatctctttgtgctcttgaacatggttgcattatagtaacttgtctttccaaggttacctaataattaactacattgtatttcttaattacatcttttaccattgtgaagtactttagctgggaatattccctgtgctgccagtaaatattgtatttctttatcctaattgcccttttttgtacagttaactggtaaggagtagatgcaatatctgtttgtttanaacncttgtaatgttctgatgaatgactttcaagttttaaataatcctttttattggacagntacnncaaaactttggaaggctggcgcaaatatttanccctaaaaatccccttcccaaaantattggtcactttcaangngaaggcccgccaattgctaaccttgcggaat

SEQ ID NO: 87847 - DNA, 546 bp, Triticum aestivum
  unsure (1)..(546): unsure at all n locations
  Clone ID: PAT_TA_87847
ctcatatatatcaaatgacattggcgaccttttttgccatcaattcctcacacacactctctgcctccctcttcctcactctctccctctctccctctctctctctctctaacacacacacatatccatcttattgggatgggaccataatccatctatttcacacacatacgctagtacataacaatatggattatgtgtattatatttgccaccacaactgagggaattaatttcatgtaaatcggccagccacagctccaagaatacgcggaggaggtggcccgggtcggcgtcggcgccgtccggcacgggccacgggccgcttccaagcgcatctgcgcgtcgggcaccacgccgtgtccttcaagtgccacttccaccgcaaatcccaaggtcacggcatggcaaggccaaggaagccgccttcttcgctcctnaacaaccgcagcaagcnggccgcggaccngctcgccntctcgtctcaanacgttngcgaccaatgaccagccaanacggctcgaaaacaagacgtcgacagtagag

SEQ ID NO: 87848 - DNA, 373 bp, Triticum aestivum
  unsure (1)..(373): unsure at all n locations
  Clone ID: PAT_TA_87848
cgcggacaaggtggcgaggatgtgcagcttcgagacgctcaccgggctggaggtgaaccaggttggcggcggcagcctcgggaataaggttcacattgataactccgtgttctataggaaaggcgaggtaggggactgggtgaaccacatgagccgcgagatgggagagaagctccgacggcatccgtccaaggagaagctccaggggtccagggttgtgtttttgagcaaagancatttgttatgtgttgtgttctcctttgtatttcctgttaagactttaatttgtttccnttttaattctgcnaagactctcaatcccacattttccataaccacgttacagcatgtttcccctaacttttnaaaaaaa

SEQ ID NO: 87849 - DNA, 462 bp, Triticum aestivum
  unsure (1)..(462): unsure at all n locations
  Clone ID: PAT_TA_87849
gtgtccaagtcaagtgaagagaattttattactgtcgttggtggacattggctgatgccaactcctagcaacaaagttcgtcgactctccatgcaaagcagtggttccaagcatgggaattccacaaaaggcatgaacttgtctcaagtgcggtcattgacagcgtttgggaagccagaacagacggctccctttccattcattcaacaatgggaataatccaagtgctaaatcttgagggctggaagggttgacaaataancatatgaatgacatatgnaaantgcaagcgctnaanttttgccccnccgnaaaaacagtgttcagantatcccacaantttgaanaacnccaatttcnaaanccntaanaggggaaaaatttnggggtgcncaanatttttgggccctaanaacccttaaatcttgggggaanaaaccnaaaagggttatttcccccaaa

SEQ ID NO: 87850 - DNA, 448 bp, Triticum aestivum
  unsure (1)..(448): unsure at all n locations
  Clone ID: PAT_TA_87850
ccgccccccaacccaaaccctaccccgccgccgccgtcgccgacgcagcgcgcggaggcgacctcccaccgccgccaagatgcagatcttcgtgaagaccctgacgggcaagaccatcacgctggaggtggagtcctctgacaccatcgacaacgtcaaggccaagatccaggacaaggagggcatcccgccggaccagcagcgcctcatcttcgccggtaagcagtcgaggacgggcgcaacctttgccgactaacaacatccagaaggagtccaccctccacctggtgtccgcctccggcggcggcgccaagaaacgcaaggaagaancctacaccaagcccaaagaagcaaaagacaagacaagaagtgnaactcncgttctccaattctacaagtcnacgacccaccggaaagtcacaagtcangaaggatgcccgaacccatg

SEQ ID NO: 87851 - DNA, 497 bp, Triticum aestivum
  unsure (1)..(497): unsure at all n locations
  Clone ID: PAT_TA_87851
ttttttttttttggatagaaacatcactatcaattgtttccttcaaccagagatacaaattcacatgtcttcggatacaattgcatanaatttacataangaatggaaggtcaacgaaaacagaggttcaacatctaaaaacacacaagtgcatcaactaaatatacacaanagacttcattttctataatctttagttgccancttaagttgcaagcttctcttcaaggttgccctgcantggacatataattgaacttgtaaaaaattgtgcaaatgtcaacagttgctacaaaaaggnaactagaaacaagggacantacctataagaaataataagcatatccaatttggnatcccagtttctcgcaataacaatggnnctgcntttggcacancaaagtanccacttcnacagcttatngncnatatggggggattattcnaaaaccatacccaaanccganacaatttgcaacngacaaaatccattttta

SEQ ID NO: 87852 - DNA, 279 bp, Triticum aestivum
  unsure (1)..(279): unsure at all n locations
  Clone ID: PAT_TA_87852
ggcggnaggcagnatcctgatatatcccgntggtcaacccggtaccggncaatgatcatatgcagggaagggcaacacaatccctgaaagnctnngaggtcttcttgggtggtttgatnaggantggtagaggattttgangtccatcncanaatatttgnnctcctntcgaacaattacttttgcggtttttttgcagctgtactgnttccgggttnctgtcttccgtttgtatttanaagtagcccaattcanaatantnatagatgtanaccgtgg

SEQ ID NO: 87853 - DNA, 257 bp, Triticum aestivum
  unsure (1)..(257): unsure at all n locations
  Clone ID: PAT_TA_87853
gttcgaactcgtggagctcctcgtcctagctgcgttcccagagctggacagcacagtgaggaagtggcacgaagacaagcatgagttctccgccctggactgattctttcagacggttgtattttcgtgtcgatctgtttcgctgtaaataagagtgctgctggttcttgggcatgccggtttagatggtgacgggntctgcnaattgtgaaaancanttaanttagaaccnacaatgggnagggatggcaanccaa

SEQ ID NO: 87854 - DNA, 446 bp, Triticum aestivum
  unsure (1)..(446): unsure at all n locations
  Clone ID: PAT_TA_87854
gcgaggggaagacgaggggccggaagaagggcagcaaggccaagaagggcgtggagacgtacaagatctacatcttcaaggtgctcaagcaggtgcacccggacgtcggcatctcctccaaggccatgtccatcatgaactccttcatcaacgacatcttcgagaagctcgccggcgagtccgccaagctggcgcgatacaacaagaagcccaccatcacgtcccgggaattccagacttccgtccgcttcttcttccccgggcaantcgccaagnaacncttntccgaagggaccaaggcttcacnanttanaataacnanggtntccnccncggttcaagntttaatgngggangctcttacattttttggaccntttaaannttaanccccngaaaattggccccttcggctttaaaaaaangagttnccgttttgacccann

SEQ ID NO: 87855 - DNA, 390 bp, Triticum aestivum
  unsure (1)..(390): unsure at all n locations
  Clone ID: PAT_TA_87855
cgccgttccaggtcccgacgtcttcgtcggaccacgacgcgctgcgcgaagcaaacccagccgccgcgtcggcgacggcggcggtgggcacagaccatgtggacgtgatgtccacgcgtttggagatcgttatttccgacgagccggcctcctcccaccctccctgtcagagcgcggcccctgctccgtctgccagcgaggagcatccttgtgccgagacgagaaggcggagctcgcagggcattgccactgttgacgcgttacctacacacgatatccgggctttggtgaaatttcctcaaaaaacaaaaaagttaantgagattaatatggtcaagtgttttccaaggantgcttgattaaaatanncttnggaagttanaaaaaaaa

SEQ ID NO: 87856 - DNA, 466 bp, Triticum aestivum
  unsure (1)..(466): unsure at all n locations
  Clone ID: PAT_TA_87856
gcttctgaaaattcangattgnanaacctgttatnccgatctgagccatgatctatcanctactttantttcttactctgttttatanctgtctttaggttttgattgttgccgagtttaactancctctcgcaagtttttcngnnttgtggaaaaggctganaatctcgggagacgcgtgtgttgtcatcagcttcgtctcnntgttcntacgagatgggagttaannaacgacacnanatttcacaantttctgcggatcctctcaanaanatctaatcagctggaatgtccccctgcacccttggcaaacggtatctnatcngganaaacaagctgtaacatngttctnaaagatttgcccgnanccaattctgatnttgactgaaacacatgttnttcaagtagcaaacggngtcnattgatccnggtgtnaagcgttataacnggtggntgctaaataanc

SEQ ID NO: 87857 - DNA, 373 bp, Triticum aestivum
  unsure (1)..(373): unsure at all n locations
  Clone ID: PAT_TA_87857
gagatcttcgtcgagatgaaggctatcatccaagagctgcaagtggctctaaggaaagatgatgacgcagctactcaggccaagatccaatcctacacccgcttggtgaagaagtccaagaatcttttcaagaagaccgcgaagaaggctcctgcagattgtagcatggtcatgttgttggccaaggctagagagatctctatgtctctgctggagtccacactccatctcttttcgaagcaaatcgaaatgcctaaacatctcttgtttccaaggcatttcacaagaagaaggcagatgtcctgccccatctccganggggggccggtaccaattcgcctatagtgagcctattaccccgccacgggcgtcg

SEQ ID NO: 87858 - DNA, 515 bp, Triticum aestivum
  unsure (1)..(515): unsure at all n locations
  Clone ID: PAT_TA_87858
atcaggtactcacagagaagaacaacatgttgtctcttgagttggaaaagtgccaaactcagctagctgttgttaccgccaaactggaaaagtccaaggaggcaccgcctggtaatgttcccctccgtccataaaaaagtataatcatatgctagcaatgttaatattgttacgtttctgatgacagtatcagtagatcaactgcaagaggaactgaaggtcgcgcaggcgggtaaacaacaggccgaaaggcaactggccgcangcgaacgtgtattgacacagtcaagggatgataaaaacaagttgcaggattccaacacctgctccgcgaaagactaaaagatgtacgagcccagctagcggcgccgttnaagggaaattaggagctacaaggcgnatattcantangcttttgacttacnccgtgtattcaccaaagaatgantaacaattttgccngcagtatctacngcgtcccnaaaggattcngtttcaagntttgcgcanacntc

SEQ ID NO: 87859 - DNA, 519 bp, Triticum aestivum
  unsure (1)..(519): unsure at all n locations
  Clone ID: PAT_TA_87859
atttcctcgcctccaagtaacctccggaacctcaagctggaggttggaaggtacaacattcaaggcatgcccaaattgccggaatggatcaagaagcttgagaaccttgtcaagttgaagatcggatttagaacatccggccaagtggagcaggatggtgctataggagccctcgggaatctgccaaacctagccgttctgcgtctcgatgtgattagtttcaatggtgaagaactacattttggggcggaggaattccgaagcctcgtcgtgctggagctttcacgcacaaggaaaacaagttggttgatttgagcagggagcaatgcccaaacccagcacttctcatcatggtctgttataccgggactagttcttgggactggaccctctcggaagcatcaaaggaaatagggatcaaaaantacgcttcagcaggagatccggacaagttgctttgaatagaaacaaccatcctgaataaatataccntctctctcaaggcaggcaggacttttt

SEQ ID NO: 87860 - DNA, 292 bp, Triticum aestivum
  Clone ID: PAT_TA_87860
ggaagattaacttccactcgattcaagcgattgtagtacctagacaatctgagcacatgctcaacgattgagcttttctcccttagtttgtaggcttaagaaacttgtcagaggcctcatacctcttgacatgggcactagtctgaaatcccaatttcagtctttggaagatctcatatgttctgcgacgtttcaaaaacgtctttgggtgccacaattttaaaccgttagcatcacacactgaactatcacgtagtcatcaaaacgtgtatgtcagatgtttcgtaacatc

SEQ ID NO: 87861 - DNA, 494 bp, Triticum aestivum
  unsure (1)..(494): unsure at all n locations
  Clone ID: PAT_TA_87861
gttctaccacggccgcaccggccgcgtctggaacgtcaccaagcgcgccatcggcgtcgagatcaacaagcaggtcggcaacaggatcatcaagaagaggatccatgtgcgtgtggagcacgtgcagccatccaggtgcaacgaggagttcctccagaggaaactcaacaatgacaagctgaaggcggaggccaaggcgcgtggcgaggtcatcagcacgaaagaggcagccagcanggcccaagcctggttcatggtgggangggaacaacaatcganaacgntaaccccaatcccgtanaagtcttcaaaattttcaagggggggttacaaangcntnttttcctaacaaaacntngccatttcctanaanccagcctgttnccaagtttttnggaccgagnattccccttttgncccccccaatgtganttcncccggggggtaanattnaatttcccggggggttntttcnttccttnaaaaaaaaaaaa

SEQ ID NO: 87862 - DNA, 558 bp, Triticum aestivum
  unsure (1)..(558): unsure at all n locations
  Clone ID: PAT_TA_87862
aagcaaagccgattttcattggagagaagtacatcaaagcatatacaaccaaaaccaatcgcatgaaacctcgtccacagtcgatgcattcagcataaacgacgcgcaagtgaatacatgcactagctaatcaggaaagtattctaccataacattgcaagtagacacatatgctcaagtttgatgagctactatgaccatgctaatgatactatgagccttacaattccgtacggttggcagggtcgccagatttagtccctcctgtttacccggggcaaggaaatcttccaggaatctactcctgtttaccttcatcaattccaaagggcagcgatagcccaccatgacaatacatagatttggtgttagaaagagataacccgagaaacttcggagacatctccttcctaatatttgtgtttgaagtggtatgaccataccccttggacaactcgcgaaagagattcttcnatttccaatgactttgtagtttgtcaaacccnactattcccgtnancnatgcaattncatangcantccataacgtggtatacg

SEQ ID NO: 87863 - DNA, 375 bp, Triticum aestivum
  unsure (1)..(375): unsure at all n locations
  Clone ID: PAT_TA_87863
cccgactccttcggggcgacctagccggccgctgagagtcggatgcacaacatgcggcagggtgggatatctctcaccacggggccggggcagaggcgggttgccccgccactccactgcccgggggtggccttggagatttgggtttggcttcggctggcagccggctctttctcgtgccgcacgcgggttttgcccgtaagtcggcgtccgggacgtcgcgccttgnnaacggngggaaaagggcttttccgcgtngggcgtcngnttcngttccaccgcgcggccgcatcgatnagctgcttnatctcnggtcatgttggggaattcttcggctcccaagccaatcaactcntctaacgccgcctggccgcc

SEQ ID NO: 87864 - DNA, 272 bp, Triticum aestivum
  Clone ID: PAT_TA_87864
gtgatagatcactcggtgttctgaattgttttctgtaaacgtcttaaatccccgtctggtacatatatttggggaactctactatccgaagacgtcacgtgtttttccccctgtttgcttttctatacgcctactgatcaacacggcgcgatttgatgatggaccgtgtagtttaagtgggtttggctgatttagtctgaacatttgtcaagtaaacctgaaaatctaggtgcacgtcacagtaaattttatgtctttccaaaaaaaaaaaa

SEQ ID NO: 87865 - DNA, 552 bp, Triticum aestivum
  unsure (1)..(552): unsure at all n locations
  Clone ID: PAT_TA_87865
cccaaacacaccatagccatacacacggcccagccctgaagaattcttgccccccctcaactccttctgaattcttgatcctttgaagagggctgattgctggaggatctggtgctcttctcgggttatgggtgctcaagaggcataggcaagaacagtgccatcttcagtgctgcattgttgaggatattcagatttcgggagaagcataagagtaggtgctcgcagaattctccctcgaccttgttctgccttgtttccattcttggccattcttgtctctcttttggtcttccactccgatcgcctgtcatggaatcctcccaaatcaccggggatggcggcgaagagtgcaacagcaatgaatccgggtggacaatatacctgacctcccccacaagcagctatgaagcaaaagagaatggcagtgaagggagcaatgttgaagatggcagtggtacatcacgaagaggaggaaaggaaagaagagaacaaccggatgatgatggagatatgatccctggcgtctgatgctcaaaaggaatcnaagtg

SEQ ID NO: 87866 - DNA, 518 bp, Triticum aestivum
  unsure (1)..(518): unsure at all n locations
  Clone ID: PAT_TA_87866
gtacaattagtgccaatgcttatcctttaggtgacgacgcatgctttacaaatacgtgttcattcctcaataaaataatatgccaccatgcacatttctggtccagtccgagtaacatcaggattcaggagctcctgcttccctaaggtaaactagcaaagggcacttacaaggctacaaacctcacagtttttcttatattaatcagttggtgctaagtgtgtacatagagaatatgggtgtttttttaacaagtttgctccttctgtcatgcagcctttactgaaagaagcagtanaaatcacacaagcctgaanaaaatgggctgaaaattgacngtatccatgaancaaattcgtgggaaatccanaacaagaccttcaaccgtatctgtccnatgcttctcaaaacggtcatactagttaacaagaaggggattcagtgtcaantctgcgctgggtcngaatttctgcacncaagggattttnaancatcnacattggccangaacaaactct

SEQ ID NO: 87867 - DNA, 539 bp, Triticum aestivum
  unsure (1)..(539): unsure at all n locations
  Clone ID: PAT_TA_87867
cgacgtcgctccggcgctgaagtgcgagggctccatctgcttcttcatctcgtcaatgatcatgtcagggttctgcatcattgctgccgccctgagcttgatcctggtccaccggacaaagatcgtgtacacgaatctgtacggtaaaccccggacatgagagatcaaaggtcatcgaggacagatcaaagctaaggtatcaaagcagaagggtgaagtttatttttttttgcgtcttccttctgtttatggacttcgcatattcttatggtgtcaaaaccatggctactggtggctacggatgggaagcgtatggtgtttttgtgcgttttgtccgaacttcttcggtgttttttggggggatatgaactcttcagtgttgagctgggaactttgcatatacatgtggtcngttctatgttcatcaaggctgttgaaaactngaaatgcaataaattgtccgaactccgcaaatggagaactcaaccttgtacatgggggttcctaagtctgagaaacacatgaancgtgtatttgtt

SEQ ID NO: 87868 - DNA, 220 bp, Triticum aestivum
  unsure (1)..(220): unsure at all n locations
  Clone ID: PAT_TA_87868
tttctgcaaatgtataaatgcccatcaatcagttagctanatnttggcaaacgagttacaaaaacattgtagtaaattgagtcaaactgaanaatgtacaactgaaacgaaaggccacgcgtgctgagacccgcaaggntgccaatgttggggtttgcttgatttttatcntattgaactgcggtgtaatcaaaataaangntgcaataaaaaaaaaaaa

SEQ ID NO: 87869 - DNA, 320 bp, Triticum aestivum
  unsure (1)..(320): unsure at all n locations
  Clone ID: PAT_TA_87869
ccagcttactgctccaccgttcaaaacatatacgtatccggtttgagacttagagtcatccggatcagtgtcaaagcttgtgtcaacgtaaccctttacgacgagctcttgatcacctccataaacgagaaacatttccttangtccttttcaggtacttaaggatattcttcaccactgtccagtgatccactcctgggattactttgaaaccttccggccatacttatggcaaggctgacatccggcttgtgcacaacatccgcatacatgatagagcaatgggcagaagcatagggaatgacactcacttttcttta

SEQ ID NO: 87870 - DNA, 397 bp, Triticum aestivum
  unsure (1)..(397): unsure at all n locations
  Clone ID: PAT_TA_87870
cggagactcgattccaaccgtctgagacgtactcgatcagcttcggctactgctagtatatttgtgggaattcagatcagagcagaggttagcgagatatgcactaaaggtagccttgttgtgtgaattaatgaggggtcgatgtggcacgccttgtcggtcggtttgggcaatgagaatcagtccttccttttctgaactaaagaaggtacaatttttttttgaacnaaaggggttgccccccctgccccattttatagattgangcaaaacaaagcaatcacaaaccanttcttgnccctaagcaangaaatnaaatacccnccagggaataancttcngncccanggggggggccngnanccaatttcccnaaanngggcctttaanccnccaa

SEQ ID NO: 87871 - DNA, 299 bp, Triticum aestivum
  unsure (1)..(299): unsure at all n locations
  Clone ID: PAT_TA_87871
gctcgacgaccgcgagcccccggtggccaaggaggccatcgtggagctcaccaagttcgcgtgcacggagaaccacctgcacgtgaaccactgcagggccatcgtggacgagggcggggcgcggcacctggtccagctcgtgtacctcggggacgagctgcagatcgaggcgctcatactgctctgctacatcgcgctgcatgtgccggaaaaccaagaagtttnggcaaggcngggttctcnccnttctccnnttggcgttcnaagcaaacccaatttgtgtcaagagntncgcgttt

SEQ ID NO: 87872 - DNA, 385 bp, Triticum aestivum
  unsure (1)..(385): unsure at all n locations
  Clone ID: PAT_TA_87872
gaaaatacaaaatttgtgcaaaaatatgatccatgtatattgtaattaggataaataggaaaaaagaagagactgcactcatgttttgtatgttgcatgatgatatttttggacaagtctacttttatttctcatattttggcatacacttaccatgaaacttcttaaaaacttgttctaagtgtacgaagtagagtgctaaaacacacacaaaaaggtgtagaccaacacaggactaccgcctaccaaactaaataattattacatataattatagataaaggaagctaaaacctattccgttggaaaccaantcatctttcccaagattggggtggtaatccacacggganccggcagttttgagcaaagcccgggggacaaa

SEQ ID NO: 87873 - DNA, 210 bp, Triticum aestivum
  Clone ID: PAT_TA_87873
gcggctggaagccggctccagatcgtcttctgcccatgatgagcggcagaacatatatagcacgtatacgcatgtaataaccaccgcacgtacgggtagtagtacctccgtataccgtacacgtgtgtcaggtattcccagccgcagtgcatacactcgagcgaggttccaataaaggtgccattaccttttgtgtttaaaaaaaaaaaa

SEQ ID NO: 87874 - DNA, 521 bp, Triticum aestivum
  unsure (1)..(521): unsure at all n locations
  Clone ID: PAT_TA_87874
gcggggcctcggaagagcccagcactagcaggcaaggagatcctgagcttaggagagaaggagatcatgggcgtgggagaggagcagatactgggcgtggacatcttggtactgggatttatttttctcttgaacctaaaaatcaatcgtcccttgagtagatgtgtgctaaacttgccttctattaacacaacatgtgtttgatctttattctcttggacaagtcgtttggaccggcacccccgcaccagggcgcgatcccgatctagtttattatantgcagctgcatttgttcttgcacctccttcgtacctctgctttctcttcccccccaccacctgaagattttggcttgactcacacacaaaggggtttcctttccccaaagtccaaccggncaagatgcaggccccccagggggaatggancaaaaggttccccggagaaagccnacacacgccnacaaaacncanctgggcctgcccgnaggcacgtnaancanaatgcttcntaacgggna

SEQ ID NO: 87875 - DNA, 432 bp, Triticum aestivum
  unsure (1)..(432): unsure at all n locations
  Clone ID: PAT_TA_87875
acttcataagttcgaaacgacctctttttatctgcttggttcttcatcaattgcctcgccctgttcaggtgctgctgtaaaagctcctggacggtatctcgctcttcaatccatgactggagtgctggcaccgaacaagagttctctgctgtaatctcccagtgcctcggctcatacccaaacatggctttgaagggtgtcatccctatagccgagtgggtgggacttattgtaccagaactgtgccagcgggatccaaaaactccaccgtcttcggaaagcttgaagtgaaacatctcaanaatgtttccanacactggttaacccgttccntctggccatctgtttgagggtgggttggccttgctgaatannattgtntgcccgcggccttaaatancncctgccaaaatggntgtgaaaaaaaaaaaa

SEQ ID NO: 87876 - DNA, 416 bp, Triticum aestivum
  unsure (1)..(416): unsure at all n locations
  Clone ID: PAT_TA_87876
ggttgatccgacgctgaggtcgtctgtgcccgacagagatgttgtaaggctgtgcatagatccggagagagagagaagagagcggccatgggggaggttgccaggatgatgaggggtgtgacggccttgtcgccggagcaggccaaacccgctgtggtgggcggagctcgagattgcatcggcggccgcggagtaaattattcgcaaccaaaggagcaaggatagctaaactgaatgaattttcctttacttttgttttttcttgattaattttgctgcattacttgttttgtgactttccaccttttgctgatgatcagtgtgaaaacacaaattgtnaaaatggagaaatgtcactgtaagtagcatgttatgatatattttactataactttganaggaattcaattatataa

SEQ ID NO: 87877 - DNA, 504 bp, Triticum aestivum
  unsure (1)..(504): unsure at all n locations
  Clone ID: PAT_TA_87877
gtcggtgacgcggtccgtgaaggccgggctccagttccctgtcggccgcatcgggcgctacctcaagaagggccgctacgcccagcgcgtcggcaccggtgcccccgtctacctcgccgccgtcctcgagtacctcgccgccgagctgctggagctcgccgggaacgccgcgaaggacaacaagaagagccgcatcatcccccgccacctgctgctcgccgtcaggaacgacgaaggagctcggcaagtgctggccggcgtcaccatcgcgcacggcggcgttgatccccaatatcaacccggtgcttctccccaagaaacggcgggagaaaggaaggcaaggcgcccaancccccaagaagncgccaancgcccaaagaagccgccacccgaagaagcttaagagaatccatctgtactttaagtgtgtctgtgtatgttcanctgaatacanatgaaggtgtccgtcaacgttattacttgtgtgttcaanttcatggaaga

SEQ ID NO: 87878 - DNA, 491 bp, Triticum aestivum
  unsure (1)..(491): unsure at all n locations
  Clone ID: PAT_TA_87878
cattgacgtgacataggctggtcattccctgcacaccagtttcctacatcatttatcggggaagactagtgtggaccaagcaacgcttgcttagcgattttggagcgcatggtggcgggtattgttcatatgttggtgatagtgatgctcaacaagaagatggcagatttcagcatacggtactaacaatcatgtgatggccctcatcctgacagtccggactgggtgtcagctcatagtttagattaaaatcctaccatatctcctggagtactcatatatctccatctcctgggcaagtgtttcttttgtttccatgaacccgacaccaagaaaggatggattttgccaaattttccaggnagttnagttataggggatgcattttccttaagaagagcatgacaaaaaaaactgtcatttacattaaaaangggggggcccngtacccattccccctanagtgagccgtattacccgcctcacggcgt

SEQ ID NO: 87879 - DNA, 507 bp, Triticum aestivum
  unsure (1)..(507): unsure at all n locations
  Clone ID: PAT_TA_87879
gccgccgacgcagcgagctctccctccaccgccgcaaccatggcgacccagatcagcaagaagaagaagtttgtgagcgatggcgttttctacgccgagctgaacgagatgctgacccgggagcttgccgaggacggctactccggcgtggaggtgcgcgtgacgccgatgcgcacggagatcatcatcagggccacgcggacgcagaacgtgcttgggtgagaaagggccgcagattaaggagctcacctccgtcgtccaanaaccgcttcaactttcccgggagaacggcgtttgacttttacgccgagaaggtcgtcaaaccgttggcttctnnnccattcgccaaagccgannnctcccgcnanaagncccctccggagggcttgccttccncaagggttncaagggggtnctccccttggttatggaaaattggggccaaaggtttttaagncattntaattgggaactcaanggccaaaanagcaaatccatnaattnaaa

SEQ ID NO: 87880 - DNA, 279 bp, Triticum aestivum
  unsure (1)..(279): unsure at all n locations
  Clone ID: PAT_TA_87880
gcctcatgatcggcgcaccattccgcagcacgtgcatcagtcagcatgggatcaaaagattcagggagctgattctgagctaaaggaagacagagagcgagtgaagatcctgtatggctttgtcaaaaatgaggagctctgtttctttgggactatctgatgagcttgacgatgagatcccagaagtgcaggccctgaaccgtggtctcaataccatccacaaccggatgatgatgttacgaaagggaaatatgggtgccncctaaanggccanaaggg

SEQ ID NO: 87881 - DNA, 299 bp, Triticum aestivum
  Clone ID: PAT_TA_87881
gtttaatataaaattttatcagatgacatgactgtgtcaaagaccttgtgctaccgtggtgacattgccttcttgtcttgacccggcagaggctgcgcagggagcccattgattagctgtcgctcaacatttgcatttttgaccataacaggaacactttagaatacgaaggattagttggttatcccttatcaggctgtcattattttctccagcgttgcgtgttcattcaagcgcgattccggtcccattaggtgacatttcaacaagttttaacaaagttgtccgaaggggggggg

SEQ ID NO: 87882 - DNA, 476 bp, Triticum aestivum
  unsure (1)..(476): unsure at all n locations
  Clone ID: PAT_TA_87882
caactgcttcgtggtggcgtgggtgctcgtcgtcggcttcgggttcggcggctgggccagcaccgtcaactttgtgcgccaggtcaacaccttcggactcttcaccaagtgctaccagtgccctccaaggcactaattacctagctttttaatctttaatcttgattaatcacctacccatataagtagcaaactgaatttaaaagattattcaacatgcctagttagttcttcttggagagaagaaacttagttaatctctcacaaagaaaaacaaatccggagctgtttttgaatttgattcgtgtcctgttgtgtttgtgtgtttgtgcgcccatgtttggtattcctggtaatatcattcaaggagaactgtatgcatgtgcatatatgttatgtatcccaaattcagtgatatacaacctttggtacgggttccgccctttgcttccccnaccataaantcanacgcattn

SEQ ID NO: 87883 - DNA, 322 bp, Triticum aestivum
  unsure (1)..(322): unsure at all n locations
  Clone ID: PAT_TA_87883
cctgccgcccctccaggtactcggacttcttcaagagcgagtgcccgcaggccttcacctacgcgcacgacagcccctccctcacccaccagtgctccgcgccgcgcgagctcaaggtcatcttctgccactagactgagtgagtccagccagggcggcgctcgccgtgccgccgccggccgtcagcagctatgactggtctgggtctgggatcgattaatgcagtgcgtgtcagtcatctcatcatcatgtgtgagtgagtgttggggttaaggctttgganactggnaaggctgcccggtgtgcttgcngtaattccggc

SEQ ID NO: 87884 - DNA, 233 bp, Triticum aestivum
  unsure (1)..(233): unsure at all n locations
  Clone ID: PAT_TA_87884
ggccaaacagactatctgtccggccccattgccagaggacccagcggacgcccgcttgacggggctgctggctccgtcaccccatgtggtgctggagaagaaggccaagaagaaggccacaggcactcggaagagttcccgttttcaggtgctatcggatgatgactccgaggcaaactcctcccaaggcgaagangggagaaaaaagaaagtcgnncccgggggggaaaagg

SEQ ID NO: 87885 - DNA, 521 bp, Triticum aestivum
  unsure (1)..(521): unsure at all n locations
  Clone ID: PAT_TA_87885
atttcctttaggatgttgtattaccaagagggcccaaagatatctctctgtcacatggagtgacaaatcccagtcttgatccacgtaacccaccacataccttccaagatacctgaagagcacctttatgaacaccaagttatgaagtgacggttgacacccatagagcattctttcggtattagggagtggcatcactagtagaaaatagggctttggtccatgccgaggtggcccattagtcccggttcagtccagaaccaggacccatggggccatctgtcccggttcgtgaggctangggcctgccgggcctcgtgggggcattggtcccggttcgtcatgaccctttggtcccggttggtgggacaaaccgggaccaatgggcctcgctcctggcccacaccattggtccctggttggtggcttgaactgggacacaggcttccttaaatcccggttcatccacgaacgggaccaatgagtgcctatatatacccttgccacagcagacacccang

SEQ ID NO: 87886 - DNA, 645 bp, Triticum aestivum
  unsure (1)..(645): unsure at all n locations
  Clone ID: PAT_TA_87886
agaatatcgagttttttcttttctgaagaaagtgaaaacaagaatgagaaaaactatttacacgggaaagctcccaacaagtaaaagaagaacgagaaatatttttgggtcttcttttaatactactacttctaaacatggaaaagaaaactaaaaagaagcgacaactaattgtttttgggattttctcaaagtttttcaaacacacaagaagaaagcgagaaaaagaaataaactagcaatgggataatacaatgaaaaagtatgaacaccgacaaataaaatgagtgtatgaacatgaatgtaatgtcagggagaaatacgtactcccccaagcttagggttttgggcctaantcatttaagcccacagttnaaagtaccctccccctaagtactgaggaggtcccgatggtccaccggttgggcgactcccnatggtcccactgataaacagccctcatacgnttatgtgatggtccnggccaagaacggggatnaattcgcnccaatatcataatgcaatnggnataataagtactgccgataatttcaccaaagaattgcaggcaagttataactgcaantcccgacggatacaagtntaatancgctacacggggggccgtacaatccccanatggtt

SEQ ID NO: 87887 - DNA, 639 bp, Triticum aestivum
  unsure (1)..(639): unsure at all n locations
  Clone ID: PAT_TA_87887
aagactggaagcaactataaattcttctgacgattttgacaattctcgtggtggcataatttcagagaaggatcagcttactgagaaatcaccaattaaagagcttgggtcttctccaggtgaggttgatgaaaatgggtcacatcaaaatgtgttaccagttaagaatgatgaacaccctgcaccagccagaagcaatgaaatttaccctattgccatgccaagtaaacatttgcctgtattgcaaaacttgttggatttcatgagtgatgacacaagagaatgggtctggaataagttgagtcacttggaaatgggatacaagaaagaaattgaaactgggcgatctgaataagttccatctcatcaaacaaatacaccccaacttcttcatcactggacacaactcaaatgtcaaatgaatttgatgcattttgtanctggccctgtggtaatatttgtcaattgttgaggaagagatatctagcacattgcttatgcacggntatatctgaagacaaggaattatccgaagtgcattgaaaaggtgaactttatctagaagaaactgataaggtgaccaacacttgcagagnactcatccgcacagtacctcaagngctaaaaggntataccatn

SEQ ID NO: 87888 - DNA, 501 bp, Triticum aestivum
  unsure (1)..(501): unsure at all n locations
  Clone ID: PAT_TA_87888
tgagcattaccattcgctccgtgatttgacatggaaggtaacttattcaacaaaagatttctgacatagggccattgcatttgctttgcctcttttggccacaactcaagtccgtgtcacgtataaggtcaaggagatggagcttaaagtgaagcaatatacatgtctagaatttagagaagaaaataattgagagaccctgcgatatactctgttgaaattcaatggcttactgcattaccttttccttccgtgaaggttgttgatggtccccttcccaatggagaacgtnggaagaacagcttaagagacttgcccatgaattgcatttcaagaaggccnaagacnagcaactttacaatcctaacctgggaaaagttccccgccaatgaaatgccaaaccacattatcnacatcgggaaaattcnccctttaagggngtaattnacggttgcccctaaatnccccaaaaaagggngnaatgggggtggcccaatantt

SEQ ID NO: 87889 - DNA, 503 bp, Triticum aestivum
  unsure (1)..(503): unsure at all n locations
  Clone ID: PAT_TA_87889
ctgactcctcccctcttgatctacagcacatgagggaagcaggccgtcctttctctcgatctggagctgcgtgacggtagttttgcagaggggttgcagctgggcggcggtgtaggcgtgcttccggcgagctaacaacggcggtagaggctcctctcctcaagattttgttgctgcaacctctacaatctacctcatacattgggtcaagcgtgctgctgctgctactccaaggcaggatgccacactggaagccaaatgcacaaattatcccaaagaaggcagcatacatttgttcagatnnaaatcagctcaagagtttagccaataccgaacagtgtttttccttaacctttggcgtcatgttcacaagaaaagaaaccctacgaagatcctgatttccgttgtgaatatggtgggngtaagttttgcatatccncatgggaaatgaacttgcnanataaagaaatggttgtttgaaattgtgtccggggtaaaacana

SEQ ID NO: 87890 - DNA, 300 bp, Triticum aestivum
  unsure (1)..(300): unsure at all n locations
  Clone ID: PAT_TA_87890
gcgtantctgagttgacggccttgccgcccgcccttttcctcttccgtagcctcccgacgccagccgcccaaggagacggncccgagaagttcaaggagctggccccgcccccggcaaaactctgccggaggagcggccaggtgcagatgttgctgctgccgcacccgcccaggcgcggggcgtttgacgcctcgtcggactcgtccccgccgtctgcncaactgtcctcctcatcactttcgncgangggagggcccgagtacccaattcngccctaaagtgagtcctattacncncgc

SEQ ID NO: 87891 - DNA, 598 bp, Triticum aestivum
  unsure (1)..(598): unsure at all n locations
  Clone ID: PAT_TA_87891
cgggctgcctgcaggtgactccctacggtgatgccgggattctcagccttgcagtactctcatggcttagtcctttgctctcggttgggaccaagaggccgctcaagctggctcacatacccctgctggctcacaaggattgtgccaaattttgctataaggccatgagcaggcactatgagcgccaacggatggagtgccctgacaggcagccatcgctggcatgggcaacactcaagtccttctggcgcgaggcgggcatcaacggcgccttcgccgcggtgaaacaccgccgtgtcctaagttgggccctgggctgatcagctactttgtgggactaactcagttacaaaaatttcntcccccatgaaggttaatcaattgcctccctatttttgtatcaaagttnattgagacaccactgctcncctgtggnactgggcgtggactcatggggatcatgtcaagtcccggctgactgcaaggtgtaaagaanggcgcaagtgtcnaatgctcaaaacaaagcatacaacggtganatgtgaanaacggatgtatttgttgggggggccggtancaatcncctanangatctata

SEQ ID NO: 87892 - DNA, 410 bp, Triticum aestivum
  unsure (1)..(410): unsure at all n locations
  Clone ID: PAT_TA_87892
ccaacgcccccctcctgctacctctccacagttctgggcaaggaccatgtccccgtttcgttgcgactgtgatgattcgttcgactacgtgggatcatctttaccatggacacgttcttcttcctagcgcgattccagttgcaggtgcaggtaatgtgatgatctgacgcgagtgcaatgtttccttgttttgggagttcttcttctacttcttcatcgatcttggggataggttcctgggtccggcagcctgggctagcaaggtggatgtcctttganttccggttggtgtttcatccatagacagatgttgttcccttggtatgatgttgatgtattttgcggcatttgtatgcctttgtatgtatccccaaactaataagttatggtacgattaatggtaaaaaaaa

SEQ ID NO: 87893 - DNA, 514 bp, Triticum aestivum
  unsure (1)..(514): unsure at all n locations
  Clone ID: PAT_TA_87893
gcagcctccaaatttccccaatctaatggcgtaagaaatccctcctggaccaacccctctcgcccatctctgtatctctcgcttgacgacggtggcaccattcagatccgatgccaagcttgtacgaaaggtgtcattccatctccgctctgacggctccagaccgtctcattgccagcagcctagttccagtacgaggatccctgtactaccaagttccgccccaatctgtgcccggcagctcagttatgtctatccgatgttgggctcgtctgctccttcccctctcatgctgaacatcaagaaggatctaatagaanaggtcctgactcaagaaggaccctatggaagggtcgtttcctgggaacgaanataggacatggctggatgaataactttctaangctnaagcaattctacancagcaaagccaaccattatggtgtgaattgtcacagtagtaactgaactatatntagancatgaattatgaatcgccatatcattccatgaa

SEQ ID NO: 87894 - DNA, 499 bp, Triticum aestivum
  unsure (1)..(499): unsure at all n locations
  Clone ID: PAT_TA_87894
acgactccctcatccgcattctagtgacgcttccgcttagcgatcttcaaaggtatgaagatgctcatcctctctctctctcttgttgctagaatctccatagattgatcttggtgatgcatagaagattttgaatttctactatgttccctaacaacatcatcatcgataacggctcaaatttcacagccgatgaggtgaaaacttggtgtactaatctgggcattaagctcgattacacctcagtctatcacccacaaaaaaaatggtcaagtcgaacgagccaatggtcttattatgaagcggcattaaacccaagactaatgcggtatttaaaggaatcagacaagcactgggtcgaaggagctcgactccgtactccngggggttgccggacaacgccaatcactctaacgggatatacacctttttcaanggggtcggcgcaaaagctgtgttaccctgcgatattatcatgactcaccccanggggggccgg

SEQ ID NO: 87895 - DNA, 494 bp, Triticum aestivum
  unsure (1)..(494): unsure at all n locations
  Clone ID: PAT_TA_87895
gcggattcagcaaggcgccatggtacatctaatttcccttcaattgcnttgtgccgaatctccttcatactcggngcaaaaagaagaatctcctccctactgtactgcaaatggggagtttgagtccctgattggagttaaaatcncccatcttccatatctcagtgaagtgatactacatccaacaactgatagtggcatcattaatgcatggaagaccgcgctgggttctcacaagtaacaggccgtgcctgaagatgcgaccagcctgatgtcattttccttgggaaggcgaanttctgttgtatgttctgtggcttaagcattancaatatccntgggttcccctctgatgtcattttctgggangtcacacccatattttcaaaacatatgaacattcattaagcaatangtnaacatcttttccttttggaaaanntggcgttantataaacaangnncaaaaaatccagggggggccngttccaatn

SEQ ID NO: 87896 - DNA, 555 bp, Triticum aestivum
  unsure (1)..(555): unsure at all n locations
  Clone ID: PAT_TA_87896
ggcaacacattnataacacgattcatgggtcctaactaataaataagcatcgattacatatanngttgaacgactgtccaaaccanaaggaagacatacaagtacattaangtttaatattacaacatgagccaatcgacatttcangaactacatagcatcactactttcnactccgactcaanggaccgngagcgtnggatgaaagctgccgtctttcaatgatggtcatgaaatcgcgggcgttgtcaancctgcatttgtacgttgtttctatctcactgttggacggttgatgtctgagataagaactgcccccaaggtacgaaaggcacctgatgggatgatttccgcaaacccngactgggatgcaaaaaatcctggtccgatgtccccatcctggattgccganaaacgcgcgggcaaccttngngataatttggtagcanaangngatatngccctacgattgcccccaagtttttgaggganaataagnacctcttacgncaaagcnggtgctntancagganaatcntatgtggtgaanantct

SEQ ID NO: 87897 - DNA, 510 bp, Triticum aestivum
  unsure (1)..(510): unsure at all n locations
  Clone ID: PAT_TA_87897
aagacattccgtgcttatctcataatatttcctgattcagaaagtcgtctcattgaacttgcacatgctttgtttacaaaccgttatgaaacagtcagaggggctctgaaggaaagaattccatcaacagatctgctggcaatgctacgaggtttatgggaggatgcaactgccatcgacgaagttatatcagaggctgcactgccagctttttcattggagactactcgagacattattaagcaacacatagcaactgcctttcttcatcttcaaaatgaaatatcagatgtacngggtcacacattcaacatcaaatgagaattagaagagcacagctgcaaactgccatggaaaaaagcaaaattaaagtncccaagggtgcatantttcccngcangaattccgtcatccttaatagantggaatacagagttgctantaaagctnaaaatttgataatgatggggtcaanaaggtttcaagattcctttcanaaacttgangggn

SEQ ID NO: 87898 - DNA, 568 bp, Triticum aestivum
  unsure (1)..(568): unsure at all n locations
  Clone ID: PAT_TA_87898
tgcagtcatcttggagtaggtagtatttataactgagtagtaatatgctcctaagtgggaaaccatttaggttttgatcggtgtgaacaggtttgcaattaaatatagcatggtagtaatttgaaatgtgatgtgtctcaagctcaaaatttattgacggttctagtttcaaagtgcggcacgattcccgaatggcataacgtgggcacacgtccttgggctgtgtatgtggcatttgcacggtgcaccgcactaggcgatgtccagcacatgncttggtacatccaacccntgcacgcttgttattaccatccgcgcatgctatttaagttagaatgtgtgccccgtcctagcacacacaccttggattatccattggttcctgtttggttgtggctaatccccaacattcatccgtggtgaagtgtagccgtcaaccccaaacacttgatctagctacatcccgtgggttgcctaacacaaatattcaccnaatgacggttgactcatcaccacacacatgtctaccaacantcngtgngttccaancacaacaatcatcagtgna

SEQ ID NO: 87899 - DNA, 330 bp, Triticum aestivum
  unsure (1)..(330): unsure at all n locations
  Clone ID: PAT_TA_87899
ccgccatccggccatgctgaaatatttcgaagaagctgctcaccaccagcgcctgcggttcgtaggtgaggatggtgtgcgccggctcgacgtagctcaggccgtngataaatctcgtccgagatgatacggatgccgcgcgcgcggcacacgggccgcgatggcttgcaattcgggcggccttggatnaaggggtgcccggtccggttgggccgggctgggcgatgatnaaccccttgccgggcccggttccaacggccggcaacgcggcggcgggtcaacttgggagcccaattccgngccccgnaagnatttccnaaaaaaaataac

SEQ ID NO: 87900 - DNA, 407 bp, Triticum aestivum
  unsure (1)..(407): unsure at all n locations
  Clone ID: PAT_TA_87900
agaggctcgcggtgttcgtctcaggcgggggctcgaacttccggtcgatccacgaggccgttctgggtgggaaggtgaacggggatgttgttgcgctcgtcaccgataagccaggctgcggtggcgcggagtatgcaaggtgcaatggcatgcccgtggtcgtgtttcccaagtcgaaatcggcgccgggagggggtctccacagatgaacttctgaatgttctgaggattctgaaaggtaaactttattcnacttgcnggttacttgaancccanacctggtnncctatttagtcaatttcccaanttcaagcctaaataaaaccttnaangcccccggaattttggaggcanggttataaggttgaaatgcctaacaatttttgccatctgggncaaaccncagg

SEQ ID NO: 87901 - DNA, 435 bp, Triticum aestivum
  unsure (1)..(435): unsure at all n locations
  Clone ID: PAT_TA_87901
gaaaaaccctanccctcgcagccgcagcggcgcgcacacctctccctccttcctgaagacagcgccgccgccggncagagcacaggatggngaccgtccccgctcccgcagccgagaccgcggnctccacggtgcgcaccgtgaaggatgtnaacccccacgagttcgtcaaggcctactccgcgcacctcaagcgctccggcaagatggagcttccagagtgggtttgacattgtcaaagactgcaaggttcaangagctgccaccttctgatgctgacnggtnctacatcnagggctgcctccaagggcanggaaatctacctgaggcaggattcggaattngggggttcaaaaanttnaaggtggcggncaaaaggaaggttnanccaacggaattnttgcaanaacaangggtttttcccgaaattcccca

SEQ ID NO: 87902 - DNA, 572 bp, Triticum aestivum
  unsure (1)..(572): unsure at all n locations
  Clone ID: PAT_TA_87902
tgcccctatgtttgtggttggtgtcaacgaggacaagtacacctcagacgttaacattgtctcaaatgctagctgcaccactaactgccttgctcccctagctaagatcattaatgacaacttcggtattattgagggtttgatgaccactgttcatgccatcactgccacacagaagaccgttgatggtccctccgagcaaggactggagaggtggcagggccgcaagtttaacatcattcccagcacactggttctgctaaggctgttngtaaggtctccctnnagctnaaatggcaagttaccggttgtccttcccgggtccccactgtngatgttnccagttgttgatccaactgttttnaacccaagaaggtgcacatatgatgacatcccagaagntaccaagntcaacctnagggaaactccaagggatttatggntacttttaggaagatttgggccccaccgatttttttggtaacacaagccaacacctttatcccangntgggatgcctnaacgacaattcgncnagctggccgtggaaagacaacaaaggggtcacaacn

SEQ ID NO: 87903 - DNA, 383 bp, Triticum aestivum
  unsure (1)..(383): unsure at all n locations
  Clone ID: PAT_TA_87903
gagcaaccagatgccgcaaccagacgttggagcccaggatccagacgccaccgtcgatgacgactactactctggaggtgcctactactacgtgcaggccgctgacgacgaccaggagtagttaggaggatcccaggcaggaggcctgcgcctctttcaatctgtatccagtttgtgcnanccttcttaaggnaacttntttaactaaggncanaccccntatnttgcgcncccttacanntntttttttanaacnttnttttngccccctaggggncncctttttanaaaaagctncanactaattnttttttttttaagaaaaaccccncgggggggggggggtnccnaatntcnccccncgagggggnttttnccccccc

SEQ ID NO: 87904 - DNA, 521 bp, Triticum aestivum
  unsure (1)..(521): unsure at all n locations
  Clone ID: PAT_TA_87904
gttagatcacccctagcaccactttttgtcatgtcatacatcatgatgcttctatttgctttatatttgttgtttcttcccctcttctctctggcagacaccgagaccgacgctgctcccgggtacgactacgcttctgacgtccagccacttgccgcagagcttccaggcaagcaacccccccccccccgatcattcctatatcacccattccattctctctcatgcttgcattagattttgctaatgtaattgattgctcctattttgatgcatagcctgcttttggtaacctacattggtaccttacctggctatccctantagtataggttggttggtgattccaccagtgacccaccttgtccctgttgcccccgctggattacaaggtgactcatcaatgtgnttgacatccattgcccgacaatcancacancccccttaagttggtatgacactgcatgttacaaccgatgtcaaaggngatactccgtatacacttcgaagaattctaaagg

SEQ ID NO: 87905 - DNA, 501 bp, Triticum aestivum
  unsure (1)..(501): unsure at all n locations
  Clone ID: PAT_TA_87905
ggacgtcgccatgctcctcctcctccatctcctggtcgtcctcgtcgtccaccgcgtcgtccatgtctccggtgttcaccgtgcagtcttcgcccgccgcgcgctgcgcccaccgacgagcgttctcggccggcgacgtcttcgaggacgcggcgccgccgtcgagctgcttcgggacggaccgagagtgcgacaggagggtggtgaaagggctgcggcgtcgccgtggccgtccggaacgcgctggccaccgtcgtaaggacgcaaagccggcggccgagccaccaacgcggcggctagagaggagcctctccctgtcctgcctacagaaatagcagtgttcatgtttaattttccaaatacccggtgttggtttcctttttgtgctaataaatgtacttgactgcgtaacttacnttcatttcccgatcatgcatggcaaggaagacaagtgttaacatnacgatatatangtggnggngtatttgtaaaaaaaaaaaa

SEQ ID NO: 87906 - DNA, 295 bp, Triticum aestivum
  unsure (1)..(295): unsure at all n locations
  Clone ID: PAT_TA_87906
ggcaccttgagatgcaaggcgacgccgtccactccacgtttcatgccgccggactgcgacggcggaggggggactcgggttggtgtgccacggccaagttggagcggactgatcaccactcgccagtagtgtgttggcggggccaagtccttggtcaattcttgatttgggttgaatgttctctcgtcggttgctctgattgtttttcttcctgtacgttcctccgatggtcactatggaaaagacctcaaaaggtagagacaaagtttggcaatggaatancaatgaccgccat

SEQ ID NO: 87907 - DNA, 420 bp, Triticum aestivum
  unsure (1)..(420): unsure at all n locations
  Clone ID: PAT_TA_87907
cccggccctgcaattgatggctcctggtgcagtccattaccttttccggttcgtgcggttccagtgcaaagcatctcatctcggcaaatcagtttagtttcttttgcaggagggaggcgaagaagcaaacaaagagataaagaagtgcactgcacagtcagactaaaaaatgttgttgattatggtttgctaagtcaatgaatcatgtagttaaaatgtgtattatgaggtccactattttgcaccaagaanttcggctgaccctgtactcaactcancggtctctctcctgcagtttgataaggtngaatactttttgtnaggnaatgngcatttcttttggtattcncccctgtgtcnaaaacngtaaaaatgatgattcatttncctttaaagggggttcaaaananaaanaaaaaa

SEQ ID NO: 87908 - DNA, 507 bp, Triticum aestivum
  unsure (1)..(507): unsure at all n locations
  Clone ID: PAT_TA_87908
ggaaaccttgcatataattgtcttgagtacaacaatacatgattttctggcaataaaatgttcatgattgatgcataatgtgtgctctgtccgcattttaattatttatattaatatttctggttatcactgcaggagttgcaatggagttgatgagggaagtctgcaatccagactgctaagtgagtaaccactccggattttatggatagtaaatggtccactgctattgacaggtgccttcctggactcttctgaccatttggcatgtttttcattctttactatcatcgtgtagtttcagaaaaatgaatactacttgggaaatatgtnaagagcatggctcaaaactcacaagacagacacaattttgaatcaacgattttaattanaccatgaaacatgtttttccgattgaaaattttgtagtaatttggaattttaaatgtatacaccaagaaaaacatagtctctacagttgaattttaatcatgtttggggaaccaa

SEQ ID NO: 87909 - DNA, 393 bp, Triticum aestivum
  unsure (1)..(393): unsure at all n locations
  Clone ID: PAT_TA_87909
atcacattgtccgaaaatatgttgagaagggctatgtgaagattctcaagattcacacggatttaaatgtgtcagacccaatgacgaaggctctaccatgagcaaaacatgagcaacaccggatagccataggtgttaaagagactatgtaaactagattattcactctagtgcaagtgggagactgttggaaatatgccctaagaggcaataatatttgtattattatattcccatattcataactaagagtttatattctatgttataactgctatgatcctgggaatatgcgattgactgggaaaaccatatgcacgtgtgggaatgataaaacaataaantaaaaggtccctaagcctcgcctcctaagactactcaagtgtttgtcgg

SEQ ID NO: 87910 - DNA, 277 bp, Triticum aestivum
  unsure (1)..(277): unsure at all n locations
  Clone ID: PAT_TA_87910
tttttttatgacgatgacacaccatatatgatttacacaatggttccagtaatatgaggagcacgccggcatgccaggaagtaagaaacaacaaatcgacggtttttctgactactgcaaataagatttcctcagtaataccaagacactgccatgaatccaaataaatccagcaaaggaagccaaaatggcagcctattattaatttattatcctccaaaaggctancctcaaattaggcaaaagantnnccccttcaaagttttggtaanttgaa

SEQ ID NO: 87911 - DNA, 544 bp, Triticum aestivum
  unsure (1)..(544): unsure at all n locations
  Clone ID: PAT_TA_87911
ttaaaaaaatatgtaccttcaaaattgtggagacaccattgaatagcaaataaacaatagtccagtaaaacatctctataatagcctattgttcatttgctatttttcatagttcgaaacgtctccagaatagtaatagctatcgtctatggcatttgtttcgtaactatcaaacatgtctaaaacatcatttctattgaatccacataacaagttttcatggaaagggacatcatcacatagattatagaaaaaagagggactaatcaatagtcaacactaaagcatccgaccactgcatggtggttgtagcaagtggcactgtgtccancccctggagttgcggtacatatactgaaccttgcaatgctccaanggtcagcaatgcatgcacatccttcgctacaaccgtgcatgcaccacaaacaacagcngggtttttaccccctaagaattngtcctgaacctgnaagcatcncctccnaatggtggtggtagcgatccccatcaaaacggacatgcactcccggtctcccaaaagggg

SEQ ID NO: 87912 - DNA, 351 bp, Triticum aestivum
  unsure (1)..(351): unsure at all n locations
  Clone ID: PAT_TA_87912
ggtggagttcctgaggacggaatttgggttggaaccttcatacatcgcacgaaggccgtccattctgacatgcagcttggagaggcggctgatcccaaggcattatgtcatatatgttctcaaggagaaagggttggttaagagagacatcgacttgttcggcgtgttttgcatgagtcacaagaaatttgtagagacgtatcttgaccgtcaatgagtgtgttccaagggcttgcagatcttaagctgctgcttgtgcaaggaaaatgctcccgaaantcaattgtgaagagattaacatccggangtcctcatcctagacnaacctatgatttgacngctnaaaaaaaa

SEQ ID NO: 87913 - DNA, 360 bp, Triticum aestivum
  unsure (1)..(360): unsure at all n locations
  Clone ID: PAT_TA_87913
cagagccttgctcccgcttcccctcgacgcgccgccgccgccgcctccgagcccctcgacgcccacctcgcagccatggcggagcagaccgagaagtctttcctcaagcagccaaaggttttcctcagcacgaaaaaggccgacaaggccaagaggccaggcaaggctggcaaccgcttctggaagagtgttggccttggtttcaagaccccaagggaagcgattcgatgggacctacatttgacaagaattgccattcactggaactgtttccatcaangggcaaaatcatagcttggaactgcacaantgccaagatnaacagnccacanttttttccanggantacttcattttgtg

SEQ ID NO: 87914 - DNA, 519 bp, Triticum aestivum
  unsure (1)..(519): unsure at all n locations
  Clone ID: PAT_TA_87914
ctgggccacgcacgcacgaacattttgatctgtctcctgggccttgggccatggtacatctgatgggccagtcaattttattgccgtcggacggagaagcagcgaaaaaagcatatagatgccacaaggattgatcccaagacctgaagtacctacgttgatggacacctctcttctttatacagaaccctatcacattttatatgtccttggattatccaaaaataaggaagctgtcttgggcaatcatcaagaacaaaagagagacccataaattatgccgtggtgtttngcgccgaattaaagggaattttgggaacgtgtcaatgaaaaaaacagatattttagttngaattgtggttagcaaatacttgccanaattaaaaagntatcccaagntaaaagaaagaatttttggcacanttaagaaaagaagcgtttnaacaaattaaaaagnatnctgggtaaaagaaggatttggccccaagggaagaaaaaanaaaaaccncgggggggggc

SEQ ID NO: 87915 - DNA, 333 bp, Triticum aestivum
  unsure (1)..(333): unsure at all n locations
  Clone ID: PAT_TA_87915
tgttgatatgtatctcatctctaggtacttgattgacctgggcctgttgcaccactcgacatttatgtgagctaggaattgaccaaaaggtttcggttgtatgtccatgtgcgagaagaatggccagacccctccgtcgatgccagtcattgctccggcgggcacgcgtaactcccgacaagcatcgaccgatccttctccgtctgccactgggcgcgaccggtcctacacctacacctacacctacaccttcaagatgaagattgcttaaaatnaacggaacttgggttgaatggagtgcttggattaattttnggtttgnnccttgggaac

SEQ ID NO: 87916 - DNA, 328 bp, Triticum aestivum
  unsure (1)..(328): unsure at all n locations
  Clone ID: PAT_TA_87916
ccaataacctgttgcaatgcacgtacaattatgtattcggaaaatatttttttgccttgtcgcagcacccactcagagaagcgactcgatagccattcataaatttagtaagtttatcacaggcatatcattttattacatagaacaggtcatcaacccacaacaacaacgatgatagattataaatactaaagttttcatcacacaacaaataataagcaatgaaatgaaattcaactcaaccaatcctcggcgttggaaacgcttgctttgaaccacaagtgattctctggggaaagggccactattgtaatctcnaagggggggg

SEQ ID NO: 87917 - DNA, 190 bp, Triticum aestivum
  unsure (1)..(190): unsure at all n locations
  Clone ID: PAT_TA_87917
ttcgacggccgcaacgtggtcnacgccnagaagctcaagganatgggnttcaacnnccantccaacngnaagccgcccnangggtgggtcaaggggcangcccgccgtggcctaagttcacatcncnctccccccncngatnggaggaagagcaagaagtggtttgaccatcatacacaatatttagatt

SEQ ID NO: 87918 - DNA, 403 bp, Triticum aestivum
  unsure (1)..(403): unsure at all n locations
  Clone ID: PAT_TA_87918
gtcaggatgggcaacatcgcccccctcaccggctccgccggccagatccgcaagaaatgcagcgccgccaactgagccggcgccactgcatctagcttgccggcgaagaagacagatgctgcatgcacctgaccttggtgcatgcccatctcgcgttgtcaacagtcatcatatcgtgcgtctggatgcgtacgtgtacgtgtacgttccgtgtgaaggttgtcctgtgtaccgtttcgtccgggttcaagctagctaggatctccagccaggagtaataagctggtcctacagtgtgtccgttgacgggtgagtgagtggtactgtggtaatgcctatcaaggctgttgtgatagtaacgcacaaaatgaataatggaatgtgttanctagccgcaaaaaaa

SEQ ID NO: 87919 - DNA, 468 bp, Triticum aestivum
  unsure (1)..(468): unsure at all n locations
  Clone ID: PAT_TA_87919
gctgtttcttccctgagaatgctgtcgatcctatgctgcgacaagctcaacctttcagactcgccgcagggttgttgttcctttatgctacaagagctcagaatcgattgccaggccctgttgtttgtggagccacttcagagcctcagatacactaaagagctatatatctgcaatgactgtgcaatggagtccttagccgagggatggttgctgcagaatgctacttccctccattccatcaagataggaattgccgaactctgcaaccttgccatctcaagatggataagcttgaagcgttacaaagtttgcacattgaaaaggcccctcctgatgaactactcccanaactgcctgcctcaacttaacaagctgaaaatttngggcnttacccaatgttaataannaattttgaaaggtntttggccnaantggggcaagtcaacaaattnccnaaggngataa

SEQ ID NO: 87920 - DNA, 533 bp, Triticum aestivum
  unsure (1)..(533): unsure at all n locations
  Clone ID: PAT_TA_87920
aatttgtaccaacactatcagccgtggaatctgtcaatagtgttcaaaatcaagatttcagcgatgctacctcgtttgcagacattaattctccaatggttctcattgatgatgcgagtacaccgaaaaaaaacaagcttgctctcaatattgttcttctcaaacccatgacttcttttgagtgattaaattgtccaagtggcttctctgtccagcataaaaacatttagcatgaattttttgctgaggggtgctctcccaagaatggcttactggtttggacctactgctcaacaattattggtcaantgtgaattgtgtttggctgagttggtctctcctccccagaacaagaagcttggatgagcaaantagtanaactggagggaaatgctaagacttaccgttttaaatacaagcctgttgaatgatgatcaaataatccctnanacttggcctgncnggcaagttccnaaataatgctacaangntcaaccaaatatgttagctgggganaagccaacngggatgnc

SEQ ID NO: 87921 - DNA, 547 bp, Triticum aestivum
  unsure (1)..(547): unsure at all n locations
  Clone ID: PAT_TA_87921
atccaaactacatttgaaacattgcccatttgctcccaagtaaacaagaactataaaccattgtcagattggaaataaatacaacttgctctgagtactaactacttctctaatcgagggaaagatctcttatggagtactaagtactatctcaaacgaactcttcttgacgaccaaaggaaagtgtgccaatgataaatagtaatagtatgtgggagagcaagcacatgaagctttaacatgccactgtggatnaagaatagaatacactccgtttgggtatagcttttgggaactacggcatgcaatgaataaatatacgatgggattgctttccttggattaccgcangttccagcggtgncaagcgccgccccggcagtctgcgtttngtgttnctcaaccagcttccgggagacgccggacagttctccgcccacccngtccggaggcaagacgaanaggaagccgtttggcaaancccccccacgangaacggacacgttgtgggcgcacactctcaantccctccttnacganccatcnt

SEQ ID NO: 87922 - DNA, 465 bp, Triticum aestivum
  unsure (1)..(465): unsure at all n locations
  Clone ID: PAT_TA_87922
gagcacctttttgaagtttatctgccgaccgttttgaattttctccaagttagttgctcatggcgtggtctctgctgttgattttgccgcaggcgatgaaggacggccgggcgagctgcacctgcgcggcgggcaaggccgccgaggagcttcgccagctgacgggccatgctcgccggcgtcccttcccttcactgcacgttcgcgggagcggaagtgaaagaccaatggcatgctgtcatcgattnaatcaaatcaaccatcccatcatcaaacccttaacaagagatgttactacatgaagtcatttgaaacccgcccnaaggcaacggccccacttttcaaccggatttgccttaactcccgtngcctacttagtccntcaacccgttaaggggttnatatacgtggggaacctggnataaatcncnatccanacggctgatattnannaaaaaaaaaaaa

SEQ ID NO: 87923 - DNA, 248 bp, Triticum aestivum
  unsure (1)..(248): unsure at all n locations
  Clone ID: PAT_TA_87923
gcggagcgaagtgctaggtatcctcgttggagggtgtcggggacgggagacacggtccgaagcaaaacgcttaagtctgacttgttaattcctgggactaaaatttctctgatgcagcgtttagatcatcaaaaatctcaggtctcgctcaagggcaagtgggtacaggtatagatgtttttatttctataccttcggatcagggcgagcttaatgttcggggtacaggcttggccctcctanctcca

SEQ ID NO: 87924 - DNA, 314 bp, Triticum aestivum
  unsure (1)..(314): unsure at all n locations
  Clone ID: PAT_TA_87924
cttggatccactcctccccgtcccgcgtgatgcgctcttcaggaatggggcgtccggcgattgggtgaaccacatgacgccggaaatggcgagccgtctggacaagatcgtagctgataaaatgcgcgggacagggctcacttttcagtgacttttgacctattcacgcattacttttctggtcgttttccgtcaatatatccaataaatctctgcaatgtattgccagcatttccttttaatcagtatcagtagtccatccaatttgttaccccgccatattaagattgtccttaatccanaaaaaaaaaaaa

SEQ ID NO: 87925 - DNA, 522 bp, Triticum aestivum
  unsure (1)..(522): unsure at all n locations
  Clone ID: PAT_TA_87925
ggaccaacaaggcaacaacaacaacatacgtggcgctctggtttgcttgcttgcaacggaagcaggggacacgagcataatagaacacccctcttgtgtaagcagccggggcgccctgaaacatcgcgaaatctgcatgccatattgccatcatatcatcggtcttgctaagtctcactcgaccgagacttcgttatgtctggttctcatgacgtgggaaatcaaaaatggtaaatgaccctgtgcgtgattgtgataacaggtcttccacggctgacgaaccgcgagaggtccgtgcagatggtgggacccggcctgaaagncattccccgtcaagntttcatccaagttgcggcgattnccgcgaattncatacagacaaagcggattaccgccgctgatgacgactttngcatccctcatccccatcgtcaagaanaccctccattnctggtcctccaagcccgggaagccctgaacactnctctanatnaccaaccgctgcaacaanaatctaggcgc

SEQ ID NO: 87926 - DNA, 389 bp, Triticum aestivum
  unsure (1)..(389): unsure at all n locations
  Clone ID: PAT_TA_87926
ccccaggtcataaacccaagtcggactcgccttcctcctccccaactactcctctcctctcctccgcgcatcgcaccggggtcacctgagatcacacacacaatggtgaaggctgtggctgtgcttactggcagtgagggtgtcaagggcaccatcttcttcacaggaagggagaaagggcccgaccaccgtgacgggaatgtcaccggactcaaggaagggtccacggcttccatgtgcacgctcttggcgacacaacaatggctgcatgtcaactgggacanacttnaacccgctggncatntncatggggcacctgaagatgaatccccaagctgggatttttggaatntnacaacctgantgatgggnttgcaacancattttac

SEQ ID NO: 87927 - DNA, 237 bp, Triticum aestivum
  unsure (1)..(237): unsure at all n locations
  Clone ID: PAT_TA_87927
gacaagtagtatggatcggaggctgtagcaaaatctgcttatatgatgttcncnattgcacacatgatcatgtcntatgatgtgcctgctgctggcatcctacatgggccgttgggtactgaaaatanttttggngggccgttactgattttgccgatgtgccattaaagtgttcaaagcgaaagaagttaaaagcttaagcacagtatccatttcctgttttctaaaaaaaaaaaa

SEQ ID NO: 87928 - DNA, 521 bp, Triticum aestivum
  unsure (1)..(521): unsure at all n locations
  Clone ID: PAT_TA_87928
cgtcgatcttcctcgtcatattagttcgccttgaacaacaagcttgatttctagtttgtgccttccccttggntccattaacctatcgcttcatcattcccttgacttgatgtcatcgccgattgattacatcttcggggagcctcttgacaacattggccatgaacatcatcaacattttgactccttccaggatatcaatggaattcttgatgataagtgccatcctcgttccttggtaatttgggttaccatcgacaacaacctttcattcctttcatcacaaacttgatcaagttatggagtcctgctaaccagctatgcttgttctaccttggggnattaccatcctttatgtcaangntatgtgagaattcccatccctgaaaatcctgataatataatactctcgcactcattggtttctgggcccgtgttgtcncaaacgaaatacgacaanggcngtgatgtgtaatctaactctncaaccctaagcttgaattatgggcatagtcatccan

SEQ ID NO: 87929 - DNA, 333 bp, Triticum aestivum
  Clone ID: PAT_TA_87929
agcgacctcacttcgtgaacacttgcttcagaaggagcaggtccagtacgtgagctggctgaaaacattggaagggatgttcaccaaagatcattgacctgatcgttgtcggaaaagatgaagaatagaacgattgttgacctattagtcctcgtctgttcaactttgctcgtcagttgttagtctgttccggatgagtcgaatgcttaatgttcttttgggctgtgacaatgcgggatacaaggtgagtgctgtactcggtaatttgtgtcctgtccagtttacagtaatggcgtccttgttgagtccatgaactgacaagtgtttaccacc

SEQ ID NO: 87930 - DNA, 480 bp, Triticum aestivum
  unsure (1)..(480): unsure at all n locations
  Clone ID: PAT_TA_87930
cgaaaacagtaccgaaaatttgaatttttttgaaaaatagaattccgcgatttagtaaatttgaaactgctcttaaaccgtaacgaattagagaaaataatagatatgaaaaagatgcgcctcaatgatatcttttccagcggtgtatcattttctccgttccgattagcggtttagaagaaatcgtgaaaaaatgctcgctgccactcgtcatggcccgcaccattttcaaaactgctcttaaaccgtgtggaatctcnaaaagtgttcaacatgtccnaagttgcgccctaatcccatagctttttaaaccgnatattacacacctcaatcccgataaacgatttaaaaattnnagtgaaaaccgnncccgaaaaacangtgtggcactttttcccgacgagaagttcacccccggtnagaacggttcacactttggttcaaagatgactncactgcgttttagcaggcatggcggaa

SEQ ID NO: 87931 - DNA, 524 bp, Triticum aestivum
  unsure (1)..(524): unsure at all n locations
  Clone ID: PAT_TA_87931
ggattagcgcgagttctctagttgatgattggtattaaggtgatttggggagcttttctcgaatcgcacatgccatgtatgacataatgcctgtgaggattaacgtcatgtttgttggtagttaagttctggattcaggattatgtttttcatagagcacatggaatgtttgatggattgtctatgaaaggctactgtgaagttttaagttacttttcggatatatgttgatttggggtatctcttttgaagttcatacagcacgtttgatgtggtgtgtgtctatgaaagaattattggtgagctttgtagttaatttcctgaattaaatgacatgggaccactgaactggcacattancctgtcagttgccggatgctatgcagattcacctccgtgttttggnacncaatacatgttcctaggaaccgtagttattgngccagtagacattttagataacgnccattcaaccagntcaatccaagnaccacccaantnaagaaacatnaagcaacacgaaa

SEQ ID NO: 87932 - DNA, 538 bp, Triticum aestivum
  unsure (1)..(538): unsure at all n locations
  Clone ID: PAT_TA_87932
gtgtgttcgttcactcatgtcggtccgtatgtaatccacattgaaatatcttaaacatcttgtatttatgaacggtgggggtatacattttttgtatatacatgaatttttttatagacgttgaacattttgcaaatacacaatgagcaatttttcaaatacatgtttgagcatttgttcaatacatcttaaacattttccgaacacatgttcgaactttcacaaacattcttttacactgtattaacaaaattccatgagcatattttgaaatgcgttaacattttttggaatggtgtaaaaactttttatttaaattatgcagcatctttccgcattgcataaacattttccanatatgtcatgatttttttgaaatgcatgaatatttgttaaatgccacaaacanttttttgaatggtgtgaaatatttggggatattacgcaaacaaggtttacatttgnataacatgtttttccaaagtcncaaactattttaaaatgcgagaacatccttaaancacanttattcaatggg

SEQ ID NO: 87933 - DNA, 473 bp, Triticum aestivum
  unsure (1)..(473): unsure at all n locations
  Clone ID: PAT_TA_87933
tttttttttatcatgaatatttatcacacattgtacccttttaacttacatcacagtggttctactggctacctatcactaccaaagcatgcaattgcaatttttggcaacaatctggcagctctgtaagaacattacaaaacatcgacttctaaagaaatccaataaaaaacagtattatcacttatcagctaagaacatctgaagccttctcgactttgaagcacactatcttctcttcaagtactcgatcctcagcagataggtaggggctcaacatccacccctttgagacaccaagtatgcgtccatgtgcctgcccngggtcanaacaacgaacaccntgtccactcctcaacgggagaactatcctccccccgggcaatttacaatttcaaccccttggcnccaaccggtnanaagggtgtttacatccacgatcggtttttgtgtnacaataacgtntccaagga

SEQ ID NO: 87934 - DNA, 365 bp, Triticum aestivum
  unsure (1)..(365): unsure at all n locations
  Clone ID: PAT_TA_87934
aagcagatgaaggcttttgcagataatattacagactggaaaaatgttgtgattgcgtacgagcctgtgtgggctattggaactggaaaggttgcttctccagagcaagctcaagaagttcatgccgctgtccgtgattggttaaaaaccaatgtatcagctgatgttgcttctaccgttagaattatctacggaggtcccgttnaatgcaacaaactgtngctgagccnacaaagaaaggagatatccaaggntcccnttcncgggggccnccttntaagggcccgncnttttcaacanntngaactcanttaagtcccaaaaagttcanccnatgtggattacaacnccnccgggggaaaaat

SEQ ID NO: 87935 - DNA, 390 bp, Triticum aestivum
  unsure (1)..(390): unsure at all n locations
  Clone ID: PAT_TA_87935
tttttttagacagaacactttacagggaagattgctgactgaacactttacaccctacaagttgcagcagtccacagtgaaactgtccttgcaaaggtccaacctgatccaacccaatccgactatccaagctagccgagactgataatttgattccaagaaagcaacacccatccatccaaccaaccatcacacaaattcctttccatcatcancatttctcccccaaatcacaatctaaaagtaagatgggaaggcttattgacactttgagaaatttgaggnacaccaaattttaaccttcctcccttngaatccccaaattttncacactgaacccttttgcgcacagaacgnggttaagcttngngcccgcttcgcctttngggc

SEQ ID NO: 87936 - DNA, 527 bp, Triticum aestivum
  unsure (1)..(527): unsure at all n locations
  Clone ID: PAT_TA_87936
gttccgagatcgggcggcagaaggctaccggcgagatctcgtcctctcccccacccttatccgatccgactacccggcccatcaagagatctgcccattgctccggtgtgtgtagtgaataaactgagatgtcagtatcaatgaatatgaggcaaaactcagtcagcactcctatccgtaggacgacaaatccctttgattcctgactcctgattctgaagtacctcaagaccatcaaagggcacaatcaagtcccaacgcagcacaccatcatcctgtgcaagaattgggagattnacccnaactttaagcagaagaancccaagcaagccaatatttgttttgggaacccaactnttngggaanatncacnaacctcntactttncanccacaaggggacaattntccnancctcnattcnggtggnancanccactntcagantnaacttttggatcccgggncatttcacaaaatggggcaaangancacatntaaaggccgttcaaaaaaaatcttaataac

SEQ ID NO: 87937 - DNA, 532 bp, Triticum aestivum
  unsure (1)..(532): unsure at all n locations
  Clone ID: PAT_TA_87937
gctatccattcaattcaattgtgcgcatcatcatccctgataccaaagctcatcttcttctccttgaaatctttttgggtccacagatttggaggatgtcttgcaactgcggatcaggctgcagctgcggctcanactgcaagtgcgggaagatgtaccctgatctgacggagcanggcagcgccgccgccgaggtcgccgccgtggtcgtcctcggcgtggcgcctgagaacaangcgggacatttgangtggccgcccgggcattccggccaagggctgcaacttgcngcgacaactgcaaattcaacccctgcaactgttnagctgcatnactcctacgtatacttttgaaggngttaaaatatacgtnaatnacanctccgatttgatggatccacaattttctgtgtntgtggttaattgccccccccttcnaagcnctgccttgcgtccngtgtttngngtatcaagttccccgtnattgcttaaccaacncacaanggtggatgggganattanaatgaaaattn

SEQ ID NO: 87938 - DNA, 537 bp, Triticum aestivum
  unsure (1)..(537): unsure at all n locations
  Clone ID: PAT_TA_87938
ctctctcctcccatcccttgatcccgaagaagaagaggctgtagcttgcatgaggaggaagatggaggcgaagaggtcgaggccgcccaccattgccgcactgtgcgtgctcctcctcctggtgctgctgcccggggaggtggccgccaagtccaagttctgcaaatgctttggacgactgcttcccccggtgcacgaacgacgacttccgcgcttcctctgcaaagtgttcttgcgccaacaattcaaccccaaccaagcccccaaaagcggngacccatttncaagatggccttgcaacaagctggtatcaatctgcngcnggtcaacggaccacaaatgcactgatccgcatctccttgaaaactgcaaccagaaatggggccncatttagggcacattacgttacttttntgagaatttaaaaaatctacgggctgtcgatnngtattcnanaaatgagttnaacncnccttatttttcaacaaccnntaaatgattnccaatnnttacnttangnatcatcccaaaaaaatt

SEQ ID NO: 87939 - DNA, 509 bp, Triticum aestivum
  unsure (1)..(509): unsure at all n locations
  Clone ID: PAT_TA_87939
gtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcaagctgattgacataactgatgatggatatgtcagccttctaactgagagtggcaacacgaaggatgacctgaagcttcccactgatgatgttcctgcttgggcaaatttaagactggatttgctgatgnaaagactnttccntcccgtgatttccccatgggnggaaaacaattttcccctttaangaaaccgtggnggaattaacactttcctngtgcccacccgcanatttggaccaatntccggngttttnnaaaacatcatagnaccaaanaccttgggngaanatttttcnaatgnngttttaanccaaagncaaggggcgcaatnat

SEQ ID NO: 87940 - DNA, 492 bp, Triticum aestivum
  unsure (1)..(492): unsure at all n locations
  Clone ID: PAT_TA_87940
cacaacccctccccaacccaccaccggcggcggcgcaagcgcgaggaagaggaagcgaagatggtgaagttcctgaaagcccggggcaaaggcggtgattcctggctgcaagggcanggtacgccggggaaagaanggcggtgatcgtgcgccgttgtttcgaaggaagggcaaccccgcgaaccgccccctaaggggcaactgcctcgtccgccggccttggcccaagttaccccgaaagaaaggtgattccgcaaaggactcggccaaagaaagaacgggncaaagaaagtccccgcgtcaaagtgttcctcaaactcgtcaactnaaccaactcatgcccaacccgctacaaccctcgaagttnaactcaaagaagtggnctccngngcgcccgaatccctcaacttcaangncaaaaaagttggcgccnccaaggncgccaaaggcaaactccaagaaccggtnaagaaccggcaaaaaaagngggtc

SEQ ID NO: 87941 - DNA, 499 bp, Triticum aestivum
  unsure (1)..(499): unsure at all n locations
  Clone ID: PAT_TA_87941
tttgaacacactaaatttgctnatgtgctatcttgatcaaacaacttanatcctcttgaggggaccaaagtatgcctatgagtcagtgaggcactttggcaagtctcccagtgtgccacacagccacaccaagccgtanctgcgctccaagggtaggaagtttgacaaggctcttgttcggtggaaaggccatggcttcaagtgtgaagcagtttctcccacgtccatcttgtcccttccatgctgccntggatgcctcctccacagaggaacgacngaggaagcgcgaaggantggtgaacaccgaatggcgaaacttgcaagcagtgtgctgcaattgatgggtccagaaacggccaatgtggattcgttncctcaacaaggtctacttctgccctgggttgcaacaactctgtcgggcaagtgcagttccttacnacacgtctgnaacccaggacanttcccctctcagaatttctggaacaagatctcanataac

SEQ ID NO: 87942 - DNA, 535 bp, Triticum aestivum
  unsure (1)..(535): unsure at all n locations
  Clone ID: PAT_TA_87942
ccggactccccgttcgcagcagctaccagtagcatacggaaagtggacggatggagggcgttccgccggaaatccaagatggccaacgtcgacgtcgtccgggcggaggcgaccgtcgggcccaggagccccaccgtgtacgactggtgcgtttaaacgtcgccctcgctctcactccatcctccttgcaccataccaatgatgatccatacatagatactacctactggatactatgtctgaccaatcattcagaaaaatagaacataagaatatatggcaaacggttcaccgtggtaagtggttccgttctaactcctggtcngtgtgcntgcaaggtggtgatcagttcaatgggaccgatgaagcaacacgcccaangnacgaaataatcgancgatgccgatgaagcaaaagagctaactggtgtgtttgangcctgtgttctcaagtcaatatgcataactgctgtgtaancctgtgttaattaaatcacttcctctctccttttaagnattgtcgtccccttgggcgg

SEQ ID NO: 87943 - DNA, 521 bp, Triticum aestivum
  unsure (1)..(521): unsure at all n locations
  Clone ID: PAT_TA_87943
gcattatagtctgattgtctggttcgttgcgctgaacacctcccttgagggacccaaaattggggtaaagagtgttcatatttatcccgaacaccccagtactagttacatgggggtagaagccgacgactgcccaactctcagattttataaatggctgcacagaangtaatattttaaattaagaaagcgtcgcctggtgcaaacgaactcatttaatattacaggatcacatgggcatgttcattcaaaagttacatccttggnacactcatctgccactaagcgggaanccttcaaggacactctcanaataantctcggggcaacgaatgtccntggccntcaacgggccctcccttaacaacttcacgggatccaaacttcgcctaatgcaacttcncccgggcaaaagcctgcgttgaactcnatcaaacgggctgctgatantcaaaccttggcagnntcactaacactacaagcnaatactccggaanggtcncaagcactcaaacaaaagc

SEQ ID NO: 87944 - DNA, 561 bp, Triticum aestivum
  unsure (1)..(561): unsure at all n locations
  Clone ID: PAT_TA_87944
ttttttttctagaagatcccttggacttcctatatgaatacatcaccatgcaagtattattacaatacttattcatagtttattatactcaccatgatgaagctacattaataacaaatgtagttgctgggaagatgatgtttgtcctttgcagctaaggtggataacttagaaatatttctgcagaaggtctaatctttgtgctccggtgatcaccgccttgtcaattgttctatggcatgaacatgggagctttcctgaccttggtgttttgctcgaacgcgtatgccaacccaatcaacctccggggcngtaccccctcaacccaacaaagcaagagancaaatggcaccccatcttgccgtacccgggcggcacggatatcccggcatgccaacaatggcgaacgccgaggatgcatcancgttgggcatcacgaaggcatctagctgtgcccctcaacaacttctccaanccaatggnggncaacttcntaagctgacggttgctgctcctccggngcaacgatgccatcntgtttcgggcgcaagaanatatttg

SEQ ID NO: 87945 - DNA, 523 bp, Triticum aestivum
  unsure (1)..(523): unsure at all n locations
  Clone ID: PAT_TA_87945
acaaccaagccaatctcgccggagaaagaagcgtcgacgatgtccggccgcggcaagggagggaaggggctgggcaagggcggcgccaagcgccaccggaaggtgctccgcnacaacatccagggcatcaccaagccggcgatccgccgtctggctcgccggggcggcgtgaagcgcatctcggggctcatctacgangagacccgcggcgtgctcaagatcttcctggagaacgtcatccgcgacgcngtcacctacaccgagcacgcccgccgcaagacggtcaccgccatggacgtcgtctacgccctcaaacgccanggccgcaccctctacggattcngcggctaagccaanccnaatctattcccccaccaacatatttgtgctcgtagctanctatggctgtgtatcatgggcttccgtgtaatggatgcatctcnctgctgtatgtcctggccttgactgttgttgcntggatgtagtatcctgngatnaaatggaattnaattggcctaaaaaa

SEQ ID NO: 87946 - DNA, 503 bp, Triticum aestivum
  unsure (1)..(503): unsure at all n locations
  Clone ID: PAT_TA_87946
gcatcatgtgctgagagtatgtgctttgttgcattaaatcaatatccatcctctccagcatcatgtataagaaatttgcatctaacttgtgtgtcatgtgtccgtagttattgaacccggagcggtgatcgacacggtaagggccttagttcagtgttcagactgccggtttagcggtccaacctgttggttaaataaaatattatgtatggttttttgtctgttagtatggtagaaacaatgttaagtacaaagataacaaacgagcacagcctagttagttatggtccaaacaatgttaaagatggtccaagtgcttccacctacagaatattttactgacccctggtttatgccggttcacaaaaggttgattggatcaaccttcactgtgaacagattggaacaaggcttggttccggtttgttctggtcggttttaaaaactancatgtgtcagtacagtattgcgaaaaatccatttttaggttgaacatgcaaaag

SEQ ID NO: 87947 - DNA, 226 bp, Triticum aestivum
  Clone ID: PAT_TA_87947
gccgtgcccattccggtgaactcttcgtgtgtttatagtacactactgtcacttcctttccctttccctcgtcagattcagaagctaccagcacttccactgtctagtaattccttttttttgttgtaactctgtctagtaattcgttcctggtgtaatggtactgctgattattaactattacaagtgcatacagtactgtttattttggtccaaaaaaaaaaaa

SEQ ID NO: 87948 - DNA, 481 bp, Triticum aestivum
  unsure (1)..(481): unsure at all n locations
  Clone ID: PAT_TA_87948
gttcgtcagcgaccatgtccgggcgcggcaagggaggcaagggtctcggcaagggcggcgccaagcgccacaggaaggtgctgcgcgacaacatccagggcatcaccaagccggcgatncggcgcctcgccaggcggggcggcgtgaancgcatctccggcctcatctacgaggagacccgcggcgtgctcaagatcttcctcgagaacgtcatccgcgacgccgtcacctacaccgagcacgcccgccgcaagaccgtcaccgccatggacgtcgtttacgccctcaagcgccagggacgcaccctctacggcttcggcggctaggctcgtcctcgcccccgtgcaaattccgatgtgcttatccgcctgtgcgcaagagtcttgctgtcgagaaaattagctnaaatgaatccccatgttanctccgctgttctttcgtaggataactgtattgtcaaacaaactgttccanccgatct

SEQ ID NO: 87949 - DNA, 458 bp, Triticum aestivum
  Clone ID: PAT_TA_87949
accagtcgtcgttcgggacggaggagagcgggtggaggtcgtcgtcggggtaccaagactgcgaggacctgcagagcgtggcctatgcgtaccttaatcgctcgtaagaaccactacaactagctagtgcagaattaatatatcacaagatatactcctcgatcgatgatttcctgaatcctgatcatgttttgggcttgagagtttgagttggataatatatgtgtaatttttaaagtctacgtcgatcagtcgatcaatcatgctcaggttctagtccttacctagccaactagtaataatcctagtagaggggttgtgagagttcactgctagatctatacatgatcaccgcaggaacctagctagttgactagacagcaaaaatgcttcttggtacgatcaatatgctatatatttctggttggaaataattatcttgtctgaaaaaaaaaaaa

SEQ ID NO: 87950 - DNA, 446 bp, Triticum aestivum
  unsure (1)..(446): unsure at all n locations
  Clone ID: PAT_TA_87950
atacctacattacgaagggaaagaaaggaaaacagaagttgcaaaggttgagctgaactttctaggtcttccacttcgtccaggaggaaaagagtgtccatactatatgcgcattgggagctgcaaattttgccaccaactgcagatttcacatccggattcctactaatgtggtttcaagagatccaatgttggagcatganaatggcgatattccacaacaaaatgttcaancatcttctcaagctgaatgttccantatggcctgctgaccgaagggcattgaatgaccacngtgcccctttttaagctccagnancccatacattgcgggaatgatccacctcggggaatgttncaancncaaaatggtgtgggtccaccagggtcccattgggccaatttncccccgggaanccctttnaanatttccaacccccccggga

SEQ ID NO: 87951 - DNA, 512 bp, Triticum aestivum
  unsure (1)..(512): unsure at all n locations
  Clone ID: PAT_TA_87951
gggagagtcccggccggactcggggtcgagcggcggcgctggcgcaggaaggcggcggcggcggttgggccggctcggctgggcttcggcccagtcgggcgctggagagatttttttaaataatttcgccgaaacttaaataaatcctagaaaataaaataaaaaatctaaaaatgccaaaacaaattttgaccatctaaataaaatatttagaacaagatgaacattttcttggccctaaaatgcaactttgaaaaaaacgtccaatttttctaatgcaaataaaatagcaataaactccgaataaaatcaaatttttgattttaatatttttcctccaatatttcaattattttggagaattcatattatctcctctcatatattttaatatgaaatatttttgggagagaaaaataattaaaacaaaaaacctccgtttcaatattggatagaattcaaatatgaaaacaatgaaatccccaactctctcccganggtccttgagtttg

SEQ ID NO: 87952 - DNA, 542 bp, Triticum aestivum
  unsure (1)..(542): unsure at all n locations
  Clone ID: PAT_TA_87952
cacgctcaagcctccaccaccctcaaggatctatctctttctctttgtctctcaccctctcatggattgacaactgcattcttcccaaattaatgcttttctttggtgtatcaggcattcaggctggtgtaatttgttttcaaaagtgaacatgttgtacagttcaatgtatctacaaaaattaagttatgaacgaggacggatccaaggttgagtactaggtgtgggaaccccttcaagatccaagttggctgctgttgtactctgttgtgggacaaactgggatggtattcttttttggatgatccttccggcccctgtcatactcattgctcttcagttaacgaaatgaatgcacagcagcaacacangcagtagcagaatggggtataatgaagttttgtttgatctgacgtcaaacctgttcgtgttccnagattccaactaagggctggttgttaactagaacacaatcacgataagattcctatatgacattcggatcgtgcnacattcaatttgaattattcaaaaaaaaaaaa

SEQ ID NO: 87953 - DNA, 621 bp, Triticum aestivum
  unsure (1)..(621): unsure at all n locations
  Clone ID: PAT_TA_87953
ttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactggagagtgggcaacacgaaggatgaccttgaacttcccactggatgatntctgcctgggcagatnaaagactgggattgctgatggcaagactgatcctgtccgtgattccccatgggtgaaagaacantttgcctgtnaaaggaanccgtggtggaataacacttgcgtggtgcctactgcgatactggtatcaatgctctgggtgttgngatacacatcataggaacaaganatcgttggtgaaacaatttgtcanaattggtgtttttaacaatgctcaggcncatactttgtaccaccaccacccataaaanccttgatn

SEQ ID NO: 87954 - DNA, 544 bp, Triticum aestivum
  unsure (1)..(544): unsure at all n locations
  Clone ID: PAT_TA_87954
ctaaacgcaaggctaaggggaggcgatgagaaaaagaaattacaagtgaggaagaagagcaagagaaggctgttcagcctcggcaaggccaagaagctgcagaagggtctcagggccgtcatggacgggctccggcggctccggcagaggatcagagtgaaggctctggaccggttcaaggcggtgctttgtccatgcccaantcgctacgaaagaagcatgatacctccagactaaggagcatgaacaaggatccatcctgatgtccaggacacncctccaggcatgggacattccaagaatatganttcnagctactttccttccaggacaaaacttttgcagttgttttaatgcatgtgcaacctggcattttggcattataaanacatggnacatactgcatgctaaaactanacatgattancctaactgtattataggagattaaaggtctcnatatcgtctcntacatgataatatgtactnccgacanagatggcactgggtaattcanggtnaaaggggccgtnccaattcccca

SEQ ID NO: 87955 - DNA, 500 bp, Triticum aestivum
  unsure (1)..(500): unsure at all n locations
  Clone ID: PAT_TA_87955
ctcaaaccaaaccgtaaattcccgtctggtggcaaaaacaagactctgagtgggcctaaagagaccaagacccctgtgccagacgctgagcaaaccaagacgcatgtgcctgagaacaccgagcccgccgccatctctgatgagatcattgatgcctatcacacccggcgtctcgatgctaaggttgctggaatggtgaagccagagtaaggaaggaaggaatctggggacctttttttgcattaagtaaatgttaccacttgtaccactggagagactgttgggggcatttcaagccatctgcaccgtnctgttcancatcttccgtgcaataaacttgatccatgttcttgccctggaactaatgatccctattggtgatacaccctgtgtaaattttttgccnggttggatggttatgtccnggaactttaaaatttaccttactggatcatttgcccaatgttgggtcctggggttaaatantggcggtaataaaa

SEQ ID NO: 87956 - DNA, 507 bp, Triticum aestivum
  unsure (1)..(507): unsure at all n locations
  Clone ID: PAT_TA_87956
cgccggcgcgcagccgaagaagaggacgttccgcaagttcagctatcgcggcgtggatctcgatgccctcctcgacatgtccaccgacgaccttgtccagatgttccccgctcgcgcccgcagaaggttcaagaggggtctcaagaggaagcccatggcgctccgtcaagaagctgcgcaaaggcgaaaaaggacgctcctgctgggtgaagaaccttgaccagtnaaggacacatcttccntaacatgattnatgtcccctggagatgattgggcaccttnaccggtgtcctaanaatgggnaaactttcaaccagtttnnaatttaacctnagatgattgggcnattacttggcanattcctccnactccctaaaaccaatntaacatgggnaagcccngatttggtgccaaaatcttcccngntnaatcccctnaaagnttancccttcnaanttnaaaaattntnngggcatcgggggattcatcnactgtccctttttaaca

SEQ ID NO: 87957 - DNA, 479 bp, Triticum aestivum
  unsure (1)..(479): unsure at all n locations
  Clone ID: PAT_TA_87957
gtttttttttttttttttttaagcaaaaccacgggagattttatttaggggtttacatgcatggcatggcacccgctctgctcatgcaggcaggtgcgtacatacatacaaagaccctcgatcaggcagcgttacatggtagtagatggtagatagatcatagatatgatgcacgcggcgcatgcatgatcaatgatctagcagctgcagcaggagcagccgcagctgggtgccgcacttgcactgggtgcagccgcagccgccgttctccgccgccatctccatccccgccggantccccttgtgggtggcaatggcggagacgatgagggtgggcgccggcggctcgactccgggtacatttgcaaccgccgcagccttgccgcacttgcaggcctgccgcaaccgcaactcctccgcaanaagaatcttccaagttcctngggatgggatggagntttgatggtgtttgcaagggg

SEQ ID NO: 87958 - DNA, 445 bp, Triticum aestivum
  unsure (1)..(445): unsure at all n locations
  Clone ID: PAT_TA_87958
gccagggtgatcctcctcgttaaagatgatgggcgtgcgggaccacttgagcggcttccgggcctctggcgctggttccacaacattgacctgtcgtgcccatcgtttgagttggcggtgagaggtgtgcaaagatgcacctccatcaatgcatagggcgtcagtggccttatgaaattcctgctcattggtttcctctccattcccttcatcactcacatcatcacagatttccttctcttggcccctggcgggggtttgccggggctatttgcttcaccacctcggcccttaccgccaggagcgttctgacctttctccttatcacgcttatcatactttgctctcgtttcttgacgagctgctcaacctaataacactcttgaaagncctggcctttggnccggtggatntgaagcatctataaangcatacccagtgatta

SEQ ID NO: 87959 - DNA, 567 bp, Triticum aestivum
  unsure (1)..(567): unsure at all n locations
  Clone ID: PAT_TA_87959
catgcgttcgctggggcagaacccaacggaggctgagctccaggacatgatcaatgaagtcgacgctgatggcaatggcaccattgacttcccagagttcctcaacctgatggcccgcaagatgaaggacaccgactcaagaggaggagctcaaggaggccttcagggtgttccgacaaggaccaaaacggcttcatctctgctgctgantccgccacgtcatgacgaactccggcgagaantcaccgacgaggangtggaccagatgatccgttgaacccgactccnacggtgatggcagattcaactatgaagatttgtcaaaggccatgatgggcaaatganaccaacctgctcccnaagacaggaggagattnttcattgcatattaattaaaatcaactcttattggttnattccaattnacacctactactgtactgtaaaacgtttggcgaccaatccgcaagttcccantgtgttcaaacccctgtgtttagtaactntgtcccctggtanctgatgcgttccccgttgngaaaattttcacacttncttacctcatac

SEQ ID NO: 87960 - DNA, 510 bp, Triticum aestivum
  unsure (1)..(510): unsure at all n locations
  Clone ID: PAT_TA_87960
acggggccgcggggtgcgtttcccccgtctcgaggaggaatctggtcgccctttgcccaagtttggcgaatgggacgtcaacgacccagcttctgctgatgggttcactgttatattcaacaaagccagggatgagaaaaaggctgggaatggacaagatactgaatcccctggcaaagatgccaggactgagagggtgggaatcttatgccaccaaggcaaattcaaagaagtggtttgctgcgtgacaccaatcctacacaatcttgaggangacaagcgtcnccccgaaagaaaaaatggttgccgaagtatggtcgtttaattttgccaaatacatactanccataaagacctnttaagaagtaccaagntccctggggcaacaacnatggtactcntaaaanatgggtacncntnaaatccgaatgtgttantatgggtgaggttgtcaanaacncaattgggtaaatgaactcnatgtaatcngnctcctgtaaaaaaaaaaaa

SEQ ID NO: 87961 - DNA, 589 bp, Triticum aestivum
  unsure (1)..(589): unsure at all n locations
  Clone ID: PAT_TA_87961
cttccaaccaatccaccaagcaaacccgatggcccgcacgaagcagacggcgaggaagtccaccggcggcaaggcgccgcggaagcagctggccaccaaggcggcgcgcaagtcggccccggccacgggcggcgtgaagaagccgcaccgcttccgcccgggcaccgtggcgctccgggagatccgcaagtaccagaagagcacggagctgctcatccgcaagctgcccttccaagcgcctcgtccgggaagatngcgcaggacttcaaagaccgactccgcttcaagagtccgccgtctccgcgctgcaggangccgccgaggctactccgtcgggtcttccanggacacaacctctgcgccatccangccaagcgcgtcacatcatgcccaaaggacatcaactcncaagaccatccggggcaaaaaggctaagatatgtcgtcnctctgaagtgnnaaattacatgtgtttgcctggtggattatccntgtccngcnaagttggtgtgnttangtccaatgnatgtcggnngtacaactgttgtanaaaatctaataaattggttaantncccanttggtttcgnc

SEQ ID NO: 87962 - DNA, 246 bp, Triticum aestivum
  Clone ID: PAT_TA_87962
cataaacttttagcaagcgaagatgccgacaaaaagaaggcacatggtaacacaagatcgaacggaaggagggcgaagaaaaggcaaaggttttcgaaaatcattttagaagtggggagaggaaaacgagaggcgaatggcaaataatgtaatgcgggggagaagagtttgtgatgggtactaggtatgtcttgacttgagcgtagatctccccagcaacggcgccagaaatcattcttgctacct

SEQ ID NO: 87963 - DNA, 431 bp, Triticum aestivum
  Clone ID: PAT_TA_87963
gcccgctgaaggagcttacggcggacgaagacgaggcatacaagacggtggaccacgagaacttcatgaggcttttcttcgcgacgaagctggaggggaagagcttcttggatcggatgaagctgaagtagctagcagctgattgctacgaacccagcatagcaggtaaactgtgttgttggtcctcgcatcgttgtcagatattcaggtagttcatgctgtgtaaccaaccttaatgaggccctaacagatcatgctctgggaatttagttcctgatggccgtcttggtagagcgcaagagagctgaacttggcaaacataataatatgtgatttcctcagtaagttgctcctgaaccgtgcctggtggttctgcaaaactttgatagatttgttccctgcgtgcttgatgtcctgtacaaagtggggct

SEQ ID NO: 87964 - DNA, 608 bp, Triticum aestivum
  unsure (1)..(608): unsure at all n locations
  Clone ID: PAT_TA_87964
tttttttggtttgaaagctgaaacgcaaattagataaggtggatttttttcctgaatttcgaacagagtatgatatctgaaactttctagaccacggggccctgctcgctctcagcaaccgttactgacgttgcaatacatacagggtacgcagctacgctagcaagagttgatacttgatgccttgatgggatctcctgtgatgatgagtaagtgaacggtaaaattggaacttacggtctccgggagcgcggcggcgtcgcgcatcaggtggttgccggcgagcgtggccgagcaggtctgcgccgcctccgtgccgaatcggcacgagcagatgaagaacaagaagcatacatgttatgcaaaagaagatcacttgctccgtatagtttaatttacagggtatgaagaagaactggggtggtacaactgaaaacttaaattnagaaagacaaactttgtttaagaactacataataaactttaaacatgcaattttaagcaaacaccaaanataaacactattgcagcatgcctaacaaatataccaacacagtttgaaggctgagaaggcaaactacattacggtgaagacaggtcataaagcc

SEQ ID NO: 87965 - DNA, 573 bp, Triticum aestivum
  unsure (1)..(573): unsure at all n locations
  Clone ID: PAT_TA_87965
gaaacatacagtagtacatattgtacgaaccaagtattattggctatgcttgacaatacatctgggtttgttggtggtgttgtaaatctcatttggaggccagttccagggatgaattgatctacggttttagaattctgcctacacgtagagtggcgttgccagaattttaacctagcttgactaattaaacatactaaaggtacacatcaaacatcaattaaaagaaacttatggtcataaaagtgtaccatgggacagaacacccaactgttacaaaatcatccacagaattcctggatttgacaaaatgtttgcttcctatatgttagatttaatgtgcaaggatgaaatgctgtttaatattgaaggtgattcctgggaactgttttgggctgaaatactgaggtcaaactgcacagagagaaaggcgggagactgctcctcctcttgtcacaacaaagntcgggaatagctgtggcagcagaaaccctcactacgctaaatccgcaacagatccgaagtgggcatgaccttcctggggggcgggtttgcagtcacaacgtcggtgag

SEQ ID NO: 87966 - DNA, 368 bp, Triticum aestivum
  unsure (1)..(368): unsure at all n locations
  Clone ID: PAT_TA_87966
aaattcatcctgggattctccttgttcatgggcatatcaattccacaggtatttcaaatgagntacacctccgttcgcaaggcttttgggccccgggtacacaangcacgcaaagatggttcaanngncatgatcaangtggncttctcgtcaaaaagcgttcgntcggaaggcgccancggcccttctcctggaacaagcaacccctgccaaaagggcacgaacaagncacccncccangggaaangggaccnggggggccaaccaatttnctgggggaanaaggttcangggtcctttccaangannagaaccccccccaaagccnaggangnttcttangcccccggcccntttaaaagcnccaa

SEQ ID NO: 87967 - DNA, 301 bp, Triticum aestivum
  Clone ID: PAT_TA_87967
ggagactgtgacgaccgtggcgagtagcgcacggcggtcagcagctgggagagcggcgatgccttactccgagtcgaagaggtccagccccggcggcccggaccctcagcaccactaattaagtaaactcgcgttgtaaagtagcttgtgttggctaaggataatgtacgccgtaagttggaatctacgagtccctcgacttctagagaatcatatgttactcaacacatgagtcttgtaattccgtgcctgtgcagcacgcaagaaaaataaacgtatgaatcatgccaaaaaaaaaaaa

SEQ ID NO: 87968 - DNA, 575 bp, Triticum aestivum
  unsure (1)..(575): unsure at all n locations
  Clone ID: PAT_TA_87968
ccaatgttgatttacagcagtggcaatcccacaaatattgccaatccaattattgatggtaagtgttaagattgacataaaggctcttggtggaaggctaacatttttccaaacaactgcttgtgaaaagataccttggaagtatttgaaggcctataatgatgttgatcctctagattacttaggggcttacaatgttgaggacattcagctaatctgttgccaacctgatgcatccacaatgtggttgggtacctcctccagtccaaagtaagattccgttccgatcccttggaagagacagaaatgatttttgggaaagatggaacttattttaaattggggatttctcaagagctagaccaaaagtaaggattagtgaaatatgaaccacccgtccnanaatgcccgagtgtagagaanttaagcaatgctcaagggttttgcacacagcttgaggataactgagcttaccctangtactccgggttactggtnangtgaatgcggcgactagagccatcgatagatcagtaagcggtgaactgctctgaataatggacnccccctggggg

SEQ ID NO: 87969 - DNA, 163 bp, Triticum aestivum
  unsure (1)..(163): unsure at all n locations
  Clone ID: PAT_TA_87969
gggatccggaccacatgaagagcatttttaggcggggacggataaaatgtcaaggctttttagtggagtacaagctgcgatggttatcaatcgggtagaaaacagtgagcaatctcctgaagattggaatagcgatggtgatggttcaaggctgttnaaccgg

SEQ ID NO: 87970 - DNA, 537 bp, Triticum aestivum
  unsure (1)..(537): unsure at all n locations
  Clone ID: PAT_TA_87970
gcttcctccccgatcaggcctcctccccacaagcttcaccagagaacctagcggggacccctcctctacgtcctctaccccaggcagcggagcgtcgaccctcctcgcgagcagctctgcctttccctggacagcgctgccttctctacttccttgctccaaccacgagaatttgacaggtttcccaaagatacactacttgatggagatttggatgatctacaagctgctgaatgtttgcaagatctactattaagttggtggagtgataatgtaatgcgccttgtttggtgaacctggagacattggcaagttctgctcattttggtggttgttttggcacataggccactatatggccattttggttgcgtgacacatttagaaacatatatacttctccctttgtggaactacttcattttggttgtgtggcacgtgtatctagaaacattatgtactcntttgtggacaatccgcttatatacatcctaagttaaggatgaagttaaggttccgatgagactatagttaaaa

SEQ ID NO: 87971 - DNA, 252 bp, Triticum aestivum
  Clone ID: PAT_TA_87971
attatgatatctttggcatatgctcttgaagaataacttcctctttcctagagtgtggcatgtgacgctgctaaatttatcaaaatttactattctgtcaggatggacaggagtttcctattgataaaggggccaaaaaactctcaaccactaactgaattgctagatcgcggggactctgttgtttaataatggtagttgggatctcacagttaatttatcaatatttacttgcagatcaaaaaaaaaaaa

SEQ ID NO: 87972 - DNA, 549 bp, Triticum aestivum
  unsure (1)..(549): unsure at all n locations
  Clone ID: PAT_TA_87972
agtggatgaaaagctttgcagttatctgctcccgggtgttaatttggcccaagttcttagcagcagctacctgaaagaggagccaagaggaaactggtgagccattgcaaaggtggctcctcatttttcaagtaatagatgaaaggtttggagagctctttgccccgtgtctgcgtggagaagcaagagatgcaagaaacatccatcttttcctacctaatatctggagagccacactgcggtgtgtgccttccaaacacggcgtcaaatgttctctctcctgcaagtcctatatataatattaagccattggaaaatagggagggttttccgcaattgcantttcctcatcctggttgcacatattgtttggtttccccccctgggccacttttgctcccatccaagtgattatccttaacaagtagtggtancataaaaacttngatacaaataattngcaaggaaatgccttttgtcacttngcaaagnnacctctgtgtngtnttgcaaaactccaactcacngtatcnccctcacnggncgtgn

SEQ ID NO: 87973 - DNA, 486 bp, Triticum aestivum
  unsure (1)..(486): unsure at all n locations
  Clone ID: PAT_TA_87973
attcttgcttgcttgcattatggttaatcccataagtctcgtaatcttattggcatctcttgtcattatgattttgatcctatggattcaacatgagtgcgaatgcacgcaatcatcggttgatccttttaaattatctttctggctcagacgtcattttaaacatgagatggatctcgaccgatcaaattgccatcgattgtacccctaagactactcaacttatccatccctattcagagcattgcttctgatcccttctcttggaattcataattccttttcatttgagctttgaattagtcgattgtttctataataggatgactatgcattatttttccttctgattgagtatcaatactcacatcagattccttgtggtccgcgagaccaattgcttggttattatccgacaatgtcctccatatccaataaccttgtcaagttctcccctgatatataatgactttggtaaattgtanc

SEQ ID NO: 87974 - DNA, 488 bp, Triticum aestivum
  unsure (1)..(488): unsure at all n locations
  Clone ID: PAT_TA_87974
cctcgccctgtttctgctcaaacccgagctcatccggacgccatcatagctctgccgtcgtcgatcccgcggccactggccacctcgagctacgccacggcttctaggcggtccgccgtcgtcgtctccttcctctacgcccctcggctcgtctccaggccgccgccagcgcttgccatcgggctcctccccacgcacagccgcacgaccttgccgttgatccatcgctccgatccaccccggcctcgtcgagctcgcctgcgacctctgctaccccgagacggctgccgatgccactatgttcgactacatcaccgacgaccctccttgtctgagcaactagatgtcggagcccaaggagccaagatgccaccgccgatgcctactactacgtggagaccgacgacaaccaggagtagttaggagntccaagcangaggcttgccttttcgatcgatgttgcttttgtgcnaccttcttaaagnaan

SEQ ID NO: 87975 - DNA, 301 bp, Triticum aestivum
  Clone ID: PAT_TA_87975
attacgacgaactggcctcttgggtgaagtcgaagttgctgggccgtgagtgcggacggtgatatacgatgacaccgatggcgttgtgcctttcgttttgtgttgtgttggctcagccttttgacgcttttgtatgtcttgtgtgctttagacctagtttagctaggtgttgtggatggttgtgtcctctgtacaggttttcgcccggtttcccttgataaaccgagcagtctcagccatgggcttcttcttctgcaatggaatcttagcagttttcctgctaactttcaaaaaaaaaaaa

SEQ ID NO: 87976 - DNA, 337 bp, Triticum aestivum
  unsure (1)..(337): unsure at all n locations
  Clone ID: PAT_TA_87976
gactagaaaaggttgagcaggaactggcaacatctgaaaaagatggtccagtgtctgagacgttttacaagaaactgaaggaatttctggctgatgcccaagctgaagggaggtcattagcttcgctttacagtacagcgggcaaaagcgcggattctctagcacattattttggtgaagatcctgtgcggtgtccatttgagcaagttgtctccactctgctaagcttcgtgaaaactttcgagcgggcgcatgccgagaacctcaggcaggcggaggcggagaagaagaaagcccattggaanccgananaaanaaggcaanggcanctcccgct

SEQ ID NO: 87977 - DNA, 438 bp, Triticum aestivum
  Clone ID: PAT_TA_87977
ccctcatctccccaggcttcgaccatcgcgtccaatagcccatcatgaacgccgcccgcttcctccgccccttctccagggccgccgctgcccgcgcgcctatggccgtccgcccctctgccctggcgcgccccgccttcatcgcgagccagaacaagaaggtcgaggttggccctcagcagatgactatcctcaagtcggccatgccccagctcatccccttcttcttcgtcaacgagaccaccgtggccttcatcctcctgccatcgctcatctacatcttctccaagtacatcctgccccagcgtctgcgcatgttcgctgcccgtctcttcatcaagcaagttgtaagcgaggggaatggaagaacaagaaagagcggatgacactgtataagtagtgggaatatgctcatagacaatcgaatggcattgcacg

SEQ ID NO: 87978 - DNA, 481 bp, Triticum aestivum
  unsure (1)..(481): unsure at all n locations
  Clone ID: PAT_TA_87978
gtttgaatagaggggaaagtgacgtgttgagttggtcatttatgttagaaatgcaggaacattctattcacagagaaggaaaagtccgaaattcaagccaaagaggattttcgcttggcttggagcattcgtgtacaaggtggcggtgaagtgactatttacaggagctaggaacagaaataatggcggtagcttgttgtttggcagtgctgcccatgtgaccccaaagcatttccaaagaagacacaggagaaactcttcagcaccaacacctacaggcagctcttgctgctgcagtattgccacagcatccaacttgtttccacaattcttgagatcccaatgagcgaattaaagcttcagcgccaacaccaacaggcagcangtgtcgtccagtatcggcgccacgaccaacttgtttgcgcttgctttgagaccacaatgaataaattaaagttttgggatgtacanacctgtatgg

SEQ ID NO: 87979 - DNA, 483 bp, Triticum aestivum
  unsure (1)..(483): unsure at all n locations
  Clone ID: PAT_TA_87979
ctcggattcagccgcttgccaaagagatggctcaagcctgtggaggattgccgatagcactacgcacatttgctggggcaatgtctgcgatacaagatgcagatgaatggaggtatatgtataaatatctccaggctcggcttccattgtcacgagaacaatttgcagatttgttacacaatatcaggcactggtaggtgttgctgtgctctcctaattagacctgtttggaagcctgataaatcgcagttctgtaaaataattgtccttgcctagtaagttagtacaaagttgggtcatctattttggaacggagggagtatgtttgaatgtccaaccacctacatctgtgagcatgctgttggatggttgatggactatgttagataaaaattctaacagccccaactttccctttgagcaaaatggcagctgatgaaaactggctatcactgaantgtaaactccacctgcaagaaattc

SEQ ID NO: 87980 - DNA, 212 bp, Triticum aestivum
  Clone ID: PAT_TA_87980
ggtcccggaggttcggcagcatgcgcatgttggcatcttgtatcggcggcccgtgagatcagcgcaccgctgctgtctgtattctgtgtagtccagcgtgtgtgtacaaggaagaaatcgcaaacctctttttaccggtgccaggatgtaccggcaaccagctagccaatgatacacgacaccacgtcaagcattcttataaaaaaaaaaaa

SEQ ID NO: 87981 - DNA, 469 bp, Triticum aestivum
  unsure (1)..(469): unsure at all n locations
  Clone ID: PAT_TA_87981
tttttttttttgaagttcaatatatacatttgagcaagagtaacatacaactatgttacacacctacaagccaccaacacactacataccactaattatctgggacactagcaatttacatggatagtagtttggccagtagcactatgttgcatcacagtgcacaaggcaacacactggtagaaaaatacatggggactactacaggaaaacatcacttacatatcacttcacacaagtgaatgcaagaaaaggtaagcaactaagtttcgctagtggcatatggtactactacacacatccaaaatacaagaaagaccattagttgacatggaagtagactagtgagattctcctccagaggcaccgtcnagattgaagccacgattgtcatcgtcaccaacaatgttctcancatcgttggttgccttcaatatgtcatgcccgacctcatggtccatanggccac

SEQ ID NO: 87982 - DNA, 547 bp, Triticum aestivum
  Clone ID: PAT_TA_87982
agagggcctgcactaccttcataagggacaagtacagaagatttttcatctagacttaaagccggataatgtattgctggatgaaaattttgtgcccaaaataggagattttggtttgtccaagctctttggtacatcatatactcaccaaataagtgctatgaaaggaacggttgggttcatgccgcaagaatacatacacaatcgcaaggtctcaccaaagaatgacgttttcagtcttggagtcataattttccacatgatggcgggagaaaagggatacggtgattattgggatgcgcgtcgtcgtccaaatttttcaaaactaattcaacaagattttatcgacagtgtacaagaatactgggaaaacaaagatgcaggcaaccaaagttatagatgggacgaagcagacctcctaagggtaacgaaatgtattgacatggcaatgcttgtgtggaggacgaccgagacaagcgacttacatgactgaaatttcagcgagctgaaggactagacccaaatcggggagatgttaaataaagtc

SEQ ID NO: 87983 - DNA, 389 bp, Triticum aestivum
  unsure (1)..(389): unsure at all n locations
  Clone ID: PAT_TA_87983
ggctggtcagcccgccgtcctccggcggcagcgaccaccgccgctgccgcgacttcaagccccgcccgttcaggctgggccgcctagccgtgaccgcgtgacggcggcctgccggccggccgctgctcacctgctctgcttcgcagctcactagtcactagtggtgaacggtgcgcctctatttcgcgcgcaccgacgctcggatccgttcatctagcaaatactagctccgtgcctaggatcgggtgctactctggaatcaatgctttgttagtagtagtactgtgatgaactgggtgacacggtgctgataattactacccttgtatgaacctgtacacatgttccgtaataatttttgcaanaggaatgaaacagttagtagttaa

SEQ ID NO: 87984 - DNA, 386 bp, Triticum aestivum
  unsure (1)..(386): unsure at all n locations
  Clone ID: PAT_TA_87984
aattaaactcactgatggccttcatgttgctgagtgttgangaggcanccagaagtaatcggattacaagtccgaaacatctagcaggataagctggaaggcaaaggctgggaagaggagtcgctgattggtggggatggngaggagttcttctacttagttgtcatctatgtcggagttcttctacttanttgtcatctagtcnaatctttcctacttttgtancaagagttcctcctanggttgtctancgatgtgtttataccaattgatgggctctgttangctgttacaagatccggttcatgtgttcaagtcgacaagttaggatgtaatccgcttgtttgataaataaatgatctacttaaaacnaaaaaggttgaagn

SEQ ID NO: 87985 - DNA, 540 bp, Triticum aestivum
  unsure (1)..(540): unsure at all n locations
  Clone ID: PAT_TA_87985
cgaaagaagacatgaagccaaagtctaatacaactccaaaggaatttagccaaagagcaatgaaaaaatatgtgctcgttgttttcaagagccccacatagagcgcatctatcagatcccggcccgttcctcttcctaatttgatcagccgcagggagtttacgacggaaagcttgccacaagaaaaatttatcttaggagggatacgtgccgaccaaatatccttgaatttcactgtacgggcaccccgagataatttggcgtacgcggtttaactaagaaagcccgaagcagagtgggccagacaaccgatcatcttcctccgganagcaagggaagcagcattagatgtttgccatcatccaactccacaagagaanggttcaaccggaatcaaggcccaattttaancnaactccaaatagaatntcaaggacaaccatacaaacagggtccggtagcaccacnaatngatccccanccacaccntaccaaagcganggttacatccgaanacaaatanagaggacgggaatggcg

SEQ ID NO: 87986 - DNA, 301 bp, Triticum aestivum
  unsure (1)..(301): unsure at all n locations
  Clone ID: PAT_TA_87986
ccgagctttgtgcatcagcgccctccgaagctgggattatctacttcctgcaagataacaagttgagtgggcgaatgtccctcaatgccggaataaccctaanggtgaaggggcaaagttcgtgatgagaatggattcctacattngggaaaaccaattacgcctaattgaaggncgtccgatttccccnaaagttgcaaaaacttncggttggcaaaancaagggnaacccttccgtttaaaatccnnaccaanaccatttctngtcccccaaaggaancttccaangganggaaccgtc

SEQ ID NO: 87987 - DNA, 226 bp, Triticum aestivum
  unsure (1)..(226): unsure at all n locations
  Clone ID: PAT_TA_87987
cgccgatgctgagaagatcgacgacagccagctggggctctggagctttggcgaccatgactgtctcgccgaggacagcgcgcgcgtgcaagtagagtagtactgtactgtatcatcgaagacgacaggatagggacactcggacaacaaccttgttgataatctctccctccttaaaaaaaaacaannaaaaaacnccttggttgatgcctttaaaaaaaaaaaa

SEQ ID NO: 87988 - DNA, 265 bp, Triticum aestivum
  unsure (1)..(265): unsure at all n locations
  Clone ID: PAT_TA_87988
ggaagatggcaaacactgcgggaccaagcctctgaaccccaagttccttcccttgggctaacaacaagatggtnattccgggagcttggatnanattggagttnaatgggagaacaatgtncatgaagantncgggcnccgcccttaaggntccgaaagagattcgaagcaaaagctccanagtcaatggtttcccnntgccaactcntcaaggaaacaatgcacccnaaagagcnaggaaggggaccaagatatctgggatcta

SEQ ID NO: 87989 - DNA, 442 bp, Triticum aestivum
  unsure (1)..(442): unsure at all n locations
  Clone ID: PAT_TA_87989
agccgtagcggccgggcatgcacaagctgacatgtcggacgcctcgtgaaaaagccaaggganttggatggtgaaagtcacaaaggatacatgtccctgaaaaaccctgaagatatccccatatctaccgctgcagttttccccattacagtagatgattccagcgatgcntctccaacaccgcctgctaangnncttcccaagaaaccggaacctgcncagggattgatnctaagatgatcgggctgaaacatgantgtaaatngacatatgaggngggttgtttaaattcaanggtgttccntttngggctgccgtaatggagatcacccggtttnnaagggtgaaattttcccgggcccaaaanattttgggatttttnacncccattttaattggtncaaccattttncaaagcnattgngggntcaaaaaaaaaaaa

SEQ ID NO: 87990 - DNA, 419 bp, Triticum aestivum
  unsure (1)..(419): unsure at all n locations
  Clone ID: PAT_TA_87990
tctaggtgaagctgaagctactttgcaaatncaatcaatcaanggagaacttngcnggctggcaaccctccctggggcccgttagtaccaagggggagtgcaagaagaagcaattgcaagaataactcnggctacgaacgttcccaaagggagaaccacnattcncgtcaagtgtttggggcnanctctaaanacccggaatgctggnatnancccgaananttccgtgcnananaggtttgtggcaaantgccaganntttcaanggnaacagnttccgatttnatacnattcgggnacnggtcctcgtntntgccccgggaatnctgtttgggncttncaacnattgnccaaactcttaaaccnttnggttaaaatttgggatggggctccccccgnagggncactccnccnaaagg

SEQ ID NO: 87991 - DNA, 467 bp, Triticum aestivum
  unsure (1)..(467): unsure at all n locations
  Clone ID: PAT_TA_87991
gcgaaggttgagttcgacgaagaaggccgccggatgacttcgaccccgaaagaaacccgttacnggggaaccccggtnggcgaatncctgggagtnacaaggggaagcaacctggtggcngggaagaantgggatncaagatnnaaaaccgccaaagatnatccgcnaccgcctccgctggtgctaccggattncaaggcgtcaaccaacancaaaaattgcgccaactnctccnacaattactcccaatccaacccccngngttccggatttgggcaaaggaccaacggcccngggggaccttgaannaaccccaagaagggggntttangncccaagaataactcctgctttccgctggccttcccncggaatggnnaaggcaccttttcaattccnaaangtaaggaataacttnaattncncaatcaacncttacccccnnaattttccgganaggcatttaa

SEQ ID NO: 87992 - DNA, 402 bp, Triticum aestivum
  unsure (1)..(402): unsure at all n locations
  Clone ID: PAT_TA_87992
cagctctggaaagtgcgtaacgctcgggtctttgagctttctactgcctctgcggttcagctctggaatgtgcgtaacgctcgggtctttgacggtctgtcagtgccactccttgcctcttgccttgccattgcagagctgattcagttatggtgctgtaggtcgcaggattgttctctcaaggccttccttcaccaccactcggagctcctgaggaacaccatgtagccaggcttagcttaagggattgttccccttcgccctgttttccccttgnttctaatcctcctgatgcggtgttttttgcccggatcctttggtactaaaggnaattctcaaacctccggtcctggttttgggataanaaataagnaaacngntggccngcttccttaatcccnn

SEQ ID NO: 87993 - DNA, 519 bp, Triticum aestivum
  unsure (1)..(519): unsure at all n locations
  Clone ID: PAT_TA_87993
gcaatgtcccttaccaagtttgtgtgcacggacaattacctgcgcgttgaccattccaaagcaatcgtcgatgcgggtggagcaaagcatcttgttcagctcgtgtatttcagcgagcaggcggttcagctggcagcactcacccttgtatgttacattgcacacaatgtcccagacagcgaggagttggcacaagcggagatcctcacggtgctcgaatgggcctccaaacaagcatacatgatgcaagacccgacaatccgagaacttgttgccaagaggcgaagattaaggctggagctataccaatcccagaggcgcaaagggtactattangtcacaatgtgccgttggagatgcatgggagaagaatacaacngngttcctcccttacaatgtccaagtgctgtatatacatcgagtggctccaatcanaccccggctngctttttttgttcccaaacatngnaaactttatttncaaaaacaacaactggccgccctnatttttgccnccnc

SEQ ID NO: 87994 - DNA, 491 bp, Triticum aestivum
  unsure (1)..(491): unsure at all n locations
  Clone ID: PAT_TA_87994
atacgctgtgatgctaacaagaagggcaggcttgactcgctcaagctgcgcggcgaactgagcaaattccctcagtttgttgcacagctacgtgctgtcgaggagctgtgcctttggtccactggtctgagttggacggatatcctagacgggctgagcacggtgaggggactgaaatatctcaagcttgttgaagataacatcgggcgcatcgagatactgcctgatcacctcataagcgttgagcggatatgcgtccagtgcgaacaaaggctgggaactaacggtcgtagctcgcccgctgcctaaactgtgtcacttcatatcatctgtcaagatctgcatgttattacccggacctccctgcatcgacatcacacacatggaccaactcaaggaatcgcgctccattctcaagtcgaccaacaataatactnactgcaacaagctgcaagcaaccatcggatacncatcgnttcacnaacgaaggg

SEQ ID NO: 87995 - DNA, 498 bp, Triticum aestivum
  unsure (1)..(498): unsure at all n locations
  Clone ID: PAT_TA_87995
atttactttgacttgcaaacttgtttgcatgttatcatcaggtatgtatatatcataatctatgcttgcaatacgcacttgcaacttggggaataggtagaactcatggggaggatactagaaacacatattatgcacatcagtcaataggcttgacaaaacagaaagcacaaataggtctaccagacatcagttgtgctggtaagctcacttatggtccatgacatgctccactaacctctttttttagagcctaagtgtacatctttaggtacttcgcaagagaaaaaggntgctttgggttgcaattggagtacttgatgctgcaaatggggcaaattggtggctggngatcacngcnctggnggtaaacngctacacaangngcaaccgggctncccccaacgaataaccantttcaaacaaggcccggctttaaacngccgancccccaaggacttagggtttagggnattcggccggccatncctggggctg

SEQ ID NO: 87996 - DNA, 491 bp, Triticum aestivum
  unsure (1)..(491): unsure at all n locations
  Clone ID: PAT_TA_87996
gatatgtaaagtgaaagatgataatgctctaatccattgtacaagaaagattgcaatggtcactaactcatctctggttacatggttgtgggtacaacataacaaaagaaataagtactagatgattttcttccaagcgtaagatgcaagagaacccgcttgagtccctgagcctgaggtgagcccacgaagaatcgcgacgacggcgaaagcaacataagggacatagaccaagaagcaatttcttgggttgctctccctgattccagaagtctccaagtatggcagcaatggggtaggtttggagaacnccggccatcaggatgtggttggcggcccaaagggcaaccggcaaggatccctaaacnttngcacnttnagccgcattggaagattaccccanccatttagcccncgggaaaaaaacgggncgcggtaggaanccnccaacttggcgctacanacttnatgcnagannggccggaaaaagg

SEQ ID NO: 87997 - DNA, 509 bp, Triticum aestivum
  unsure (1)..(509): unsure at all n locations
  Clone ID: PAT_TA_87997
ctggtgcgccgcggaggtgccggctgccggtagcaaccggaccggcagcgatgacccgtgcgccgttgttgggaacgcggcgtatgttcggcctggcccaggggctgcgcggctgaggcagctcgttacgtcgctcttgtcggaggagaacttccggccgaaacagtgcaaagtagcagtagtagaagaacatattcccgccaaaaaaatagaagaacatattccctcggaaaaggtagaagaacatcactgaagcgattggcccaatccatccttcccggatgtcatttaagtgtaacgtttcacacaatgtatgttataatgcacaccaagagcctgggtgccctgatgcaaacaatgggtccattntcaaagtgacaatttccctccttggnanccttnacntgtgttaaggggacacccaaanggcaaacctnaacggtgcaaaaatgtccnttttttggccaatttnaatnganaanagggtnccggcaaaaaggatntgggan

SEQ ID NO: 87998 - DNA, 508 bp, Triticum aestivum
  unsure (1)..(508): unsure at all n locations
  Clone ID: PAT_TA_87998
actgatggataggtcgacgatcgatgcagagtagtacgtactcgataataatttgcgcactttcttcttcacaggtcaagctctagctatagcatatggtgcttttcagttcatgaagttatatattgcgtagctactaaattaagtattttgtataaggtgctttgaacttgggattgaaaacgatagctttgatgtggtatggacttgcagtatattggaatgacaggcaccagagtcaaatcttttgcatggtcaattattggtcaccttttgcatcaattattggttaccttttgcatggtcaaactgggtcacttgaaatcagggaggtaatttggttttaagtgattttttaaaagcgtgggcgtagatctttagatatgatgtaaatccggcaaacacggttcgtcgactcacgtgtccgtcctcctaaccanctggtgtacatttttggtggtggtccgatancgacacgatgattaagcaatgccaatggncaatccaa

SEQ ID NO: 87999 - DNA, 254 bp, Triticum aestivum
  unsure (1)..(254): unsure at all n locations
  Clone ID: PAT_TA_87999
ctcctctcccgaccgccgcccccaccgcatcgtgacttcccgaaccgtctcgccgccgcagccgcctaccctcgccggccaccggtggctgaagaaggcgctggccggtaggccgcaccgcctcgaaccctaagtgcgcaccagcggaatcgccgcgagcccgagcccctcgaagcggnagggaggggggtcatggantcngaggtantgagggcgtganattgtgctggngncgatcanggcattcattaatg

SEQ ID NO: 88000 - DNA, 317 bp, Triticum aestivum
  unsure (1)..(317): unsure at all n locations
  Clone ID: PAT_TA_88000
tggtgttctttctttcctcggttcagcatttctaaggtcctcagttccctgcttgattgaaagctagctagctcatgatgaactantatctattttcactttccttccaaataagtagcttagtatttactactctcgcttgtttatgatgagtatttcacttctttatgatgtactgctggcttgtttgcccggcacactgctgccctcatggctgctttgagactctcttgctcctttctcaaaatcaatggaatgaaggtgaagttagtttttttacttggttgcatcaccttttgtgcctaagtgctacaaaa

SEQ ID NO: 88001 - DNA, 459 bp, Triticum aestivum
  Clone ID: PAT_TA_88001
cccttttttagttttgtcacataatgttagttactcaccttagagaacccccttttttatcttctataaggttgcctgctactgctagcgtatgcaagtaaaagcagctatttgcaccatcattcattgcttcaaacttctgttgatcaattcacacccaaaaaaacgcttacttgactggctactatcaaatcaaaattttataaaacggacaatctagcactcatatgtcatatgacaattgcaaatctctcacagtctatcgaagggaaaaaggtgtacatgttttttagcttttacctttataaatgtataagtatcatgtacttatctacttgcttcctcaacgcccccctttattatcctctctaacctattactatatagtgcagtgtcaaataatatagttcacactattagataattaagaaaatatctgagtgaccaaagcattgttca

SEQ ID NO: 88002 - DNA, 550 bp, Triticum aestivum
  unsure (1)..(550): unsure at all n locations
  Clone ID: PAT_TA_88002
gtgaggcggtgggatttgacagggtcgtggtgaggaggaggccgctggactgaacggggatctcgtgccgccggacagccagggaacatgcggccgaggtgccgatgcggggcgtgcgagctcggccgccggtgagctcgtgctcctcaccgctggagctcgtcaagaccaccgtgtgcatcttcacgggacgcctctgctctaacgcaatggagctcgtcgaggtagcgccccctccatctctctcatgctctagctgtaccatccaaccgtggtgagtttatcctcacgaatttgatgcccagtttgctgcttactacattaacgcgtnaagagaactgaaatccgttcaaagatgtcctaactagaatgcatgtcacaaggatccattnaattaactgtgccgttnanatgcagctcatggactgtcaactggtattgttccttaattaaaaccagacaactttgtanacgntcaagccctttgccaagttttggacaaagtgaaatctcattgtcacgccaagttttgtcatccggtgatgataaa

SEQ ID NO: 88003 - DNA, 465 bp, Triticum aestivum
  Clone ID: PAT_TA_88003
gtagcacgcaaggtctttctcgtgctcagtccgcacattcagcctgatgcatacacattcaacattttcgtccatggctggtgcagtgcacgtagaatcgaggaggcaaagtggacaattgaggaaatgaaagcccgggggtttgcgccttcagttatcacctacactgctgtccttgaagcttactgcaagcaacacaattttaggatggtctatgaaattcttgattggatgtgttctgaaggctgccatccaaacgtcattacttacactatgatcatgacctcactgtcaaaatgccatatgttcgaagaagctctgagtgtatctcatagaatgaagtcctctggctgtaagcctgatacattgttctacaattccttgattaacgtgcttgggtaatgcgggctatctgtctgaagcttcccaggtatttcaagtggagatgccaatgaatggcgtgcc

SEQ ID NO: 88004 - DNA, 374 bp, Triticum aestivum
  unsure (1)..(374): unsure at all n locations
  Clone ID: PAT_TA_88004
catggatccagcacttgtatataaagcatttaaccaggatttgaccgggttggctgcagcgtggaaaactgttaaacttcactctgtaccacaagaatgtaaatagctgtactacttctgataatgatacctcgtacaaggtcgttcacagtgtaaacagcagaagaatgcccggcgactgtcggggaacagttcgccggctataatgttacaacaaagagcaactgcacactgtcatttgtaacaaaaagaatagactangcacacacaatcaacaaagtgccantcaattagttcctaaaaaagtcagcttaaggtcttccaaaatntttgcgtggtaaancctcaaaattttttggnnccggacattttcc

SEQ ID NO: 88005 - DNA, 253 bp, Triticum aestivum
  unsure (1)..(253): unsure at all n locations
  Clone ID: PAT_TA_88005
ccaacgcggcccggatngcgactcctcccggctcccccagtacancgcctccctcaagtgtctggngaccaaccaagacaagagcaagtgccaacagcagttcgatgactacaaggngtgcaacaagagaaagagggaggctcnnctggnacggnaccngggccaaacattgttcgggtgagaaattnngggagcactgtgcantgnactggnagagttnntgctactgaaaccatgactcncgntgatttcc

SEQ ID NO: 88006 - DNA, 245 bp, Triticum aestivum
  Clone ID: PAT_TA_88006
gccgggcgccgcgagtggcctccgcactgcgccggctcgggggttacccccccagcgagccgccaaacggccactcgcgcgcgacagtccctctgccgcgctcccgggtcgtctccgcgccatgacgcacctctcttcagccagccttctgcttcccttctctctgtcacctcttcatccgcgcccacacggtcatgggctcacgcgcgcttgcacggccaccatacaaaacgttctgagccctc

SEQ ID NO: 88007 - DNA, 478 bp, Triticum aestivum
  unsure (1)..(478): unsure at all n locations
  Clone ID: PAT_TA_88007
ggaatccgtgaccgatgctgttttacagtggagcggcaactacttttatgtgtacgggcaccctcgatgtcgaccgcgtcatgtgcatctggtgcgttcgcctgagccatctccgtctactctatctcccacgtcaacaacctcgccatctttgactccggcaccgcctggccacacattacctgtgtaatttgtggtctacaccaaggggccatcctccacaccctgggtgctttgtgcaagcagctgctagcacatgctaatttagctccaacggcgtgacatggtataccttcagtgcaaccttacatgaacgagacttggcgccgccgagtaacatacggtgcaacggtcaacctgtaatntagacactaaatagagtagtattatgtagtcacaccgagacccnagaaaatgtttaagacgtgttgacaacacaaagacatcaaggatgtnccctttgnacaaaaaaaaaaaa

SEQ ID NO: 88008 - DNA, 342 bp, Triticum aestivum
  Clone ID: PAT_TA_88008
gcggaagcagacccgcgccttctacctcgccggcacggagatgaactgggccgtgttcctccgggacgcgtacgacgacgacggcgtgctcagggacaaggatcccctcgtgctcttcaacgagaagctgcagggctacgcgtgcatgaccgagatggatcccaggaacaccattgctgaatgaatgctgatgggtgatcgatgctggaactaaatttgcttcatttgacctttgtcatgttgtttgttcaggttcaagctagttcatacttgtattggctgtaattggacgccttgtctgttgtgcaacgagtcatatgctagatcttgaaaaaaaaaaaa

SEQ ID NO: 88009 - DNA, 385 bp, Triticum aestivum
  unsure (1)..(385): unsure at all n locations
  Clone ID: PAT_TA_88009
aggtgttgcagattgcagcaaggggttggatgcaaaagggcgctggacgcgtgctcgtacagccagagtcagcatgctagtctgccctttctggtttctcgcacagcttacattcaatctatctctaagatacaccactgttacatcaaacacgatcctgagcagcacgtctaccctcttcactttcctgggttgcattggtatttcttgggagaaacattcacatggtttgaagctgattnagcgtgctctcctgcatacaaggacaattatagtagccttgctgattcaaggatncanctaangctnttgccaaaatccncttcttggggantccnttccaangttcaaacgggttaaangncgtgtaaacanctngatacgg

SEQ ID NO: 88010 - DNA, 525 bp, Triticum aestivum
  unsure (1)..(525): unsure at all n locations
  Clone ID: PAT_TA_88010
tgcagcaatgtcgctgatcgcgggcgaggagttccagcacatcctgcgtgtgctcaacaccaacgtcgacggtaagcagaagatcatgttcgcgctcacctccatcaagggtgtgggccgccgcttctccaacatcgtctgcaagaaggccgacatcgacatgaacaagagggccggagagctttccgcggaggagatggaccgcctgatggcggttgtgcacaaccccncccaatttaaggtgccggactgggtcctcaacaagaaagaaggactacaaaggacgggaggtctnccaagtccttntcaacccgttgacanaaactcnaggattacctttagaggtcaagaagtttcaggaacatcgtgggccggctcactactggggtgtcctttccgcggcaacanaccaagactaccggaagaaaggaaanctgttggtgtcnccaagaacgataactgcttcacaaagatccncaanactttccacacgggtttggccattcanaanctaanggatgttct

SEQ ID NO: 88011 - DNA, 325 bp, Triticum aestivum
  Clone ID: PAT_TA_88011
aataagaagctggagtttctggtgggtgatcttatgaaagctggtcatggcaacaaggacaagcttgccaagatcaagtcaatccttgatgagtgaacaatgttgttcatcacctcagttatgttaagctaatatgtggccttggaacaatatagctggccttggggttgtatattttgggaatcccctagttatgtaatgattgtgatatttatctgcaaaactacctccagttaatttatgtaatgtatgtaatgactagctgcaaaactgccccagttatgtaatgttgttagctttctatagtaagagctatgctattatg

SEQ ID NO: 88012 - DNA, 364 bp, Triticum aestivum
  Clone ID: PAT_TA_88012
aaaattgtgatgtcgaaggacaccgccggaacaagtgtcaaagggcggccgagctcatactgaaaaatatttgatggttatcacttaatttgccaattgtaccactttgttaggcagatactagattgtgttgtacctgtaaaatttgtatttcttggacctagatgatcataaaatgtgtgttagtactctgcctaaaaataactcatcgaacatggtggacaaggggcagtttcatacttataaaacttgcttgctggtgtcgccgatgtctttattttttactgattgcaaaaaatgatatgaaaatcaatgggcagattgaagatagtgatgttcaagggtcactgttgccctgattcag

SEQ ID NO: 88013 - DNA, 497 bp, Triticum aestivum
  unsure (1)..(497): unsure at all n locations
  Clone ID: PAT_TA_88013
gctagccgcgctggtgtgggctatggaagagacagagggtgcgaatctgcagcagaggaggaagtggtgggcgttccgctcgcgccgccgcttccccacgggcccggaagagatggtggtgggtggcgtcatggcgattccggcgccggagagccgccggaccctgctacctctcgagcactgcgttggtttttccttgaagaggaaagggtgatgcagcaaagtagcgtaagtatttcccccagtttttgagaaccaaggtatcaatctagtangaggccacgcacaagtccctcgcacctacacaaacaaataaatcctcgcaaccaacgcaataaaagggtatcaatcccttcacggtcacttacgagagtgagatctgatagatatgataagatacnattttggtattttaagataaagatgttaagttaaataaaaagnaattaaagnnattggaataacttatgttggaagattaananaaaaaaaaaaaa

SEQ ID NO: 88014 - DNA, 519 bp, Triticum aestivum
  unsure (1)..(519): unsure at all n locations
  Clone ID: PAT_TA_88014
gtaaagtaggctggtattttcattttgttcatatgcagatatttgatataagtgaatatataccctttggtaggtgaatgtgctctccgttaatatcactgatatatttgagcttcagagaaggatatctatgccattttgtttttgtttttttgaacaaaagagtgttgtatgtgtatcgttaaggggatgaagcagcaaagttacctacgcaatttagcaggatgtggctgatacgtacagagtggtttacttaggtttggtgttactgctatctctatcgttgtaaaactgcagagcagcagagtttatagatttatcgaccatgcttttgggtgccagtagttttgtatgtaagatgtagctttgtgcagctccatgtgtctatgtgattctgatgtatagatttaacataacatctaaaatttatagttatcncnatatatgagaaagcatgaaagaacatgtnttaagggtaaataaccttccggttgtttgataaaacagtangcggcancc

SEQ ID NO: 88015 - DNA, 443 bp, Triticum aestivum
  unsure (1)..(443): unsure at all n locations
  Clone ID: PAT_TA_88015
cgccagcggcgtgctcgtgtcggcggtcgactgggcgacgatgcgcacgggggagagctggttctcggacaacctcaaccgtgcgcacctcgactacttctactgggctctggccggggtcgccgcgctggaggtgctcgttttcttgtatttttccacgagatacgtctacactaacaaacgcgagcttgtaatgtanaaatgcatctcggnccggnaagaaaanaaccattttgaacccaaaacttaatttaacgggacattcttgatctgtactgcattctaatagggcagcgatctgcgccggcgcacgggctcaactgttgggccggtcgagccccagccgtccgatgcggttagtgtgaaccgtcaaatntgcgcgcgagtctgtnncgaacgaaccgttncagcaaaaaagaaatgtttgttgcaaaaaaaaaaaa

SEQ ID NO: 88016 - DNA, 468 bp, Triticum aestivum
  unsure (1)..(468): unsure at all n locations
  Clone ID: PAT_TA_88016
gcggcctgggagaagcgctactaccgggcgtacgtctctgatgtgtccacgctcgccggcgctctgcagttgctggccatggataccaggcccggcgtcgcggctgctgttgccgcgctggtgctcgccggcgtgccggtgtccgccgtcttcgcgctgcacctccttgggcaggcggcgggatccgttttgcaccttgtttcttgattgactatcattcattcgccggtagcgtgtgctatctgtgtctgtagataattagatacacagtgcaatggagatatgtaattcttttggttttaagctgcagtataaacgcagagtaatatgtattttcttttcttatttcactagtttcaacgagcgaagtgatccgtcgatcttttcttcngtggctgctaaggtggtgccggaggtaaatgacagaaattggtatcaaactcaaagatntttgctaaaaaaaaaaaa

SEQ ID NO: 88017 - DNA, 518 bp, Triticum aestivum
  unsure (1)..(518): unsure at all n locations
  Clone ID: PAT_TA_88017
ctccagcccagccaaacttttctcaccttcgaagaagaagcagcagcatccatggcccccaaggctgctgagaagaagccagtggagaagacccccgcgggcaagaagcccaaggcggagaagaaggtgccggcgtccaaggagggcggcgacaagaaggggaagaagaaggccaagaaaagcgtggagacgtacaagatctacatcttcaaggtgctcaagcaggtgcaccccgacatcggcatctcctccaaggccatgtccatcatgaactccttcatcaacgacatctttgagaagctcgccggtgagtccgccaagctcgcgcgctacaacaagaagcccaccatcacgtcccgcgagatncagacctccgtccgcctcgtcctccctgggcgaagctcgccaagcacgccgtctccganggcacaaaggccgtcacaaattcactcgtcctagntcctcgtgcattantctgtgttccttcctgttcctgtctgataattcgtactactgtg

SEQ ID NO: 88018 - DNA, 456 bp, Triticum aestivum
  unsure (1)..(456): unsure at all n locations
  Clone ID: PAT_TA_88018
gcccagccttctgttgcagaaaaggtacacttgtattgggagcatacatgacactgtcctgaatgcactcctgggtcgtctgtagtaaacgcaattaaaccggcatacatgctgtcagatagaacacttgaaagggctggtagatcaaagaagatcaatcgcaaagaagaaaataattatgttgcaagaaagtgcatggacaaaactgatcctccacaaatgatcgtctgtagtaaacacaattccgaatacccaagtggaaatcatgtgttccaagacaagaacataaccttgcgtgcttgccttggtagtatcatcttcctggatgtaccttttttggtgttgaaatatatgcatcctatatgcccagtttgtaccctcctaatcccggcggaantncacacatgttaatttggtaagacttanatacttggatatttngatgtnncactggct

SEQ ID NO: 88019 - DNA, 493 bp, Triticum aestivum
  unsure (1)..(493): unsure at all n locations
  Clone ID: PAT_TA_88019
ctccgtgtgggcaccgctgccactgtcggtgccatcgtcgccggcagaaggggtgtgccagcccatggggatggcgccggccagcggcggctttggccggacggagtacgactacgttgactcgttcctcgtggaacctgcttacgcgctaatctgaactctgaactttgcaagcaggttttgcttagtcgatcatagttggggtagtcagctttagctcgaacgtccgtgtaaaatatttagatgtaaaaaatctacttgctatgttagtgtattcccgttcgtgtgtcaaaaactgtcaattgcaagacgttttagagttgctaaatctangcccaatctacttctactgattggttctaacgtatcggtagaaatctgagtttagaacatatcaantnaaagtcaattctgaactggtgattccgaanatnaccgactgtatgtttnaaacataatatgactgactgatccttacccagggaaaaaaaaa

SEQ ID NO: 88020 - DNA, 422 bp, Triticum aestivum
  unsure (1)..(422): unsure at all n locations
  Clone ID: PAT_TA_88020
gatgaattggataagatcgataatgccaaaagttcacctataggccagcaaaaaaattggaaactaaagtacacgatgaggatgcacaaatttggtgctttaccccctgaacctcggttcattggcgtaattctacatctccaatgaagaccttgaaagatataagtccaaggacaccaagtactagccaatctcacagcaccaatcttccgatgactggagacaaaaggcactgggcgtgagaaaaaagcgggattcaaacaaactatacgcaagttggttccaccattggttcaacgaatgacgaccaataattatgctcctcccaattcnagtccaagttactcaaaccgtgtgttcttaanttgcaacccttttnggctttcncaacatttacaagtgaattaatccaaccaatgcaa

SEQ ID NO: 88021 - DNA, 565 bp, Triticum aestivum
  unsure (1)..(565): unsure at all n locations
  Clone ID: PAT_TA_88021
cctgcccccagcctgaacttcccattgggacaagccggcaataagactctgatttcctgaccatacttctccaaggcgaaattggcggcctccagatcctccgtgaagaccggtgggtcgacgtcacaccaacaccataagccttcgtcgttaacatcggtgatctcttactgatgtgcagctgatctccatgattgggttcaaagtgtggagcacagggtgggtggctaaagaacattgctccaagagcttggatcattttgcttccttcaagcacacatttccaccctgcctccgacgaggatgcatggtccgatnnaaggagctgtttgtctgatggggaacccactgttgtacagggaacctttgtgagaattacgtccaagcatttactactcccatccgggtttaaatgcaaaaactgcattctccgattcctggttggtgaattgtgatgttaatttggngcccnaagttaatatacatcattttggctntaactgttnancaacacatagggattgggaaacggtcaatctccagttatttttcnaaaaaaaaaaaa

SEQ ID NO: 88022 - DNA, 543 bp, Triticum aestivum
  unsure (1)..(543): unsure at all n locations
  Clone ID: PAT_TA_88022
acatgatgcctggacccgatgcaacggttggcgccatgacgcacagcttcatcagagcagtggagtgcgagccgcgcaccacctacggccacctgctcacctccatgaggaccatcatgcgcgacggcggtggcaactgcaacctgcagggccccgccggcggctgcgtccgcaaggtggccaacttcagcggggttggaggagcctcagctgtcttctgcttgcaatttgacatccaccgcgagcgttctgcatgttagaacccgcgtccgggtccgtccgtccttctgcactccgacgattaccacctacacggctaatcatcgaccgttatccgagataccgatttaatggggacaaataactatgatgcttgctgctatatgttttataccgattaactcaaccaaccgcatgacatccaagaatgagcatactcatacaagntctggaggacacttccctacgtactgtactccgtatcnactactcactgtataagntgttgtgtgttgtgtgngtccaanacctaacaaatatatn

SEQ ID NO: 88023 - DNA, 393 bp, Triticum aestivum
  Clone ID: PAT_TA_88023
gccgccgcgggacatgaacatgcgctacatccagtacaacatcacggcggaggagagcacgctgtcggagctctacccgcgcggccacccggtgttcctcgaccccggccccatccacaagcagagctggtcgctcgtcaaggacatctacctcggcaagcaggacgtgcgcctcgacatggcccgcttccggcccgtgctccagaaggcgctcgacctcctccggtgacacgcgcactgacacgtcacacgccggcgccggcgccggcgacgacgacacatacatacacatcatgttaatcaagaccaactttttctccccttcttcttctcgttctttgtcgacatgaaatcaaaggtgtacacaaattgattctagtttttggccggtgc

SEQ ID NO: 88024 - DNA, 529 bp, Triticum aestivum
  unsure (1)..(529): unsure at all n locations
  Clone ID: PAT_TA_88024
ctggtggacaagtacgaggagatgatggagaagcaccacccggggctcggcgacgagcggtggcccttcatcacgcacttcgtcggangcaagccctgcggcagctacggcgactacccggtggagcagtgcctcaccggcatggagcgcgccttcaacttcgccgacaaccaggtgctcaggctctacggcttccggcaccgctcgctgaccaaccccaaggtgaagccggtggcgaaccggacggcgagcccgctcctgaacaaggaggcgtctctcaagatggacgccaagatcgaaacttaagtggctaatccttcctccctgagaaagatttttcagaggttttgctgttggagttccaggttaggcacagcaagatgccacgttttttgctgttttaattgaacacaggacaggagtaataggattgctgcagattgtcaatctctttgttgttttggctccaggacgaaatcaaaaacagagagttctgaagcttatttggttcnagatagttttaaaacnc

SEQ ID NO: 88025 - DNA, 518 bp, Triticum aestivum
  unsure (1)..(518): unsure at all n locations
  Clone ID: PAT_TA_88025
taccaataaaatttcattcaatgaattctgcacatanatttttcaacctgntataaaattgcttgtgcatgaatctgtttgctgttgttagtcagaagtcnattattactggngtgttcangattcnatttctgtcatcnaaaatatgtgttaattctgatacagcanaaagagctatgtgagccctcctggatggggcttatgttggacctctgattgagctccccatagactttgacccaagcatcctcgtgacagggtttgtcggaaccgccatcgctttagggtgcttctccggcgccgccatcatcaccaagcgcaactnaagaacgcaagtnaacaagaagaggaagaggaggtcctgaacgttcctcctgcacatcgtanatccacaaccgttggccttgtaaggaattaagctggcgtngtgcaaccttgngtaccngttttgatngaagtagaaattggncgtgcatacgtgtatttgccctgggagtattnactggatgttcccggan

SEQ ID NO: 88026 - DNA, 496 bp, Triticum aestivum
  unsure (1)..(496): unsure at all n locations
  Clone ID: PAT_TA_88026
ggaatgcatttgccgaaggtactccgctatgggatgttgatccggtcgctggtgagctggctgttggtttaaatggagacatgtactacataccaccaggtgatgctctggtctccgcttcaggtgccatggcagagacaccaaagacgttgggctacatcttgggagaggaaatctggagttttctcatggggtgggatgaacaagatcctgttgccgatactctctcgagcccgccgtcacgggcgctggatctccggtgaagctcccacggtgggtaagtcaaacggaaggtgggtaaaaaggtcagttctacgtccagattataaaatgtacctaatccnaccattgagatccactcttatccaatccaaccaattgagatccgggggtaagttggtaagttcaaatttgcactgaacggtggtttcaactgctaatcacatgtgaatgatgatatgtgttactccaagcatcccttttgaaaaaaaaaaaa

SEQ ID NO: 88027 - DNA, 559 bp, Triticum aestivum
  unsure (1)..(559): unsure at all n locations
  Clone ID: PAT_TA_88027
ccccataggagccttggcgacagagctccacggggagatatctctgccctttcaccaatttggatctgctccattttgggtgttgctaagttcttcttccatcgatctgcaagatcatggcagaatctctgcttctccctttggtgcgcggtgtgaccagcaaggctgcagacgctctcgtccagaccgtgacccgcatgtgtggcctcgatgacgaccgtgaaacactgaaacaccatctgctagccgtggagtgcaagctagtcaacgcggaggaaatgagtcagacgaatggctacatcaagagctggatggagaagctcaaggccgtcgcctacgangacgttccagtacgaagcgctgcggcgcaaagcccagatnggcgactccacctcccgcaaggtactcggctacgtcacgcacaaaagccactgctcttccgttttgccatgagcangaactcaaggagttctcaataagatnaaggagtagtggaggagatgaacacgtttggctcnaaaatccgtgaacggtggncaacaantacttggcgnagacc

SEQ ID NO: 88028 - DNA, 545 bp, Triticum aestivum
  unsure (1)..(545): unsure at all n locations
  Clone ID: PAT_TA_88028
gaaaaaaggtaccactgaaaccgtcgagcccggcgccttctccgccggcgactgcatgattgctgcctagacctcaccctccgtgaatgaattgtctcacccagccgcttgaatccttggtagctgcagcgcgctccagttgagggtcacatgccgacccgtgtccgctgccatcaccttgctgaaatgatcatggatgatctaggccatgtccccataagttgtggcaaactgttcgtcgctctgaatggtgtggatgacttgcatcttctggaagaacatttaccatggaaaaactttgtgctggcatctcctgctcgcagctagatcaccctggaggcctgcctccttctggccctttcgatagccgccagccccaacagtcgtatcttgagcagcttgcgcangttatactctgctgctgaaagaattcttgtctcctgcgctactcaatcggagaattacacgctagcaatgtgaaacgtgtcnttgctccctnaatatgatttgtccaaatnttccggtctgaacancccggcganctt

SEQ ID NO: 88029 - DNA, 380 bp, Triticum aestivum
  Clone ID: PAT_TA_88029
ggggcgcaagaccaagtgcccgctggccgtcatctgcccggtgagcctgcagctcgtcgacccggacgtcgccgccacctccttccagaagaccaagtgcaccatcctccgggccaagatctccggatgctagcctagcccccgcgctcgccattgccaccagctaatttccttggatttcgtttcgtgctgtaaaaaaatgtactgtgctagtgctggtgcagaacaagcatcaattctgctcctctttcgcatgggaaaacatgggatcttcatttgttgttggtcgattagatttgttgttgatcttcatgcttggaagattcgatgccaatgtcatgatcatcaatcaaacttgttgcttgctcaaaaaaaaaaaa

SEQ ID NO: 88030 - DNA, 325 bp, Triticum aestivum
  Clone ID: PAT_TA_88030
ggcggcctcccagtcggcgaccaccagctggtccttggtgaacgcggacgaggaggtgacggcagcgttcggcctgggattcgtcgacgaggagacctccctgaacaacctgatgcagttctgcctccccgcagcgtgcagcagcaggtgggacccctcggcggacttcgtggagctggcggacctcgacgacctcttcgcgccggagcccctggcggcctgaccggacgggacgggagagcggcgacggcagctccaccgcaactttttgaaagagaacagttttaaacataattttactttatttctcgggaaaaaaaaaaaa

SEQ ID NO: 88031 - DNA, 514 bp, Triticum aestivum
  Clone ID: PAT_TA_88031
gaacctcaagaatatgcttcctcttctgttctttaacatgttcctctttgtttattctgtatttagtacgtacagtatgttccttgtcaggaaggggcgcagggacatctgcagtcaacagctgatagagctggcctgtacgtgatcgataggctttcaattactagcggcaatacaacaccgtattttcaagccagttccactttcccgatttatatatcgtggttatggtgtacccctattatgtacactatgatctgcctagttgttgtgtgctcttgttatcatggtttggcaataaactctctatatagtatattatgaacctatcatctgccagctatccttacttctggagcctattttttgtgtacttgtgccagattatataaatgcacgcaccatattacagcacacaatgagctctctcatcaagaatccagtgatagcacacaagtgtttacaggggcgcccttatattagaatatcatctgcattacaaagataactcaca

SEQ ID NO: 88032 - DNA, 562 bp, Triticum aestivum
  unsure (1)..(562): unsure at all n locations
  Clone ID: PAT_TA_88032
ccgacttccccggcgtcaagaagaagcccgcccgctccttccccgacacggcgacacctcaagcttcagggctgtagttaggtcacctgaccgtccgctccttcttccccacgcgtacgccgtcggatcgaccagatcttgtggtttttcaccggacacctctcctcctttcagtttcccaggtccttgcgcaagatctcaagcctgggacatccacatcgtgctggcctgcgtgggggttcaaagaggacgtgtgtgtgtgtgaagatnccagcacctcactgttcaatgccaagagccatctagtcgtcctccgttcttgccgtccgagaagcagcaccggcatgctaccagataggatctgaagtgtactgtattttcgcttatcaacctccactttcaaattctttttcccaaacagtgggtcatccggtgtcctgctcatcctctcctccccaaccggttgatatggatgttggacactcaattactctcntggaaaaagnaagataaaagaatggactcggatgaggatgatgaactaataaagcctgtanagtnn

SEQ ID NO: 88033 - DNA, 546 bp, Triticum aestivum
  unsure (1)..(546): unsure at all n locations
  Clone ID: PAT_TA_88033
ctgatgcccaagtgagcattgctctctgtaaggctccgtttatcctgaagaagtcgaaggaatctctcaagcgtaggtccgagttcctcttctctgaggtggggttggaacccgtgtacattgctcatcggcccatatttctcagtcttagcctggagggccgggtcaggccccggtactatgttctcaagttcctcaaggaaaatggattgggtagatcgtgacctgagcttccatactgcagtcaataggcctgagaanttttccgtggagaattcatatgccctcacaaggaagccgcaccgcacctcgctgaagactatgcaacgcttgcaaaggggaagtgccaactaaaaccaaaaatgggcaaggaaattggtactgcgtatggcacaacatagtttcaacctgcctgcgtgtaactgtttggtgtccttgcctaaganatttggttgtttccggtatatgcctgttacatgcaattatcatgccaaatgcnatccctatgaaacgataattgatcctgaaccccaatatatttgtgtt

SEQ ID NO: 88034 - DNA, 558 bp, Triticum aestivum
  unsure (1)..(558): unsure at all n locations
  Clone ID: PAT_TA_88034
cggaactgttattacagcaaaagttgatgtctacagctatggcatggttttgttggaaattgtatcagggaagaggaactcaggtagacagtatacaaccggtgatgattatgtctatttccctgtgcaagttgcaaacaaactactggaggggggtgtggggaagtctggtggacatcaatctacatggcgatgcccatttggaacaggtggaaagagctttgaagattgcatgctggtgtattcaagatgacgagtttgatcgacccacaatgggtgacgttgttcaaagtcttgaaggccttcttgaagtcaacatacccccaatgccaagactacttcaagctattgcanggaatcaacattcaacatttgatgggcacctggaccaacttcacaagaagcaagcaaactgcaacatacttggagctcatgaagacagttgctgcaatgatggagcaaacttccctcaatgattgcctaaacctgaaatacagtggnaattacattccgaaactaatgaactgagataaggttcaaggatatattgttgtatng

SEQ ID NO: 88035 - DNA, 373 bp, Triticum aestivum
  unsure (1)..(373): unsure at all n locations
  Clone ID: PAT_TA_88035
ccaatccgtttcncntcccnaggctgtcgcagtcctcctcgnctcntcgaccncctcanttggntnctactgtncgtcacncacatngangaagtacncagnaattcnangtcnatgcaactccacnacctcngggcatggctcnacatcngccactagatgctctccgacttaatttttgggtgcgattgacaaggcanggccacggangagcatcactcttgtgtcacatgcccatcctctttttttctgtgggattggaanggaatgcagctgatagatttggtatatagcatgcaaagattncgctacctcngtcttagcacttttcnggtaaatggnaggnancaacgatacnanntttctaacngaa

SEQ ID NO: 88036 - DNA, 560 bp, Triticum aestivum
  unsure (1)..(560): unsure at all n locations
  Clone ID: PAT_TA_88036
ggcatggaacaatcaaaaattatagatacgatggagacgtatcacatcatatcaaatctcccgaagctagttcctgtctgaccagcagacggaagcctttgacagttttgaagccattcagtctgaactacatggccacagataagtcagcaaggaagggggcagacagcgccgtgggggaacatcaagagatttgccacctgatctctatgagctatacaagacagatccataggaggattacaatcaagcgcaaaagacgaatccaatggattccgaaagatattgggcaagagcaatgggttcaagtacaggttccgtgacccaaggaatatgctnaaaagaatgccatcaagcgaccctngggagacatcttggtacaaaatcttcccacccagtccaaagctnaagcatttatnaaaggctctaaccttgcatggccgttggacaacagctgctnatccgaccaactccgtgctangttcctgacgacatctgttaaacgcaacataatttgccaagaaccggaaaagagaacagaatcncggggacagactnat

SEQ ID NO: 88037 - DNA, 410 bp, Triticum aestivum
  unsure (1)..(410): unsure at all n locations
  Clone ID: PAT_TA_88037
gctggtactccaggacgacgtggagggcctccaggttatgcacggcggcgaatggctcaccgtcgaccccgtccctggttccttcgtcgtcaacatcggcgaccacttcgagatatacagcaacggccggtataagagcgtgctgcaccgggtgggcgtgaactcgacgcgcccgcgcatctcggtggcgtcgttccacagcgtgggggcggagcgggtggtcnnggccggcggcggagctcctcgaccanggccgcggcggggaaccacggcggtatatggacaccgacttcgcgacttnctggnttactcgctcttgccgagggcaatgagngnacttcctccaatcnaaggagncnccttcgnngaantccactttttatgctnaanatcnattccatngacttttg

SEQ ID NO: 88038 - DNA, 529 bp, Triticum aestivum
  unsure (1)..(529): unsure at all n locations
  Clone ID: PAT_TA_88038
gaattccatcgtgtccatgaagaaagcaatggctttgacgcgggactctgcgcagagccacagcaccgaaaaccttggtggcctgataaatggcactatgggttatctcaaggatttgctcctgaggaaatcggagtcgtgctcggatccaagtctaaggtacctgttcctgctcaacaattcctatttccgtagcacaagtgggtacctgaccttcggtatctttattaaatcctcatgagtttgtggcctgggacaccaccagacactttgaactaacacctgaatgttagaagtacatggatagttatctcgatcttccttggggacatgtgctcccctgcataccgaatccaaaattttggccggtggaagtttggggttnaagccccttcaatggcaaattcnaatccggtttcacaaacgttcaggncaanngtctggaaggtttngcccncngcncaaaaatgactgcggaaacntcnccaaaaatcnttnagggtacgtggcaactgatgacatcanactn

SEQ ID NO: 88039 - DNA, 385 bp, Triticum aestivum
  unsure (1)..(385): unsure at all n locations
  Clone ID: PAT_TA_88039
gctagaactgctgcgttgaataatagcaacagtgctagcgaacatataaaggatcagatagtgcagacgctgactgaagctggcggtcgggttgattatgttgagattgtggagcaggaaagtttggtacctgtggagacgatcgaccgccctgttgtcatttgtgtcgccgcatggtttggaaaggttagattgatccgataatatcgaaattcatatacaatcctgaggatttgctgtccccttggtatacgtatctcatgaagtacaccaatctgtattcctgtccaaaaataagaatgatgttgtacaatgtaanttggttacaaccaactttcagagaacttgcaaaccttccgataatgtcctcatttattggtttccc

SEQ ID NO: 88040 - DNA, 486 bp, Triticum aestivum
  unsure (1)..(486): unsure at all n locations
  Clone ID: PAT_TA_88040
gtccgatcgccggttcatggctggtgcagcggaggaaatgggggaggagccggcgccgggagcgttgaacgcatcgagtgtctgttcctggtgggggggtggacatcagcacagcctctcaagttggaagtgacaatgtgatgccacaatcacgaacacaagacacattgataagcatgctggtctgaacaaaggcatttgtatgatccaaaagtgatcatttaagtcattttttgcaaggtatattgtccattgcctatcaagnggttccgntgtagttttttaacaaatagttcattccataccaattttaaatanccgcnntttttgttagcaaanccnatcaattttgggcaatgaattttgttctgnnacngtttcacatagncaattcnaccanattggnnctttttcccnaggaactccaaagcattatttancccaaaaaaaaannnaaaaacanggggggggccgnaccattcccca

SEQ ID NO: 88041 - DNA, 456 bp, Triticum aestivum
  unsure (1)..(456): unsure at all n locations
  Clone ID: PAT_TA_88041
gagacttactcgccggtagcaatgctgaagtcagtgaggatcgtactagctatagctacatatttcaattatgagatatggcagatggatgtcaagacggctttccttcatggaaatttaaccgaggacgcgtatatgatacaacccgagggttttgtcgatccaactagcgctagtaaggtatgtaagctcaagagatccatttatgggttgaggcaagcatctcaagagttggaacattcattttgatgaggtcgtcactggnctcggtttcaatcaaaagcgaaagaggaccttgtttatataagaagttaantgggacnccanaggtttttgatcctgggagtgggttaaaacaacgttcggaatgantntcccancctancccggcaaggnnctccnagggaattttcccctaaagggcttggnaaggaagttanttttnggatttaattt

SEQ ID NO: 88042 - DNA, 358 bp, Triticum aestivum
  unsure (1)..(358): unsure at all n locations
  Clone ID: PAT_TA_88042
aaaagctgaaagaaaagaaaaaaaactcagggcttgtttggtttgtgactaattttgtcacagcttatcacactatgtttacccctcaaaaaaatcatactatgtttgtcacacttgctttatgttaggtgctcaaatagttagccacacattggcttgcctcgggagtcttgctacattttttgtctgtatgacatgtggggcttatttgtcaaaaaaaagnttttgctttaggtgtgggctaaaaccagacaaacacctaaattggacaaaacttgcctaacttaacatgtgggcaaagtggtgggctaagaaaccaacaaccctcaatgtacgttgattctggaaaaaaaaaaaa

SEQ ID NO: 88043 - DNA, 354 bp, Triticum aestivum
  unsure (1)..(354): unsure at all n locations
  Clone ID: PAT_TA_88043
cacttgangggacggtggntcatgtggacaccatgaacatnaantcatcaagacttgccaccgccttccancgtgttcgtgcagcattgatctggaccacgccggaactggctgagcggggagctgtcctgctggcctctgtaccgtggcgctgcaggttgancggcgtctccggtcancatatgcctgagctagtgaagaggcangcggtctggggagatgggtgtccgtttcgcctacttatggcccaagtaagagtaggtacttccctgttccgttcacgcccggaagtgcgtcagctacaaggctctctaccnttgtgacacacgtgcaanaccanaatccatgtctgta

SEQ ID NO: 88044 - DNA, 500 bp, Triticum aestivum
  unsure (1)..(500): unsure at all n locations
  Clone ID: PAT_TA_88044
gccacacgttccacatgtcgtgcatagacgggtggctgtgccggcatgcgtcgtgcccgctgtgccgccgcgccgtctaggcttggcgtgcccggctcgttaggatcgatgtgtgcatagccagcgtatatacacacgtgttacgcgcgcgtgtgggtgtggcgctagcacgtacggcacgcgcacgcacatacgggaagttcgtcaatttgttagttcgttgggttgagactgacatgacatgacacttatgccgacaattctttccgtgacttgttccgttgccttcatttcctgcggaattatgatgtattgctataccacacgcgcggctggttgtgaatatctgtatagaaaacattagcgttcanattatancctttttggcacttcccattgcttcttccaaaacttgtacctccnctaaattttttaacacagtaaaaacaccntncatacacatatacacttacttctataaacaatacgcacncctgtcc

SEQ ID NO: 88045 - DNA, 560 bp, Triticum aestivum
  unsure (1)..(560): unsure at all n locations
  Clone ID: PAT_TA_88045
cttagctttgggcttgcagcgaatagtttagattattaagccctcaaatataaagagggacacatttgaagatgaaattaaatcaaacctgggaaagttactaacaactcctgtccaatcctactttggtcctcccaaatccaacaaaagggcttgcctggttccttaagtngcaataaaacccttgngattaatttcccnaacttggngtaactcctccaacttcnangtaaaaattccggggtccttgccccaataataaaggacaacaaggttgggtgaancataanccccccccnaagggaatgctatacccttgggggggtttcccccccaaggccaaatttaagggccccaagggaggggggtattcccaagggaaatttgnaaaaaaaccnggggnncccggtttgaacccctnnaaaaaaaccatccccgantttaccanccccctggggantttttanccaaaaaaaaccctttccaaaataanatttccannggggnaatttncctttgancccgttaatnccgggaaggggaacncnttccnggcccng

SEQ ID NO: 88046 - DNA, 352 bp, Triticum aestivum
  unsure (1)..(352): unsure at all n locations
  Clone ID: PAT_TA_88046
accacagctgcggcggcgcgcgcataggacgcgaagcagcagcggngccaanccaccgacnccaccatgggtatctcgcgtgactccatgcacaagcnccgggccaaccggtggggaagcataaggcgttggaggaagaacccatagtatgagctcggccgccaagccatccaacactaaactttcgagcaacaagncagtganggngggtccgtgttcncgggnngtaaccttaaaattggagggtcccccgttcnggggaactggggnaattcccaaagggggnaagggngccttttacccncaaagaaccnttccccggattttgggtttnaaatttccncaaacaatt

SEQ ID NO: 88047 - DNA, 445 bp, Triticum aestivum
  unsure (1)..(445): unsure at all n locations
  Clone ID: PAT_TA_88047
gcgccctgatgatgatcatggagccgcacggcggcgtggtcggcagcgtcgtcccggactccttcacgccgtacccgcaccgcagcggcgtgctctacaacatccagtacgtggccttctggtgggcggacggcggcgcggcggaggcggccaacgggtggatcaacgggctgtacgggttcatggagccgctggtgagcagcaacccgagggaggcgttccgtgaactaccgcgacctgggacatccgggcagaacgcggtgggcgacgaacggcgtgacgccgttccctacccgtctagcctttccttcctgcaacgagtgaacttccttaaaaaaanaaaaaaaagagaactgttacattgaaaggctgaaagatgcngatcaactnttcncaagccaacatgctttaatncaattgtgtttgnccttggaaaaaaaaaaaa

SEQ ID NO: 88048 - DNA, 518 bp, Triticum aestivum
  unsure (1)..(518): unsure at all n locations
  Clone ID: PAT_TA_88048
caggggaagcccatagaaatttacctgaaagtgtctgacgccgccgacgcccacctcgccgcgagctgcaccaaaacccgcagggcgagggtggtcaaagccgtggacgaggacctctacgtgatcccgccggagatgctctgccacaacaacccacgcaagaggctgacgaaaaggctgtggatcgggtgtctcggctgcgtctccgcctagggatcacaaaccatccggcttggtgtgcgtgcgtgttggagaaaagaggagcggaaagcatggggccatgcatgatgctgtcacgccatgtcaaacatcctctctctctctctctctctctctgctgtatccgtacattatgctttcaataaggatgggatggacggatggatnggacggagggacggcgacgccgacgtgatgccccatccnangcnctttctccttcccttgcgtgcacttccccgatgggttccgctatccattgtcaattantgggaaactgttcgtgctgtggacatcaa

SEQ ID NO: 88049 - DNA, 361 bp, Triticum aestivum
  unsure (1)..(361): unsure at all n locations
  Clone ID: PAT_TA_88049
caattggtgtagcgagcggcattgcgaagtgtctgagaccaaggcaaagaaatgggcattccctcgaaggcaatcctgaaagtgcttccacaacaaacccgccgatagctgcacaacaagtttgaaggctcaatttctatgggactacttgagaatttgtttcctgcattatttgcaaataattgttgtgctgtagtcagtctgtttttccttcctaaagtccagagtaaacttgaaagctggcgctgttgtatatttctgaacactattttagcataattgaaattgggacttggagcaatcaatgcatatctgttaggtgttcatagattggnactgtaatggaactaaaaaaaaaaaa

SEQ ID NO: 88050 - DNA, 522 bp, Triticum aestivum
  unsure (1)..(522): unsure at all n locations
  Clone ID: PAT_TA_88050
tctaataggtttttaatgctatattcatatagctagggtgtgtggcacacccgagagccacaaatcctcttatgtgcctttgggtcttgtattgtactgtatatgccatatatatacccgcttgtgtgttgaacaaattgagtggaaggactgccaagtcccacagaaagaaattcttcgtacctagcaaccattgttaaaatgccggaatatcccttgtgaaaattaatagttgtttaccatatgtagtttggtgattcttcaaaatccggcatatccactctgctactttcaccccttctcatctctgctgctcatctcgtgtgcacacaatctccttccaanctcgtatatgtgttatggnnatcatggatgatttgtaataggaactttatgaaantagaagtcatntcncccaaaattaatttggggtgnatccantcggggatgatgcccaaaccaaagtcacaacccnaaatcaaatttggcggnncccttcgcggacaaaannnaagagggana

SEQ ID NO: 88051 - DNA, 327 bp, Triticum aestivum
  unsure (1)..(327): unsure at all n locations
  Clone ID: PAT_TA_88051
atttcaaccaagtgagtaatcccttccttcagagtttgttcttgaggaataaattctagttccaagtgtttttcatctttttcttttccggagttcaatttcctcagccatttcatcggaacctccatctgaataatcgcaaggctcatcttattcttttcattattcaattctatctcatcatccttttgtcaccggagttcttcatggtggctcttcatgatttaattcattcctcaagtgttcatcaagatcctggtaggcgaagcnaaagtaatcctncttctngctncgccaagggngaattaattccccgtancttttgaa

SEQ ID NO: 88052 - DNA, 333 bp, Triticum aestivum
  Clone ID: PAT_TA_88052
ggcaacgtcaggctcaactgcagggtgctcaactaatttcaggcccgtacgtatatatatcggcatgcaagataagtacgtatatatagcatgaccaggccaataataataagcctacactacacgtacgtatgcatgcgtactcattgcatgcatgtaaaaacgtgctaggtagttaggcacaaccccagtatataatggatgcataatgtgtacacttgaacttctgcaatgcatgatcaaagaaacggacttgtcaaaggaggagaactgctttgctttctggaaagaaaaacaaaataaatctttgatcatgcatggaaaaaaaaaaaa

SEQ ID NO: 88053 - DNA, 536 bp, Triticum aestivum
  unsure (1)..(536): unsure at all n locations
  Clone ID: PAT_TA_88053
atctagatgtgctttagcaaaactatttcaaataatagttatattatttattggtatttggatgtaatgtactatgcactgaaaattctaattctaaaaaatgaaaattttatcatgtaacaaatgatttatttttctaatattgcataaacaatgtagtgtaacatatttgcatatctatgagtgtgttcatatatattcaacattattgaatattatggtagagatttctaaatcatatacacgctaacaaatattttaatagtggtttctagtgtattttgggaagtcatattcttggaaacttctaggacatagaaattgtgacatgcaaattgggttcgataatagaatcatcgaagaactaaattttttcttgattatactctacatatgactcgattaactaacattttcgtccagactcacatggnttgatttaatgcaaatgagattcccacacgtctattgaataaaaatgggcattaagacaccatgataaagagagacantgtatttgaccactcgccggtcgg

SEQ ID NO: 88054 - DNA, 534 bp, Triticum aestivum
  unsure (1)..(534): unsure at all n locations
  Clone ID: PAT_TA_88054
cagtgccctgcctggctgcctcctccgcgtccgagctcctccaccggcgacataagcgacgccctcaaccccctccgtctgttgctcaggatccaagctccgcccctccagcaacggtgatggaccgcggccgtcaccgtcctccttcccggatctctactccgcctctaagctctggcctcctctggtgaccgcgacgacgacggttctctgttcgttttctacctcctccggtcaagatccaggaaagtgagcacagcctcctctcagatcattttcaccatcgtcaatctcaggacaaagtggctgtgcttttccttccaccgggatctcgacggcgagaggaatctatgtcatgtccaaccatggcgacgaccggtatccaagacgtgattgcactcaggaattatatggtccggagtacaaatcttggagtgcggtacgtgctnaatgtcaacttatcgaaggaacaagtgccctaaaaatcgagctgtggtactgatgtcacgtggatgggaacagtgagcaaaacnn

SEQ ID NO: 88055 - DNA, 412 bp, Triticum aestivum
  Clone ID: PAT_TA_88055
gcgaagggaaaaagatgctccggaaagaagaaaaagaagcattatagcctaaccaaccaaccaaccaccgattcatcaaccaactttttctttcactcattcactcacatattcccaccattatcacctctcacacccttatattaatcctgattttcccagcagcatgcagcagtagcagttttacttcccctactgggtacttatcttcgttgacaggacggatcgctcgatcagcccttactgtaattgtcacctagtagtagtgattaccttacctgtatttgcctgggatttttactgtacatccgtccgtcagcatgtagcagcagcagcagcagttccttgctgctgcgccgcagattctataatttgatttggagtggagtgaaccgtctccaaaaaaaaaaaa

SEQ ID NO: 88056 - DNA, 300 bp, Triticum aestivum
  Clone ID: PAT_TA_88056
gtcgtacccaccatacccggccccgcacccacaccctcatccggcgccgaatgcgccggagatcacagcggccgcgtgccaggtgcagtccagcaacgcgtggtgcatcaccaaggacaaggagtacaccgatgtttgaatgcctgagccgagacgatgcacgtaaaattccttttcgttttcgaacaattgcttgctgatttcaattggattattatttgctgatatgtaaaacaatttgtttgtacaaggacaatataaatgttttaacttgttattatgctgttcaaaaaaaaaaaa

SEQ ID NO: 88057 - DNA, 547 bp, Triticum aestivum
  unsure (1)..(547): unsure at all n locations
  Clone ID: PAT_TA_88057
ttgatggcttaagatttttatcagtcagccccatgcgacggaaggtttcataataaaggatattgatgctgctacctccgtccatgagtaccttagtgaatttatatcctccaacctgaggcgccaccaccaaagccaggtgacccggattatcaacccggggcgggtgatcctcacgactccacacaataggctgctcagaccagcgcaagtaacggggaactgccggctcaacggcattcacaacccttttatggagcttctggtcccgcttgcataaacttgtggtgaagacgtggtactgcccactattcaactgctttggggttactctgatacccagattgctgctgttgatttgcctgggccaagactgctgatgataaccgccctgattgccttggattcccttgatgaccctggaagcataattagaaccaccgccaccataacccggtccctgagaaccgccgcaacataacctnnacaaaactagaccacgctcggccatgatattccggaacaantagattttaaacccctcata

SEQ ID NO: 88058 - DNA, 538 bp, Triticum aestivum
  unsure (1)..(538): unsure at all n locations
  Clone ID: PAT_TA_88058
agagaaccttgtatttgaactggggcacaaatgtgtcatgaccacacagcacacagggcgtcaccttatcatattgaaaagttgggacagagacagaattgtgtttgatagcatcgacttctcacgtctacggtcactgacagtgtttggagagtgggaatcattcttaatctcaaaaagaatgaggctccttcgggtgcttgatttggaggatgcaacgggtgtaaaggatgatgatctccggaaaatgttgaagctgctgcgtcgcctcaaatttctgtctttaagaggacgcaccaagatatgctgtctgccaaattcattgggtgatctcaggcagcttcagagtcttgatgtgagatatacctctatagtcacgctgccaggaaccatcaccaagttaaagaagctgcagtatattcgtgcaagcaccaccatcccagcatcaacgccagatgcctcaactagcttgttgccggagttcgcanatgtctcgcctagtggtgttgtatgccaacaggatggtgaactgacgnat

SEQ ID NO: 88059 - DNA, 333 bp, Triticum aestivum
  Clone ID: PAT_TA_88059
gatttatcgactgtatcaaatatactcgggaataagagctgttcaaaggaattagaagttgtgaaacaatgtaccgagatcttacttgatctaccgtcgcacttctgataggttgttgaagatatacaacaaaatggtccgccattcttcgacatctaacgttaaggaattagaagcaccggatggtgcgagattccctttgaataagctgaggttggatgcaccctttttagggtcgcccgcattgtaccgaggcttcggattatgcaaataacgatttttggcttcgcagtgtgatgtcatgaagttttccgcctcctcaaaaaaaaaaaa

SEQ ID NO: 88060 - DNA, 252 bp, Triticum aestivum
  Clone ID: PAT_TA_88060
ggtggctagagcatggaataacttattctactcttaaaccactagtagaaaacagggctttggttggggcctggccaacccattagtcccggttcagtcacgaaccgggacccatggggggcatacgtcccggttcgtgcgcccagggggccggccgggcctcgtgggggcatttgtcccggttcgtctggacccatttgtcccggttcacgccacgaaccgggaccaatggcctcgctcctgggcccaaat

SEQ ID NO: 88061 - DNA, 512 bp, Triticum aestivum
  unsure (1)..(512): unsure at all n locations
  Clone ID: PAT_TA_88061
agaaaaaatagcagacatcgcattcctccatggaccagcacacgaccggcctcgaagcaccaccctgtgcgctcacccgtcgccgccggccgccgtctccgccgctgccctcgccgccggttgtcgtcgctgtctcctgagtttctcgccggatccacgcatgcagcaagctgtcaccccgttggttgcagctccctcgcccggtgatggtcgcgactctggcaacgtcgatngccggtcacagcaccccagcgacgagctcgccagaaggaatctgcttcgggttgttaagtancaacaaaaatgtccaccggtggtagcaaaaaaaattgttggttccaagcaaaaaatanctcgtcgttgtcgccaacccgtngcaaatnttncaaaatcttcgctgcctgtancntttgtgaattgccgggttgcaanaaaatcatgcgctccgccgtnaacgcgggaaaanattcgnggggggaacaaaaatgatgggtgggttcaaaaaaaaaaaa

SEQ ID NO: 88062 - DNA, 210 bp, Triticum aestivum
  unsure (1)..(210): unsure at all n locations
  Clone ID: PAT_TA_88062
ctgatttcagattgtgctgaacctgtaacnaggancttccttctanctgttgctanaacttgggaagaacatggcaaacacanttattttggcaggtgggaacaataactttnattttgcttgagatagctgttcgttcngtccctgtnacttgcngcagataaaagcatttctgcnttanttcaatccatcttcaanaanttttgcatc

SEQ ID NO: 88063 - DNA, 538 bp, Triticum aestivum
  unsure (1)..(538): unsure at all n locations
  Clone ID: PAT_TA_88063
gaaaaccgctcctcctggctggcctccttcaaagcatgagccccatgacttgaaccaggcgggctggcagccgaatgtcccattttcggcgcctccaaagtcggaccgcgacaatatggagacgaacgttcgtgggtttaacctcaatgaggaatcatgcccgatggattgtgaaaagccagacgtctcaatgaagccgccctttggcgatcgatggccgactgaaccaaaggtgcttccatctcctcccagcagacagcctctgccatggcaacttaagcaagcggggccggcaaccgggtcatcatcttatccgaggagtcgtgagacgcagctgggcctgggcatggactttctgtctgggcgtgggaaaaggagcgccgcggatggcggcgatggncgtgataaaganggcaagtgaagtgaanggtgcagctgcggatgtttatagcgaaattagaagaaatcagctgtgtagatatagacttatctatagtcnagattantttgcaacatgatcatcatatagatatgaatt

SEQ ID NO: 88064 - DNA, 489 bp, Triticum aestivum
  unsure (1)..(489): unsure at all n locations
  Clone ID: PAT_TA_88064
agatgctcagaaggngcttgatcccttgaangggggnaatcnaaggggcctncnggcaaannttncaagggctgctgaaaaaggcncaancncccccccnacaagggatgggggttcttttggaaaaccaattgggggncccaaccccccantatttgtcaagggtttgattcaccccancagggaggatgctattcggagccccttcaaaaaaacttctcnaaatgtggggaaatcacacgtgtccaattccnaagggttatgaaaanggngcaagcaaaaggatancttacaagggnntttnaccatgaagagtccctttncgaaaacacttnancctaangggtntgacccaaagggggggnaaactnttatgttgctgaanctnaaccnaaagggaattttgggggggntggggntntnttgggcgccaaaatggnggcagatttttcgccctcccggnggaaaaattttcggncccctnggcgt

SEQ ID NO: 88065 - DNA, 241 bp, Triticum aestivum
  unsure (1)..(241): unsure at all n locations
  Clone ID: PAT_TA_88065
ccacgcatctcnngtactttccagctcgccggagaantagcatgcaanatggccggnaggaagggcggagacaggaanaangcggtgaccagggtccgtcaaggccgggctccagttccccgtcggacgcatcagncgctacctcanagaagggccgctacgngcancgcgtcagttccggngcccccgtctacctcgccgacgtcctcgantncctcgccgccnangtcttggcnctcgc

SEQ ID NO: 88066 - DNA, 209 bp, Triticum aestivum
  unsure (1)..(209): unsure at all n locations
  Clone ID: PAT_TA_88066
aatccataccgcggcatcttgttccngtgttttcttttcgaggaagacatcantttcantanattgcagttttttgttgatattctttattactgcatatttgaggttgttttgatacacgaaaggagcantaaagcattgaacttctaaacttctgatacagattgtgacatttcatttccaagcanttttgccangcggtcacttca

SEQ ID NO: 88067 - DNA, 561 bp, Triticum aestivum
  unsure (1)..(561): unsure at all n locations
  Clone ID: PAT_TA_88067
cggggaagatcgccgagtacttcgtctaaatctgctgcaaacgaccaccgctctgtgcgaagaagtggaagtatttcatccctcacacgtgctttctgcctcacagtgatggaccatttcaagggagcacacaaagctgcagaggcaccaactccaaggaatcagtacggtgccgtgttttcagtattccaaaaataaatgaagtaatggtgtgattaacactaccattaatggatcagtagttgctattgcgaaaatcatcatactctattaagttggattccttttctagcacaacttgcttcggcatcttatgaattttggatgccccgaacagtaaggacaattttcaagagatgaagaactactacagggaaaatatatacatctacatgtcaagtgaaacttangagagaagaatggcattgccgaatgggcaaggnaaacatccacacctgggtagaaaagtatgactcacgccgctacggctgatgcgccataatgcaagcaccgctgccgncgcaactcaggcacgaagagacacaaataaaggcggggcan

SEQ ID NO: 88068 - DNA, 457 bp, Triticum aestivum
  unsure (1)..(457): unsure at all n locations
  Clone ID: PAT_TA_88068
ctgcagggtaagataatacagagattaaatacaactttgctacacgggccagcccctagcactccggttgatgaagatgctgatttgacaaaaggatcagtgaagcactgggcgatcgagacactttcttcatcagatggtgtactgcacgacatacttccgttagttgaagatgatacatggagtagtgacctaaataagttgaagaaaaattctgcaagtttggtgcatgtgctgctccaaatctattgtgtgtctgcgagtagctattgtatgtcttctgaatcatgatgtangctattctttggtacatgtcttaagtgtgcgtacggaaggccgagaagttctattgctggtatacgccaagttcagaggcgtttccgccaacgacgcttaagcagcggtcaaaattaaaccggtcaatttgtgcgtatcctttttttataaaaaaaaaaaa

SEQ ID NO: 88069 - DNA, 554 bp, Triticum aestivum
  unsure (1)..(554): unsure at all n locations
  Clone ID: PAT_TA_88069
agaaggttgggccttcgcaaaaattgaggacttcgatgttttttgggcgaagcagcataaatttattagggtccttgtgcacattatgcaagaaggcaaaatgtttacggttcctaagaatttatgtgacagatgctgacatgagccctatacacagtttttccaatccataccatcttcgctatcttgaatatattcctgttgtcattacacccagatcctctagagtctacaacaacactgtgtttcctcaagcattgacaagattttatcaccttcaagtatggaatgtgggtatttcaggcaatttttctgtgcctactgatatgcataatcttgttaatttgcgccatcttatttctcatgaaaaagtgcatcagacaatagcctgtgttggaaacatgacctctcctcaggaactaagtttcaanggtccatcagtagttttgagataagagaactcaatccctgaatgagctgtactacttgaaattctcaacntgaaaagtgaagacaaagaagaggcagtggggcaagctatagacaaagatatc

SEQ ID NO: 88070 - DNA, 392 bp, Triticum aestivum
  Clone ID: PAT_TA_88070
gggttaacgatcatgcaagtggtcgtcgaagctgccgggagccggccagggaggtctgtctaggagtaccgggatacatacctgtcttgcatgcatgggctgcatcgcgtcgagagcacccatcctgctgaaaaattcttgatgtacattcgtctgctggtcaatgatattggtcaaagtgcatcgatcaggcagatgctagagactacgtagctacgttgtatatcatcagatagctagctagaaccaccttcggaagtcttgtaagtgagcatgcaagcatgcgtctcacctgcttacatgtctggaatggtctggttggctgtataatgtgtatctctacttaactactgcaatgtgccacatttaacaaagaattcaaaaaaaaaaaa

SEQ ID NO: 88071 - DNA, 537 bp, Triticum aestivum
  unsure (1)..(537): unsure at all n locations
  Clone ID: PAT_TA_88071
gagagagagagactagtcgcgagtttttttttttttttttttttttaactctgaacggtaatgccgatgctgacaacacgcatcatgtttccttaccaattgccaactaccactactttaaaacagtaatatttttccttctttgtgaccaagtatcggtagactataatacatgaatcctagaggtcaaggaaatgagcagctaatatctttcctgttgaattccttttatttctacctactagaagtgctcatgaatgggaaaattgtttttttttcaaaatagtgagtgtgctaacaagngttcaanccanttcaaacctccaatccanagnccattaaaatggcccgccttggttaacaacaaaaccaaccctttaaaatacattnggcccccnagggcncaggcctagactnngaacctaacggtganncccttttttaaggaaaattnngcacacctttaaaacgcaagggaacctngcaatatgcaacctgcgctccgccaaagggggccggacaatcgcctaaatgant

SEQ ID NO: 88072 - DNA, 246 bp, Triticum aestivum
  Clone ID: PAT_TA_88072
ctgatgttcaatcagccccagcagaagctcctgagccgttggacgaattggatcattatggagctctagagctccagtgaaatgttgagacattgtcggcgcaacaaatgtttttgcccgtttgtagttccattgaatttttccattacatgtgtgttgttaagctgctttatgagcctgtaaatattatatgcaaatcatatgattattgtgcccctgtgggcgagcagactgaaaaaaaaaaaa

SEQ ID NO: 88073 - DNA, 535 bp, Triticum aestivum
  unsure (1)..(535): unsure at all n locations
  Clone ID: PAT_TA_88073
ctccccatgaccgaaggatacataagatgagacctcgactatacgccattggacacaaggtgaactcgctcccctccgaaccttctctttccacatgtgagacatggctactacctcaaacgtgtgtgagacatggctactacctcagacgtgtgtgctatgcgatcatgaaccaagaggaagaccatagaacagctaggagtattggacaagacggcgagaacaccaagcgtgaggaacaagaagaggaaccaccgaagaactccagcaagcggacgttcggacgacaccggacgaccggctctcacagcgagcggcatccggcctccggcggacgaccagcgcctgaagaccagcctacgccagctataactcccagcgagccgacntccgactgcacaggacntccggcatattnacgganccgaacttccggactcccgtgtccccgtcacaaaanttttcaacggacnccngngctagcngacacgnncccccgaaacaacggcnnccngccctggtgtntcaattaaag

SEQ ID NO: 88074 - DNA, 355 bp, Triticum aestivum
  unsure (1)..(355): unsure at all n locations
  Clone ID: PAT_TA_88074
tcgagtttttaagttgactgcagcctcgttgtcatgctcaaagcaaatgatagtatcgtccgcatattgaaggatagccacacctccattgatcaggtttggagcaagccctgtcaacatgccttatttttgagcattaaggatcatttttgataaggcctccatagccatattgaataagaagggtgagtacgggtccccttgccgcacccctttgtaactctggaaataaggaccctctcattacactacaaaaaaagacaaaccgtgacattttgggccgaacgaaaaaattctgtcataattatacacttctataatataattgtgacaaacccantncaacanaatttgg

SEQ ID NO: 88075 - DNA, 533 bp, Triticum aestivum
  unsure (1)..(533): unsure at all n locations
  Clone ID: PAT_TA_88075
tgcacatgagaatatattggcaacatgtaactagtttttcacgtattgtaccacataatccaatgctcacagctacgtattatacatttatactaaaatataatgtcgtaggcatataaaaagcatggacaagaggtagaattgttacctggacggtttggtcatgatgcatccaaaccggaaggcaacaaacctacagaattggatgatagatatgcatttgtatatgctctaaacttgtcaagataaatgagtaaatgacagcatacatgtggacaacaagcagccacacatgagacatgataagattaattaaaatggacagccacacaacttggnaatatgcagccacacattacaagnttaaggggtgcccnctcnnttaccttnnccaanaaccgtnaaccggtttggcaccattaaccaccgacactggattaatgccattaaccgttgacatttnatggaccgagttgtctatcccctcatttagcaccgattacgattaaagggnattaaangggaaccnggcg

SEQ ID NO: 88076 - DNA, 530 bp, Triticum aestivum
  unsure (1)..(530): unsure at all n locations
  Clone ID: PAT_TA_88076
ccgcaaagacgcccacacccagatatacaagaagcagtggaacccgctgaccccggagcagatcgccaaccctaagagctacgcggactgcacccattggtgcctcccgggactccaggacacctggaacgagctgctctatgcgaagctcttctttccttgagcgaaggaagaacttcagattcggagaattgacgcgcgtatccagcactagcgctgatcatccctttgactgaaagaggaccaggaggaacacctggcccaantcctgggagtatagtatatatcatctgggaaggtctgatttgccgaagaaggttagtgtagctacatcgtacaggttgcaaactctgaagagtggaagatattataaacggtgcacaactaaggtttgtggncgtccngttnaaaatgctaattgtggtaccgtacaaattctctcctctgtcnaagccctaattgcangatgtgtaacatatcttcatngaacatgaagcaatngcncaaagggtnaccttaaaaaaaaaaaa

SEQ ID NO: 88077 - DNA, 294 bp, Triticum aestivum
  Clone ID: PAT_TA_88077
gctcacggaagcgagcgccatcaactccaagggctagcagcgcggcttgcatgctgtggttgaatctcaaaatgtttgtgtattatcagtggctgtttcttgtatcaaagttctcggtcgccaccattaagcattttgttctcgtttctctaatatattatgttcatgttctaaattttgttcgtgtgttcttcatctgaagctaaagctttttcaattatcaagaggactttactgtaaactaggaaagccttcttcagatgattaaatgatcgattgctcaaaaaaaaaaaa

SEQ ID NO: 88078 - DNA, 528 bp, Triticum aestivum
  unsure (1)..(528): unsure at all n locations
  Clone ID: PAT_TA_88078
gcgggtgttccgcgacaaagttcatctgcaggttcatggagacgtaacgactccagaatgtcgacagatgagaacgtgaaccggaagtttgctaggacagctccagcgtggaagcagcagaaggttcaagatcacagcaatcgagtctgccaaatgctcaatacgatgcatctcaatgagaaagctcaaggcaccaagcaaacaccatggagaagcagtgcagctcagcgttcacttttccacaagtcatgcaccattcggtgacaatggacactctcaagggtaccaatcacacggaggccactaaccggtgggccgaaagaacgtggcgagcacaaagaccgtnnganggcacaagaaccgcttgcgggtcctccaaggaaanccacaaatgagattgaagcaaatgttgcataactacanctttatcctcaatccaccgttgatgttagtcctaacaataanaantggtggttccccnccanngatggnaaagccttncattggaagnggaacatcctgtttagn

SEQ ID NO: 88079 - DNA, 444 bp, Triticum aestivum
  unsure (1)..(444): unsure at all n locations
  Clone ID: PAT_TA_88079
agctcatcgtcggtcgccacggctgtcccgggccgcggcgaaggaggagagcaaagtggcagcggcaccacggcggcttcaccactgccgtcacccaccggcgcccaggctgaagggagtagcgtcgctgctgctccaagcacctcccgagtatagtagaatcaatcacctcgccgacaagagacctccctccttgtcgtatttgcttccctacgtacgtgtcggtaatgtatacatcgttcgcgcttattttgcaaggtttgagctatatttctcctgccatttgatttcactatccttctccttttcctggttaattcctcctggtggccgattcgaatccctaagatcctagctanctaagtcaanngagtaactgaataaataattnccaaatccgcaaatggtaattgagatttggaataatggngttttggggaactg

SEQ ID NO: 88080 - DNA, 537 bp, Triticum aestivum
  unsure (1)..(537): unsure at all n locations
  Clone ID: PAT_TA_88080
agaatctgtcaattgcatttagaacaaaacaatttgtctaatctaagcacaagtgtatctaaatccccagtcgaacggttaagaaagcgaaccgattcagagcaaaattccacgagcggaaatgctaaccagcagtaacgtactctatcgtaacctatcttattcaaacgacatgtacaattcctggattgttatactactgtagtaagaaactgagagatccaggtagcaggctagacgaacagctcgagcaagacaggcagcctgccggcggcggcctgggtgccccgcctcctggatccgacagcgcgaccaccggtcgaagcgccatatcctcgcggtgccgccgcatgtggccgccgagcgcctgggcccgtctcgaagcccaacccgcagatgtggcagtccgtgctctccgtgccgaattcngnacgagtatactaactcatcaacaagtcaaattcattcatcattcttccgggaanagctaattgcccggacttnagaaacaagcaagggaaacanacagnncaagnc

SEQ ID NO: 88081 - DNA, 184 bp, Triticum aestivum
  Clone ID: PAT_TA_88081
ttcatatttctctcttttgccaataagggcacacacacacatgtaatctcattttttggctgttagctgtagcgtggtgattaattttttggggtagttctgcgcctgtgaaactgtggataacctgtatattgtttgctacacttgctcgctggaatgccatattttctacaaaaaaaaaaaa

SEQ ID NO: 88082 - DNA, 559 bp, Triticum aestivum
  unsure (1)..(559): unsure at all n locations
  Clone ID: PAT_TA_88082
cggcgctggggtgtcgggtgccggcgttgggtacctgcaggcatcgtgcgggacatcgtcgccgctggcgtcagggctgatgccggacgtcgacagcggcggcagcgacgatctcttcgccatctcgcgtcagatgggattcgttgggagccccgccggatcctcctcggcggcgccgaacaccgccgtgcagcagcagtactactcgtgccaattgccggcagcgacgatcacggtgttcatcaacggagtcccaatggaggtcccgaggggtccaatagacttgcgagccatgtttggccaggacgtggtgctcctccactccacgggaccctcctcccagtcaacgactatggattctgattcanaacctgcaaatgggagaaactatttctggtctcnaagcaagcttaaaatcccgtttatatagatacatagagtntctactcaagtctaacgggttaaatttaatcaagggggcgacaggaccaattctcaatcaatataacggatatnccttcatgaanttantntcaacgngaanaaactnctacatncn

SEQ ID NO: 88083 - DNA, 336 bp, Triticum aestivum
  Clone ID: PAT_TA_88083
ccacctcccaccagtggcctataggcccatccagccgccggccttcctaggccaagcaccagcgtcgacccatgccagcccacctacagctaaccctaggcgcccgactcctttctccctcgtttcctttcccctcgcgccgccagaacccttcgcccgacccctcgctcagcccctctcgatcctcctcctcctcgttcctcctcccgctgcctcacacccccctgcaccgcatcgccagggagaggaactccccagcacgcgcgcccccctctcttccatcgcccctgcttcagtctctcgttgtcgcctctcctcctccgtgccccgtcgcct

SEQ ID NO: 88084 - DNA, 556 bp, Triticum aestivum
  unsure (1)..(556): unsure at all n locations
  Clone ID: PAT_TA_88084
gtgggcacgaccatgggtatggacacaaatcggttctttgagtatgtccgcattgtccagatggtgagaagaaaaatgcaaggaattgcctgacacacacagatttgtcctcattcgttctcctctggatgtggatcatcaaggttagcagtaccttcacaaaaagtcttcttctttgtcttcctgttgcatgtattgtccgcaacgagacctcatccttgcaccataaaaagaaagcagccattttttgttcgagtacagagcacagattcagttcagttccaaattaggaagcatgtgttgttgcatcctgtaatcatgggggaattcggttgtagagtgcagagaggancttcctaattctgacctagatgaaggtgaggtggaagctgtnacgtatcaaatgatgatttcttgcgctcctccaagatttgactgaagacnatctagtggccggcaaagacaaaaacctattgaaatccagcgaatgatttcgatnaagttgccanattggctgaatgttacggggntgtacacgttgggtaaactgaggcgg

SEQ ID NO: 88085 - DNA, 541 bp, Triticum aestivum
  unsure (1)..(541): unsure at all n locations
  Clone ID: PAT_TA_88085
cttcaacaaggctcaggttaacaacagagacctttccattgctgttttgagatggtttatttcgaaaagacaggaagagcatgatacccaattaaaaggcaggcgtgctgagataccagcggagcagcatgccgatggattagacactgctaccacaggttctgaagacactgcattgagagaggaatcgagccttaaagcacctaaagttcttgaggctttggctgcatcaggattaagagctatccgatatgcacttgaggtggatggaattggggaagttatagctcttgacaataatgaagttgctataagaatcctgtaagagaaatatctatcacaatggcattcttgcatcttcgaaggtggtgtcacatcttgctgacgctcgcantttacatgctcactcancctaaagaanttgatgtggttgatcctgatccctaaggntnaacaagctgcattcccttgattcaacaattcaatgtgntgcaaatngggggaancctgatgtgctcaactacaagacatgggantcctt

SEQ ID NO: 88086 - DNA, 537 bp, Triticum aestivum
  unsure (1)..(537): unsure at all n locations
  Clone ID: PAT_TA_88086
gaaacaccacacctctcctcgtcgaagcagcagcagcagcggcatccatggcccccaaggcggagaagaagccggtggcggagaaggccgagaagacgacgacagcgaagaagaccaaggccgagaagcggccgccggcttccaaggagggcggtgagaagaaggggaagaagaagtccaagaagagcgtggagacgtacaagatctacatcttcaaggtgctgaagcaggtgcacccggacatcggcatctcctccaaggccatgtccatcatgaactccttcatcaacgacatcttcgagaagctcnccggcgaagtccgccangctggcgcgctacaacaangaagcccaacatcacgtcccgggagatcaagacctccgttcgcctcgtcctccctggcgaactcgccaancangccgtctccganggcaacaangnaatcacaanttnaactcctcctaagnctaggatggttctctgtaanantcnggttgttcaaaccatgtctccttgtaactttcctttggttctgtt

SEQ ID NO: 88087 - DNA, 247 bp, Triticum aestivum
  Clone ID: PAT_TA_88087
ggaacatagaggtctctcccacaatttttgtcatatacctctggaatagtgttgaaatcacacgccactaagctgttttttaaaccaagtggtttatcttagtgtgctagccgctgcttcatttcgtatagcgataacgctttctctttcttagcgctccaccccgcggagaactctggttgcgctttggttggctttctctttttttcgattttctctgacttgactcagcttgaaaaaaaaaaaa

SEQ ID NO: 88088 - DNA, 537 bp, Triticum aestivum
  unsure (1)..(537): unsure at all n locations
  Clone ID: PAT_TA_88088
ttttttttggcagtaaacacacagggttactcaatgagttacattacatattttcttgggacaaagggcgactcccctccttctacttgaagtattttatccacaacagcaatacaaatatacacattgtcccatccatagtttcctatctcgacaaatatagacaacctgactatagttcacaaacaagttgcgacttatgggattgattcaatatgaaaaggcgattgaatacgtctgtcatcgatggcctttgatccacatcaaggctaagacattccacggcgatccctgtcaaactatccagaatctccaaatcctcaagttacaataatttccttgtcaaacaagtgagttgctttcctctcttttttgtaaagcttcaaggaaattgatcactaagctactaccctccggaatgtgtggctttcttcccactaataagctccaagatgacaactccaaaaactggtagacatcactttttccggtantccggctgtccgcagatatactgggttcaatataacccaaggt

SEQ ID NO: 88089 - DNA, 171 bp, Triticum aestivum
  Clone ID: PAT_TA_88089
cccgaggaagatgtactttgacggcggtgagtgcgcgatgccaccacctgacgactacccaccgctgcccagcgccagctgcgatcagcgcctctcggcagtgctgaggtcactgctggcgggcctcgtcttgttgtttctcctgttctaggggaggaggaggagaagaaa

SEQ ID NO: 88090 - DNA, 326 bp, Triticum aestivum
  Clone ID: PAT_TA_88090
caccgaagtagctgctagctaggtagcaccactagctagccgcaggcaggctgatctatcggcccggccgccacctccacggccggatcgctcgtcgtcagccagccagtccctgggtcgtcaccagtacatcatcacatctccctctccctgtagcttcttcgacgctctcctatattttgtgcactctgttgtccatttgttactgtatgtcgttatttgatccgaattaaattccatggctccgtagtggattctttcattcgttgctggactactgctggttgttcatctgatgggatggaaaatacgacgctcacaacaaa

SEQ ID NO: 88091 - DNA, 343 bp, Triticum aestivum
  Clone ID: PAT_TA_88091
tggcgccctcgctgcccgcctgcttccttcccacgcccctcgtgagctcctccggcgaagaatccgcacgccgacgctacatctagccgcctcgctgactggtgcctcccgtccgctcgcttgcgtccgagcacgtggacgcgcagcctccgtcatgggccgcctcgcgcatcctccatcaccatctagtttcttctccaaggccacggcatggtgattgatgtctgcggcagtgaggataatttttatatgttggactgatgcacaggtagcatcagggcacttcttcgttgtttctcctatgcgtattattgggactgattcggttttttttaaaaaaaaa

SEQ ID NO: 88092 - DNA, 384 bp, Triticum aestivum
  unsure (1)..(384): unsure at all n locations
  Clone ID: PAT_TA_88092
cggcgctgcgcggcgagttcccggaggaggaggcgctgccggtgctgaagctgggcgtggtgtgcacgtcgcagatcccgtccaaccggccgtccatggccgaggtggtccagatcctgcaggtcatccgggccccctcgctgcccggctgcacggcgcaacttttctgacacgttaaagtacgacgaccagagcagagctagacgagatccattgattggcatgcagctggacgtactacgtaccatggccatgcatgcatagcatggatccgcgagtagtacgtacgtgccgacgtgcatatattgatgctctccactgtgtgtgttcgtgtcacgtgtttgctagtgaaaataatcanttactattaanaaaaaaaaaaaa

SEQ ID NO: 88093 - DNA, 537 bp, Triticum aestivum
  unsure (1)..(537): unsure at all n locations
  Clone ID: PAT_TA_88093
ttcacactttgaatacaatatttgcgaatagagggatacaacaatcaaaatggtagcacatgggaaaaatatatgatcgagcaattattttaagccttcagtaaaagaaggcattttttcggtcttcccatccattggtgcacacattcataaaaaacaaggcatttgttctcagcagttttaaaggaagtatatccatctgcatacaaccaatgacaagaagatatttatgctagcatgataaaatgctaggccttcatcaagaacttcatacacttcagatttcaccatcccaaaaatcctccacggttttgtaaataccttgggggtgaactacaaattcaagctcctaaagtcctaaaccgtgggaattcaaaagaactttggaaccaatcctcaagganngaccaatccaaatntttnaaagtcccctttaaccctggttcaattgatgtgggaatttgatggcaacaccctgacaaagaactgcgtatgaaggccaaggccaaggccaaatcacgaacaaattgangnggt

SEQ ID NO: 88094 - DNA, 316 bp, Triticum aestivum
  Clone ID: PAT_TA_88094
ccgccatcgtcttctcctcgcagtgggggctccccgcgctctcccactccgccagcggcggcgccagccgcaccgccaggctgcgggctttctacctcgacaggagcctctccgccggctcgggcgccggctccccctgctgatcatctcaccaaaccacacaccatcgacagcgcgcggctggtcatcgactcataatgcatgcatgagctagcaaatcgtgttcccgatactgtaatcatgcgctgcatgtaaggctcgagctatagcaaagcatcttcacgatgctgtaatcatgcgttgcaaaaaaaaaaaa

SEQ ID NO: 88095 - DNA, 492 bp, Triticum aestivum
  unsure (1)..(492): unsure at all n locations
  Clone ID: PAT_TA_88095
ccaggtctggacgctagcacggatggcgtccaatcattgccctttcattggtgctctgattaggctcaaccgagtcattttactttgatagatagagatttcatgacctatatactctaatacacctgcagccatcgcttcttacctttctaggtggtaagcaagctccagcacggacatcatcaatcatcacatgagcaacatcatctcactggttgcttgtcattaggatcattcgctcatcattaggatcatccactagacctatggttggagcatgtgagttgtttcatggcctcgttgaatcttctttgtctagtcttgtgtataatttattcaatggttacaaacgtacattatatatttggctaggttgttacttttgggcaatacaanttggtaactggctagtttangataatagataagtccnttcttgantccggtgtcntgcntttgnctccnacgtgtcaattgaacaatggcgaacaa

SEQ ID NO: 88096 - DNA, 495 bp, Triticum aestivum
  unsure (1)..(495): unsure at all n locations
  Clone ID: PAT_TA_88096
aaacagaagggtacaagcatgttttctcaccaagtgtttattcccctctgcttccgtttttcagtttcctggtgcggagtgctaggtcgatttctcaaaaatcttgaaatcaggtagaatgagctaacagatgtcgtcgacatgtactcaatcgtgcgtgcctccaactccggtgtcccttcttttccaaccaatacagtgaagcacgctgcattttccttgctgtttgatccgccttctttctccaaggagagatgaaggccccattatggcctgtcatgtttgagttatccttttctttataccaattcaagaacaatcaagcttgtagggcaccccctgcattttgccctgatgaaccattagttattatgtactgatgatgtatggtttgcctcctaaccagcgttggtcaatacactcctttaattggnacagctttttcctaaaactcgatatttaatccaagactcataaactatactggtcaagagt

SEQ ID NO: 88097 - DNA, 526 bp, Triticum aestivum
  unsure (1)..(526): unsure at all n locations
  Clone ID: PAT_TA_88097
cgatcgggcgcatggcgtcgggtccgctcattggatggatgattatgaatgaatggtatcttcctgcttttggcacattagctttgtctggtgcaagtgattggcaagaaagatgggcatcaattctgtaattggttcatatctggacccattggctgacaaggtgttgatttgctgtgttgctgtagcaatggttgagagggagctcttacatcctggccttgttggcctggtggttgcaagagactttctcctggtgggtggggctttctacaaacgagcatccaacctgggatgggaagtggaataatttggtcanacntttgtaattttggatgcaattcaacgtganaaaggtcaanctcctttcaacaacaanggtaaatacaagttatttcaanttgatgttgggttgcctggnngcantccctcaagccaagaaattcggcacaaaagggaaaccccggaattttnattacaanacctttgggtttggntngggttgccaacnaacaanaaangggaa

SEQ ID NO: 88098 - DNA, 388 bp, Triticum aestivum
  Clone ID: PAT_TA_88098
gtggcgcggaggaggcacaaccttctcaggggaaactcctatcggtcacttggcacaggctggcctatgatcgtcagccggtcgtaacacatgtctttggattggatgatgccgagttgatgagctttgagtttctgttgagctcgcattctcatattatcatgtacacagttgaaagcaaccttagctcccgagtatggtaaacaacattaccatagaccgggcaatgttagatatttttcctctttattcttttttcaatttctgtgagaaggcaatgttagatgttaatgtgtgttctcctcctaagttgtagcaattgtatgtgaaagtggtatacagatacatgatagaatttgtaagttttgtgatgattatatatggcgta

SEQ ID NO: 88099 - DNA, 505 bp, Triticum aestivum
  unsure (1)..(505): unsure at all n locations
  Clone ID: PAT_TA_88099
cccaggctgccaatctccagtacgtgcagtcactgcttcactctgcagcctccgttgccgccagccccactaccagcagcagcctcaacagtctcaccatggacctggagcagatcaacttcttgagccctccgcagatgctttctccaagtgtacttgagggtattgatggcatagacttagcagggcaggtgtctcagaaccaaatgcctagcgttacctttgaccacacaattggcaacatcaacccgggttcacataacaatgttgaaaccagtgagaagcaccgcagcgagggagagaacagtagccagaaaaggtcgtttctctctgaaaactcccttccacctctcactgacatggcagcttccaacatttgtaataccatcaagcacctcaaactgtgacggcgtcagtagtccgtttcccaagttggtcggaaatcctacttgatgaagagctgctctgcgagtttgcatgatgcaanctgaantccctaacttgg

SEQ ID NO: 88100 - DNA, 501 bp, Triticum aestivum
  unsure (1)..(501): unsure at all n locations
  Clone ID: PAT_TA_88100
ctcatgaactggatgtttagaggaacatactgtaatactgcagcaacataagagtccttatgatgtataatattataaagagccaacttcatatttctagcctttggtagatcatgttccatgaaaatggttatgtcggcagcgtattgtagtatggacaccccaccatccacaaggtggggcatgagtccaactacttgcccgccctttttaaccctaccgatgagaattgccaacatatctgccactatgttgaacaagataggagacatcaggcccccctttcttaggcccctttgcatctggaaataatgacatatgttatcattcacgttaatctttacgctgcctttttgtacaaaggaatcgacctgattcctccaggaatcgtcgaaactccgcacacaatcgtatgtgttgtcacgacttatagcagatgatttgcctttaaaataccgtgtgcggaacttcgcacacggngtatattaaacaatgtgtgcg

SEQ ID NO: 88101 - DNA, 508 bp, Triticum aestivum
  unsure (1)..(508): unsure at all n locations
  Clone ID: PAT_TA_88101
ttttttttttttttttttttttactactaaaccctctcttcctcttcagctagaactgatcaagactgtatgtacaaggactgctgccgagattcagagaacaaacacgacgaacaaacacacattcaggctaactcaggtgaaagcttctgcaattccagcttcaccagagacctctaggcctaaatgatcacgaaggaactagcactagttctacttactgaactcaactcaactccggnaacaacggctgcttctgtccatcgccgatttgccggagaaacagagaagagccgcagaaaccgagccgtcgtcctccgtggagaaggtcttctatctacagatggatggagcgcgccccgcatgttggtccatcgatttcttcagcccgcaaccgcatcccctccgcagctcgcgattcacgggtgnctcaaggacntgttccgggggagaaactgcnggaaaactcccttgcaaaacaatgcngngcaacaaggnccttggcccc

SEQ ID NO: 88102 - DNA, 505 bp, Triticum aestivum
  unsure (1)..(505): unsure at all n locations
  Clone ID: PAT_TA_88102
tacggtttatttttgtcctcctcccacctccactggttctttttctctccactctttccttgcaaaccaataatttcctaacatacaaaagatcacgaatctatttttccttacccgaaccaatcgcgccctacatcagtgcatttctttattaagaactaacacgtatatcttaacgcattgtaaacaaatcccgttatggacctaattaatttattatggaatctatacgtggtcgcattggttctttttctctccactctttccttgcaaaccactaatttcctaacatacaaaagatcacgaatctatctttccttacccgaatcaatcgatccctacatcagtgcatttctttattaagaaaactaacacgtaaatcttaacgcattgtaaagaattcccgttatggacctaattaatttattatgaaatctgtacgtggtcgcatctctcccctcgtgaaaaactcgaagggggggcccgggaaccaantcgncctatn

SEQ ID NO: 88103 - DNA, 217 bp, Triticum aestivum
  Clone ID: PAT_TA_88103
ccgaccagcgcgtcgagatctgccagctccccgtcggcgacggcatcaccctctgccgccgcgccaagtgaaccacagaacccgtctccgccgctccgccatagacgccaagaacaagaattaattaattactccccattttgtctttcctgctcgccttctgtactctatatctatcttctgcaattcgtataaagatttctccaaaaaaaaaaaa

SEQ ID NO: 88104 - DNA, 401 bp, Triticum aestivum
  unsure (1)..(401): unsure at all n locations
  Clone ID: PAT_TA_88104
cttggctaatttgatccccaactgcagacagaagccgacaaaccctcatttgtctacccgggcaaactcaccttccattttcaaaacctcaaatgcatataaacacgtgacgtggatcattcaagtgatatagctacatataaacacatgcacgtggatcattcaatcgatatagcgcacaacaattcaaccttaaacacaaagccaaaataatcaatgccaagtaaattcaacaactcatacatagacgatatactaatgaatcaatcatcgctagtgcgctagttgatcttcttatttttgttgacgaaccacttattgctatcgtcatccatgagggtagtgtcgatnaacatgatccttgactcatccaagattctcgctaggntcgccttctcttt

SEQ ID NO: 88105 - DNA, 533 bp, Triticum aestivum
  unsure (1)..(533): unsure at all n locations
  Clone ID: PAT_TA_88105
aaacaatgaccctacaagcaacagcatgtatctgtgcacgccatcaaactcctaagtttacatgatccaggtaatcttggaggtgacatcaagtttaaatgaacatgatatgttttggccataacattaaaacaggaccgagcgacgcacatgatacctcaaccatactataggtggtagcactggaggcgcgtggcatagctcttctgagctaaggagaaccttggtcaggagattacgggagggcacatgggtgaagcttggcggcaagccatcggtggcggtgttggggatacataacaggtaggcccacgaagggtccaaatatcatgaagtgtggggtccacacaacatgtgggtccaagtcaattcatacagacacactgtcaactccngacaagtnacatactatccactcgaacaagcaacatacatccacccggatgacagttaacantccgaccgtncactcactccgntatacgaagacancaggaacaaacatcggatccttctaatatgaagnttatatg

SEQ ID NO: 88106 - DNA, 489 bp, Triticum aestivum
  unsure (1)..(489): unsure at all n locations
  Clone ID: PAT_TA_88106
ccgcaccctgctatgcccgagctcctgaagcctgaactgccgcatccggctgtcccggagacgccaaaggaagtgccacatcccaaggtgccggaggtgccaaagcacgacctgccaccgcaccctgctatgcccgagatcccgaagcccgaactgccgcatccgattgtgcctgcggtgccaaaggagactcaagcgccacactcaatcgttccggaggtgccaaaggagcacgatctgccacaccctgtcgtgccggaggtgccaaagaagcctgaagcgccacaccccgtcgtgcaanaggtgcaaaagggagcacaactgccgaaccctgcaatgcaaganttgcaaaagcctaaattgcaaaacaatgccttgcctggggtgccnaannacccaanttacggnaccctgtttngcaaaaggtcccaaannncaaattgccgcnnttcccnaannccaatngctccnnaanccaagttcaatttc

SEQ ID NO: 88107 - DNA, 306 bp, Triticum aestivum
  unsure (1)..(306): unsure at all n locations
  Clone ID: PAT_TA_88107
gcttgattcagtcggtcaatccgcaagtacaacagatgtttttttttttggnttgaggtgcaggtacaagcacaacanatgtgaaccgcgtcgcgtcatgcatgcctgcaaagtgtctanngggcaacgccttcttccccgtgaccanagttgacgaacgataagcccgtgcctcgcanggcctcgtcgacgatgccatccaagcctggccgccaaggccggcgtcatatggctgcgccaatccgcgaacaacgccctttctnaaaaaagggtnctttggnaacggcaattgccggnncccctttc

SEQ ID NO: 88108 - DNA, 489 bp, Triticum aestivum
  unsure (1)..(489): unsure at all n locations
  Clone ID: PAT_TA_88108
gcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccaagaagggcatcccctacctgaacacctatgatggccgcaccatccgctacccagaccctctcatcaanggcaatgacactatcaagctcganctggagaacaacaaagaattgttgacntcaacaaanttcaantttggnaacgttg

SEQ ID NO: 88109 - DNA, 498 bp, Triticum aestivum
  unsure (1)..(498): unsure at all n locations
  Clone ID: PAT_TA_88109
cctgttagcaatcaacccaaatgctgcccctccagatgatgatggtcctggtgtccatgtctttggttgtgtccccttcaatgggcataccaacggacgacaagtgcaagtgcctcatgtgcgtctgcgacctggatccgcacccgctgccgccggcaatgccgtcgcgccacccagcgccttacccgccaccgtcggagccagagccagagccagagccaaagcctgagccacagccggaaccaagagccggagccaaagcctgagcctgagccacaaccggagccggagcccgagccgaaaccaaaagccacagcaatgccgcctccgccggagctgtgcgacgcaatgtatacactaccaacggcgtcggagccgaacaacgccgtgtacaacttcacgncggtgaacnttactgtaccgtagttcaaccgggcccgtgttggaaatgggaccccgggaaatttccgcgtanacatntnaaccgtcaaagccacg

SEQ ID NO: 88110 - DNA, 347 bp, Triticum aestivum
  Clone ID: PAT_TA_88110
cttcgccgggatgccgcaggaggtcgtgcaggcgtacatcaagacgggagcccgatgcacactcgtcggacagagattcaaggcacaccaacaaacctatggatgatgaagtcacgggagctccttccatgccgaagaaaaccttagatgctggttcacatgagagggcaattctctaccgatcctgatcgtgtgatccacaatggagtagatagataggagaaaggatgttccatgcaaaaaagaaaagagaaaagaaaggttgttggaaattttggcggcaatctgtcgatacactggagaaagaaaggctgttttgctgattttctgtaaaaaaaaaggggggg

SEQ ID NO: 88111 - DNA, 512 bp, Triticum aestivum
  unsure (1)..(512): unsure at all n locations
  Clone ID: PAT_TA_88111
ccaacgtccacgtctccacaagcccaacgatcagaagcaggcatccatatggagggatccttccctggttacgctggaggaagggctcgaaccgagtgcgctgcctccgtctctctctggctccactgctggtctccgttgtctgaccctcggcaggccctcttcccctcctccgttttctacaaaaaaacagccaacaaagcatcaatattagatgaggcgattgagtacttaaagtccctccaaatgcaaacttcagcagagctgactgctcgtggcagcgctggatccggtggccagccgtcaccgttgcctttcctctttgacgtgagagcacatggagaangggctcgtggaagcgctggatctgatgggcaaccgtcgctgttgcttgtcctccttgacataaagatcacactgctccantccatcaagttnactctccgctgctaatccatcgttttggcttgnagtcnccggcaagncnccgggcaattcgcanaaaacttgtt

SEQ ID NO: 88112 - DNA, 518 bp, Triticum aestivum
  unsure (1)..(518): unsure at all n locations
  Clone ID: PAT_TA_88112
gtcaaaatggcgcgtggacccgtgaagcaccagaagcgcctcagcgcgccctcgcactggctcttggacaagctgtccggtgcctacgctcccaaggcctcccccggtccccataagctacgcgactccctcccgctcgtcatcttccttcgcaaccgcttgaagtatgcgctcaacgctcgcgaggtcaacgccatcctgatgcagcgtctggttaaggtcgacggcaaggtccgcactgactccaccttcccctcgggattgatggacgtcatctccattgagaagaccggcgagaacttccgcctgatctacgacaccaagggccgcttcaccgtccacaggataacagacgaagaggctcagtacaagctcggcaaggtcaagcgcgtccagcttggcaagggcggaattccctacttggttacgcacaatcgcgaacaatccgctacccgaccagccatcaaggtcaaagacaacgtcaagtcnactctccaatggcaagattgccgactnaa

SEQ ID NO: 88113 - DNA, 256 bp, Triticum aestivum
  Clone ID: PAT_TA_88113
gtggatatcaggcactgccccaagctgaaagagctagtgcagccgtttcgtagaggctgctactgctagccaacgatggttatgtattctgccggctcctctcccctggcagttgctcggttgatgttatgtgtctagactctttttttttttttactctcattttgtgtatcaagggggacccttcagcctcttttatttgtactactactagatcgtacggcccggtacaaccctgtttggcaaaaaaaaaaaa

SEQ ID NO: 88114 - DNA, 539 bp, Triticum aestivum
  unsure (1)..(539): unsure at all n locations
  Clone ID: PAT_TA_88114
gctagttcgagttttttttttttttttttttttttttttttttttggagcagagatggtctttatttgctggtacatggcactgaacttttgcctattaaatacatcctaaatggaaaacactctacaaatctgcaattgctgggaaaaaatcatcttaaaaattacgagttataatctcaataaacgtagacggactacagttgcagaaagtaatatctcctgtagagtgatgaacactccatttatagggagaaggcttcatgtgcaatggatcgtggagaaaacgaaagaccaggctcatccaaatgacagatgcctcggaccagccgccatccacatattcacgccaagtacccttcctaagtagcaccatgggcaacaaggaccgtgagggcgtggggctccgcttgggttgatgaaaaaggtaccaactgatgaaaccgctccaaagctgggaaaancaagacaaagaataacatgaggatgatggnaagcaaccgaatcaaatggnaaacgcaagnaacatccttccgnagg

SEQ ID NO: 88115 - DNA, 506 bp, Triticum aestivum
  unsure (1)..(506): unsure at all n locations
  Clone ID: PAT_TA_88115
gtaattactagtcattgctatgtatttcgtttgggtgcaattaagatttagtgatcttacttatcttgttctacttacagggctacgactacagctccggcgtgtggcagttcgagggctatgggtacgtcccctccggcaccacgggggtgtctatcatgcaggtgttcggtgccggcgagacggccaccacattcatgctgcacgtctatgatggcgcgctgcggtattacaaccggcagctcgtcgaggacgccatctatgacagatggtttcggctgaacgtggtccacgacgtcgacgcatcgacgcttaccgtgtatatcgacggcgagctgaagctgcacgtccaaggccgcggcggtcactcgcactacttcaagttcggcgtgtacggtcagcgccgggagtccagccggatggatcgcactggaaggactcaagatctcaagaaagattagaactatttgtgtattatgtagttgatgggtgacatttgtatantt

SEQ ID NO: 88116 - DNA, 398 bp, Triticum aestivum
  unsure (1)..(398): unsure at all n locations
  Clone ID: PAT_TA_88116
cttgaagctcatgcagcccccaattgcaaggttctggttgttgccaacccagcaaacaccaatgctctcatcctgaaggagtttgctccatctatccctgagaagaacatcagttgtttgacccgccttagaccacaacagggcactcggncagattncngaaaaattngggtncaagtttcctgacgtgaanaatgctattaancgggggnatcnatcntccantcagtnacctgaagtttaacaagccaatgtgaaagaccccaatggagaaaaanctgttcgtgaacttgttcaaagattattaatggntaaatgggggaattcaantggcactgtccaacaacgtggggctgcaatcatcaaaagcgaaggaanctccccantgntcnctccgg

SEQ ID NO: 88117 - DNA, 434 bp, Triticum aestivum
  Clone ID: PAT_TA_88117
cgagttttttttttttttttttaaaagaaaaacttgcccactttgaactttattcacatgcaggttgtttgctcataaaaaggaaaatattttttttaaatacgcacaagcatgcatgtcatatactacttcatacttcctccgttcggaaatacttgtcctcaaaatggataaaatggatgtatctataagtctagatataaccatttcgagcacaagtatttccggacggagggagtagaagagaatcaacttgcaaaatgttggaactagcttgatcagcttgccgcgtgcacattgatcggcttcccgaccgtgaaaccgccgtccaccactaggttatggccagtgacatacttggcctcgtcggacgccaggtagacggcagccctcgccacgtcctccggctccagcaacgccccatggagctcgct

SEQ ID NO: 88118 - DNA, 253 bp, Triticum aestivum
  Clone ID: PAT_TA_88118
ccctgactactttggttcttgctctaatatgttgtgtaagactggattgagacatagcacatggttattatgattcagtcgggcgaaaggtagaaaaagaggtgaaagttgacgctagggagataggcagcagcaatataggtatccaccatgcaccagcacatggggatggatgggaatattgcatggtagtctcagtgtagctgttgtgacaaagttcattcattcgtgggttattaactctaaaaaaaaa

SEQ ID NO: 88119 - DNA, 525 bp, Triticum aestivum
  unsure (1)..(525): unsure at all n locations
  Clone ID: PAT_TA_88119
gtaaagaattgcaaaacagcaaatgacgccatgaggaatcaaacctacaacgtccctatcctcaacaagcgctgctaaccacaggactaaatggccgcatatgaactataccgcatcgcgattgtatttaagaactttgtattgtgggatatttctcttacatgttattttctgtacatgtactacagcatatagattggaatatgtgattatttttcgagatttgaaatacctgaaaattttctgaagttgtgaacaaaatttgaaaatgcaaaatattttaaaaattacgaacaattttttcaaaacacgaacattttttggaattattaattttttcaaaacgcaattttctcaaaagttccaaaaacattaacatttttggaatatgtgaacaaaattggacaagctgcaatagtttttataaaattagagaaaatttccatatttatgacaaattttcgaaatgagaacattattcaaattcctcgaacatatttggccttgccaactaanttacgtaaa

SEQ ID NO: 88120 - DNA, 503 bp, Triticum aestivum
  unsure (1)..(503): unsure at all n locations
  Clone ID: PAT_TA_88120
gtggacagaagggaagaggtctattgttggtgtttctcagtctctcacttgtaggaataataactctcttaccgttcatgaaggcctttgtttgtctgacatatctcaaggaaaagagagcattcccatatgtgtgatcaacacaattgatggcgtgctgccaacgccatttaagtacatcaccaaagtcatatatccgccctcatatgcaaaagcaccttcaataggctgtgactgcactaatggttgctcggactctagtgaatgtgcttgtgctgtgaaaaatggaggggagatcccattcaatttgaatagcgcaattgtttatacaaagcctctcatatatgagtgtggcccatcatgcaggtgcccaccaacatgccacaatanggtgagccagcacgggcccaaagttccactgggnaatattcaagactgggaaaacaagttggggtgtaagattcctcaagttttatcccntcaaggtagtttcctaggtgaag

SEQ ID NO: 88121 - DNA, 510 bp, Triticum aestivum
  unsure (1)..(510): unsure at all n locations
  Clone ID: PAT_TA_88121
gtgacaacgaaaatctggttaaaccattgtcagtcgtttgtccagaatctttccttcatatgtttcagacaaatcaaggcaactattttcttaaaggacaaaagggccaggcctcccgtccgcgtcgcgccgccgccggcatggagctggttaaggccactcatttccatggcagggtctgaaagctgggaacaagaaacagaagccctctgtcatggatatcctactgaatttgcatcttatttccattactgccactcactgcgctttggactatccgtatctcaagtcattgtctagagaccattttattggagagggtttcagtttgattgtattttttattggacgattctgaagtataaacaattagatgaccagtgctccaccgcgcgctatgggtgttagggcccggcaagaggacaaggctctgggatggcttccaagggaaacaagacagtttagtgagcaagggaaaantagttgcaaggccgagttccccaactcccn

SEQ ID NO: 88122 - DNA, 526 bp, Triticum aestivum
  unsure (1)..(526): unsure at all n locations
  Clone ID: PAT_TA_88122
ctgcgctctcttttgagaaatatgccaggccttggtgctatcaggcggcctgtcaagccgctgtcgtcggtggtgggttctgtgctcatacccaatgatcttcatgattccttttattccgaagaagtgctgacaagacagagggagaaagtaaatcgtctgctcgtggactataacaacatgcaccagaagctaaaccaagacatggatgcttttcttgagtctgtaaggcgtgattccaatgaattatcaaggtcacaacatatagttgatatatttgaaaatacaattcatgttattttctttggcgtcccagtagttttattgacgattggtataaagtatgagattgatatcttcgagtatctccctttgagcccttggaggttgaaggacttatggttttgatgatgtcggtccttgaccgtggcctggacagctttccctccgtatctccaanggaaattcaaattcnccaataagtattccgttttgaggatgttccaagantttttcccatgaatng

SEQ ID NO: 88123 - DNA, 530 bp, Triticum aestivum
  unsure (1)..(530): unsure at all n locations
  Clone ID: PAT_TA_88123
gggcaatgttcctccaaatgctgttcaacttccccgggttaatcccaataaagggcaaactcngtggcaattgcaatgggtaactggaaccaacaacgggccaacttaatgaaaagggcaccctggttgggcgggaganaanctcctggtgactaatantaatgtgggagaaacttggtcaatcaaggtggccaacaagtgggtggtcctttggacncctaactttnaagggncngagattttcctggaattggacccaaaggataacccccgaacaatccaagtnaaagtgnaaaaattcaattaataatcaaacaacaatttggtccctggtggtcaaaggggttttaaacgaagttcaaatggcaccgtnaaaaccaanaaagaagctggaaacatattttgaaagggaggtttcaaagaaaaccaacctccttttttgggnccgnttggtgaaccgtaaaccggtccgtgctgcaagggngataaattaattgaggttcccntgggaaaatttacatcaacaagtg

SEQ ID NO: 88124 - DNA, 261 bp, Triticum aestivum
  Clone ID: PAT_TA_88124
gacagggcgcgcatgtacgtcgaggcgctccgcggcagcgcgtggggcggcgaggaggccgtgctgtacgagacggagggcgagggtcacatgtattatttctccaaagccgcgagatccaactccgtcgtgccggagaaggcggcgaaggagatggccattgttgtgtccttcatcaagcgcgttacatgcaccaagtccatcggattgtaacattagatctacgttgtgaatcgaagccactcttacaaaaaaaaaaaa

SEQ ID NO: 88125 - DNA, 545 bp, Triticum aestivum
  unsure (1)..(545): unsure at all n locations
  Clone ID: PAT_TA_88125
gtcactccccgcgttttgtggggaacgagggagtcgccagctgatgcgtaccctgaccaggccaaactaattcttaaccgatgatttggctaccctgctcttccctgcaaatgtcgttgcgcagcagactccgctgatgttcaatccccattaacctcccaaatgctattattcagtccctttaacttccacggatggctgggctggcagaaagcctgcggaattgtctgtcgatcgtttagaacagagtttggtgcggcatccgaagcgttgatgtgattttggacatggtttttgttgcggggagggcttggtgccgaaaggcggatgtagttttgggtgtggtttcgctctgtctgcaatgcaggatctattgttgagcctaatgtantgcaatgtantgccgtgcaaatgttgttctctgcggtccaagatcttccggggtaagttcaagttcataancnattcgccaagtttgcatccggttaatttcaagcttaatcaaaaaggttggtccntttggatcccaaagaaacngaanccnt

SEQ ID NO: 88126 - DNA, 535 bp, Triticum aestivum
  unsure (1)..(535): unsure at all n locations
  Clone ID: PAT_TA_88126
gtttactatgttgtttgtttctttccgggttgcttctctcgttagctttggtttcgttccggagttgtgagagttcgttcgactacgtccgtttgtcttcttcatggactcgttcttcttccttgcgggatctcaggcaagatgaccataccctcgaaatcacttctatctttgcttgctagttgttcgctctattgctatgcagcgctacctaccacttgctatttcattcctcccatattgccatgaacctctaacctttgtcacccttcgtagcaaaccgttgtttggctatgttaccgcttttgctcaagcccctcttatagcgttgctagctgcaggtgaagatgaagattgctccatgttggattatgtattcgttgggatatcacaatgtctcttatattattaatgcatctatatacttggtaaaaggtggaaaggtccgnaataagcctgggggtttggtcaatcctggctccctagtttcaacaaaacgggntaaagttccctgaatttgcgttcctaacgnggg

SEQ ID NO: 88127 - DNA, 370 bp, Triticum aestivum
  unsure (1)..(370): unsure at all n locations
  Clone ID: PAT_TA_88127
gcatgctgagcggcagatgaagcttttagaagcgcaaaaccttgcagccaatgcttcaatagagggtgaaagcttgactgattcctttgccaatgtggataagtgaaatgtgtcctggtgtgggtttttctttcatgaattcctgagtttaattgtcgatggtcctttggaaacattgttgttcttcctatttccaaataatgtgtattgaagaaatgatcagtgtgagtcagtgttcgtcaagatgacaatggaaaggccatgtgagtccctaatgtgttcttggggttgctgacatgtgattatgttggactaacgatttacttgagaataatacgcagatatttagtcccaaaanaaaaaaaaaaaa

SEQ ID NO: 88128 - DNA, 394 bp, Triticum aestivum
  unsure (1)..(394): unsure at all n locations
  Clone ID: PAT_TA_88128
gtttcatcgcgcgacgatttttcccatgtaaggtaatttctcctaatctccccatgattgttgatattaaatatgtaagtctcttctttttggatggatcccgtgtaagctatttagatcaactatttcaggcatactgcagttgtcgattttacaaaacatctctccattagcttgcctgtcaatgccatatagttcaatgttaaataaattgaaatacatgaaggcagaatattgctacagattttattctactcccacgtgctcaaacttattcatacgaaattattacgcaaagctaagatncaatcaatctaataatcaatttgtacattataatgtacacacatggataattgatacaatttgttacctttttaaaaaaaaggggggg

SEQ ID NO: 88129 - DNA, 359 bp, Triticum aestivum
  Clone ID: PAT_TA_88129
gaggttggtttcagcttagtttcacttctgatggaaatgcaagtcagcctagtattctgtgctgaatccggatacagatggttgagaattccccgatcagaagttcagaacgtgtgctcaaagagggattatcacttgacattagcaaactgggtgtagaattgtagatctctgtttggcaaatgatcaatgttacaatgtagagtagtttgtcttgaatatactgaatcaaatggtggtctcaacctcgaaatgtaaatgcatgctctcgttgtcatcctacactgattcgtaaatgcagcagacaagttcagaatcagcgctttcggctgattcgattattcttgaaaaaaaaaaaa

SEQ ID NO: 88130 - DNA, 500 bp, Triticum aestivum
  unsure (1)..(500): unsure at all n locations
  Clone ID: PAT_TA_88130
aacatgggattctacactgctggtaagcacaaggagttcttctcgcgcttcatccaaccattttgaagtcatgctagtttcttcaagtgatgctgccaaacgttcctctaactgactcttctccttctgaatatcagcaacggtgttctccatttctcccctacaaagttgcaaaccatcgatctcctgttctttcagcataactgtgcgcacaagctcactgatctttgtttcgaagaaactcattgggcagaaacatgggaatctacactgctggtaagcacacggagattttcacgcgcttcatccaagcattttgaagtcatgctactttcttcaagtgatgctgccaaacgttcctctaactgactcttctctttctgaatatcaagcaaggtgttctccatttctctcgtanagtgttgcaaaacatcgatctctggtccttcaagctgaacgtcgcttcagacatcnagtcagtttnngtacaatcangttct

SEQ ID NO: 88131 - DNA, 541 bp, Triticum aestivum
  unsure (1)..(541): unsure at all n locations
  Clone ID: PAT_TA_88131
ccccaacctccgttcgccgcgattcagagcccaggtgtcgagctccttcgatacaagtacggagcgagaaggcaatggacgacttctatgtatcagacgatgagctacacgttccgttcttacctctgctcactccacgctgtgtgaccatatgccggcaatatattttggatctggctctaaagaggcttgggcttgttgtagaaagcatcaagagcacaaccaaacagcagacaacgccttctcccagcacatatgaacaacagatgacccctcctccgaagttagacatgtcaagcaagcaagttgggaaacgtgccatgtgcaatgttcgcaaagatttatttggaaaacgcaagcgcgactgcgaagagtaaaaagggattaagttcgattggatnaagcaaggcaatgcaattagccgttttgatgccgcctccaacaattataacaagttangtaccgtcctnantggnggttggtancagacactttgaagttaccgtgtgtaaaatcccttgcggttttgtanaanggttan

SEQ ID NO: 88132 - DNA, 581 bp, Triticum aestivum
  unsure (1)..(581): unsure at all n locations
  Clone ID: PAT_TA_88132
tttttttttttttttttaaagacatgaaaaaaatcgttttttcaattagtcaatcatagaaacaccgataacgtcaacaaaatcacatggcacaccaagataataactttaccaaataaacacgacacgcgtacgtggcagtacatcagctaaaagaatagaggaaatcacacggtggccggccacctaggcgcgccgcgccctgtgtaaatatcagtgcacgccaccggcaccgtgcttgtggttgtggccgccgacgccagcgtgcttgtggaggcggtgctccatggcggcctcacggtgcgccaccttctcctggtgaagctgcgcctcagcggcggcgactttggccctgccacgctcgtgcgccaaccgccgctcgtcgtgcgacctcgacgtcgcgggctccgtcttctcgggcaagtttgggccacacgatnttcgccttgggtctcaacgcggntcgggccaatccttaaccttcaccttcgcttgcngcaaccccgttggngatccttgggggtttcttggggaaccctcccggttgtcnaaccanncttgaaccccgtgccgaaattcgg

SEQ ID NO: 88133 - DNA, 306 bp, Triticum aestivum
  Clone ID: PAT_TA_88133
agaggacagagctgtagcggcgcgtggagcagcatggagggagctgagggcgaacgccatggccctgacggagctcgcgaaggcagagccgctggccggagagagcctctgcatggctagtgtccgggcagcgtctgacttgcatctggcaaatgcatccggcaaatgtacatgcagattatgggcattatctgactagtgtacgacgtagtgtatggctaatgtatggttagtatctgggtagtgttatggctaatggtttgaccattgttgactagcatctagctagttcgcaaaaaaaaaaaa

SEQ ID NO: 88134 - DNA, 525 bp, Triticum aestivum
  unsure (1)..(525): unsure at all n locations
  Clone ID: PAT_TA_88134
gacggcgagagcaacctgctggtggacccggaggagatcgggtgcctggagcgggtgagcggcctgaacgacgaggccaactgcgtggacgagctctacccggacgggcagccgtcgccgtcggcgtggcaggacctcgtcgcgtcaccgtcgagggcgtccgtgcagcgcgagctcagggccgccgtccaggcgagcgaggcgcgcttccgggccgcgtcgctggccgacggtgccctccgcggcgacgcgccggtacaaactttttgagtccggcgcgtgcggtgcgaatcatcatccgtgatgagggcgttttctttctccctttccttcttcttcctcttgacactgtcaggctggggttttccgttgggttgagtggtgctaaatgatggatggctcgccgaagaggccgtgctttctgccatctccaaacccgattcaacaatgtgtactcctctcgtatccgaaaacacacacacacacacacacacactcaacgaagcgttcggtaaaantttgtgt

SEQ ID NO: 88135 - DNA, 375 bp, Triticum aestivum
  Clone ID: PAT_TA_88135
cgagccgcaggcggcggagcacgaagcagcaacagcagcagcggcggcagcccgggtaccctgagcggcggcacctgggcggcgtgcgtcggctccacactgctcgccgcggcgcccatgctgctttaagctgctctgcatcagccagcacctagcgatttcgtgatacggctggctagcagcccagcatatgtgatttgtgtggtgtgcagtttggggtcaagatgcatggagttggatacattttcttcctctccctcgactccttcggatggcattttcttcctctcgcttgactccttcggatggcagctttatgtgattgcagtgtgttttcccaattcaaaatactcttactttgtcaaaaaaaaaaaa

SEQ ID NO: 88136 - DNA, 521 bp, Triticum aestivum
  unsure (1)..(521): unsure at all n locations
  Clone ID: PAT_TA_88136
cccaagcgcaaggagttcgggcttgacttccaccttgtacagctcttctttgtttgcatgccctcattagctgtctatttggtagcccagtatgcacgaagtgagatcaaaaggatggaagcggaagcagaagcaaaaaggaaaaaaatcgaggaagtagagaaacagaaacaacttgaggtcgactctgttaaggtggatgccgattcgaagctggcaacagttttagtcaggttagatacactggagggtgtcgttaaggaaattgcagatgacaaaatgagaagttctgcccttaccaaagaggaatctctgaagaaaggtcagacatcatctcctgataaggcctctgctccaaaaagtgatgcaagtgatantcagctagcgtcagtcaagattaaggacatcaagggatgctaccaaattctcccgccagattgcgacacaagcaaggacactaaacgggacnanagggaannacaaattgngnngtcaaattatttannanccggttttggggg

SEQ ID NO: 88137 - DNA, 537 bp, Triticum aestivum
  unsure (1)..(537): unsure at all n locations
  Clone ID: PAT_TA_88137
gagaaggttgcggctggtgagctgagttctgctatcgctctagtcagacctccaggccaccatgccgaacatagccatcccatgggatattgcctcttcaacaatgtggcaattgcagctaactacctgttaaatgaaaggcctgacctaggtatcaacaagatattaatcgtcgattgggatgttcatcatggaaatggcacgcagaacatgttttataatgaccctcgtgtattgttcttttcagtgcacagatatggttatggaagcttctacccttatgaagcggatgcatcacacgttttcattggggatgaaactggtcgagggtacaacattaatgtgccctgggagcatgcgaaatgcggtgatgcagattatgttgctgcatgggaccatgtactccttcctgttgcagaagcatttgatccggatataatattactggtccgctgggtttgaccaacaatgggtgatgaaatgggtggattgctgatcacccaaatgggtttcncggctacnaaaaaactgttnggt

SEQ ID NO: 88138 - DNA, 195 bp, Triticum aestivum
  unsure (1)..(195): unsure at all n locations
  Clone ID: PAT_TA_88138
accatcaccaggttcngttaagatatgctatctgaaagacggctttattactcgtangatgtcctggntgagcgttttcaaacctttaatgtgcatctttatgggtcngtgccttggattttgntatnaagncntcattaaatgtttaatatctggttctttgtttgtcgtttacatcaagaatnggaggtaaaa

SEQ ID NO: 88139 - DNA, 402 bp, Triticum aestivum
  Clone ID: PAT_TA_88139
ctacaggccgggtaatcgcagggatcagggcgggcgagcaatctgccgaggacctgtggtttttcctcggctacgctggttggggttacagccaactgtttgacgagctatctgaaggagcgtggcacgttagtgcagggccgatcaggcacttggaatggccagacagttagaagattcctttttagtccattttgcacatatctgctgacactacagtatggcatcatactgcagtttctcctggatcagtcggtcattcagaggcatagtgacattgtgttttaacgcccgtgtcgaggctacagaaatttttgatatatttctggttgttttgagctaaattagtttcggcacattggtgcacagttagttggatggataagggaaagcattgcattt

SEQ ID NO: 88140 - DNA, 414 bp, Triticum aestivum
  Clone ID: PAT_TA_88140
gtccgaagagagcgcatcagtgagaggctcaaagttctgcaggatcttgtacccaacggcacgaaggtggacatggtcaccatgctcgagaaggcaatcacctatgtcaagttcctgcagctgcaagtcaaggtgttggcgaccgacgagttctggccggtgcaaggagggaaggcgccggagctctcccaagtgaagaccgcgctggacgccatcctttcttcccagcagcaaccctaggccatggatgcatgcatccatgttgaatttttatccaagttttagatgatcgcggcggcacgtgtaagatcagaaaagaaaagagagcacaagctctggaaaaatacatggcaagatcatgtttttgcttcactccttttagatcaattctccttgttttttaaaaaaaaaaaa

SEQ ID NO: 88141 - DNA, 506 bp, Triticum aestivum
  unsure (1)..(506): unsure at all n locations
  Clone ID: PAT_TA_88141
gcgacaccaagtggaacaagtgcttcaagaccctcctccatgccaagagcgacatcatgaggaatgagcatatgaggaccttcctccaaggaacgagcgatatcaaaatcgctatcatgatgaagaactccgctacggcaagatcaagttcaccatgccaaagttctccgaaagcaatgatcccgaagaatatctctcatggacattgaaggtggacaatattttccgccttcacaattatgatgaagaaaagtagatcgccatggcctccctagagttccaagactatgtcctcatttggtgggaacaagtgattgagcaacgacataaaagaggtgaaccaccaatcacaacttggaaagaaatgaaggaagtcatgagagcccgcttcgtgcctactcactacactcgatatctcttcaaagaagttgcaactcctcaaagcaaggcacgaaagatggtgggaagaatactatcaagaaatggagaattgccatgatacgang

SEQ ID NO: 88142 - DNA, 485 bp, Triticum aestivum
  unsure (1)..(485): unsure at all n locations
  Clone ID: PAT_TA_88142
gcacgatgttcctctgtgttgagtaacgtgattgtattaggaaacataggttagactgggaaatattctggcttgccttgtactccaagtagatcatgtactcctatctatatgcccacgaggttcaagcaatacaataaattattccaccaaatcctctctcttccttctaatatggtatcagagccaagaggtcttgagttcaagaccctgctaacgtagtattaaaaacatcgatcccacatctaaggactaaaatagcctagacatgagggggagtgttgaaatatatcgcccacctctctccatcagttcggacttttggatgagttggctggagcatgaattcaatatggtaggttggctggagcctcaactcgggcgccgctgctccgttggtcgctcgggcctcgctgcccgggctccggcgctgctttggcagccgggtgccggtgctgacaaagctcgtncgcacgacgtccacg

SEQ ID NO: 88143 - DNA, 255 bp, Triticum aestivum
  Clone ID: PAT_TA_88143
agccagctccgccggtgtggggttggccgtgccccaagcggatatgctgaactgctgtccctgacacgtttcctggtgaagccggtgtccaccgtcaaggacgaggaggcagcggacctgactcttctgctgcatatctacatcaccaacagagcagctcctgattttttttggaaaataacatagctttgttaattgcaaataacggttacatcgcctataaaaaaagatagaatttcatctaaaaaaaaaaaa

SEQ ID NO: 88144 - DNA, 506 bp, Triticum aestivum
  unsure (1)..(506): unsure at all n locations
  Clone ID: PAT_TA_88144
gatgagggctgctgggagaaaacaggacgcagagttactccaaacggttgaggatgatttgtcttcagatgacgataatatacaggatgaaggggatgaagcttacctgcaaacttacggcagcgacgatgaggacgatgccgacgatgattccaacgaatatctctgagttgtgacagttttaaccgatgaaactccaggccactgttcttccctcgcgtggccacatagtcagaacaaggcacagttccaatcggtaaggcgacgcatggctcgtgtggtttcgacttctgcactgctacagcacaccgatagcatgtccgtagccttcaactgaagatgttgccaagtatgtggttcatatggcttgttaccaccaatgaggttgtaacttcagtgggcatccgttttgtantttgacaaaggagctccttgtcaaaatgcanactcaacganggttccccctaacaatatggccaaactgggngtttttccggaaaangagg

SEQ ID NO: 88145 - DNA, 513 bp, Triticum aestivum
  unsure (1)..(513): unsure at all n locations
  Clone ID: PAT_TA_88145
aatggattagccaatttgcagagcaaaggggccggatatagtggtgaatctttgcattgaaggttggcgataacaaatgcagttctccgtgtcgctcagacttgctctgctgtgaaggcctcgaacaatctgctacatcataaacaaatccaaaaacatttggtagtcaatcaaattttagcatggaggtacttaacaaaccaatccaaaaatatatatttgtcatttcattgttggcaggaatattttggaaatggatggccaatttgcagagcaaaggggcctgatttgggtggtgaatctttgcattgaaggttggcgatacaagaatgcagttctccgtgctgctcagattttctatgctatgacgggctcgaaacaatctgctacaatgtttaancactccaaaaaatatgtagttattaatactccgttagtcctgggaaaattttgggaatagatanncaaatttgcanagcaaagggggcctgatatangnggcgaaatcctttn

SEQ ID NO: 88146 - DNA, 254 bp, Triticum aestivum
  unsure (1)..(254): unsure at all n locations
  Clone ID: PAT_TA_88146
cggaggaggagngggcctcagaatcttcggacaccacgtccgangtacccttgcgacgaaggcngcccctagtcnccttggactccttctcgggcttcttctttggtgccttanaagacgccgggaccagcatcttcatcacgaagtgggccagcttgttcttctggcagtggggcngaacagtatgatncgtttcgccttcttcgtccagcgctgggagaatcattggngaaanattaggngttnccctcaga

SEQ ID NO: 88147 - DNA, 389 bp, Triticum aestivum
  Clone ID: PAT_TA_88147
ccggcggccaagggcgtgacgttcaaggacgcgttcgacgtcgccctcgagcgcgtcatcgaccgggtggcgaagcgccggcgcgccgccgccgagggacgggagtacgtggacagcgtcgacggaaaatatagctggaagtacgacctggcacaagatagggagaaaatgttggccccgcacgagttcgatccatatatcaacacgtaaatgcagatttgcttatgtttgtcccgcgaaatcagtcagcttcgaatcaccttttgatttggactttggagagtgggtattatttactcacttaataaagtgctcataagaaaccgtatgcacggtctattttcctccgttaaaatgtttatttatgcggatttgctaaaaaaaaaaaa

SEQ ID NO: 88148 - DNA, 530 bp, Triticum aestivum
  unsure (1)..(530): unsure at all n locations
  Clone ID: PAT_TA_88148
ttttttttttttgataaaagtgagtcagacccagcaggccagcacccatgtataaaaaaatcgtgtgaatttttttactcttgtgtataaaagaatcgcaatattaatattacaaagaaaaagaactgctacaaacttgtctgggagacaacgtccccaagtcctgagaccttttcttggctggcttgaagaagcacggctcgtttagggttggaaaccagcagctgctgcatgtcctttgggaggacactgaatgctgcttggagatctgccttcagtttctggcatgctgctattgattcagcagtacctgtccgagaattctccatctctttgagaagataccgctcaataacattaaaagaatcaatcctctccaactcagacatctttgacattaacttctcaatatcaacattcatgcgagcttgcctccataaccttatctgatcttgctctgcagcagaacgtctttgtcggnaccaaggcatgaagttagggccttccaagaattttctatataaatccaa

SEQ ID NO: 88149 - DNA, 523 bp, Triticum aestivum
  Clone ID: PAT_TA_88149
gtcacccccttttatgttgtctactaccagtctaggtgcttggtgtcttacgtgcactactccgcccaccaagttaaacaacatttcatcgtggttgcacttgcatcttgtaatgatgtattgcgcttctactttgtttcattgtcatatgcttcgtttacacatcatatatgtggatatctcgcgtcttcctgtttactgcacttattccatctgtcatcatatcatgttttttcattcaaatgtcgctcttgtttatcggacatccaaacggacgaggttgattgcagactccgaaggagtgcaaacaaagtctttctaaaagacagtgctacctgataaatcagatagtaccccaagttgctgaggaaactatgaaatcgatgtttgtctttactataatcttttcatgatgggaatatacacacatagttcctaaaaaacggaagcaattcgtgttaaaccgggaagcaagtaatgttattcatggcaattaccttttagctttcgtcgattgaacgca

SEQ ID NO: 88150 - DNA, 309 bp, Triticum aestivum
  unsure (1)..(309): unsure at all n locations
  Clone ID: PAT_TA_88150
tcaaggccgagtaccacaagaagtacaagcgctcgctcgccgacgccatccactccgagacctccggcaactaccgcaccttcctcctctccctcgtcggccgcgaccgctaacacgatctcaccaccaagaccaccttgctgatagacctgtgggtctacctgtgtatatacatctgtttcttccgactgtatggaacaactccagtgacaaagcggcgaggggcgaacgctatggctactgctcactatgttcatgttaccactgaaatgaaattgacagctactgtctttttttatcaaaaaaaan

SEQ ID NO: 88151 - DNA, 522 bp, Triticum aestivum
  unsure (1)..(522): unsure at all n locations
  Clone ID: PAT_TA_88151
gcttgaacacggttggcttgcttgagatttacctctcgcttgggttcacctgctgttctcgatcgcttctcggcccgtgctgaatatttttgtatatcagcctgatgccatctcatgagtctgggggaaacgatgtgtccatctatatctcttcagaatagaaaagaatagtaaagaaaaaaaaaccgtgtcattgtgcaactaattaagttaagtccgcatttttttagtaatctgacggtgtgattcttggtgaagaggccacgtgatttggtgtttgagcgcaacataattgtagtttattgtacatcaacgcggcattgctagatctaaatcacttgatgaaatcataaaccatattcagagaactgtagtactgtactacatgtatttgggttcaggcaatgtactgctcccggatcaaactcttgctaggtaatcaatcaatcatattgctgaaacatgtcaaaatgatgcaaggcaacangagggagagcgacgcgatctggaggaatgttccgg

SEQ ID NO: 88152 - DNA, 513 bp, Triticum aestivum
  Clone ID: PAT_TA_88152
agcccgccacgctagccgagtacacgctggggcagggcgggagccaggacttcttcgacctgtcggtcatcgacggcttcaatacgcccatgagcttccagcccgtcggcggcgcgccgtgccgtgcggcgacctgcgccgtggacatcaccagagagtgcctgccggagctgcaggtgcccggagggtgcgcgagcgcgtgcggcaagttcggcggcgacacctactgctgccggggccagttcgagcacaactgcccgccgaccaactactcgaggttcttcaagggcaagtgccccgacgcctacagctacgccaaggacgaccagaccagcaccttcacgtgcccagccggaaccaactaccagatcgtcctgtgccccgcccgaaatgatttgcacatggatcagtaagtagaggatgtattactcctagtagtcttcctcttacttattatgatcatccatcaatctgcgtgtgcccatattatatactccgtatataatgtcacat

SEQ ID NO: 88153 - DNA, 277 bp, Triticum aestivum
  Clone ID: PAT_TA_88153
agaagcagttgtatatttgtacaatagcatacaacatgttacaaaccccaaaattgatgtaccacaagctacactttatgttgactgaaagtataacaacatagcttctcatggggaaaatttgatttgcaggaatgcccaatttaacgagcagttttttgaagtaataccaggcctttaaaattcttgtgtagtttacctgatagcttcattatacacaagttactaaaatggttaaattttcatgaactgcaggttattggcgatgagagtggta

SEQ ID NO: 88154 - DNA, 372 bp, Triticum aestivum
  unsure (1)..(372): unsure at all n locations
  Clone ID: PAT_TA_88154
cgtcgacccatcgaccatgtctggatggtgggagaaggacgagcccaacggctccaaggcggtgagcctgctgctccgcctctccgcgctcatcctggccctcgcgtccgccgtcatgatggccacggncgacgactgnacnatngccggcgcgacgcccacggccgtcacctaccgggactacngggccttcgtgtacctggtggnggccaactcgccgcggtcgtgctggaggncgcgnnatctactgcantcagcncnccggtgncaatgatnncnacgggggaagccgctccagggatatcctggcctcgtcaanttctggcgcagggctcttacncntaacggcgccgctaggccgntgtccgctct

SEQ ID NO: 88155 - DNA, 467 bp, Triticum aestivum
  unsure (1)..(467): unsure at all n locations
  Clone ID: PAT_TA_88155
gctcggggccgactccagcagcggcaagcaagcaggaggtggcctgacacgtgctcgcgcgcgccggccacgcgctcgtcctcctggcaagggggaagatgacagggaggagcccctggtgggctacggccggccagctacagtgctgggacggttggtgggcgtcaggtaagttttctctgctctatttatttcggtccgttttcctttnataattcattttgcaactgtttgaactccaaacaaattganaacagtgacaacattcctctgaatattaaattgcacaatgggattatccaaaggnacataattttttcaggnntatctgaattanatccaaanntaaggatgtaaacaaatccaatccantatggnttaanttaaatgccaaaatatccttaaaatgtcataattttggttgggaaaaancctgccaaatttcaanttcagnnggttatttgggt

SEQ ID NO: 88156 - DNA, 400 bp, Triticum aestivum
  unsure (1)..(400): unsure at all n locations
  Clone ID: PAT_TA_88156
tgatgattggtggacgccaataataccctgctctttcccctctcttcttcctcctccggcctccctgtcgctccgccccatccatccgcgcctccaaataaagtaagcgcggncacccgcaccaccgaatcctcctccgcctcgcaacccgccctcgccctcncgccatcgcctccctccgcgcgaccgtcaagccttctcttgcggagganagggagnacncgtgcgcnggcgcaatggcttcnggaaggcttctnaaaggggccngaanctcttttnaagaanaatggngtttaatgangggncccaaaatggggggaaaatcncttggnaatntnttgcaaaaggggtttnagnaaaaaatntcccaaaggggttnaatttgaangggcnccagggg

SEQ ID NO: 88157 - DNA, 567 bp, Triticum aestivum
  unsure (1)..(567): unsure at all n locations
  Clone ID: PAT_TA_88157
gtagcttggnatcacngttgtttaatttcctgtgcattttgatcttatgctgaaaacattgcacttaatcacacttactgtcttaatgacaaggcagaacacctgccggttagccttaaaaaaatcacacttgctgtgaaatatcaactcattcactcagcttttaaagtatcgtgtattttttattggtcaactcagtacacatcacaccctactataaagtacccctccgtcccgaattacttgtcttagatttgtctagatacggatgtatctagacactaatctaagacaaactttttggggatggaggtaatacccagtacattactaacatatgtctacttattattttcacattatctaaacgaatattcatgagcatangaaaaatggtattaattctccacangtctcgtcacctccttctatacaagagcaaaacatccacccagtgcaattctgnacagcatcatcatacgtcattagacacaaatgcggccggctnaacatacacatcactggaatatgaanccgactggacnatatcgataggtagaaacagng

SEQ ID NO: 88158 - DNA, 566 bp, Triticum aestivum
  unsure (1)..(566): unsure at all n locations
  Clone ID: PAT_TA_88158
gttcaacctnccttcctttgnccgataanagtgcgacctatgacaatttgncncanacagatttttncctgaaanctcaggacaactttacacataanggtcacagtatcctacngttattaccacaaatcagttaaccattanctgaacangataccgatgtaagttaancatatttnctttttttnaggtgaatgaaccgttttttngagtaaggtngcttgcccaacaggtataagttgacacaantccgagttaatagacacagaatgagaacacngctgggttaaccctggattctcctccaacggngcttttaaaaatgagttgggacccaataggaaagtgccacctanaggctaacncaaggtggttgggaaggcacaaaggngttacaaatgaaagctanaggtgttaagtngaaccccggggttaacaatttggggacatnctaacggattgtanccaagcggataattcctttgaacaatctttcaccggaangganaaanantgccctggatcccactgtgnaaggngnaggancccgattcgggaaanacang

SEQ ID NO: 88159 - DNA, 514 bp, Triticum aestivum
  unsure (1)..(514): unsure at all n locations
  Clone ID: PAT_TA_88159
aaggcctagggctcgagtcgagtcgaatcgaagcggaggcggcggcggcggcgaccggcggcggagacaccgtcgtcgagcggcggccgcgtcgtcccgtcaagctgtctcagcagttggatcggcggcgtgtggcgtgcgtcggcggaggcggacccgacggggtgtagggcgtgctcgtcntaaaanaccgccgacggggacanagcgtgaaagngtcaaaacctcggatgctgtccgaatatcccctcnanttcaaggattggatccctgcaagggtnctgccaagacgananaaaccttnaagggtcaaaccttggntgtgttccgaacgttcaaccggatttaggtttggtnnctgcaggctgtgctgacaactcnaaaaggtntgacttccaaaantaaagctaacaaattntcaaaaggnatnaagggatgggggtccaaaggaanngccaaaaatgccctaaagtttggaaaataaaacccccagnccanggnttnaactccgaat

SEQ ID NO: 88160 - DNA, 514 bp, Triticum aestivum
  unsure (1)..(514): unsure at all n locations
  Clone ID: PAT_TA_88160
ctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatggccggtactgggacaatgtggaagctgcctatgttcgggtgcaccgacgccacgcagtgatcaacgangtggaggaggcaagaaggattacctgacgcgtatgtccnatcatcggattcacaacatcgcaagtgcaatgctnnacttatcgcctnaagcaacgggctgcaagatccggnaaggctaaanactnatcacaagggcaaataaaangcatggggttngtaaccnnanatgcttgggtttccttcaattaacttctgttgtccaanaaa

SEQ ID NO: 88161 - DNA, 255 bp, Triticum aestivum
  unsure (1)..(255): unsure at all n locations
  Clone ID: PAT_TA_88161
tagncncnagtttttttttttttttttttttttttttttttttttgaaatacacangcatgaaaatncattangangattccaaatattttacacngctgtaactactatacactatatattganacaatgacgggnaagccggactatattttnaagtgcccncaaatggggaataggagccgaaaaagtataacangagacangatctccctctgccccgaaanatgaaatggacatacttcacaacaaaaca

SEQ ID NO: 88162 - DNA, 554 bp, Triticum aestivum
  unsure (1)..(554): unsure at all n locations
  Clone ID: PAT_TA_88162
acatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaattcgagaccctgtcctacctgccaccgctcagcacggaggccctcctcaagcagtcgactacctgatccgctccaatgggtgccttgcctcaagttcagcaagttgggtttacttccgtgagcacacgcatcccctgggtactacnatggcggtactgganatgtggaagtgcctatttcgggtgcacgacgcaccagtgatcacangtgaggagtcaanangatacctgaccctatttcggataatcggattcanaantgtcaggtcatgcgncnctcacgcttaatcacgggtgcangatccgnanggctaacagcnaccacanggcaantaanncatggggttgcancnaaatgnttggtttctt

SEQ ID NO: 88163 - DNA, 572 bp, Triticum aestivum
  unsure (1)..(572): unsure at all n locations
  Clone ID: PAT_TA_88163
caacatggcagcgtctctccaagccgcggctacgctgatgccggccaagatcggcggccgggcctcctccgcgcggccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccactctgccctcctcgtctccggcgcgagcgcggagggggcgcccaaagaggctgaccttcgacganttcaagagcaagacctacatggaggtgaagggtaccggaccgcgaacaatgcccgacatcgacggnggcgtcnatcctccccttcaangccggnantacgagatgaagattctgcctggaccactcctcaacgtcaaggccgngggntcaaaaaaaagagcgccggcttcaaaaaacaagtaagaccgttaactanccttgacaaaaggaagccntcaaggtcggccgnggacctaattnngggaagggggatcataggggcgtacngaaccccgggggaanggtncttcttnagnaa

SEQ ID NO: 88164 - DNA, 472 bp, Triticum aestivum
  unsure (1)..(472): unsure at all n locations
  Clone ID: PAT_TA_88164
cccgcgtacnaagccaccgaccaacatggcagcgtctctccaagccgcggccacgctgatgccggccaagatcggcggccgggcctcctccgcgcgaccgtcgtcgcacgtcgcccgggcgttcggngtcgacgctggcgccaggatcacctgctccctgcagtccgacatcagggaggtcgcaagcaagtgcgccgacgccgccaagatggccggcttcgccctcnccacctctgccctcctcgtctccggcgcgancgcggatggggcgcccaagangctgaccttcgacganatccanagcaagacctacatggncgtgaagggtancggtaccgtnaaccagtgcccgaccatcggacngcggtgtcnatcnttccccttcaagccggnaagtacganatgaanaattctgcntggagccactccttnncgtcaaggcgagggatcaagaagacagcgcggcttcaga

SEQ ID NO: 88165 - DNA, 554 bp, Triticum aestivum
  unsure (1)..(554): unsure at all n locations
  Clone ID: PAT_TA_88165
tttagatgcaacatttcggatttgcagtgcgtggtaatcctgttgaaggtatgctcttgtgtttcttcaagttccaactatgattttaaattggggctaagcgagtgaagagatttaggttcgttatgttctcaccattgctagggctttcatgctagacggacatttctgtgcgacatggcaatgtgagtgttttcctacttatgtttagttcctgaatctcaataaaataaaactataaaaacctgagctacctctacactcacagagcttacaagttgggcataattaggatgaacacacatctttaccttatcagggtgacccccaacaggaagtacttcgcatctaatgagaatgatacgcgcaaccttgttttagcttgctcgaactgaagaatctcctgggnagaaatgttgtgttcacatggaactaatatgaacaagtatgatagtaacactaattncataaaaacatcacacgtctgaatataggttancactaattgcantaaaatagcaccgtcggaaaaaangggggnacgggngggttcc

SEQ ID NO: 88166 - DNA, 451 bp, Triticum aestivum
  unsure (1)..(451): unsure at all n locations
  Clone ID: PAT_TA_88166
aagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgngtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgcaagttgnangcgtcagttcatcgcnttaancaacggggctgcaaagatccggnaaggctnaaanagttaatcacaanggccaaatttaagngcattgcggtttgcaaacccgaaattgcttgggttccctcccaattaccttcgggttgtccaaaaa

SEQ ID NO: 88167 - DNA, 584 bp, Triticum aestivum
  unsure (1)..(584): unsure at all n locations
  Clone ID: PAT_TA_88167
gccgagtgagatagaagcagcacagcttccgcttccggtcctcgccatcgattcgctcatggnctccacctcctactgcgccactccatctccgtccctacgatgctctgccgccttcttccccaccttcgcctctccgcctcccgccctccgcttcgccgtccctccgctcctcccccgccgtctcgccatatccccaccgagagttcgaattccggcggtggcgtcagcgctggagtccctagtgcaggagtccgatgacgaggacgaggaggacgacgggtctgggctgttcanggacgaggcgtgggcgtcggnggacganagggacgcggtgcggtccccggagctggtggtgcccgagctggaggagctgcccgagcagtggcgccgctccaggattgcctggctctgcaagagtcccgcctacaagcactcaacttcaccgcatcctcaacgcccagcgcaatggtcaccaggaggacgcactagtcgcgtaactgctcccatccgctaaagacccgcttcggtgttagctgatggagcggagactggacgctnaacttgcgctgcacagggggggt

SEQ ID NO: 88168 - DNA, 433 bp, Triticum aestivum
  unsure (1)..(433): unsure at all n locations
  Clone ID: PAT_TA_88168
ggaacctcagcaatggcttctggcgctcaagcagcgaagatggttgcactgagcatgatgctggccatcctgctcgccaccacggccgactccaatccccagccagacggcacctgctccgtggagtgcgcctgcgccgagcagtgcagccgccagtaccctcgcatcgacgatgacccccctttcaagatcactcctgtctgcacacaccgcacggagcacgagctctacgctcgcctctacctgcacaatacttttcaagggggaatataggaaccaacacaaagtattgagcagtgtgtccaaaataatttggntcctgggtgcnaaggattgggtnatcacgganaacctggcnntnaacaaaggtnnggccacccaaggggatccattcangccggatgggncccaaacaaaanntttttnaaaaggg

SEQ ID NO: 88169 - DNA, 392 bp, Triticum aestivum
  unsure (1)..(392): unsure at all n locations
  Clone ID: PAT_TA_88169
agagagcgagagagagaactagtctcgagtttttttttttttttttttgagctcggcagcatatactccatgtccctttttcttcttctgtctagtacaaaagaaaggaaaccctcgggcaataagtcacgttcgtgtgatcaatagccaacaggtacacgatgcgtacagttgccatatactttgtcccatgcacgcatacacactacccggtgctctggccgtctttgcgtttcgcatctcantcngacgagccgggccagacattgaacggcagcgagacgtccttgataacgggggngangcngaaggganacgctggcgccaanggacaagatttggnccgcccacctgcgggccnaacacaccagacgtcgangcnganttcaaaa

SEQ ID NO: 88170 - DNA, 559 bp, Triticum aestivum
  unsure (1)..(559): unsure at all n locations
  Clone ID: PAT_TA_88170
cagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaagtcgggttatcttccgtgagcacaatgcgtctcccgggtactacgacggccgctactggacaatgtggaagtgctatttcgggtgcaccgacgccacaaggtatcaagaggtggaggaggtcaagaaggatacctgacggtacntcgcatatcggattcganacatgcgcaagtgagtggtcagttattgcttnaacaacgggctgcaagatcggaaggctaaanagtcatcacaagggcanataaaaggcattgatttgcaccnaattgcttggg

SEQ ID NO: 88171 - DNA, 524 bp, Triticum aestivum
  unsure (1)..(524): unsure at all n locations
  Clone ID: PAT_TA_88171
gttagaaaacatgggtgctaccgtcttcgaccccgcacgaccgccagtatcctttcctccgacgccactctgggaattgggatgcgggccaaccgccgatccgttaccggccaccatatcatcaaggaaatcatggccgaatcgacctgtgtgcggcgttgctctaacatgcccgccacttcacctctcctccaatgtctcgcttgagtgtgggagcgcgccgggctgccgtttagttgccgaaccccgaaatcacagatcctcggtcaaggcagaaccgctaaggatctacccgccgttgctttgcacagcagcgagggcctcgcccagagccagtttcgtgggctgcccggtggaatcatgcttgtgcttccgacgaatttgacgacggcggcaagcatccgcaaccacagccgatttcccgacgcgggttgaatcggtcaattcggatcggcgcttactgatcacatctgcatctgtcatttgctgcnaagtgtacctcaatgttgtgccaatatacaggt

SEQ ID NO: 88172 - DNA, 545 bp, Triticum aestivum
  unsure (1)..(545): unsure at all n locations
  Clone ID: PAT_TA_88172
cgacaggtggcaatgcagaagagggtaaaagcgtaaaaagcaaggtagttggtacagttgcttgtacagtgcccccctacctaactctaacggcaggggacatgggcattaaatgcctgtctgagtcgcccgaacagtgcagagaaggaccgttaggggcgccatcgttcgccacgatggtgatctcgtcagcgcctgatcgccacctcgcacccctagctgcacggcctcctgccacgtgtgcttggttgggttccagagcgacacgttagcaggtgagctggagcgcgggcaggaagtgggggtttcccgcggcaagctccttgccgcggtcgtcgtcttgtcgctgctgctttcttgtcgggcccggaagcttgtcgctcaccgggcttcgagtacttggtcagtctcccggcaagctcctcttgccggggcttgtccctnccggagcgcgtggcgctccggcagtttcctggatccttggtggctccggaagctctctgccgggtccgtccttccggnagatctcntgcgggccttgnntn

SEQ ID NO: 88173 - DNA, 532 bp, Triticum aestivum
  unsure (1)..(532): unsure at all n locations
  Clone ID: PAT_TA_88173
ggaggatcatgctcctgctgctgatgcggatgctgctctcgtcgacctcgcacagggtggcaaatccgccgtgcacgctgcccagctcgatgctgaagctatgggttcggctcccccttcgaccttgccacggaccgacggacggcgtccacgctgtgcccgccgctcatgttgtggacgcccttgatgattatggcgccgacgcgggcgcccgactatgctcaggttcttgccgaccgcctcgcaacttggatgtgaacatcgagttcactttcaccgatgaaatccaaaacaaaatgcccttgcaaggtcagtactacttttgctttaactgattatcaactttttagtgtttcttctgaaatgtccaaattccaagtatcatacagtacaattgtaaaaatgttttgggactttcacgacctgtgcatagcccgccatcagcaagccacagtcctttcgcttggtccctcaacacacgacatgtaaagtaggtctcgtcaactactagcaaaattaatactacaaagtn

SEQ ID NO: 88174 - DNA, 520 bp, Triticum aestivum
  unsure (1)..(520): unsure at all n locations
  Clone ID: PAT_TA_88174
ccaccttcggcgccgcgtatctcaccttcacgtgcacaccgcctgctcgacgcaattccccacacgcccgccaactcaccaacctccccgatggcaaccgccaccgccaccgccgcggcggccccttccacctcctcgtcgctcctcctccgccgacccctccctccaaattccacggccgcgcgctgcctcgcgccaccacggtgccgcgcgcgcctccgcaccgcgcgccaggtcgccgtcagcagcgtgtccccatccccgtcccccgactggcggacnaggaggccgcggccgcgccaaagctcggnaancgcntgcncgtaanggcgccggtcggcgtctacatntcccaagggnccggnctggcctcgnggnaaggaaggttggtcaancagtatgtcgttctggaagggaaggcatcagggcaatcccnttccgggggagttnanctcanctgganggacaganaaccggtaggttctcctcactcgggaggacattcgattcgtanaaanan

SEQ ID NO: 88175 - DNA, 161 bp, Triticum aestivum
  Clone ID: PAT_TA_88175
ttcaaaataaaaatcacattattcaggaactagtgtacaaggtttctgatcacaccattcttcagcgaatttttcagaacaagaactggcctgagaaagtactccaaggaactccttgtacaaggttccttggaactgatagcatatactcatgggggggg

SEQ ID NO: 88176 - DNA, 523 bp, Triticum aestivum
  unsure (1)..(523): unsure at all n locations
  Clone ID: PAT_TA_88176
ggagggcatccctccggaccagcagcgcttgatctttgctggcaagcagctcgaggatggccgcaccctggcagactacaacatccagaaggagtccacccttcacctggtgctcaggctccgtggtggcatgcagatatttgtgaagaccctcaccggcaagaccatcaccctcgaggttgagtcctcggacaccattgataatgtgaaggccaagatccaggacaaggagggtatcccaccggaccagcagcgtctcatcttcgctggcaagcagcttgaggatggccgcacccttgcagactacaacatccagaaggagtccacccttcacttggtgctcangctccgtggtggtatgcagatcttcgtcaagacctcactggcaagacatcaccttgagttgagtctcggacacatcgacaacttaaggcaagtcaagacaagagggantccccggacaaagcgtctactcctggcaacactgaggatggcgcaccctgcggntaaaatcagaaggatc

SEQ ID NO: 88177 - DNA, 524 bp, Triticum aestivum
  unsure (1)..(524): unsure at all n locations
  Clone ID: PAT_TA_88177
gcctatgcaacattcaatccatattattgtagaaacatgacatggcttttcacatttattccatttcaacatttctagaatcatgcgttccaaagagcccttagcgcacctccaatcgggctcggctaatttaactcatacgtggacacactcagacgttgttcgagcgtgtcctcttcaagtcctcatttgtctatgcactcagccatgacctcctaaattgcccggtcacgtgcgtatgattggtgaggattgggggaggtggggaggagtaaaggaagataaacacttgtctatggtgggtaggatcagacgcggtggactggacatgcccggacaccctcatatcatccccatatacaggctggatttgaggcgtgttggacaatccagacatataaggatgattttggggctagttgggtangactctcactctctcatctcaaacattgttcgggttgtccgcacgncatataggaggaaatgtgtcgttcnggcgggaaggaagtggggggggggcg

SEQ ID NO: 88178 - DNA, 392 bp, Triticum aestivum
  unsure (1)..(392): unsure at all n locations
  Clone ID: PAT_TA_88178
gttttgtgccccattctaaagaagttcagtaaatgtgtacgtcccatcgtgatacaacaacttgatctttgttttatttttcacaagaatctattttttgcttacatgaagggatgcatgttcttcatcttgcaggtatgactcatcctgacattcttacttcgcctttgtttccttcagcttcttgatcctgaaattttaagataaattgtaagtactcggtatcatattattaagcaaagctacaattttttgcttgaattacagtgttttctctaacctatgtatagtgtcaataaaaatctaaattacaagatggagatacattttctggtggatcttacatcacagtaatttacaaccaagataggttacaatgtcttcntagcnca

SEQ ID NO: 88179 - DNA, 295 bp, Triticum aestivum
  unsure (1)..(295): unsure at all n locations
  Clone ID: PAT_TA_88179
gtccaatctgaagtcccccagccaccttcatcttctgtaaagcccgcctcaacttcgtgccgaaagaagaactccggcacctcgtttgtcacgcaactgagggatcacttccacgagtttattcatgcctccatggacgaacacaggacatgcttaacaaacactgtcaagaaattgtttgcnatgtcaaagggagtccaagaggggactgctggggcaaaanaactgganctgaaaacgtttgcaantcaanagtgaatntcacggtaaaaacatngangcaangnaattcggt

SEQ ID NO: 88180 - DNA, 287 bp, Triticum aestivum
  unsure (1)..(287): unsure at all n locations
  Clone ID: PAT_TA_88180
cgccacacacgcacgtacagaggagcgatgcccttgccccattcccgaccgcctctcccctgcgtccatcctcgtcccgagccaccaccaaccaccacgagctccaccatgggccctgacgtcggtgaccgacgccgtcccatccgcgcctcctcctccctcctcttggccacgatgccccgcgcctctccgctccctgcaaccccatggcgcccgtcctcggncaccctgtcatgccccttcctcctctgcctagcccccaatgcctgggggcctccncntgtgcc

SEQ ID NO: 88181 - DNA, 393 bp, Triticum aestivum
  Clone ID: PAT_TA_88181
tttttatttcgtttcttttttatttataccttctcttctttatctttagttttatctacttatcaatagtatctaccggctcgaactcgaatttgatcgccttccatacttcacaagctgcggctagttcaggactccatttgcaagctgctcggataatttcattaccttcgcgagcaagatcgcgcccttcgttacgagcttgtacacaggcttctaaagccactcgattagctgctgcaccaggtgcatttccccaaggatgtcctaaagttcctccaccaaattgtaatacagaatcgtccccaaagatttcggtcagagctggatatgccaaacatgaataccacctgaagctaccggtataacacctggcatcgagttttttttttt

SEQ ID NO: 88182 - DNA, 262 bp, Triticum aestivum
  unsure (1)..(262): unsure at all n locations
  Clone ID: PAT_TA_88182
cggaggagagaagagaaagcgaagctcccgtgctcgcgcgacgacgacgacgacgaccccggccgcggcgacgatgagccccctccgcgccctcctcgtcctcgccgccgtcctcgcggcgtgcctcggccccgcggccgcggaccagcccggatccgtcgagggatacaccatcgccgggccgcatcaagatnacgctgcaaaggggntttggncttcaaccnaggaattcanncacnaaggtgatnttaagggggggnaa

SEQ ID NO: 88183 - DNA, 448 bp, Triticum aestivum
  unsure (1)..(448): unsure at all n locations
  Clone ID: PAT_TA_88183
acattgacttgtcacacatacacaggttactattattcttgaattggcaacacatttaaataaaactgtgataaagacatttccatagtatgccacgcttaaatttggccgagtcccggtttttctttttcttttattggcgggaacgttgagccccattaaggaatattttgtgaaattgaagccgtacatatcatacatttttcttagaaaaggagattggagccacatatatcacacatttttagattgacaagccatgcaaaatgtccaaaacacanatatgtttgccttcangatatatatcaaatatgtaccggtaaagcagcatgtttaacgcatatgcattgcttagagaacttattgcttttaanaaagctcattggagtcacggatagtttgtctcaccatcgagtaacataaatcatattagtggaanncnccaggt

SEQ ID NO: 88184 - DNA, 501 bp, Triticum aestivum
  unsure (1)..(501): unsure at all n locations
  Clone ID: PAT_TA_88184
ctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaacttgaggatatcgtccttcatcccanaactgtgacgtccccatgttgaccgccangattatcagctgattgaataactgatgatggtattcagcttcnaactaaagtggaacacnaggntgactgannctccacgaagattccnntgggcaantaaaaggttttnnngaaagggntttttttntnttccccnggngaaaaaaatttccttnaaaaaaccggggggaaaaaaaaa

SEQ ID NO: 88185 - DNA, 578 bp, Triticum aestivum
  unsure (1)..(578): unsure at all n locations
  Clone ID: PAT_TA_88185
gaaatctagggcaagccgcacgcacgccacccaaattcccgtagccctacgccaccatccgccgccaccgccaccgccggcggcgagtctcggcgggggcagaagcggccgaggagcaccccttcgccccccgaatcaggccccgaggggaagaataagagggggagaagggggcaagtcagccctccccgttcgatcggaggcagcatctctcccccggaaggtcgccggcggagcaaccgctgatgcggcggccatggcgtcggcggtgctctcgtacattcaaagcctgtggccgctctcggctctcctgaaggaggacgacctgggcgcctccgcgcggctggtgcggaccctctccgtgcccgaggagacgaagcagttcgtgttcgcgatcgggagcccgagaccanggcttgctctacatcctcgcggcgcagaactctccgagcatccgctttggacgccggaatctgataggcggtcgcccgggcctgataccaagtcgccacaagagtcaggactttatcangacatgctgctaagcgagcggcgctgcnggtccataangtatannt

SEQ ID NO: 88186 - DNA, 266 bp, Triticum aestivum
  unsure (1)..(266): unsure at all n locations
  Clone ID: PAT_TA_88186
gtgatggnttcctcggccacctccgtcncacccttccanggtctcaagtccaccncgggcctgcncgtcagccgccgctccaccagcgccngactcngcagcgtcagcancngcggaaggatcaggtgcatgcacgtgtggccgattgagggcatcanagaagttcnngaccctgtcttanttgccacccctctccacggaggccctcctgaancangtcgactacttgatccgctccaagtgngtgccctgcctcnagttcagca

SEQ ID NO: 88187 - DNA, 568 bp, Triticum aestivum
  unsure (1)..(568): unsure at all n locations
  Clone ID: PAT_TA_88187
ctccgatcgacccgaggctcgtcgaacccttcttccccaccgcctcaagatgcagatcttcgtgaagacactcacgggcaagaccatcacccttgaggtggagtcgtctgacaccatcgacaacgtgaaggccaagatccaggacaaggagggcattcccccggaccagcagcgccttatcttcgctggcaagcagctggaggacggtcgcacccttgccgactacaacatccagaaggaatccaccctccacctggtgctccgcctgcgtggtggcatgcagatcttcgtgaagaccctcaccggcaagaccatcactctggaggttgatagctccgacaccattgacaacgtcaaggctaagatcaggacaaggagggattccccggaccagcagcgccttatcttcgcagnaagcagctggaggatggtcgcaccttgccgactacaacatcagaaggatcaccttaactggtgctccgcctcgtgtggtatgaatttctgaagacctacggaagatatacctgagtnagactctaacatcacaantcagacaagttcagacagg

SEQ ID NO: 88188 - DNA, 582 bp, Triticum aestivum
  unsure (1)..(582): unsure at all n locations
  Clone ID: PAT_TA_88188
aattaacctgtcttcaacagttggatgaatttgtggtccgtacagacaaaggatataagatcagtgaattgaaggaaatgaaggagattagagggcatatttgtattaagaatatcgagtgtgtggctagcatagaggaagcaattggagcttttctaagcgagaaggcgttcatcagcatcctagaccttatctggtccgataacaggcacatagcatcagaagaagcaaatcaagacaaaaggatacttgaggtctccggccacatcatgaactgaacgactaactgtcaaggcatttgcaggtcctccttcccaantgggttggtancttcccactgcaaacctccactgtctgatgtacaaaatgttcgaccctaccacacggggagactgcctcaaccaatattanaatggnggttcccggcatatcaanagcaagnttcaggacaaggantaatggttcaacacgaaagacctatcaagctggtattnagaggtggctagtcagatggaattctcgcctaagactgatatggctgccaatacaagttcacctccacancaggagccaatttcacgg

SEQ ID NO: 88189 - DNA, 574 bp, Triticum aestivum
  unsure (1)..(574): unsure at all n locations
  Clone ID: PAT_TA_88189
ggcggncaagcacctgcngtcccgcgcccgcctcctcctgacccgccancgcagccgccccaccatcctcncgcccncnctcacccgcntcctcttcggnnggaccaccaccccctccgggccggangangacgacaaggccagggcccgggcggcggncgtggccctggacgccaagaggtctaagcggganggttcggannacgacnacaagggcnccggnctgccctgtactcctggnggccnacntggcntgagtgaccaaagcactcnagccggcgctgcanntctacaaacatacanctggaaccattcgntctgacaaatcccccnngcagcgcacttttaacgagatcanacgtgactccagnacagcacngtaccataaagactgggccttacgacttacgtcngctctactcatnacttagcanctctaanagatgtcngcttaaggcgtcagatcctcaataagagtaanaataattanacntaacccaaaggtgtataggntgcactggcttcaagatatatgtcgncacgattttanttgnaggtcatattcactgntcat

SEQ ID NO: 88190 - DNA, 500 bp, Triticum aestivum
  unsure (1)..(500): unsure at all n locations
  Clone ID: PAT_TA_88190
cctcgattcgcggagccctcgcctccaacantccncaagcatccgatgccgacccccntcaattcacgcccccacacgctgcatcggcnccctccggngctccgcctcntgccncagatccgtgcacccctcgccctctcnagactcgatgattcacanatccgcccagctgcccaggcaccgactaccggngtccggatctcctgctccantgntcnctgcctcggggctctctggcgttggctcagcgcggtgggccccccaatacgctagntccggatcnccccancacccangccncacaggncaagcagcggnaccgattctgacgaacnanagaactccccgcgnttaaagaggaggaggttaggagcgaccaccgagatcngntttaacatccgctcccgntctaagggttgtcncngtttctaagaagnactaatgacgtgtctgntctcaggttgnaatttngcttagatagtgncancatnctccggtta

SEQ ID NO: 88191 - DNA, 352 bp, Triticum aestivum
  unsure (1)..(352): unsure at all n locations
  Clone ID: PAT_TA_88191
cagtcctcggttcccggtccggtcccgttccgttcgttagggtttantagtagcggggaagaggaaggaatggcggacgtcgagtaccgctgcttcgtcggcggcctcgcctgggccaccgacgaccagtccctccagaacgccttctccaagtacggcgacgtcatcgactccaagatcatcactgacagggagacnggccgatcccgcggnttcgggttcgtcaccttcgcntcagacgangcnatgcgccanggcgatcgncgncatnaacggacatnacctggacgggcgcaacancnngtagcgangcgcagtcgcgttgcnccggcntcggaagcctnaggcntca

SEQ ID NO: 88192 - DNA, 592 bp, Triticum aestivum
  unsure (1)..(592): unsure at all n locations
  Clone ID: PAT_TA_88192
taacgctagagcaattcaggtcgtctggttcaataatattttcaagacgtagttagaacagtttgattttttggcactggaggagcgccatctagaatagtaggtcctgataacgaaagtgatattggacataagcgtatacctgaagtatcagatggacgtttgttttgatctttgatacgcttatccttgttcctccaataagcagctcgccgcagggcgtttctatggtctcttgcgttcttcttctgttttttgctctatttctccgtgtgccattcaaaatacatctggaatatagtcacacgttccagaaaatagggatcataccacttagatgctagcaatgctgtttgagtangaacaatttgattaccttgtactcgttgtcattaacgtccagatgagaccgtattgtacaagaaagttgaccacatcgagaatgatgtatactaatggttgtcggtgaacaaagtgtcaacatataacataataatanacgtacaacataangtaacatatagttacgcaaatttggcgtgagtcacttggatagttgctctcgcntagagccnccagggttcaggcnccn

SEQ ID NO: 88193 - DNA, 569 bp, Triticum aestivum
  unsure (1)..(569): unsure at all n locations
  Clone ID: PAT_TA_88193
aacaaattatatactgtgatctatctttcatacttatatacatattatgcttggacgtgtgttgtttgtgcgaaaggaaacatctagtattttgtaatgcttgaactgagggtagtcactacttaaatatttctccaattaatcaagtaagaacagttcttcagaacattttatcattttaatcttcagacatcttgataggaagcactagggaatgtttgcattttcaatttatattgtacgtaaaggactatagatatgttctctgccagtcaaaacttctaaatgatctatgcactatggagtgccgcagtggatactccaaatgactgcacacacttttattaatcctatcagtatatggantcaataactttggtgctaaacaatggngcntaccantacaatcagtanaccgtaagatttacagcagcttgggaaaantttggatggtgttatccacggtcatgantgagtatcangtaacgtntncccattcagtncaggagaaatacagcnggaactattagcncnttgttgcnaaaaaacgaagtggtacctcaattatg

SEQ ID NO: 88194 - DNA, 580 bp, Triticum aestivum
  unsure (1)..(580): unsure at all n locations
  Clone ID: PAT_TA_88194
aagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggcctcctcaagcaggtcgactacctgatccgctccaagtggtgccttgcctcgattcagcaagttggntcatcttccgtgagcacaacgcactcctgggtactacgatggcgtattggcatgtggaactgcctatttcggtgcactgacccacacagtgtcaacgagtggaggagtcaagaagatacctgaccctattccgcatcatccgatcgacacatgctcaggtgaatgctcactatcgctnnagcacggctgcaggatcggaagccaaacgccatccaaggcattnaagncattcattttgcacccgaatgcttggtttctccattacttcnattt

SEQ ID NO: 88195 - DNA, 582 bp, Triticum aestivum
  unsure (1)..(582): unsure at all n locations
  Clone ID: PAT_TA_88195
caanagttatagggagggacttatgtcaccacaaacagaanctaangcangtgttggatttaaagctggngttaaagattataaattgacttactacaccccagagtatgaaactaaggatactgatatcttggtagcattccgagtaagtcctcatcctggggttccgcccgaagaagcangggctgcagtagntgccgaatcttctactggtacatggacaactgtttggactgatggacttaccagtcttgatcgttacaaaggacgatgctatcacatcgagcctgttgctggggaanacagccaatggatcgttatgtanctnaccantanacctanttgaanaggttcctnacnaacatgtttacntccantgtaggtaacgtatttggttcaaancctacgtgnctacgttggaggtcncaatcccccactatcaaacttcaaggccgctcatgggncacttgaanannattgacagttggctccttatggattctatancaagtggatttcncaaactangagncttntagtgcactgcggtttattacantatagaaactnccaacattagcg

SEQ ID NO: 88196 - DNA, 584 bp, Triticum aestivum
  unsure (1)..(584): unsure at all n locations
  Clone ID: PAT_TA_88196
caccgagacgcagcccagcttctccatgacgccgtgcaggccatgtgctgctgccgccgcataggggggcggctgcaccgtgcactgtcggcagttggtacaggccgtgacaccacccgccgggagatagtggtcgagggcatcgcctcgccgttgtcatggtctgcgacttcgccgaggttgccgcctgcgcgtgcaggttgcggtcctcgggcgctctgcgccggaggacgtcggcatgctgcgcatcggaaatcgaggccgagcagagcgtcgagggggcgccaacgcaccgcgtgctgaggagcgccgagcggttgacggcgagcgtcaccgcgccacactcggggctgccgttccctgcgctctccgcgtgatggaggtgggatcngggtcaacgcctgaaggccgccacgtttccgacgcagagcaaccggggtgccgtgtcagtcatcatgggncgagcaaacaagcgatcctctcatgacttcttgatggctatgcacaacgcacacaatcagaacatgtatngtnagaattacttcntatcgtccataaccannaaaaaaacggggccgnccatt

SEQ ID NO: 88197 - DNA, 369 bp, Triticum aestivum
  unsure (1)..(369): unsure at all n locations
  Clone ID: PAT_TA_88197
accacgcggtcaacagcgcgaacgcatcgggagatccaaagatcccacagctccatccccactcgttccgatccattcatttcaccttctcgtgatctcttggcgcgtgtggatacagccatcangcatcagccatggctgccggaggaggagtggtgctcaacctgcgcgtcccgtcggcgtcagtggcgccggcgcggcggtgtgggacggcgtcgtcgtcgtcggtgagatgctggggcgcgcgcggggcggcgccggcgaggcatacgggcggggcgctggaggatgaccactaccggacgctgangctggcgccgggggccancatgggncatgtcaanagggcttccaccgcctcgcgctgca

SEQ ID NO: 88198 - DNA, 180 bp, Triticum aestivum
  unsure (1)..(180): unsure at all n locations
  Clone ID: PAT_TA_88198
caaaagaggagttccggcccccgtnancaggtcctgggttnnctgaagcnganctgttctcggccagntcncgcaaangctggcanagcttnaagcgaaggttcattctcttgaanaanaaccttctgaaatgccttgcgaaaaagnagagctgcctaatgncgctgtccgncacattaa

SEQ ID NO: 88199 - DNA, 571 bp, Triticum aestivum
  unsure (1)..(571): unsure at all n locations
  Clone ID: PAT_TA_88199
gccgcctcctctcggttccttctccttcctcggagctccagccatgggtaaggagaagactcacatcaacatcgtggtcattggccatgtcgactctggcaagtcgacaaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaattcgagaccaccaagtactactgcaccgtcattgatgcccctggtcaccgtgactcatcaagaacatgattactggtactcccaggctgactgtgctgtgctcatcattgactccacactggtggtttgangtggtatctccaaggatggcagaccgtgagacccctcctgcttcaccttggagtaacagatatctgctgctgcaacaagatggncgcacaccccangtaccaaaggccgtataggaaatgcaaggatcctctaccgaagagtcgcacaccnanaggtcctt

SEQ ID NO: 88200 - DNA, 562 bp, Triticum aestivum
  unsure (1)..(562): unsure at all n locations
  Clone ID: PAT_TA_88200
agtgtgaaggtgttggctctgaaggtccgtttcagagtgcccaaagaagtgagaactttgctgtgtttcttgagatgcttccctggagtagataccttacacatcatggcttccgacaacgacaccgaccactacgatgacccgggtgaagtcaagcccagcgacatgctcaagtccacattctggcagggggtcagtccgatcaaatgcgtgaagtcgcgcgtccagaagctggtgttcgaccagttcactgggggcacgaaccaggttgattcctgaagctggtcttgggggantgtgttgctgcagaaggtgattgtcctgctggccggccggatctctctccatcgtgaggcacgagcaactgcaccgttggctccaagagatgtgggcgattaaggctcgggcagactccttggaggccgtgggcnccggaggcagtttggagtatgacgaacgtcgatcttctatcggagaccgttactcntaagcggtacnacggtgtttcaatggctgcagccatacgttgatgctttcctgtaaaggacacatancatagtac

SEQ ID NO: 88201 - DNA, 481 bp, Triticum aestivum
  unsure (1)..(481): unsure at all n locations
  Clone ID: PAT_TA_88201
naccaatcccccggaaacgaanccctanccagcggnggcggnngcgatgggcaacccggnnaanctgatggngcagatcttcgacctcaagttcangtccaagtcgctgcancggnaggcgcgcaagtgcgataangatgagaaggagcagaagctcaaggtgaanaaagccatcnagaagggcaacntggacngcgcncggatctacgccgnaaacgccatccgnaagcgcactnancacatganctanntccgactcgcctcccgcctcgacgccgtcgtcacgcgcctcgacacgcangccaagatgcangccatcggcangtccatgggcagcatcncangtccncaactcctccctcgccangggcacnctccatcaacattccgagacatgnncanctccagcgcagttcgtcaacatggaggtcannncgattatgganggcncatggccgntnaatcctctccaacctngacg

SEQ ID NO: 88202 - DNA, 381 bp, Triticum aestivum
  unsure (1)..(381): unsure at all n locations
  Clone ID: PAT_TA_88202
atttgacgggactattctgcacaccgccgccggtgcancttccagccacgccacgccacgccaggcgggtatatatgcgcgcaacacttggacncnatctattgacgacggccgggcggtgccangcacgtacgtaaccttccatggangcgggtgcggggccaccnaagcccgcngtcacggcnaaggtggcgtcgtcgtcgtcgtcgttctcgtccgtggccgccanggtcgcgagcctggtggnggtcngtctgggangcgcgncgctgctggtgtggtgggcgctggcttccacccggngcacgcngngcactggatgntgcccgcnntgatggtcctccncggcacgctcgtcctcggctgnctctnactcatcgc

SEQ ID NO: 88203 - DNA, 567 bp, Triticum aestivum
  unsure (1)..(567): unsure at all n locations
  Clone ID: PAT_TA_88203
cagaccaggagcgccctctctcccccgccccctccccccaggaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaggtggaagacttgagcgaatcggaaaaggcccctatgtggccaaggcaacaactcaagggcgagtacaacaaggcattgctgcctacaacaagggcgagacgctgctgctgctgcccaaagaagctgcggcaaggagtagaggagaagngaagaggatctgacaatcaatcggagncatgacgacatgacgataagcagcatangacaggacatgacantgaanaaaccatctgtanggtgctcggcgaaatcggactctgtcaaaacgnctactttg

SEQ ID NO: 88204 - DNA, 573 bp, Triticum aestivum
  unsure (1)..(573): unsure at all n locations
  Clone ID: PAT_TA_88204
ctttgaccccatcgcccctccgtcctcttcgtctccggtaggccaggtagttaacagctccagcagccatgggaaaggagaagatccacatcagcattgtggtcattggccatgtcgactctggcaagtcaaccacgactggccacctcatctacaagcttggaggcattgacaagcgtgtgattgagaggtttgagaaggaagccgctgagatgaacaagaggtctttcaagtatgcctgggtgcttgacaagctcaaggctgagcgtgagaggggtatcaccattgatattgctctgtggaaattcgagaccaccaagtactcctgcactgtcattgatgctcctggtcaccgtgatttcatcaagaacatgatcaccgggactcccaggctgattgtgctgtgcttatcattgacccacacggtggtttgaggtggtatctccaaggatggcagaccgtnagcacctctcttgcttcaccctggtgtgaacagatatcgctgctgaacaagatgatgcacacccantatcgaagccgtatnagaattnagaatcctcatactagaagtgg

SEQ ID NO: 88205 - DNA, 184 bp, Triticum aestivum
  unsure (1)..(184): unsure at all n locations
  Clone ID: PAT_TA_88205
ccatccaaatcccccgccgcccccctcgcggangangaggncggcggccatggnatacgagaggaaggggttccagccccacctgatgggcctgggcggngggaggctgaggggcnctgcgggggcgatgggcctgcanaagcaganctcgtggtcgcccnacatctancnggacnaggngtgg

SEQ ID NO: 88206 - DNA, 587 bp, Triticum aestivum
  unsure (1)..(587): unsure at all n locations
  Clone ID: PAT_TA_88206
agtagattgggagtacgttcatatattttcttccccacgaaactaatcgctgtctacgtatcagagactatcatcgaaccatgactcttatctccacgggagggccgcctcatgctccgtcgtcggagatctcccaccgcgcccacccggggcacaagctgatgctggtgccgacgggccaggccgtgttcaagtgcgacggctgccatgagcacggcacgggcggcgataggtacacctgcctgcagccgtcttgcgacttcgacctccacaaggactgcgccctcgcacagcccaccttcaagcaccagctgctgcccgatagcacgttcgactctccttcgagcccccccgtgccaagcacaggcagctatgcagtgcctgcggcgactacgtgaaggnttgcactacacggctacagaaggactgtactccaccgtgctgccaactgcctctggagatctctgggtgatagctaattcagctcgcccggagggtccactgcgnacaanncagaaagtgcgngtaggattcggtcacgcncactcaaacgttactgattcgcgcnganaagttctcgcgaccat

SEQ ID NO: 88207 - DNA, 583 bp, Triticum aestivum
  unsure (1)..(583): unsure at all n locations
  Clone ID: PAT_TA_88207
gctaactagagcttccagcaatggcgacctccgcggtgctcttcctcctcctcgctgtttttgccgccggtgccagcgcggccaccttcaacatcaagaacaactgcggctccacaatttggccggcgggcatcccggtgggtgggggcttcgagctgggcgcaggccagacgtccagcatcaacgtgcccgcgggcaccaaagccgggaggatatgggctcgcaccgggtgctccttcaatggcggcagcgggagctgccggaccggcgactgcggcggccagctgtcctgctccctctccgggcggcaccagcaacgctggccgagtacaccatcggcggcggcggcaccaggactctacgacatctcggtgatcgacggttcaacttgccatggactctcgtgcacaccggcgaccgctccagtgcanggatccagctgcccgccgccgcaagctacaacacccaacgacaagcaacacctgcatggatataactacagatacttcgccataagnttcagtccacacaatataaaaggtctaattacggctaaataaaggtctgctataataatacaatn

SEQ ID NO: 88208 - DNA, 591 bp, Triticum aestivum
  unsure (1)..(591): unsure at all n locations
  Clone ID: PAT_TA_88208
tggtgtctttctttcaaaagatgtgcctggttctaaccatattgggccaattatccatgacgaggaggtttttgcatctgatgttgttacttgtgttggccagattattggaattgttgtggcagatacccatgataacgcaaaagctgctgcaaataaagtaaatattgagtattctgagctgccagcaatcctctcaatatcggaagctgtcaaagctggtagctttcatcccaataccacaagatgcctttcaaatggggatgttgaacaatgttttgcatccaatacatgcgataaaattatagaaggagaaattcgagtcgggggtcaagacacttctacatggaacctcaatgcacttttgtctggcagttgattctggaaatgaaatcatgatctcatctactcaactcccagaacatcagaatatgttgctaatgccctggcttcacatcaaaantgttgcaagacaagcgtantggtggcggttggtggaaagaacagatagaatattcggcgcgnatcgtgctcaatgtcaagaagcagtaagatgtttgcanggatttncatatacacngcaagnaantn

SEQ ID NO: 88209 - DNA, 472 bp, Triticum aestivum
  Clone ID: PAT_TA_88209
gaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccagctgcggctgctcctgctgcagctgctagatccatcatcgatcatgcatgcaccgtgccgtgcgtgcatcatcgatcgtatcgatctactactaccataccatgtaaccgcaacctgatcgagggctttattacgcacctgactgcatcagcatcagtgccatgccatgattgtaacaggcccctaaataaaactccttgattaaaa

SEQ ID NO: 88210 - DNA, 573 bp, Triticum aestivum
  unsure (1)..(573): unsure at all n locations
  Clone ID: PAT_TA_88210
caaactaattantttacctctttggnagaatgtntctngtctcttggcacccctanctccntgttcncntcntcctctgtcntgccgannacctccacacctcnggtgntatcnctgnaanaaatnaactggtcnanaatggattttcaactgatctgaancttgacggcaaagctttgtggatagatnacctgttgagtgtanccaatggcncaggnggnaaaagcgnncatgntttctgcatatatccccnaatntttcanaataatcccggtggngntatctcctccttctcaacaacntttgtnttcgtcatgggcttcaacagtataaagtaatgggatggcntcanacttcancaccactgncataccatangatcccacnnattacttggtatcccgcatctaanttatntgncagcttcatcgccgtcagttcnaaccgtcttgatcctnagatccggacatcgatgacaacagttgggattgatgnaaagctgnntaattganccaactgctgggtcanaactcacgtagttcaangtttccaaatcgnacnatcagntggtgg

SEQ ID NO: 88211 - DNA, 525 bp, Triticum aestivum
  unsure (1)..(525): unsure at all n locations
  Clone ID: PAT_TA_88211
cacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggatccggcaagnctaaacagctcactcacgacaggcatatataaagtgccattgcattttgtcaactctgacattgcttggtttcctcctcaattaccttctaattgtcccaaaaatattgtatgtcattcaagttcaacatggcccagaaacatgccnttgaaaatgcatcgtggtatttatgacgnccataattntacatattcacanaacgtttatgn

SEQ ID NO: 88212 - DNA, 574 bp, Triticum aestivum
  unsure (1)..(574): unsure at all n locations
  Clone ID: PAT_TA_88212
gcaacatctactggctattcaaactatccctcagctttgttttttgcaaacatcaactctagaggctatccacatcttgagtctaatatgtcatcaccttgcctaatttggcctgcattcctcagggatgatggaagtctatatattcctcgaaatgacttggctagtggttcaaccaatgtgcagcagagttcgtcatctttagctcaaaatgtattgtcgtcagatgctgaaaaccagcagtctgaccagtctgtaacccctatggatgtatgtccaggggaaccatctgcgtctagtgatgttcaaatgccttccacgagcaacagctgccactccggcaatagcaggctcaggtctgctgttgatcgtatgccagtgaatcatcacactagtgggtagatgtcaaatgttctaagaatcanaggtggaacacatcacatccctcagtgaccgctactgggagtgcttttgcatggtggtgatggccaaatcagcagtgctctatcatacgattccgcggcatacagaggtaatcacacancctcangcccagcttgctcgtcagggntga

SEQ ID NO: 88213 - DNA, 455 bp, Triticum aestivum
  unsure (1)..(455): unsure at all n locations
  Clone ID: PAT_TA_88213
cttctgtttctcccacgccacacactctcccacctaaacctaaacctaggtcacctgccgccgccgcctgacttgccagccgatttgctcgcgttgttgccgtctcttccaccaccagcggtgcctcccaaatcctccttctagcatgtggtgcttccccatgttccaaccccaaggtgatgccttaacagaaggcatgacaggagaagaggaagcgagatccaccgcgagcgaagaaggccgggcggcgaccatggcacgcccagatcggccagcgccgtcgacgtcgagtcctctgctcccagtgccagtccgcctcgggtccatctccacaaccaccacctacagcgccatggaaggtgctctgcgtgcttgctcttcccttcctgggacgccgctgctccgaccatggacattagnggaaaagngacggcnggaancatttcctcagaaaa

SEQ ID NO: 88214 - DNA, 583 bp, Triticum aestivum
  unsure (1)..(583): unsure at all n locations
  Clone ID: PAT_TA_88214
cccatccccgccgccgcctcctctcggttccttctccttcctcggagcttcagccatgggtaaagagaagactcacatcaacatcgtggtcattggccatgtcgactctggcaagtcgaccaccactggccatctgatctacaagcttggaggtattgacaagcgtgtgatcgagaggttcgagaaggaagccgccgagatgaacaagaggtctttcaagtacgcctgggtgcttgacaagctgaaggccgagcgtgagaggggtatcaccattgatattgccctgtgggaattcgagaccaccaagtactactgcaccgtcattgatctcctggtcaccgtgactcatcaagaacatgattactgggtactcccaggctgactgtgctgtgctcatcattgactccacactggtggtttgaggtggtattccaagganggcaaccgtgagcagcctccntgcttcaccctggagtgaacanatgtngcgctgtaacaaatggcgcacacccaataccaaaggcgttcaagaaattcaggaatcctcgactaaaagtcgtacacctacaggtccttgtccatc

SEQ ID NO: 88215 - DNA, 460 bp, Triticum aestivum
  unsure (1)..(460): unsure at all n locations
  Clone ID: PAT_TA_88215
ntctactgnacngccgcanccatggtgaantactcgacngatcccgccaatcncaccaagtcngncaaggccatggnccgggacctgcgtgttcatttcaagancactagggaaacancatttgccctgaggaanatgtcgctcaacaaggccaagaggtaccttgaggatgtgttggcacacaagcaagccatccccttcncggaggtactgccgtggngttggacncacagccangtgaacaaacgtcaacccaangggcacggatctggtctgccaagtctgctaanttcgtcctggatctccaaaaaatgnngaaacaatgctangtaaaagncttgaagttgangtctctaaattcaacatcaaattnncaagccagnanaacgcnccgngcancgtgccaangagctnnaccnaaattcaancaancacatgnctgtttntcgaaaagaaaccg

SEQ ID NO: 88216 - DNA, 450 bp, Triticum aestivum
  unsure (1)..(450): unsure at all n locations
  Clone ID: PAT_TA_88216
ggcttctgcacagcatctccatcatcattatcagtacatcctacggaggtgagttaggatgcacttgatcccagaaaggtatctatccttctaaccataggagtgcttcaaactaacaacagtacataatatccaacaaaagagggtcatgctatagcagcatgacacatggctcaatctagatatcagtacgaatcaagttgtgcatatttgctgttggcatgaaccacatcaccgcatgtcgggtttgcaaaagccatccatcgcatggatgcttgatgcctttcacacactaaagatatctgggcaacaantgtgtcgacganctccgggatatggtgattcatgaaaccatggtatgatgtgtaaacacantccccctgggcgaatggattgcatagcacgatatcatcatcggtgatatgtcnatgatggtggtgatcggtatga

SEQ ID NO: 88217 - DNA, 584 bp, Triticum aestivum
  unsure (1)..(584): unsure at all n locations
  Clone ID: PAT_TA_88217
cgtgtttagggatttgtcttgatttgctgcttgcggttcggacggtttgatgctcgtggttcgggtagggctagcacaatcgctcccaggttataaattattattattgccaatttcgagagctgacctggtagattacctggtctaggtaggtgtgattgtaaaataacgccacgaaattttaaagcgggtactgggattctgctcatcacctgttctacattgtatttgattgcatgttgcctttgtaggcactaggcagatcatgtgtctacaaactgtttggatctggttcagatctttgaaagaaaaaaaagatcatccaggattaatccttggaggcatatttttatagaagaaactctaagcaccacggccactcangactcgagacgggtgggcaactcgctcctgcgagcctaacaacaaggtgacacctgttctcggttagtactggtgttggatccaggacaagcgaactgaatcaaagatgatcagtcatgagaagtgtgcatctgtaactggtaacaattcagttccacagcctctagntgacttacacacatatcaaanatcattgtatt

SEQ ID NO: 88218 - DNA, 595 bp, Triticum aestivum
  unsure (1)..(595): unsure at all n locations
  Clone ID: PAT_TA_88218
ggtcactactagatctcccgaggttgctaaagtaattagccccacgtatcactatgagttaccttgcttaaaaggtgacgtattctggaagttcttcaaattatgtgcatttggatccacgagttctgtcgacaaccgtgagtcactagagtgcattgggaagaatatacttccaaagttgaagggcaacccattggctgccaagactattggacgtttgttgaggatggacctaagtacaacacattgggaaaatataatggaaagtgaactctggcaagtagaacaaacggagaatgacattttgccggcccttcgactgagctatatgtaccttcctcagaacctgaaaagatgctctcaatctgtgcaatgtatcccaaggatcacaaatttgagatgcgtttttagctgatatttggactgcacatggatatcgggaatcccaaaaanacactcacttaatgcccntgcaaatcgtcatcttcaaaaacatcccatacagttcaaggagtaatcagatctgagcatgtacggaancttccaaggatgatgctcacanaacacccgtacataataggtcctcacggtcgtn

SEQ ID NO: 88219 - DNA, 401 bp, Triticum aestivum
  unsure (1)..(401): unsure at all n locations
  Clone ID: PAT_TA_88219
caggagtgccgcgataagttcatgagtaagganaagtacatgaaggtaattcttaaggccttgtacttacttccttcatttagtaattcatagccttagcgctcaagtttctatttgctaacttaggcccctccganatggtgtgcggatcggatggattgttgggagttgttggncaatgcgtggngcncanaacaatggatggccacccacaangaggccaaggacaaacgtgcccaaatggaaggtgtgccacaccancaaggcagctccaacttatttcagtanaggcngaactgggtatgtggtttgcttcatgattcatgcaattcattcatcatgcnanctttagccctttaattactaanttactttgttcctctttcaggcacactacataa

SEQ ID NO: 88220 - DNA, 584 bp, Triticum aestivum
  unsure (1)..(584): unsure at all n locations
  Clone ID: PAT_TA_88220
ctctcccccgcgtcgatcccatcctcctctcccccgcatcgccgctggcctcaccccaacaggcgccacaaccggcgacttcgcctctcaccgccaccccctctcatcccctcccgtcgtggaagatcgagcgacaaccgcggcgtgggcgggcggcgccaacacgctgctctcggccgcggagctgctcccgccgggccacccggacccgtccgtcgcctgctcgcctcccgcggcgtcttctccgagcacacagccgacggaggacggaggccggagggggtacgcgcttgtgctggcgtggccccggttccacaaggccatgctcgaccccgctggcgccgagcccttcgcatgcgcccactccggcgtccccgcctacgcctactacggacatgaccgggaggcgaactggtgatcacgacgacgaacatctactaaggaatcctgctcggcgatctctcttctcagattccagcgcgtggtcagaaggatttcctgacatgtgcatggcgtctgttggatcgaaggaagaatnaaaatctgttataagcgtggatatgntgatcagtgtaagtantncg

SEQ ID NO: 88221 - DNA, 574 bp, Triticum aestivum
  unsure (1)..(574): unsure at all n locations
  Clone ID: PAT_TA_88221
ctccccttccctttccttcccttcccttcccttcccttccctagaaagagagacctcctcctcacgccggccaccgcaaaacacacagccactacacaaacaaacagacaaacaagatgttcgccgacgccggcttcagcttctccgcctactcgccgccggggccaggctactcatactccccgctcttctcctcctccccctcctccttctcctccccatctgcatccacccacgctgctccgccgccgccacctctccctctccctctccctctcctgcacaccaacaacaacaacatcaagccgccgccgccgccgccgccatgtaccaccacctcggagacatggggcagccatccctgatatcagagtacgactgggaacagaggggactgttcaagntccggagcccataatcgagagcgntgtggcctcgaccggtancgcgcatctcgatatgtcggnggganactcatggacacatataaggctcgaatgggctgaacaagtgttcaatnnanaagagtatgggaancgcacgaggaacattcgagtctgactcagatccatnn

SEQ ID NO: 88222 - DNA, 594 bp, Triticum aestivum
  unsure (1)..(594): unsure at all n locations
  Clone ID: PAT_TA_88222
tgctgctgggagggttggggatggctgtagaattttgaaggagatggtggatgctggctaccgcgctgacctcaaaacatacaacatactcattggcggtctgtgtggtataggtcgggaggataaggcacatcagatgtttcagattgtccttcangaggagctagtgccaagctctgagactgtttcacagttactagtttgctatgctgataagggtgagatggttaatttttttggattggttgacaaattggttgagctgagcttgcctgccgtagaatttttagcagacttcttgaggctctttgcatgcaanggcggtagggaattgaangccgtggaattgttcaagactttgagacaaaaaggtattgcagtgttaacatttataacatcctattgagaatctgccaagatcaaggagaggagaaacattattactgttgaggaaatgaaactcagatgactgcgagcagaacatgtcatatanctatattcatgtttgtgnataangaatattaagagctgtcagcacaccatgataaggtgaatgnacaatcttaccaacgtccncnaaaggcatcaagattg

SEQ ID NO: 88223 - DNA, 596 bp, Triticum aestivum
  unsure (1)..(596): unsure at all n locations
  Clone ID: PAT_TA_88223
cagacacatagatcaaacaaaagtgaaaccccaatggcctccagtttgctgataatcatactcccgggtgccactatagctcttggcgctactgctttttgcttctactcttggtgcctatcaatcggaaagaaacttgagaaaggcaaggtcgaagcttctattgatctggaagacccggtaagccatcagttaatctctcatgtcgatcttgtccgcgccacagataattttagtgaagataacatgttgggatctgggggctttggaaaagtttttaagggccaactgagcagcggtttggtggttgcaataaaggtctcgatatgcggtccaagcacagcgttaagagctttgacgcggaatgtcgtgtgtttcgcatggcgcgtcaccgcaacctgatacgggtaattaacacatgctataacatggactcatagcactggcgttgcagtacatgccaacggcagctagcatgcactnacaccagaagatgggcaagacaatcggttctagaagtagcctagctgagtacatgcaangatactgcacatggtacataatggttgatgtgctgagccacatgttgttggnng

SEQ ID NO: 88224 - DNA, 572 bp, Triticum aestivum
  unsure (1)..(572): unsure at all n locations
  Clone ID: PAT_TA_88224
ggcactgcaaccttcatgctccagagctgagaggtgagctttatcgaccccaccaccaccactagacgtttttcctttagttgctgcagagctattcgtgctaatccacgagatgagtatactggtgattacggtagacctgcaatgctgccgctgcaagaagntgatcaagaatgtcctcgagtgtctcaaagaggattactgcatcaagaagattgagtacgaggacaaggacaacagggtgatcgtccgtgggaaattcgacgcggacaagctctgcaaaaagatctggtgcaaggcctgcaaggccgtcaaggagatcgagatcgtaaaacaatggccgccaccgccgccgccgccgcccccatgccagacaagccaaagaaacacatgcgcatgcacatgcccgcctccgcctgaccgccaaaacatgcacatgcacatccgcctccgcccaancgcaaaacatgtcattcaccgaagcatgccgcggtctgacacaacatcaaactgnccaaacatccgtcgagccaacatcaaactgaggcaaacatccggcgacaaaacatnat

SEQ ID NO: 88225 - DNA, 384 bp, Triticum aestivum
  unsure (1)..(384): unsure at all n locations
  Clone ID: PAT_TA_88225
caacagttatanggagggacttatgtcaccacaaacagaaactaaagcaggtgttggntttaaagcnggngttaaanattacaaattgacntactacaccccactagtangaaacnaaggatacnganatcttggcancattccgantaagtcctcancctgnggttccnttggnanaagcangggctgcagtagctgccgaaatcttctacnggaacatggncaactgtttggactgatggacttaccaggtcctgatcgnctacaaaggncnatgctatcacatcnancccgttgcaggggaagacanccaatngatcngttnngtcgctnacccatnagacctanttgannagggttccgttncancatcttactcattga

SEQ ID NO: 88226 - DNA, 569 bp, Triticum aestivum
  unsure (1)..(569): unsure at all n locations
  Clone ID: PAT_TA_88226
ctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggttggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaangttgggttcatcttccgtgagcacaacgcatctcctggtactacgatggccggtattggacaatgtggaactgctatttcgggtgcactgacgccacacagtgatcaacgaggngangagncangaagatacctgaccgtattcccatcatcggatcacacatctcngtgaatgcgtagctatcgcctcaancaacgggcncaagatcggaaggctancagtcctacacagcattanaatgcatgagttgtnt

SEQ ID NO: 88227 - DNA, 569 bp, Triticum aestivum
  unsure (1)..(569): unsure at all n locations
  Clone ID: PAT_TA_88227
ctcggcagcgtcatcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcatgnnaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggataccctgacgcgtattccgcatcatcggattcgacaacatgcgtcaggtgcaatgcgtcagctcatcgccttcaagcaacgggctgcgaagatccggaaggctaaacactcatcacacaggcatatataaatgcatgcatttgtaacctgaattgcttggtttcctcncattaacttctantgtccnaganatgtgtagtcantcaagtcaaatggccnanaacagcctagtaatcntcgtgcattatcacgccaat

SEQ ID NO: 88228 - DNA, 569 bp, Triticum aestivum
  unsure (1)..(569): unsure at all n locations
  Clone ID: PAT_TA_88228
aaaaggccaatggaatattattattatgtgttacaaagttcatacaaagaatatatattgtagtgctctaaatataaattaaaatattgtagtccttggttaatgcattgttttttctttttgatccagaatgatatttgaagataaggaattagtatgagatgctttatgtcgtttaaacaattggataagattaaacacatgtggtgccgaattggcaatccttcatccttattttcttgataattgtcggagtcctggacttgggggtatccagtcctgcctacctgcagcccaccacgtggctccatcgacggcctggtacggccagcttcgacaacaacacagcaagacgacgccaagaccccgaaggatttggagagatctatgcantacctcatgaggccagatgacatgancatgactacaaggcaatgggcgcaagcggccagatgcagttccccttgttcaaggaggaagcatagagcgatccgaggatcancaangttcatcggtgcacagacaaacgcagatgncggacgagtcacacgancatgangtccacanat

SEQ ID NO: 88229 - DNA, 589 bp, Triticum aestivum
  unsure (1)..(589): unsure at all n locations
  Clone ID: PAT_TA_88229
gcatcctctgccggacctcccctacttcgccttggtccgccgccactgcccatcgcgtcgtccttcgtcaagtcctgcgctgccgccgttcgagaggaggacgacggagccgtgcccctgcgttgacttctcatcgagacgctccagccggcccatcgcttcagcccgccagcgaatcntcaaagcccagccacccgctgctagttttgtttttcctgcaggcctccctcttcatctggtcgggccagacccaaagtgagcagctcccaccagcccagttccctcagatttcagcccatttgtttttttcctttgtccagcgaatttgcatttaacgagtgcatgcatattacagaaatgccatttcttgcattgctcataattaaataactgtgcaccggattaaaatgatctctatatgaaactgctagaattcatcaatttataatatgcagctcatcagtttaaatgtcaaaaagcattgttaaattgccctagtatgttaaatggtaatcatactaatacgtactcaaactaaaacttanagtaatgggagataagcattacangggctacttgagttaaaatn

SEQ ID NO: 88230 - DNA, 589 bp, Triticum aestivum
  unsure (1)..(589): unsure at all n locations
  Clone ID: PAT_TA_88230
ttttttttttttttattatgtgcatgtgcatatacatagccaccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatntgactttatatgtggcccgtggtgagtgagctgtttangccttgccggactcctcgcagcccggtggcttgaaggcaatgaagctgacgcactgcacctggcgcatgttgtcgaatccgatgatgcggacgtacgcgtcagggtactccttcttgacctcctccacctcgttgatcacctgtgtggcgtcggtgcaccccgaacatacgcagcntcacattgtcagtacggccgtcntagtacccgggaaccatgtgccacngaagataaccgacctgctgaaccaangaaggaccactgggcggtnagggatccactnctgangaggcncctgctancggtggaggaanaaggtccnactctgatgccccatggcanctncagcaccggatctcaacgtgcnt

SEQ ID NO: 88231 - DNA, 555 bp, Triticum aestivum
  unsure (1)..(555): unsure at all n locations
  Clone ID: PAT_TA_88231
cctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggcggtactggacaatgtggaagctgcctatgttcgggtgcaccgacgccacacaagtgatcaacaagtggaggaggtcaagaaggatacctgacgctattccgcatcatcggatcgacaacatcgcagtgagtcgtagctcatcgcctcagcaccggctcaagatcggaaggctaaanctatacacggg

SEQ ID NO: 88232 - DNA, 564 bp, Triticum aestivum
  unsure (1)..(564): unsure at all n locations
  Clone ID: PAT_TA_88232
cttggacgcgacgggcgcggaggcgaccgagcagggaaactgcactcgcttcgtcggcgctcacagctgcgagaagcggcctgtaatgatggacctgggccccggcacgccgtacaaccttcaggtcgccaactgctgccggggcggtgtcctgtcttcgctcgtgcagaacagcaaggcggccacatcgacgttcaggatgatcgtcggcaactttgctccttccagcgacggcggcccccagatgccattcaatttcagcattggggtgccaggttacacttgcagcaatgccacagtggtgcccccatccaggacccagttcgacaagcagcggcacatccaggccttaatgacttggcaggtcttgtgcttctactcacagacagtggcggcccacggaatcttgctgcgtgtcgctctcatgtctacagtacgtggtcgtggagtgtccgcgttcatctgcgggctgccagtgactcatgcgcccagtcaaggaccaaggcgagctgctgccgatcatggcacattgccaatcagtnacggacatagaagacacgggan

SEQ ID NO: 88233 - DNA, 554 bp, Triticum aestivum
  unsure (1)..(554): unsure at all n locations
  Clone ID: PAT_TA_88233
acatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtggtgccttgccttgattcagcaagtcggntcatcttccgtgagcacaatgcnctcccgggtactacgacggcgctactgggacatgtggaactgcctatttcgggtgcaccgacccacacagtgatcaacaagtggaggaggcaagaagatacctgaccgtactccgcatcatcggatcgacacatcgcaagtgatgcgtagctcatgcctcaagcacgggctcaagatcggaaggctaaaagctatcacacggcaatataaatgcantnagtttgcactcgaaatng

SEQ ID NO: 88234 - DNA, 455 bp, Triticum aestivum
  unsure (1)..(455): unsure at all n locations
  Clone ID: PAT_TA_88234
ctcctccctcatcactagccaccgcaacaagggatttgccacccctcctccatcatcaccagtcgcagcaccaggagatttgtcgccgccgagatccancgccttgtaaggtcctcgggtcagccttgtcgtgcccaccactctgtcgaccagatctgtgcccttgactccctcttctctcgcgtctcgcggtgccttctgctccaccatgccgcagttaagttgtggatgacggggccatggaccggtccttaaggagagaangaagatgatggtgagagaangaaaganaggagggataangagagaggaaaganganagtngccacanaaatcttgatganatctgacgatcaatagnatagaanaagttancngaatgggtnatgaannaatgtcananttatggtancgaatggntacatnnatcacagtnagtttnagttacantgttg

SEQ ID NO: 88235 - DNA, 544 bp, Triticum aestivum
  unsure (1)..(544): unsure at all n locations
  Clone ID: PAT_TA_88235
cttgatcttatcggtggtagtgctacaagcgagtgacactagttcttgcaccgatcagatccaacttctgcacaggatgctggacaagctgtgggacgacgtggtggccgggcctcgcccggagacgggcctcgacaagctccgccgggccgccgccacccaacccctcgccatcaacacaggtacagtttatatacgttagtccagaggtaccgacatggcctgaaactgttgagaagaacgtaagaactagcacgagtagttttcagaagaagatttgatgcttaaccggaggatctgttgggtttattattgtgtgaactgacggcggtttacatggatgttggtggaggtgcagctgcangggaggcgattaagcatcgccgtcgatgccgacgacccgaccacccggtgacccgtcgtcgtcacccgccgcgcgcggcagctgtggcggagctttcacccggganaactgncacaagnctcgggcaactctcgacgccgancaatcccacgtcacacggactncctnccatatnaatnn

SEQ ID NO: 88236 - DNA, 543 bp, Triticum aestivum
  unsure (1)..(543): unsure at all n locations
  Clone ID: PAT_TA_88236
caacatggcagcgtctctccaagccgcggctacgctgatgccggccaagatcggcggccgggcctcctccgcgcggccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggggcgtcactccttccccttcaaggcggcaagtacgagatgaagaattctgcctggagccactcctcacgtcaaggcgagggcatcagaagaacagcgcggctcagaagacaactataccgttaactaacctgacantgaagccgtcangtcgcgcnaggacctaantcagganaggaggatcacntcggcgtactncaccc

SEQ ID NO: 88237 - DNA, 519 bp, Triticum aestivum
  unsure (1)..(519): unsure at all n locations
  Clone ID: PAT_TA_88237
aacaaggtcaacgcaacagagttgaaggaaatattaaggttgcttttgtcctctgatctgctgtttggtcttcatctattactctgttggttcatcatctgctcggttggaggttgtttttggtcctgccntttgttcttgttagagctcactaaaatataacttgaaggtcctctgcagtgctggtttttactaatttttgctttaatctagaacaataggcagtaattccacatttgtacttgggcgtcccgtgctttcttgggaataaatatgtcctgtttttattagctatgaagatcattctacctttccgtcagtgtgcactcctttgatctgcatcctgttaatttgtaaaaaatctgttccatgtttgcttacagtacaagacatacttcctaactttttgtgtgataatccgaatgctttgtaagctaattacntgttgttaatctgcacaagngtccaattcgattccgttcgaccgttggtccaatcnaatttgtctcacacanantt

SEQ ID NO: 88238 - DNA, 510 bp, Triticum aestivum
  unsure (1)..(510): unsure at all n locations
  Clone ID: PAT_TA_88238
ttttttttttttttttttcttttttttttgcaacaaatccattcttattaatggacgcctttgcatgatctaagactggttgcaatgcggacgacaggaaagaatgaaaagagaaaggaggccatgcatgaatctcaagcttattccacttctgctgctgctgctcaaggactccacagttggtgactaggatcttggtgtagggccggttgaaccctcgctctgccaccaccgctctcttgtccccgatcagcttcgccaccttgaagtaggccgagccggtgttgtccttgacggtggccacggcggccatcctgccgacgacgtccatgccggcgacgacgcggcccaccaccagcgccgaccgtccagctcgggggatcctggtggcgatcacaactccgtgccgttgggcacaccccgctgctcccctcgatnttaancgccgcccgcgcacanctcggttcngcggcgaagccngtccnacacattaaacgccccgcgcgtcat

SEQ ID NO: 88239 - DNA, 531 bp, Triticum aestivum
  unsure (1)..(531): unsure at all n locations
  Clone ID: PAT_TA_88239
gtcaagctgcccggcggcgaagagctggccaggagcgtcgtacggaaggtggccccgaatttgccttcggtggcaccaccgtcatccctggttgaagatcgaaagcggttcacccgtcgaacgttcaccctcgacgntggggacatccaacgactcaagcaacgcatcgttcatctaggtgaatcccacggcgcacccttgcctcactcgccgtcaactttcaccgctgtcgtcgcgctcgcctggacatgcttcgcccggtgcaagccattctccccagaggacgacgcgcagctcttcttcttcgccgacacccgcgcccgccttgatccgcccgttgatgtagggtacatcggtgcgtgtctcaccgggttgatatcgaactccccgtgccggacttcgtggtgaccgccctggcanccgcgggtcactgtcgaggacaagnnaacaagtgaagaaggacctatgctggtggactcctcngcgctcacggtgctgcctggacgtagatgaaatatcgggctatgggat

SEQ ID NO: 88240 - DNA, 530 bp, Triticum aestivum
  unsure (1)..(530): unsure at all n locations
  Clone ID: PAT_TA_88240
cttaantcaagagttatagggagggacttatgtcaccacaaacagaaactaangcaggtgttggatttaaagctggtgttaaagattataaattgacttactacaccccagagtatgaaactaaggatacngatntcttgnancattccgagtaagtcctcagcctggggttccgcccgaagaagcaggggctgcagtanctgccgaatcttctactggtacatggacaactgtttggactgatggacttaccagtcttgatcgttacaaaggacgatgctatcacatcgagcctgttgctggggaagacagccaatggatctgttatgtagcttatccantagacctatttgaaganggttccgttacnaanatgtntacttcantgtacgtaacgtattggtttcaaagccctacntgctctatgttggangatcacaaatccccacntancaaaacttccaanggcgcctcacgtaccaanngaagaganaantgacaatatgtcntccttacgggagtctataant

SEQ ID NO: 88241 - DNA, 563 bp, Triticum aestivum
  unsure (1)..(563): unsure at all n locations
  Clone ID: PAT_TA_88241
gaggctgtgggaggcgaacggcgcgggaggaggaggaggtcgtgcgggaggagaaggtggaggtcgtgcgggcgaccggttttgttagtgcggaccagattagcgatagattgattgtagtggcttaatgcgtggttggtagagttaaacacaaaatgattaagggccattagatcttgatgatggatgggtggattgtttggatctgcccctctttttttttttatagtggtagtagataagtttctctgcaccgctagttaacacctactatagtantagtagacgctgtcnaaagataaattatttcaggcacccttgataatggcttttgcaacttttgatacaccgattgtanttaatacgtaanaacggcatgattgnnaaanacggtgggagtatccgaaagatcaccacagaatgatncaggaattcaccgtcaacaccanctaccagacttannacatcatntacccatacanattaccgatttatatttcgtgngtanaggtggncaaaantcaanctgtttcaaaagcggccatttattgaaaaaaaaaaaa

SEQ ID NO: 88242 - DNA, 578 bp, Triticum aestivum
  unsure (1)..(578): unsure at all n locations
  Clone ID: PAT_TA_88242
cagtccccctccgatctcaccgagaaatcgacgcgaaggctctctgcccgtcctcaagatgcagatctttgtgaagaccctcaccggcaagaccatcaccctcgaggtcgagtcgtcggacaccatcgacaatgtcaaggccaaaatccaggacaaggagggcatccctccggaccagcagcgtctcatctttgctggcaagcagcttgaggatggccgcacccttgctgactacaacatccagaaggagtccaccctccacctggtgctcaggctccgtggtggcatgcagatttttgtgaagacctcaccggcaagaccatcaccttgaggtcgatcctccggacactatcgacaactcaaggctaagtccaggacaaggagggatccctccggacaacagctctcatcttcgctggaacactcgaggaggcgcaccttgctgacacaacatccagaaggatcaacctccactggtgctaggtcntgtggatcaaatttgtaagactcacggcagacatacctgaggtngtctcgcacatcacactaagnaagnnagacagnggnatccccggcan

SEQ ID NO: 88243 - DNA, 577 bp, Triticum aestivum
  unsure (1)..(577): unsure at all n locations
  Clone ID: PAT_TA_88243
ctccggctaggtanctagcaatggccgccgcactgagcctccgcgcgcccttctccctgcgcgccgtggcgccaccggcgccccgcgtggccctcgcgcccgcggccctcagcctcgccgccgccaagcaggtgcggggagccaggctccgcgcccaggcgacgtacaaggtgaagctggtgacgcccgatggcgaagtggagctggaggtccccgatgacgtctacatcctcgaccaggccgaggaggaggggatcgacctgccctactcctgccgcgccggntcctgctcctcctgcgccggcaagttggtgtccggcgagatcgaccagtccgnccagagcttcctcgacgacgancanatngagcatggtgggtgctacctgccancntacccaagtcgacatcgtatcagaccacaacgaggaggagtcaccgcatngctgcttacnactctctncangatatatacgacctgagactgtgtaacctgacacnattatgcangacggcatgcaanaacgaatgttntgnccaatattntcatctgttgcangnaatgttncnntaacttttt

SEQ ID NO: 88244 - DNA, 581 bp, Triticum aestivum
  unsure (1)..(581): unsure at all n locations
  Clone ID: PAT_TA_88244
cgccgatcgatcggagcagcggagaggacggcgcgcgcgtcggcgatgcggaaggggccgtcgcggtcggggtcggcgcggcaccagcagttccgcgcccgcgccaagacccgcgtcgacgacctccaggacatgttctccggcctccagtacgcccgcaaggaggcccgctccaccgacgccgtcctcctcgaggcgcagctccaccagatgctccgcgagtggcgcgccgagctcagcgtcccgtcccccgcctcctccctccagcaggggaacaacaaccgggatccgccgtccgagacgccgcggccgccgcagctggcggcggccgaggaggaggacgacgccaccagcaagctcgtggagcanaagcccggccgtccgctaatcaggctcacaagcaccgcagggagaccaggacatgaaccggagccgcgcgaggaancatccggatcaatgacggtgggcacagcgacncgctggtcggagtacacacccnctatgcnggtcacatagngtcattgacaggactattgagatttctncanatataanataactctgggtcaatcagaacccat

SEQ ID NO: 88245 - DNA, 227 bp, Triticum aestivum
  unsure (1)..(227): unsure at all n locations
  Clone ID: PAT_TA_88245
gcaccgcgagtgacatcacaaaacagagagctctgctctgctaagcgagcggctcaccctcncccgcaccncagtgggaanagaanngcttgcttgcccaanatgatgctcgcctacatggaccgcgccgcggncggtgccgccgcggagcgggacncnctcgagctgaccgtnntggccgctgacgcgntacagtgcnctgcggctnnggacttcngcgggnttgt

SEQ ID NO: 88246 - DNA, 499 bp, Triticum aestivum
  unsure (1)..(499): unsure at all n locations
  Clone ID: PAT_TA_88246
gcgattcccaagtccccgcacncctcctccgtccggtcccnccggcnccncgccacacgcttttanagttttttcaangntggaacacaatgaggcnaggttgccagcagncggcagggcctaatcctaggtggttaataactgtggcttctttggcaangccgcgaccatgancatgttctccaagtgccacaaggatgatggtcatgaaggaggagcangccaacctggctgcctcctcctgcgatagcatcgtcanccngnggcgagggtnggaaagcacctgttgntgcggnngtggncgcgagcgcagangtggcngttgctcaanttgancgtnaaggcgcntgttgtgnancctgctgctgacgttgcaggcaccattnaanctgtagccgtgagccccaaggngaangagaggccgaaantgtgctcaacatncaagaaagggttgggctgaccgggatncaantgccnttgcggtaatanctnctgtcac

SEQ ID NO: 88247 - DNA, 534 bp, Triticum aestivum
  unsure (1)..(534): unsure at all n locations
  Clone ID: PAT_TA_88247
ggattccctgcggcaaacatctgttgctgctaaagaagctggtgggatcactcagcatataggtgcctttgttgttgagatgcaatctggagcctctatcacatttcttgatacaccagggcatgctgcatttagtgctatgcgggctagaggtgcagctgtcacagatattgtagtgcttgtggttgcagcagatgatggtgtgatgcctcaaacacttgaagctatgtcacatgcaaaagtagcaaatgttccaattgtagtcgccataaacaaatgtgacaaatctggagctgaccctgagagggtcagaattcagcttggttctgaagattgcttttggaggatatgggtgggaatntaaagttntgnaattcgcattaacgaaactggttggataattgganaagcttgccctcaggccnnataaggcctgaaaccagnanaganggccngctcacctttntgtgaggaaggtgncanggnagggacacttcacaacntagtaatccggacatatngtggcanaatgtt

SEQ ID NO: 88248 - DNA, 589 bp, Triticum aestivum
  unsure (1)..(589): unsure at all n locations
  Clone ID: PAT_TA_88248
ctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatattcagcttctaactgagagtggcaacactaaggatgacctgaactccactgatgatttctgcctgggcagtnaagacggttgctgatggaagactgatctgtcgtgattccgcatgggtgaagaaaagttcctgtgaaggaatcggtggtggaagtacactgtctggtgccactcatacttgancatgctctggtgttgataaatcatagnataagatatcgtgtnaca

SEQ ID NO: 88249 - DNA, 574 bp, Triticum aestivum
  unsure (1)..(574): unsure at all n locations
  Clone ID: PAT_TA_88249
catcgaaggtgggttccaaacggtcacggggatggctcttggtattcttcctctttataatgagaccaaggcccattatttttattcaatcctctatcgaatccgcccctctccctgagttccaacacccagggctccgaattcagataccttcaatccttgacaatgtccggtcctgatctatgaggccggtggatgccctcctccgtcacggaggaggacgtgctgaagctgagagatgccaggtatttaacctacgagatttcgcataggctgcctgcccgagggcaattatcccaactcccaagactggcgagatcgtcatgttcatgtatcactccgtcgggnttaagctcccgacgttccttcatgaganggtcatttttactatgggctagaatcatgactggctccngatcacctcatatctcacatcatgtcgttgtgaacctcctcgcacacctcactcgctatggccaaaacttaatgtggagcnaagatatgagggctagcaantcgcggcggtaaacaagatgcanctcatgncaagntcttcagagaccgnttgaaaana

SEQ ID NO: 88250 - DNA, 587 bp, Triticum aestivum
  unsure (1)..(587): unsure at all n locations
  Clone ID: PAT_TA_88250
cgactacccgctctcggcnacaatcatntccaattacnccaacangaanacnaggggcncnttcatcgccgccntcttcgccatncagggnttcggaatcctcacngggggcntcttcacgcacatcgtctccnccgctttccgcgccgctttncacacgcccgcntancangacgcccccctcnccnccacgccgccgnaggccgncttcntgtggcncntcatcctcatgttnggggncgtcgcggccctcatgacctactantggcggatgaagatncccnagacggcgcgcnacacggcgctcgtcaccaagaacgccaagcaggccgcgggccnanatgtccaaggtgctcaggtggacatccgcgccnaanaanacgaccncaaggcaaaganggcggcgccggancgccgacacgcaatcgtccggctttctcnggnaatcctcgccggacggnncactnctcggaacggcactgcggtccgcngaanncctcaanccanactgtcanaagaatttncggnttaatgatccaaggcanaaatacccccncaggggtancatcccccccaaactaancntt

SEQ ID NO: 88251 - DNA, 343 bp, Triticum aestivum
  unsure (1)..(343): unsure at all n locations
  Clone ID: PAT_TA_88251
ngagttatanggagggacntatgtcaccacaaacagaaactaaagcaggtgttggatttaaatctggtgttaaagattataaattgacttactacaccccagagtatgaaactaaggatactgatancttggcagcattccgagtaagtcctcatgcctggggttccgcccgaagaancaggggctgcagtagctgccgaatcntctactggtacatggacaactgtttcactgatggacttancagtcttgatcgttanaaaggacgatgctatcacatcgaagccngttgctggggaanacagccaanggatctgtnagtgtcccttatccacnagaccta

SEQ ID NO: 88252 - DNA, 579 bp, Triticum aestivum
  unsure (1)..(579): unsure at all n locations
  Clone ID: PAT_TA_88252
ccaagccaccgaccaacatggcagcgtctctccaagccgcggccacgctgatgccggccaagatcggcggccgggcctcctccgcgcgaccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaattctgcctggagccactccttaacgtcaagccgagggcatcaagaagaacagcgccggcttcagaagacaactatgaccgttactaaccttgacagatggagccgtcagtcgcccgcggacctaantcagagaagangatcacacgcgctacgtnactcccgagcaacctccttct

SEQ ID NO: 88253 - DNA, 584 bp, Triticum aestivum
  unsure (1)..(584): unsure at all n locations
  Clone ID: PAT_TA_88253
cactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaagagcctcgccaccagcatcaagtccatcaacatgggcaaggtctccggcgtgcccggcaagtgcggcgtcagcgtgcccttcccatcagcattcaacaactgcaacaatgtcaactagttaatatataatccttcctactcatgcatggaccgcttcgtggagctaattcacgttgatggagtgtatacatttgactacaaaaataaataattgctgtgttgtantnagtatgtgtcangtcgtactgcaaacacgtgntnaaaaaatt

SEQ ID NO: 88254 - DNA, 601 bp, Triticum aestivum
  unsure (1)..(601): unsure at all n locations
  Clone ID: PAT_TA_88254
aatccaagggcgccgccaaggccgacaccaagttggcggtgaagagcaagggggcggagaagccggcggccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccattgccgcctacaacaagggcgagagcgctgctgctgctgccccaaagaangcggtggccaaggaggtggaggaggaagatgaggaggatccgacaatccaatcggagatcaatgacgacgacgatgataaggtagcgatgaggacaagacacgacgatgaagaaaccatctttcaagctctggctccggcggacaaagcgaacggtctgccgagaacgactgagcttgtcggtggtgtntaggagcttcatctcacananttccagttnctnaatctatttgttncntttttctn

SEQ ID NO: 88255 - DNA, 579 bp, Triticum aestivum
  unsure (1)..(579): unsure at all n locations
  Clone ID: PAT_TA_88255
caccagaaattgctttgaccgtgctgaaattgctagagttatgaatgctgctggcaggaggcctgaagctttaccccaggatcttcagaaaggaatagatcttggagttgtttctcctgagatattgcagaacttctttgacctcgacaaaaaccctgttatgactgagctaattcaccgattccaaggtttccgggaaagattgctcgcagacccaaaattcctccaaagattagcaattgaagaggctatatcaatttcaaccactctactagcacagtatgaaagacggaaagggcgattttttgaggaaattgactatgtcctcaccgatactattagagggtctgtcgtcgatttttttacagtgtggctacctgctccaactatttcagtgctttctttactgataatgatctggcagacttgggcttgtcagagcttttgggatantgcagataagcgtccaaaagaaaccttgggcaaaacggaaataaccagaggttgcncantaaaantggggttgannttccggggngggttattcangtgggcggattccaaatcctgtagcgccng

SEQ ID NO: 88256 - DNA, 605 bp, Triticum aestivum
  unsure (1)..(605): unsure at all n locations
  Clone ID: PAT_TA_88256
attctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttcatgccggcatgatatttccgcctaaaataaaataaaactcangcgagatgagcagcgtcatcgtgcctatgcgtgtgtgtgtggcaacaatgcttatacagtattcgtctctcgtcgctgtgtttctctctcgagaaaaattggtgttgcttgttgtcactatcggatatctccgtgaataaaagctgtataatgtgcgtgctgcaataatatagtcctgtcaccaaaggggggccgtaccaatcgccanatgagtctataccnccn

SEQ ID NO: 88257 - DNA, 592 bp, Triticum aestivum
  unsure (1)..(592): unsure at all n locations
  Clone ID: PAT_TA_88257
aagtgccgtcccgtcctcagcttggtcctcctagccgtattcagctgccttccgcatgtcgtcacctcgcttagcttcgactacaacttttccgcccccggcgtcctcgccggcgccgacctcaagtacatgaacgactccgcccctgtcctcgaccggatcgacctcaccaatctctccaggagctggagcaccggccgcgtcgcccacgggcaggccgtgcgcctctgggacgacgccaccggcaaggccgccagcttcaccacgaacttcaccttcgccgtcaagtctctcaacgtgaccaccagccagggtgatggcatggccttcttcgtgggaccttaccgccgagcatgccgacggacgccagcggcggcttcctggcgctgttcaataaccgcggcaaccggcaacactactcccgcggacatcggcgtggagttcgacacgctcangaactcgagtgggacccgatgacacataacactcggctaagtaacgaatagtcagaataacgcgctcggacggacttatgggcattcggtcgtagtcacgcggacgcacgctctcggacctgcgtaagaatccgatt

SEQ ID NO: 88258 - DNA, 595 bp, Triticum aestivum
  unsure (1)..(595): unsure at all n locations
  Clone ID: PAT_TA_88258
agcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatttcggatgcaccgacgccaccagtgatcaacgagtggaggagtcaagaagatacctgaccctattcgcatcatcggattcgacaacatcgtaggtgagncgtcagcttatcgccttaagcacgggctcaagatcggaaggcaaacactatcacaaggcatatataagncattnagtttgtactcgaaatgctttggtttctccattg

SEQ ID NO: 88259 - DNA, 604 bp, Triticum aestivum
  unsure (1)..(604): unsure at all n locations
  Clone ID: PAT_TA_88259
tagaagcagccaccctttaaagagtgcgtaatagctcactgatcgagcgcccttgcgctgaagatgaacggggctaagcgatctgccgaagctgtgggatgtcaaaatgcatcggtaggggagcgttccgccttagagggaagcaaccgcgaaagcgggggtcgacgaagcggaagcgagaatgtcggcttgagtaacgaaaacattggtgagaatccaatgccccgaaaacccaaggtttcctccgcaaggttcgtccacggagggtgagtcagggcctaagatcaggccgaaaggcgtagtcgatggacaacaggtcaatattcctgtactaccccttgttggtacggagggacggaggangctaggttagccgaaagatggtataggtttaaggacacaagtgacctgctttttcanggtaagaagggtagagaaaatgcctcgagccgagtccgagtacaagcctcagnctgaatatgagcccgtggacaacaatgcttctcacaagctcatacaagcgctacgcctaagttgtactatgcatactccagaaaactcaacacctcacaaagggtactgtccaaaccacacagtggtagna

SEQ ID NO: 88260 - DNA, 632 bp, Triticum aestivum
  unsure (1)..(632): unsure at all n locations
  Clone ID: PAT_TA_88260
cacaagtgctagctagctaatcgatcagccagccatggcggaggagaagcaccaccaccacctgttccaccacaagaaggagggcgaggacttccagcccgccgctgacggcggcgtcgacatgtacgggtactcgaccgagacggtggtgaccgccaccggcaacgagggcgagtacgagcggatcaccaaggaggagaagcaccacaagcacaaggagcacctcggcgagatgggcgccgccgccgccggagccttcgccctctacgagaagcacgaggcgaanaaggaccggagcacgcgcacaagcacaagatcgacgangaagtggccgccgccgcagccgtcggcgccggcngcttctcttccacgagcaacacgagaagaagcaagaccacaaggaagccaaggaggcancggcnagaagaagcacacacttcggcanatngtcttnaanttccgtggccggcctcgcctccggcgttcctgtgcntacttactnttttcataagntanaaaagtgggaccggcccngtcnctnctcgccgtggngatttccgctgcnanctccgctgcnganaatggttcgtcnnattgtccaactanctcggtttcttttcgtttttnattnn

SEQ ID NO: 88261 - DNA, 634 bp, Triticum aestivum
  unsure (1)..(634): unsure at all n locations
  Clone ID: PAT_TA_88261
gttctgtttagtgatttctccctaggtatttttctttttctgtcctagttgtctcctgcagccagccaggtgaatatgtattccagaaatatgtttaatttgaacctaagaagaaaattacattgttacattgtggcagtcctacagtaatattgtagaggtttaaacctgttaatttgtctactgagcacatctattagcgagtcaatttagagtagcagtactacttttagttgtgcacctgctactagtaccaaggccaagtgttcgttcactttctctcaaccttgaggcagacaccgagctagcacttgccatcacagtgacacaacgcgttgcttcntcaactccgttgctccatcactaggtcgccctcctgaatagtgctggtgacaagtgatcctaaatcttttttcctcatgttancctctttttatttcgatnacttaacactctaantgtcttcttatgattcctgtttttgggatgcaagtccangtnactctgtacaatcgtgcaacgcatggncacaataagctnaganggaaacatgattgccttggagctgacacataacaaggtaagtcncangcacccatatcncgcaagtatccannaacgcaagaataactag

SEQ ID NO: 88262 - DNA, 358 bp, Triticum aestivum
  unsure (1)..(358): unsure at all n locations
  Clone ID: PAT_TA_88262
agcgatttccccggcgtctccccgcctaacaaattcttcgcgtctgcgtatgggctgctggtggccgggcgtgagcgcccaggggctggctgggcctgcggctgctcaggggccgtgtggatctgcgccggggttgctgcgggcttcgggaccagatctcgccggtgggcgcgggggaagctcggcttgaggttgtggtggctgcgtgcantgcggctgcccatggagcgcgagatggggccggcacggatcgtgggtggcccgtgcagtgcgggccgnccctgtgagttttctcgtccanctctgtacaattttctgaatccttatattgggctttcttctccttccttaanaactc

SEQ ID NO: 88263 - DNA, 641 bp, Triticum aestivum
  unsure (1)..(641): unsure at all n locations
  Clone ID: PAT_TA_88263
tcaagctccggctcccgacgtggccgcacactggcgcctctcctctttcctcgcgccccgcctgctccgcaccgacgcccccgcgtggcccacgccgccgccgtcctgcgatccaagttccaactgacacagccggatctcgtgcgatctcacagctgccaccgccgccgccgaactcacagtcggatttcgtgcaatctcacagccgccgccgccgaactcacagctggatctcgtgcgatctcgctgcctccgacgtanggaagtcttcactgtatgggatcgccgccacggtactggatcccgccgcggacgtaanaggctgaaagcnccgcgggtgggacagggtgtgcgtcgcgttgctggagaacttcctcgaacgaacgctgtggtggtgcattgtccattgatctggacgtcggtagaaaaattgnggaaatcaaagtcagaagaattgaaatacatgcactgtgtctacaaaaanccaagctgcctaatcctaataaggataaggatcacgaaatctggaggactcaaaantgntcttgccggggaaanggtgtaagcgtttgccgcanatcagagcaattgtcaacatanctcaatgatcctacctgagctncaattcacgcccggttgtg

SEQ ID NO: 88264 - DNA, 341 bp, Triticum aestivum
  unsure (1)..(341): unsure at all n locations
  Clone ID: PAT_TA_88264
tcctgccatgcctctgcctcgtgcagtcctgccttcttccgtaatccccactccctaccacccagacgaccaggctgcggcctgagcttcttgagattcccaggcggcgactgcagctgaaccgagagggcagcggcggcggcgactagagcggagancaacggtagcggcctcgacggccgggaggcagatcgcgtgaagcagatggcggaggctatactgctcgctgtgtcaaagattggggcaatcgttttgaatgaagctgtcttggctgtcatcaacaaagctgtcnaggaaggttgacaacctaaaaggaattgccggcaaagataaaaagaatc

SEQ ID NO: 88265 - DNA, 586 bp, Triticum aestivum
  unsure (1)..(586): unsure at all n locations
  Clone ID: PAT_TA_88265
cagcaacggaaccaacaaatccccacccaatctcgtctccgatcgacccgaggctcgtcgaatccccaccgcctcaagatgcagatatttgtgaagacactcacgggcaagaccatcacccttgaggtggagtcgtctgacaccatcgacaatgtcaaggccaagatccaggacaaggagggcattccgccggaccagcagcgtctcatcttcgctggcaagcagcttgaggacgggaggacccttgctgactacaacatccagaaggagtccacccttcaccttgtcctgcgtttgcgtggtggcatgcagttttccgtgaagaccctcaccggcaagaccatcacttttggaggtttgagantctggacaccatccgacaacgtcaaggccaagnttcaaggacaagganggcattccccccggaccagcaacgcctttatctttgctgggcaagcaactggaggatggccgcaccttgccgactacaacatccagaaggatcaacctccaactggtgctgccctgcntggtngcatcaatctctgaagaccttatggaaagacacacncggagtgggaacccn

SEQ ID NO: 88266 - DNA, 567 bp, Triticum aestivum
  unsure (1)..(567): unsure at all n locations
  Clone ID: PAT_TA_88266
cagccacctcctccctcgcgctcctctccattcctcccaccgccaatctcccaccgccgaacagctctgcaacttctctgtaagctagaggcaaagcgtacgcagaaaagcaaagcgcgcgagtgtgtgccgagatggctgcggcgctgctgccgggtaccgggatgacgctatctggggcgtggcagcaggtccgtggcccggtgatcgtgccgctgctgcgcgcgtccgtgctgttctgcgtcgccatgtccgcgatgctgttcgcggagaaggtgtacatggcggtggtcgtcctcgccctgcggctgctcggccgccgccccgagcggcagtaccggtggggagcccatgcgcnacggcgacgacccgactccggaacgccgcctacccatggnccttgtgcaagatcccaagtncaacgaacgccangtgtaccggtgtcatncggggcggctttcgggtgtcctgggcatccgattgggtaatcgtcaaagtgctccaacaatcaacnaacctgtcntnaaggattggtncngtggagtgcaacnctgggcaagnaaggct

SEQ ID NO: 88267 - DNA, 583 bp, Triticum aestivum
  unsure (1)..(583): unsure at all n locations
  Clone ID: PAT_TA_88267
tccggttcgggttctggttcggttcgggtccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccatcccgcccggccggcggtgggggccggcggncgcggctacggcggccaacgccggcggtancggagtacggccggccggcngccgttggctacggcgcaaaggcngttgccggctacnaagntaaaggcggtgggcggtaacgcnaagggcggtggtggntacggnnggccaanccggnnggcggcngctaaggcggtcgncgcngcaggtacgncggcgcagtgnttgctancgctggcant

SEQ ID NO: 88268 - DNA, 581 bp, Triticum aestivum
  unsure (1)..(581): unsure at all n locations
  Clone ID: PAT_TA_88268
gccaaatgtatcttatgtttgatcatcacatctattacatgtctggcttcacactgaaaatattcagaactgaccacagaactgctgctgcttctgaacatattcaggctgctgctgcaggtaatgcttatatgggagcaaccgagcaaggacttcaggaaccaggctactctgttggcaaatagttcatgcagcaatatgccgtttttgacagctgaatggaatgtcttcccttcgtcatatgactgcctgcctaacgaagtaacgagtaacgatgatggattgtatgaaggcccttccctgctgcgaattctgagcaaccgcatgcaaactgcagctaagccgggaggaggcgcgggaagtgacccccatctctgtttctgaaaccttccggggtcatggagatacagtatgtaccgcatcttacacaagctccaagagtgaatgcgcatattgagctcacatcatcaagccacacaaaacggtgctganctaggattgaaaaccccgggtgcctaactaacttggcgcccaagttgctgtcggacncaaccnaaggcgggaaatgccgggtnccacaa

SEQ ID NO: 88269 - DNA, 559 bp, Triticum aestivum
  unsure (1)..(559): unsure at all n locations
  Clone ID: PAT_TA_88269
agctcatcaggaacacccccatcaatgcgggtgcgacgggggcggcctggacgccgccgtggagcgcctcaagaccgggttcgagaagttcaagaccgaggtctacgacaagaagcccgatttcttcgagcccctcaaggccggccaggcgcccaagtacatggtgttcgcgtgcgccgactcccgtgtgtgcccctcggtcaccctgggcctggagcccggcgaggccttcaccatccgcaacatcgccaacatggtcccctcctactgcaagaacaagtacgccggtgttggttcggccatcgaatacccgtctgtgctctcaagttgaggcatcgtggtgattgggcacagccgctcggtggaatcaagntctgctctcaatcaaggatggngcaaaacaatccttcnaattcgtccaaggactgggttaaggatngggttcccggcaaagaaaaagngcaaactgattgcccnccaagcctttnaatgacaatngaacgtctccaaaaggngnaatnaactntccncaaaaacccctgacnaccgttcttaaggg

SEQ ID NO: 88270 - DNA, 570 bp, Triticum aestivum
  unsure (1)..(570): unsure at all n locations
  Clone ID: PAT_TA_88270
caaccttatcgtcgccgcggtacgagcacagatggcgccgccggcaagcagcgccgcctgccgccatgtccgccctccccaccttcgcctcctcccacccatacccttccctccccactcccaaaacggccgcccccaaaccacgcctcaccctggcctacgccggcgccgccgcggctcccaatgccgtcccccaccgcagcgccgccgcctccaacgaccgcctgcgaggcctggtccgccgcggcgacctcgaggaggccctccggctcgtcgattccatggcgtccgccgccttcgccgcggggccctgcgccgcgctcatcaagaactgtgcgcgtccgggcgcaccgcggaggcccggcgcgtgctgggcggcctgcgacccgactcnatggcctacaacgcgatggtcccgggtactgcgtcacggggcaactcgacaaccgcgccggntcgtcncggcgatgccatggagccggancctacactacaacacctcatccgcggctgtgccggcgcggcaggacgataacgcctcgcgtgctcgacatatctcgccgggggtgg

SEQ ID NO: 88271 - DNA, 589 bp, Triticum aestivum
  unsure (1)..(589): unsure at all n locations
  Clone ID: PAT_TA_88271
acaagtgctgcgtcatccacacaaggtgaaaggaagatgttagataaattacgcagctatcagggtgcaccgtttattgaatccttcctaggtccacaagaggacaagttcagtagcagctcatcacaagatacagcaaaacccagtgtcccaactgctccatcgagtcacactggacagcttccagcttttcctgatgtaaatgcagatgataaagttgtggatgaaggtacactttgttggaaccttctatcctcacggctctttttcgatgctcaaatgagtgatgagataaacaaggccatcaaagcacgtattcagcgaacattatcaagcatgaggaccccagcttatgtgggtgaaattacacttacggagttcaaccttggaaaactccaccttatgtgcatgcgatgagattcntccactggatttaaaatgactgtgggcctttgaaattgattttggaatatcaagggggatattgttggacattgaaacnaggcttgaggttgaggaacanagtacagaaggactcatgaaaacaatttcggaacanactcaaanggggaaggtgactcaaaacntc

SEQ ID NO: 88272 - DNA, 586 bp, Triticum aestivum
  unsure (1)..(586): unsure at all n locations
  Clone ID: PAT_TA_88272
tgcaaacccagcacgaaatccctcgattccccgaatccgatcgaagcttttcttcctccccaatccaaatctcgcgcgcgctgcgatggcggccgccgccatctcccacctccgccggggagcgcagcgccacgcgctcctatacctctcgcgccgccacttctcctctccgtcctccctcgccgccgccgccccgctcgccgccgctgctcgccgccttctctctacgttggtggaatccggcacgtcctcgaaggcgggaagctataagcccccgcccctcgaccccttccgcgctgccctcgctccagcgtctccgccgctggagtcgcctcccctcgaggaccccccgctaccccgccgctcccggaggtagcttctgcggccgcggggcccgagcaggattcggtggttttgcagaacgagcaattggagggcctgaaggcanggctggaggccgtgaggagtanggaggagtcgccggaggagaaggaagcgtggtggttgctcaacgcgctgtcgtgaattatgcggcacnccgttggacggtggaacgaagaccttcacggcaacatatgctaatncn

SEQ ID NO: 88273 - DNA, 593 bp, Triticum aestivum
  unsure (1)..(593): unsure at all n locations
  Clone ID: PAT_TA_88273
ctctctcttacctcacgcgctccacgcacgcacccgcacactctcccctccccaccctgtcgctctcgctctccgcactccaaaaccctagtcaccctccgcacccaaaaccttacaccaccctccctaccacggcggcggcggcggccccatggctgctcccacaactggctaaggctaggctaagctaagttccccgaatatctcatccgaaaccgtcttgttcgtctctctcgtcctctcggcggcggcggcggcggcggcggaagctacgggtctgaagtcctaaactgctgtgctgcctgcgacctattttgaggtggcgggcgtttccgtgtcggcgatggaagagccgaatgcgggcggcggggccgtggcggcacccgaggtgattgcggatccgggtgttggcggggccagcggcggcgctggcgcctcgccgtggaggaagacacccgccgcctgtccaagtgaggcanggtcaatgggggcnaantcntggcccgcnctggaggaagcncggcaaaaagtcctggcggagccacgggaaacctctgccgggcaatgctgccgggggnaactggcaaaggggn

SEQ ID NO: 88274 - DNA, 479 bp, Triticum aestivum
  unsure (1)..(479): unsure at all n locations
  Clone ID: PAT_TA_88274
gcgcggcctcgtcaggctggctcacgaggaggcagagagatcaaggtcgggtatctcacgaggtgcccgtcacgcaagccatgacgaccgggggcgccaggcgggtgccagcccacgcatcgtctttccttcctctttggtgcaaagggggcaagcgtagccgcggagtaccgaggcatcaggcaaaggttgccatttcggtgcaacgagaccaagaccaggaggactacgagatggaggtcatcgtggagcccaagacggcgtcatcaccagagctttgcgcaggcgaagactacttttgtcaggtagctagtactagctgtcccccttcaaattagcccgccattggttgggctcccttcccgctcgatatttgggaagaggaccagggcctctataaataggaccagccacgcacagacaaaagggggccgagggtttggaaggatagagaagatcanaagagagagagagagaga

SEQ ID NO: 88275 - DNA, 591 bp, Triticum aestivum
  unsure (1)..(591): unsure at all n locations
  Clone ID: PAT_TA_88275
ccgagccaccaccgcccggcccaccggcctctcccccggctcgccgcggnctcgccatccccgcccagccgccccgccggtatggtctacaatcagtagccgatcgcgtcccccgttggtcgttctcccccgaccgcccaatccagctcttctcggtaacactacggctcctctgcttgctcgccatggcgattcgcatcaccgtctcctactccggctacgtggcgcagagcctcgctgcgtcgctcggcctccgctgcgggtcctcggcctccgccgggtgccgcttcctccaggaggggtcgtggcgccccttctgcatcttcacctcctctcgccaccagtccgagcgcctcccggccagcggcggtgaccgccatgacgccgccgacgacacaatcacccaagcccaagccctcgccgccacggcggcgtctccnggaagcaatctcgttcccttcgaggcctatcctcgtccaaccgcggccgcgctctcccgtggatgctgtcgtgctcgccangtnnacggcgggtcgtcnnngcgggattncngcgcgcgntctggccgntctngtcanttcatngggcngt

SEQ ID NO: 88276 - DNA, 607 bp, Triticum aestivum
  unsure (1)..(607): unsure at all n locations
  Clone ID: PAT_TA_88276
ttaattcaagagttatagggagggacttatgtcaccacaaacagaaactaaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttggactgatggacttaccagtcttgatcgttacaaaggacgatgctatcacatcgagcctgttgctggggaagacaagccaatgggatcgttatggtagcttatccattagacctatttgaaganggttccgttactaacatgtttacttccattggnaggtaaactaatttgggttcaaaagccctacgttgctctacgttttggaggatttacgaattccccctaacttattcaaaaacttccaaggcccgcctcaagggatccaagttnaaagaaaaaatttgaacaattnggccnncctttatgggatgtacaattaacccaaaatgggattncccaaaaaatntggaaaanctttaananttctn

SEQ ID NO: 88277 - DNA, 619 bp, Triticum aestivum
  unsure (1)..(619): unsure at all n locations
  Clone ID: PAT_TA_88277
gcctcctcctagcaagctatatacctacatagtacagccatggcccccaccggtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcaacaagttgggttcatcttccgtngagcacaacgcatcccctgggtactaatgatggccggttactgggacaattggaaactgcctaagttcgggtgcaaccgacgccacacaagttgattaaacgaagtggaaggangtcaagaaaggattaccctggacccgtatgtccgcatcatccggattcgacaacatgcgccaagtgcaatgcgtcaacctcatcgccntcaaaccaacgggctgcnaagatccggnaaggctaaacactcatcacaaaggcatatataaagtgcattgcantttgnan

SEQ ID NO: 88278 - DNA, 582 bp, Triticum aestivum
  unsure (1)..(582): unsure at all n locations
  Clone ID: PAT_TA_88278
gtcagcctcagctcactcgaagttagcaatggcggccgcgaccatgggcgctctcctccccggcgatggccggcaccccggtgaaggcctccagggcggcgcccttcggtgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctggggacaccgcgggcctctccgccgaccccgagaccttcggccaagaaccgggagctggaggtgatccactgccgctggggcatgctgggcgcgctccggctgcgtcttccccggactgctcgcccgcaacggctcaantccgcgangctttttgttcaaagncggtcccaaatctcaatnaagggcggctcgatactcggcaacccaacctggtgcaccgcaaacacctccatctgggcctcaagtggtctcatggccccttgagggtacgctccccgnggccctcgcgaaatttggaccgctctacccggnggagt

SEQ ID NO: 88279 - DNA, 604 bp, Triticum aestivum
  unsure (1)..(604): unsure at all n locations
  Clone ID: PAT_TA_88279
atcctcctctcctccagataatacattaccatggcccccgccgtgatggcttcctcggctaccaccgtcccacccttccaggggctcaagtccacagccggtctccccgtcggccgccgctccagcggcagcctcagcagcgtcagcaatggcggaaggatcaggtgcatgcaggtgtggccaattgagggcatcaagaagttcgagaccctgtcttacctgccacccctatccacggaggccctcctgaaacaggtcgactacctgatccgctcaaagtgggtgccctgcctcgagttcagcaaggttggcttcgtcttccgtgagcacaacagctcccccgggtactacgacggccgatactggacaatgtggaagctgcctatgttcnggtgcactgacgccacacaggtgctgaacgaggtggangangtcaaganggatacctgaccctatgtcgtgtcatcggcttcgacaacctgcgccangtgcantgcgtcagctcaacgcctttaggcaacgggttgcnangagtccggcaaggccnaaactacgaattaaacaagggctancncgtataangtctttgtgaactcactttgnn

SEQ ID NO: 88280 - DNA, 615 bp, Triticum aestivum
  unsure (1)..(615): unsure at all n locations
  Clone ID: PAT_TA_88280
cacaagagcagtagtagcagctccgtgtggtggctgatgcggtggcgctgaactccatgggccacggtgcagctggagctaggaccaacgggtcaagctcagcgagtcatggtgcaaattgcagcccacgggaggaccagcgcacgcacagcggggcgcgggcaggcacaagcagagcatgcatggccaccggcgcacagcacacacggccaccggcttccccacaacgaacaaccttgtccaagaggtccacaaccttgagatctccttccccgtgcaaggactcggcagaattcaccctgaagccctcgccatcatcctccaactccaagtccgagtatcgtcgttcgtcgtcgattaccttgccgttgctgcttccccggcctcaccgacctcgccgtcgggttcatcgtcctctccgtccgggaccgagctttgacgccgcatgtctggtccctaaaaacaggagcccaaattgctcggtccggtccantctagacaacggcggcggtccgggaggactttctnaangcgcaaaatattggnagaaaagcaaaggggnancggtaatttggtcnanttnacatgncatggaaatgcnaatgccanggcggg

SEQ ID NO: 88281 - DNA, 332 bp, Triticum aestivum
  unsure (1)..(332): unsure at all n locations
  Clone ID: PAT_TA_88281
cacacatagacacacactcaagcattcnaagaaatgatttttagtcnttccttggctggaccttgcagtnanggaagttcagacaatacccnnaaaggcagttggcgtgctccaanntgtgggcaanggnacngatnaacgnagcnatcnanggatccacaatgcattacgggaatctgtatttcaannncctcggtcaangttacccatgtctggaaaaggtcganacgcttggncatccctatgtacccacaccatanggatttgatgncctggcnggtcaaagtcattnaagaanaaattcnccnacgagtttccttcactttactcaa

SEQ ID NO: 88282 - DNA, 506 bp, Triticum aestivum
  unsure (1)..(506): unsure at all n locations
  Clone ID: PAT_TA_88282
gcgattgcgaggcgcgacctgagaccccaggcgacgtcgaagacgcacgctccggcgatctttcagccgactcaaccaccgggatcttcggccgtccagagcaatacaagcgcggcgttggcgatgctccgatcggccactggggtcgcgctccggcggcaggcgccggcccgtcggttctccggcagcagcggatgcagccgcaccaccagggagagggcctgagctgctgtttggctgcatcgcccttaccatgatggtcacatacaagtacaatgtgacagggaagggaatactgggatacagattcgacgaggcgaggaaggagcaggaggcagggagcggcgggaggangcgaggaagaacaaatattgatatttctctctgctagctgatctctttgcacacacccccaaacatatgggccataatatggcagttattaccctgggaacatcnggaangcaaggtcacaaactgccaaaaaanaaaanagaaannaaaaa

SEQ ID NO: 88283 - DNA, 621 bp, Triticum aestivum
  unsure (1)..(621): unsure at all n locations
  Clone ID: PAT_TA_88283
gcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggtttccttctccatttatctttcctaattgttcctaagaatatgtgtagtcatgttcatgtnccaacatggctccagaaagcatgctcgtatgagaatgctatcggtggtatgtntatgaacggcgcataatattatcaatattcgacatatacgtttaatggtaaccaatggaaatntcccacacgg

SEQ ID NO: 88284 - DNA, 540 bp, Triticum aestivum
  unsure (1)..(540): unsure at all n locations
  Clone ID: PAT_TA_88284
aaagctgtccctcgctaggcggaacacgcgcctcccatcgtccgccgaacaacaaacgttccagattccgatcgtccaaccaatcagccacgcagcccacaccgcgctccctgctgcccacagctacctacgccatggcattggccacgccgctccgccacctcctcgccgcgcagcccgagcccgccaccggtgcggcgccgtccctgcaggcgcagccagcgcgcgcctccccgcaccaccgccgtctccttctccgctccatcaggcacgtcgcggcgccctcagtgtgtccggcatccgccagggtcgcggcgagggcggcgggcggggggcggccgacggtgctggtgacngagaagctgggcgcngcggggctggngctgctgcnggcgttcncgaacggtggactgcgcgtacgatctgacggnggangaactgcncnccaaagtgtcnctggtggacgccctggtggtncgcaacgccacgcnggttaaccgggnggtcttctaggcngcccnnggacgggtccgccncgtg

SEQ ID NO: 88285 - DNA, 626 bp, Triticum aestivum
  unsure (1)..(626): unsure at all n locations
  Clone ID: PAT_TA_88285
ctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccggtgagcacaacgcatcccctgggtactatgatggccggtactgggacaatgtggaagctgcctatgttcnggtgcaccgacgccacacaagtgatcaacgaaggtggangangtcaagaaggagtacctgacgcgtatgtcgcatcatcgggatccacaacatgcccaangtgcantgcgtcagcntcatcgcctcaaagcaacggggctgcaaggantccggaanggctaaacagtcatcacgacaggcatattnaagtgcaatgcagntttgtaactcganattgcttggggtttcc

SEQ ID NO: 88286 - DNA, 610 bp, Triticum aestivum
  unsure (1)..(610): unsure at all n locations
  Clone ID: PAT_TA_88286
ttttcaaccaaaacacaaccacaccaatttcacgattaccattacaaagcaaatcccacaattatcagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcggactcaacattcttcttgaaagcatctaggtcatccccttcaagcttggcagagaggttcttgatgtacgcttcatgtgagagataaactgcttcttgtcaaaagcangttgctcctgaagacggaaggtgtcaacaatgtcaaccaccttcacgggctggtcatcaacacctcatcatcacaacaacctcagcagagggattggcncaatgtcacataacggcccttgaanaaccaatggcancgacttccagagcancctt

SEQ ID NO: 88287 - DNA, 624 bp, Triticum aestivum
  unsure (1)..(624): unsure at all n locations
  Clone ID: PAT_TA_88287
gacacctccacccttgccgccgtcgcttccttcgtcgccttctccacgaagccccgcctcctcccgccactcaacccctctcgcacccttccacgcacccgcggctcccttgccgtctgttgctctcactcccacgcctctcctccgccctcgcccctcccgtgcactgcgtccgatgaggaggaggtcgctcctccgcgcctccgcctccgcctactcgccgaggagttcggcgctcttccggacgccgaccgcgcgcgccgcctgctcgcgtacgcggccgcgctcccgcggctgccccaggcggaccgcgtcgcggccaaccgcgtcatggggtgcgtcgcgcaggtctggctcctgngcagctgcgaccgctcgggacgcatgcggttcgcggncgactccgactccgagctctcgcgcgggtactgttcctgcctcgtctccgcgctcgaaggcgcgggccccgaagangtgctcgaagttggaccccgncgatntgcgccgctcggtgtgggcgcnggggcgncgtcccggtaatactggaaaacttctcgtcggatgcagaaccggcccggaacaatgcggnccccaaggnagctccngggaaccntcccgtccnnt

SEQ ID NO: 88288 - DNA, 601 bp, Triticum aestivum
  unsure (1)..(601): unsure at all n locations
  Clone ID: PAT_TA_88288
cgtcgattggcgttgggaactcgttgccgcgcgcgctcgtcgagtgctcgctgaagattcgccaggcgagcgcgttcggccaaattggccaaacgtgcctcctccaaggcgcgagccttgggggtttctcctgcgatgggagtatgcagggtatccatgttcctgcggcgaagttcctctctttgtagagagtcgagtggctcgggctggtactcttcgtggtctcgtgcggggtcgcctctgtcgcctgccccaccatcacgggcgaagccaggggggctgcgaggcccgtcgaccatcaggatttccgctgctagatcgctgctatcgcatttggatgcagtctctacggagccagtcgacagatcgaacaggccgtagagagattcgtcgggctcgattgccgcaacttgggtggtggccgtctggcgagccaccgcgtgtctcaccaccgctgaagcctcgaccgacccgagcgctgcgctggcgggagacnggaaggtggtcgatangggagtcgaccgatatgggtcgacgttccgcaacataacgccgcgaacaatgccnaaaatcgtccnacgcggacggggaacgatcactt

SEQ ID NO: 88289 - DNA, 542 bp, Triticum aestivum
  Clone ID: PAT_TA_88289
cggaggccaaggcggccggggcgagcgcggcgctcgcggaggccagggctgccggggcggcgacgggatccaacggccggcacatcgagctagctagctagctcttcgctagctccattcgaatggattgagctgctagctagctagctccgttcgaatggattgagctagctagctagctccgttcgagagccgcggagccacgggcgagcgcggcggccgggacggccggccgtccggctatcggacggccggcgagtgagcgcggtggccggggcagacgggcgcggcggccgggcgagcttcatggcgttggcgggggcaaagattcctcaaccgtcaatgttgaccggtccggtatgcaaggccctgataaatttgccctcaaaactgtatatttatgaaggtttcgtgttcgtgtttacagggcccctaaaaaattttaagggtcggacgattttgcggggtctgttccgggctttttttttactgaaactgttaaaaacagttatttacggtttgaccaattacatttaaaaaaa

SEQ ID NO: 88290 - DNA, 605 bp, Triticum aestivum
  unsure (1)..(605): unsure at all n locations
  Clone ID: PAT_TA_88290
ccaacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgaggtggaggaggtcaagaaggagtaccctgacgcctatgtccgcgtcatcggcttcgacaacctgcgccaggtgcagtgcgtcagcttcatcgccttcaggcaccgggttgccaagagtctggcaaggctaaaactacagttaaacaatggccatgtanaaggcctttgtaaactaactttgtcacaacncnctggacnacaa

SEQ ID NO: 88291 - DNA, 341 bp, Triticum aestivum
  unsure (1)..(341): unsure at all n locations
  Clone ID: PAT_TA_88291
gccatggcgcgggattgagcaagaagaacctggagctggtcctcatgcaggccatgatggccgccaagaacgtgcgcgcgcagcgcggccgcctcctggagctccaccgccgcctggagcgccaccaggccgaggccgcccccgccgacgccgacgccgaggccaagctcgggcagatcgtctcggacgtcttcacggtctactacctcggcctggatcccggctccaagatgctctgggtctgcctcgacaccgccgtcaagaaccgcgccgtctccaccgtcaacatcgccttggcgcgcatgcccgacgagcagctctacgacgcgctcntcgcgcaa

SEQ ID NO: 88292 - DNA, 588 bp, Triticum aestivum
  unsure (1)..(588): unsure at all n locations
  Clone ID: PAT_TA_88292
atcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcatggcccgcaacagctcggaccgcaagatagcgtgcaagtgcctcaagagcctcgccaacaagcatcaattccatcaacatgggcaagnctcccggcgtncccggcaaatgcgcgtcaatgttcccttcccatcaacaattccaacaaactgnnaacacngtcaactaattcaatatataacccttcctaacgtgcatgcaanggacncccttgtttggagcttaantccaagttnaatggatggcccaaacanaccgaagagctaccaaananaataaaataattnccncaatgtttaatcaanaatgtncnaatccgtccctgcancan

SEQ ID NO: 88293 - DNA, 283 bp, Triticum aestivum
  unsure (1)..(283): unsure at all n locations
  Clone ID: PAT_TA_88293
gagtgactgatanttagcaatctcgttagnanttcagtncattgtgtcanncacgctcgtacatgtncctccacagtccacacaacgcatatatctagagttgtatacncaggcacncagttattaanacnanacctcacacatcangcgcaacgcngcgaanagacaggaacanngnccacagtggaggatggtgcgcagttngggacccgcggaantctacaggacctctatcntctcgacnatngttgcggcancggttccnagttnagacttccggtct

SEQ ID NO: 88294 - DNA, 538 bp, Triticum aestivum
  unsure (1)..(538): unsure at all n locations
  Clone ID: PAT_TA_88294
cgcgcatccaccgctgtgctggtgatcagtgatgaatgactgatnaaccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaaggtcttgcgtacgatatctccgacgaccagcaggacatcaccagagggaagggcatcgtggatccctcttccaggcgcccactggcgacggcaccacgaggcgtcctcagtcatacgantactcaccaggactcaagaatacgactcgacaacaccatgggaggttctacatcgtcctgcttcatggacaacttgttgtcactctccaagaatnatgaccggccaaacananccatcatctggtatctggga

SEQ ID NO: 88295 - DNA, 247 bp, Triticum aestivum
  unsure (1)..(247): unsure at all n locations
  Clone ID: PAT_TA_88295
ttactttgttattcgcttgttgaggacagtattctgtcaaacacaatttggcatatagcttctttgattgaatgnngcaatgggacccaacanagcaatggttacaagaggtctttagnaccaaanaaagaaatgggggatgattgagtactcgggatgattggacaatctganactgttggcanctcaggtcaccattgangaaaacagttgggttcagtccacatgttgatnatgttcangcatt

SEQ ID NO: 88296 - DNA, 583 bp, Triticum aestivum
  unsure (1)..(583): unsure at all n locations
  Clone ID: PAT_TA_88296
ctcctgtctcgtcctcgtcccccgtcccccgtcccctcgtcggcgcccgatctaagtcaagatgagtcgtggcgggagtgctggaggtggtcaaagttctctgggttacctgtttggagatggtgagcctgcaaagcctgctgcagcaccagctgcgaagccagcacctgctgagaaaccagcactggcagctgccgatgtaaccaagcagattccagctggcattccaggtagccgggcgaacaactactaccgtgcagatggccaagaacacgggcaacttccttacggaccgtccttcaaccaagttcatgctgctccccggcggtggtccgtccctggggtacttgtttgggcgggaagtgatctccgttaatggatgctgcnatgaatgggcctgtactccgttanccatgtgngtgaaaactggaatgtttggnttcaacatttacacctgcgtcgatgtacccgtccgtaaggttcatgggtccaagctgactcctgcctgggaaccacttgcctaaaactgtcgcctnaaacaatcgtctcatcccaaaaaaaaaggggggccggtaccaatccc

SEQ ID NO: 88297 - DNA, 486 bp, Triticum aestivum
  unsure (1)..(486): unsure at all n locations
  Clone ID: PAT_TA_88297
gaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccaagctgcngctgctcctgctgcanctgctagatcattgatcatccgatcatgcatgcaccgcgcctncaacatcgattataccgattctactactacataccatgttaccgctacctgattnaaggcttatctatcacctggacctngcatcancatcaagnggcatccatgcttgtttttaacaagccccctaaaataaactccctggtttactatnaaaaaa

SEQ ID NO: 88298 - DNA, 599 bp, Triticum aestivum
  unsure (1)..(599): unsure at all n locations
  Clone ID: PAT_TA_88298
cttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagccngttgctggggaagacagccaatggatctgttatgtagcttatccattagacctatttnaanagggttccgttacnaacatgtttacttccattgtaggtaacgttattgggtttcaaaagccctacntggctctacgtttgngaggatctacgaaatcccccnacttaatcaaaaactttccaangcccgcctcatggtatccaanttgnanagagataactngaacaagtangggccccctttattggatgtactattaaaccaaaaatgggattatccncaaaaaatntggtnaacgnttg

SEQ ID NO: 88299 - DNA, 606 bp, Triticum aestivum
  unsure (1)..(606): unsure at all n locations
  Clone ID: PAT_TA_88299
ctgcttcggccggtcaaggggcgcccgctcccgcctccctccctccctcctcctgcggccggtcgcggcggcatgctggcgtgaatcgagcggcgcggcctgagacgaaggcgaggggcgagcacgaagagcgaccgcggcggcgagctgtggtaccgcgtcgtcgacggatcccctcctccccgccccggccaatcccaagctctgaaaagaggctgcacaatggagttatcaaagcagggccaggaacccatgtcagctagcatgggatctcaagcactcccctcttcaaatatccaacctactcagaccgggtatcccactgcattctatcctcccctatctgctggctgggggtgcacagccaatgttctctacgggagcttcggtacctgtcaagttcatattatattgtccctatngagtcaacaagctgcccaagctgggtgcttccaaggcnnanagacttcaacatccctatatctgtnagcagagtatcatgtaggccccgcancangtgctgaatgttcaaaacatccttgcccagcaatngacnggataaaagtgtcgcatctttgcgggaaanaaantgttgctctccaaagg

SEQ ID NO: 88300 - DNA, 511 bp, Triticum aestivum
  unsure (1)..(511): unsure at all n locations
  Clone ID: PAT_TA_88300
ggcctctctctgtttgctctcgcgtccgccgcgcccatcctcgtccgcgcctgcgccccgaccgtgctcgccgcctcccgcccgatccaccggtccaccaccgcgccggcggcatggcggatcagctcaccgacgaccagatcgccgagttcaaggaggccttcagcctcttcgacaaggacggagatggttgcatcaccaccaaggagctgggaacatcatgcgttcgctggggcagaacccaacggaggctgactccaggacatgatcaatgaatccgacgctgatggcaatggcaccattgactcccagantcctcaacctgatggccgcaagatgaagacaccgaccaagagaagactcaaggagcttcaggttttcacaagacaaacgttcactctntgctgactccgcacttatgacaactcgggaaactcaccgacaaggagnggacaaatatcctnnacccactcaccgggtggcanttacanaggntttcagggatangcna

SEQ ID NO: 88301 - DNA, 315 bp, Triticum aestivum
  unsure (1)..(315): unsure at all n locations
  Clone ID: PAT_TA_88301
ccggcgcccctcgattccctcgtcnccactgctgcnctcccaggtctangnacaacgncagcgccancactctcangagtcttaaaccctcactcctctccttccaccacctctccacacacaccatctctgtcanacatggcgccttccgcnacctgcnctctccactccatggcatccgtctcccgcgctctccgcccgcgcccgcgtctcgccgctcctcgtntcggatgcggnctgananttggntgctctgtgcnatcatatggnatgtgccgncactgncaatgcngngtggggattggnnattgcgcc

SEQ ID NO: 88302 - DNA, 538 bp, Triticum aestivum
  unsure (1)..(538): unsure at all n locations
  Clone ID: PAT_TA_88302
ggttggattagctccacactgcagaagacaatgggatttgtttcaaaatcccgccaggcaaaattagggcaacagaacaagttttactatgatgagaagctgaagcgatgggtagaggaaggtgctgagattcctgccgaggagcctcctctcgctccacctccaacaaaatcctcctcataccagaatggcatgccagactataacttaaatggccctactagtggaatgcatactcctaatggagtggcagaacgaagtctccaaaacatgcagtcatggtttgggggatgccgccaatccgcccagccagaaccattttccgcgcgtggacgaacgggtgtccggccagtatgtggacacatcaacaagctgggtgcaactgggacggccatcttatacagaccggcgctacatctgtgacaccacctaccggtgcaantctttgtgcccacgnggtgcttcgcgcagacaaagcctaccaacatgcagnactggcgaaacttccaacgggagacgccanctcacgcagcggaaa

SEQ ID NO: 88303 - DNA, 569 bp, Triticum aestivum
  unsure (1)..(569): unsure at all n locations
  Clone ID: PAT_TA_88303
cttttttgtttcagttcagatcccttttgctttgcttgtatggcttgtttcctcgctcaacatcacctacccagcaaacaaactagtctattgtttgccccgtattccttccatttttatttgtttgtttcctgcatttttagatgttcttttactgatttgattcttaattttagttgtacttcgctattggtctcgatgagcactggttctcatttgtgtatcaaagataaagcttttgtgtttgttgattcggcttatggagagaactcattgtatcacagagatatccatgatgagctggtaatttttctttactacatgaatagtttttaatgctcctgctttattctggtcctcttttactttgtagttcccatttttttttgttctcccactgtatctcagtggtattttacagtgtaaatctattttttttangattttacacaataactctcaattgaattttgcagtgtaatttcctgtttacaatgtaattccaaaacaatttgcacggtaatcctantgagttgtgcacnccaaaaggtccacggaataaactnttc

SEQ ID NO: 88304 - DNA, 572 bp, Triticum aestivum
  unsure (1)..(572): unsure at all n locations
  Clone ID: PAT_TA_88304
ccactgcaacggcattgccgtcacaagtctatccttcccgcgtcaacggcagcaggtccatggcgaacaccgtgatcctgtaccccggcctcaccgtgagccacttcgtccccatggtgcacctcgccggcgccctcctcgaccacggctacgccgtctccgtcgcgctcatcgaccccgccgtcaacggggaccccgccttccgcgccgtcgtcgcccgcgcggtcgcctccatgccgtccctccgattccacacgctcccgccctccgaggacgcgcccacgctgatcgcgccgttcatccccaggtacctcgacatcgtcggccgccacaacgaccgcctccgcgacttcctctgctcctttacacgcggcgtccacgccgtggtcgttgactcgctgtccgtcgaggcgctcggcgtcgtcaagcggctcgggatccccggtacgtcatgttcacctccggcgcggcngcnctcgccgccttcgtccagcntcttcgtctcgcngnggcncgaagacgttcatgaagctaagcgacgcgccgctcagttatcggccttcgccatgctt

SEQ ID NO: 88305 - DNA, 550 bp, Triticum aestivum
  unsure (1)..(550): unsure at all n locations
  Clone ID: PAT_TA_88305
cgagttttttttttttttttttttttttttttttttttttttttttttttttttttcgtttcttttttatttataccttcncttctttaactttanttttancnacttaccaanagnatcnaccggctcnaactcnaatttgatcgccttccaaacttcacaagctgcggctacttcaggactccatttncaaagctgctcggataatttcattaccttcgcnancaanatcgcgcccttcgttacgancttgtacacaggcttccaaagccactcnattancggcggcaccangtgcatttccccaaggatgtccnaaagttcctccaccaacattgtaatacanaaccgnccccaaanatttcggtcaagagctggcanannccaaacatggaagtacnacctgaaagctaccgggcanaaaaacctggcatggnntacccantcctgaaggaaaaanatccgccangacnaattttttcaatnaacncatcngngcaatacatcaccannaacccaaaactcattcgcggtncccttncaaanttcc

SEQ ID NO: 88306 - DNA, 498 bp, Triticum aestivum
  unsure (1)..(498): unsure at all n locations
  Clone ID: PAT_TA_88306
cgagttttttttttttttttttttttttttttttttttttttttttttttttttttcgtttcttttttanttanaccttcncttctttatctttacttttanccanttatcaatagnancnaccggctcnanctcaaatttgatcnccttccaaacntcacaagctgnggctanattcaggactccatttncaagctgctcggagaanttcattaccttcgcgancaagntcgcgcccttcgttacgancttgtacacangcttcnaaagccacncgattagctgctgcaccaggtgcatttccccaaggatgtccaaaagttcctccaccaaattgtaanacatcaatcggccccanncatttcggncagagctggcaaatnccagngcatgggtaccaccngaagcnnccggtataaaacctggnatgggtnccaatccctgantnnaaaatattccgcgagcacantctttttnaanngaaatctncgcgcaatt

SEQ ID NO: 88307 - DNA, 578 bp, Triticum aestivum
  unsure (1)..(578): unsure at all n locations
  Clone ID: PAT_TA_88307
cgggagatgggcaacgccgggagcgcgggcgcgccggagcaggcgaagaagccggaggaggccgacggcgggggcgtgggcggggccccgccgtccaccgtgcggttcttccccgccgccgcgcatcacacggccaggcanccgccgccgattaagctcgagggggaggacctgccgccgccgccggccgccgccggncnagggcgtggangaggacatggccgccccccgcaacctctggcaggtgtacncnctgggagcgttcctggnggcgcgatngggctgggccaagtgagnacgagagcanggaccganacnactctgacgatggccagttgccgccnccggctgcttcatccttaggtccatctcctnccaacgtaangaccgaccnggntctgcttacggtctgaatcatcactcttangntgttncanagtagatgaanttcgctgaaactcctctcaaagggaaccggtggnnggaacgacaagttgacgcnttncaatcatcccgatcagagnttttcctcccaccattgtcgctggtttaacccgnataacnntggattncancaa

SEQ ID NO: 88308 - DNA, 582 bp, Triticum aestivum
  unsure (1)..(582): unsure at all n locations
  Clone ID: PAT_TA_88308
cctcgccgtggccgccgccctctcctccgccccgccgtcctcctcccacagccgaggcagggccaccccctcctcctgccgccccctccccgcctccgcctccaagtccaaggccctgcgcgccgccgccgcccccgccgccgacgcggtcgacgaggaggcccccgcctcccctcccccctcagatcctggcaggggagtggagaacctggtgatcatcggctccggccccgcagggtacaccgcggccatctacgccgcccgggcgaacctgaagcccgtcgtgttcgaaggctaccaggtgggcggtgttcccggaggccagctgatgaccaccaccgangtggagaatttccctgggttccccgacggcatcaccgggcctgacctcatggacaaaatgcgcaagcaagcggagcggtggggtgcggagcttcacaagaagatgttgagttatagatgtgaagaatangccgtttgttatccgtagcagtgacgagaggtaaatcccatagtgtatcattgaactggantactgcaaagcgacttaattactcgnaaagaagaatttggngtanagtn

SEQ ID NO: 88309 - DNA, 611 bp, Triticum aestivum
  unsure (1)..(611): unsure at all n locations
  Clone ID: PAT_TA_88309
agcccgcccggcgcgcccgcccgcccgccccagaaaaatggagacctccttcctcccgaccgcgcggcccctcccggcgttccaaaccctagccgcggccccgcggtgcccccgccctctgcgccgctccaccatccgcgccgccatctcccgcgggcgcaaggaggacacggtcgccgtggtccgcgagcagctggaggggtgctacctcctggccggcatccgctacgagggcctgacggtgaagcagttccagggcatccgcgacgcgctgccggagtcgtgccacctcctgggtggcgaaagaacacgctggtggggaaaggccatcnagggcaccccctgggaggcgctcaagccgtgcatgaagggcatgaacgcctggctcttcgtccacacggaggaagtccccgtcgcgctcaaaccctacgcgccttccaagaaggaggaacgcctctanggagacaacgactcatcngggccgtttccanggcaagtataccgccgccgagttaaatccctcnagacatgccaancgcgccgagtcnctcaaactgctcggngcctcaaatggccgcaactcctctcacaagctgnagggccgcaaggaa

SEQ ID NO: 88310 - DNA, 605 bp, Triticum aestivum
  unsure (1)..(605): unsure at all n locations
  Clone ID: PAT_TA_88310
catcgatccaacccatgaagcatggaagccccgcaggcatccagcgcgcccacaagctacttctccccgatgcccatcgtccccgccatggttttggagctcatatcggttgccgatctgagccgccccgggaatcgacgccgccggagtccctcctcacctacaagaccaccgccgccctaccacctcgtctcctcgtccgacgcgactcctacctcctctgcttctccctgtgccgaacgacaagccgcagccctcgtcccaaggtccaggccgtcgccgcgtgcccaagctcctccgcccccctgcagactcatctccggccgtgccggtgactantggccgctcgccggagcacaccgaaccaagcagctgctccatgccgtcgccccagtcttcctcgccctccttctcctccctttcccggctgctctccgtctcctgaaaatccctggcctccaatccctggaaggtgtgggcctcnaacgccaatgggagccgctgcctccgttgttaaccgggatgggtccnatttggatngctcngctgcnggtccaanccgccgccgtccaaggttctaaagcgggccgcataaccgggagtcc

SEQ ID NO: 88311 - DNA, 630 bp, Triticum aestivum
  unsure (1)..(630): unsure at all n locations
  Clone ID: PAT_TA_88311
cttgattggtatttgttaacctagtaatttttaaaaatatatatgctgctcactttcttagttgatgtgaattttcagaatgactttgtaaatatacaggttatttagtaccactgtaatctatgttactccatgttgcgaatcttggggtgattatatagcatttcttcactgattagttccatcatatatgttagtgactgttacttatcttaatttacaatcgcaatttcttgtttgctcggtatctcttgttccatgcaccttcatcgcatgagtacttggctagaaatgtatgctatttctaatatttgtttgtatcattacatactagtacttctcaacagttgtgtctcatctgttacagatgggacgccaccactcccaagtactccaaaggcccgttatgangaagttgtttaaggaatcctcttcataacctgaagaaggtcggctacaatccctgacaagggtcccttccgtccccatctccngggtttgaagggtgacaacatgattganaagtccaacaaacctngacnggtacaaagggccctacctgcttgaggcactgatcagatnaatgagcccaagaggcccaaaaaagccatgcgtcttccctcaggagtt

SEQ ID NO: 88312 - DNA, 615 bp, Triticum aestivum
  unsure (1)..(615): unsure at all n locations
  Clone ID: PAT_TA_88312
atatataaacaggacaaagtatacaagttagtaatgggcacttcagatgtgatgccatgtgaggaagccttggtatgatacaataagagatggtaatttgagggaggtcagaatccaaatttgtagctacctacccaggttactaaattcagtatactataaaaattatgtgctgctgtagtatttatctacaatcgagtatggttgtcggtctgtttttcagattactgctagcttcagttgtatttcctggatgttcccaaaaacatatgtggagaactctcttccaggcgattgggatgtcacttaactatgctttctgctattttttacagtattgctaatgccaaactgttgtcattacttactggtgaaatttaaaagctatatatttgcatgtatatgcgggtatttaatttaacatgatccngaatattcctgaatctgcagttccacactatgctttgccgggacaaccaatttaagtttcccttangtatccaaacttntccgatcacatgggcgaaggctgatgatggctcncctggtacacacataattggaacacngatgcncaatgcagcagtatagcactctgccncattatcagncacn

SEQ ID NO: 88313 - DNA, 361 bp, Triticum aestivum
  unsure (1)..(361): unsure at all n locations
  Clone ID: PAT_TA_88313
tttttttttttttttttttttttttttttttttttttttttttttttttttttttgancatatgaanganagtatgcaanaaaatttatgaagtgccaaaaaaangaaatttacagtcncgctcnacgtgctcgatgaattcactgtanaaataatcctataattgtgncaatgtactatgtanggctttcttttctttatttccgnagcaagtanaacaagcnnantcttttttatcacngttcctcanacctctgcttgctgangtaccagttgttccncnttgacaaangaaggngtggaacccgtngggaanccgagntcggcagntcaacgaccgccaccggatcangccacatgg

SEQ ID NO: 88314 - DNA, 595 bp, Triticum aestivum
  unsure (1)..(595): unsure at all n locations
  Clone ID: PAT_TA_88314
gcggaggggttttcctcttcttggacccctcgcccttcccccttggggcggccttccttttctttcctccccccgctggggggggagagctttcttcttcctcctcattttcacgggaggagggcgtctcagactcatcggatgacgagtccgacaacaccatgttgcgggtactctttcgagtccccgtggtcttcttcttcttggccttcttttccggcaccacataaggcgccagagccagcagcttcactaagtagagctggggctgggtcttcgggtagcggagccggacagttaatcggtccaagataccgcccgccaagcctgtcaaaggtangggattttagattnccgcatagagttaaactatgaaaaaagctgaacatcctgtaaaaggtggaaaataacttacctcgctggcgtgacgctncaagctgtatcccgcggtcctccggaaacggatgttggaacctcggngcctttgggtaacaccttccaagacgtctcaatacatcgtgtccaaagaacctgttnaaggtttgggtgccanaacggggacaaatcccacagattaaaaanccgttgttgggan

SEQ ID NO: 88315 - DNA, 588 bp, Triticum aestivum
  unsure (1)..(588): unsure at all n locations
  Clone ID: PAT_TA_88315
ggtgccatgtcatgacaccatgtcaagtttcatgattttcaggcgggttttggatttacaagaattttataaccaagtttcgcacactgaggtgacacgttccccatcggaaccacgagccttcttgagagaagatccggtttgcaagaagcttataccaatttggccaaaaaaattaccgcagcatgttgataccatgtcatgacaccatgcgaagtttcatgagtttcaagacatgttttggatttacatgaattaaaaaatcaagtttctcaatctttccagtccgagtcaagacgcctagatgtttgaatttcattcccatttcttgcatgtgacctaagaaatcacccaaaggacacacatgtgatttttcaacgaactttggtgcactgggacatgtgcttgtagttcaaatttaaattaancacattaaagcccaagaaatcaattaatgtataaaaaagggacatttacatctgtgcccctaaccggaaccactactcaanattgcccctagttctgaagcatgctcaaaattaccccnccctcctaagtcactactcagaaatgccctccgtacaaaan

SEQ ID NO: 88316 - DNA, 590 bp, Triticum aestivum
  unsure (1)..(590): unsure at all n locations
  Clone ID: PAT_TA_88316
agtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcngagttcagcaaggttgggttcatcttcccgtngagcacaacgcatcccctgggtactatgatggccggttactgggacaatgttggaagctgcctatgttccgggtgcaccgacgccacacaagtgatcaacgaagtggaggaagtcaaagaaggataacctgaccnttattccgcatcatcgggattcnacaacatgcgccaagtgcaatgcgtcagctcaacgccntcaanccacggggctgcnaagantccnggaaaggctaaacaactactcacaa

SEQ ID NO: 88317 - DNA, 311 bp, Triticum aestivum
  unsure (1)..(311): unsure at all n locations
  Clone ID: PAT_TA_88317
ngcngccacgttcggcaanccaanntacgacaggctgccnctggatcaagangccnacggacnggngctgtgctgtccgggtcngagggcgccgccacncacctggagcanacanggtatacgggggcgccgccgtgcccgcgacgatgtnccccgtgccncnagacgccgcccacnccacatgtncgggnactgtcgggcaggcngacgtggcgcnggctccgntgagaatcattcngcgcgctgaagtgggagaatcctcgccncngcttngttcccctanctaggtanttcngctttctgcttcntcc

SEQ ID NO: 88318 - DNA, 580 bp, Triticum aestivum
  unsure (1)..(580): unsure at all n locations
  Clone ID: PAT_TA_88318
gaacgtacgtaaacatgaaatatatgaactacaaataagtactcaatttaaacacatggtatacccaagcacaaaaggtgcactacttacatgattttatccatacaagcacacttccaaccatttagacagtagggcagaactagactttgcgttatatagcactggtgacaacaataaagatagctgctccacttactaacactgacacctttttcaggttcagactaatctacataacaaatactttactacaccacgaggaagtgccatctcaagatgttttgctattgtgcttccccatgtcacactcacaacaactgaaactgcaaatcccgacaccaaacctagtccaacaaagaggaatagtataatgtccaccgatttcctcctcaaatgaagtgtgaagaccatatttggggttggtcctctccgcatccttggacaatggtagtccacacangccaatatccccaagaaatgaaagattantgaatgtctgaaaatggggtggatcnggtaagttccaaccaaaccgttgtacgacaagttcaataccgaaaggaatcaagccatgcta

SEQ ID NO: 88319 - DNA, 582 bp, Triticum aestivum
  unsure (1)..(582): unsure at all n locations
  Clone ID: PAT_TA_88319
ctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctccgagttcagcaaggttgggtttatcttccgtgagcacaacgcatcccctgggtactacgatggccggtactgggacaatgtggaagctgcctatgttcngggtgcaccgacccaccangtgatcaacgaagtggaggagtcaagaangatacctgacgcgtatgtcccgcatcatcggatccgacaacatcgccaagtgcaatgcgtcaagcttcatcggcctcnaagccaccngggctcnaaggaatccgggaaaggctaaanactcaatcaacanngggccacatataaatngcaatn

SEQ ID NO: 88320 - DNA, 570 bp, Triticum aestivum
  unsure (1)..(570): unsure at all n locations
  Clone ID: PAT_TA_88320
agctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaaggccgtgaaggtggttgacattgttgacaccttccgtcttcaggagcaacctgcttttgacagaagcagtttatctctcacatgaagcgctacatcaagaactctctgccaagcttgaangggatgacnagatgctttcaaagaagaatgttgaatccgccacaaaatatcctcctaacaagctcaangaccttcaattccttgttggccaaaacatcatgatgatggcngcgtgtgttcgcctactacaagganggaactgccgatcaaacttcccgtactttgcanatgggcnaaanaggcaaatgcnaatccaactgtatgctaa

SEQ ID NO: 88321 - DNA, 236 bp, Triticum aestivum
  unsure (1)..(236): unsure at all n locations
  Clone ID: PAT_TA_88321
ttcggttcgggtccgagagtagctacgcctagtctagggtttccgtagttcggagacgannanaaagggagagatncatggcggagacggagtaccgctgcttcgtgggcggcctcgcctgggccaccgacgaccacaacctccagcaggccttcagccactacggtcnagatcctcgacgccaanatcancaacnaccgcganacgggcaggtcccgtggcttcngcttcgtcac

SEQ ID NO: 88322 - DNA, 587 bp, Triticum aestivum
  unsure (1)..(587): unsure at all n locations
  Clone ID: PAT_TA_88322
ggaaacggaaccaacaaatccccagccaatctcgtccccgatcgaccccaggctcgtcgaatcctcctcccccaccgcctcaagatgcagatctttgtgaagaccctcaccggcaagaccattactcttgaggttgagagctctgacaccatcgacaacgtcaaggccaagatccaggacaaggagggcattcctccggaccagcagcgcctcatctttgctggcaagcagctggaggatggtcgcaccctcgctgactacaacatccaagaaggagtccaccctccaccttgtcctgcgtctgcgtggtggcatgcagatcttcgtgaagaccctcaccggcaagaccatcactcttgaggtgggagtcatctggacaccatcgacaacgtcaagggcaagatccaaggacaaggagggcattccccccgggaccaacaagcgccatctttgctnggcaaacaactggaggatggtcgcancctccgctgactacaacatccagaaggatccaacctccaaccttgtcctgcgtctgcctggtggcatgcaantnntcgtgaaaaacctcaacgggcaagacatnn

SEQ ID NO: 88323 - DNA, 586 bp, Triticum aestivum
  unsure (1)..(586): unsure at all n locations
  Clone ID: PAT_TA_88323
ctatcgaagtcaccagtcaaaactactccgtcgttgtgcatatgctatacgccaaaaggatggtgggttcgtgtcccgttatggagtctcaggatgccaatggctgcgcgcatcggcatccttatccacaccgtgcgtgcgccaccgtcagttttcaccggcgcccgtggcctgcaggccaaccacactcattgtccaaactgcgcggcgttacaggtgtatgaccggcagcagtagttcacgccaacacgacacagtccgcgtgctttccgtgcatgctgccacagtagaaagccgtggacgcgggactccgtcactaagagtccaggatcacaggatataccaaagagcccacgcatgtacgggagcgctggtagcctgtccttttcaatccaacgcgcgggtggaaaatcnagangctgccttggatattcgctgtccnacgtaaaattcaacgaaaaacgatgggaaanggtgatgctccaactttgtatcaactngcaacaaagattttaccaagttaatatacctaatacgcaatatacctattacngcagtaacatcaanggccttaatggtaatttnt

SEQ ID NO: 88324 - DNA, 593 bp, Triticum aestivum
  unsure (1)..(593): unsure at all n locations
  Clone ID: PAT_TA_88324
gttttttttttttttttttttctttcgtttgcagatgatgcaaacgccaaaacacgcggccagtagcactatgaaaccaccaacagctccacctatgatggccgcgaccgatttcattttgccagatgccgcgctgggactggcatcagctggcttttgtggaagtggaggattgagcccagaaagattgttcggtgatccgtaattctgtagcttgaagacctccagaccattcagtattgcatcaaaatactctgggtctgcttgaaagatcagggtggagtgcaatccacatgtccacctgaccgaaaccagcagccatgataacatagccgtgtatgttgttcctaccgattcctccgctccaagacgatgacatccatttgctccctggaactgtctggttggttgatggnagatgaaagaaggacctccggattggatccttgataataggatactgaatcccaacaagaaatggganccttaggaggtaaaagaacccgcatcaaccggtaaaaccaagtaagggtgtanttgaaggttgatctgtgcaattgggcccatcnaancgagctgtacaatagaaacag

SEQ ID NO: 88325 - DNA, 601 bp, Triticum aestivum
  unsure (1)..(601): unsure at all n locations
  Clone ID: PAT_TA_88325
ctagggtctgggcttttgatttccttctggaaggaccaatggctagaagtgggccgtttatgccagctcttcccgacgttgtattccttcgcggcgcagccagcttgctcagtacaatcacaacattctaatggttcatgggctattcagctccaccctaatctctcacaaacggcctcaactgagctagctgccctgcagggtttgttgatgggcattgctccaaacttactgcatgaggacaaacggtctgcttctgtgagctcaggacagctttgcactgggatacttctataggctactcaccttccgaggggttttgacaacttttcacacttggggtttggggatgtggtgatccccctcaagcacagaatcttcctatggcttgctttccgtggccgcctaaacactaaaggataacatggtaaagaaaggctgggtccggaggctgccccgtttngcacattgtgacagttgccccgctgttgagtcaatcgattacttactactacccntgcaagatggagctggacttctggcttgctcggctacnaatgtccttcctttgtggagcaagcacaacacaagatagtttatg

SEQ ID NO: 88326 - DNA, 563 bp, Triticum aestivum
  unsure (1)..(563): unsure at all n locations
  Clone ID: PAT_TA_88326
acgcagacccatctccccaaaatccatcccgcgggagacacgagcgtgcgagggagagaggccgctgctcgtcctggtcccggtgggatgaagattgacgatcccctcgacttcgagggggataacgaccccctcctcaccgtccgccgccccgccaagaggaagaaggttattgggctggatgatctcgtagaagattactttaattccggtaaggatgagctcaaagcttctgctgctaagtctaagggtcgccccaaaggagacaattcagacgatgaagataggcaggtcaggaagaaggagattgacttctgcaaatttgtggaggagtgtgaggaaaaggcgaaagcgatggatcctggagaggatgtaccccaatggggccagcaagttttccggctgtcagaaatcaccctccggttcttaatagcacgggagttgaaaattgccaacttttgcaatcattctgtggggatgaagcattangttttgatcnagagattgaacgaagaaaaggcttttccnaagnatgctgatcaatggatggcntttgaanttgg

SEQ ID NO: 88327 - DNA, 598 bp, Triticum aestivum
  unsure (1)..(598): unsure at all n locations
  Clone ID: PAT_TA_88327
gttttaagtggccaagtagacagccagctgcaggttacaggctcaatattgcggccaagatgtctctgggatgatccggttaagccatggtgaagcatatttgcctcatgataaaggcaatggtgctgtggcgactaggttggcttcaaacaagtccagctatcttcttgctggttttggtcaaacaaccacttcgcaagatgtctcacgtttcttgggtgcattgtcaacttcgccagacaaaacagaaaggactcttgagaatggaagttttaagccaaacattgatgcccgactcaatgacttgaagctcacgctgggaccaagaattaagaattgtttatcctttaattctgaactttgctgtcagtggtgaccttgagcttaatggcatggtacatctaaagtacataagaccgaagggtatattaacatttgaaaatggtgangtcaacttggtagctactcangttagacttaaaatgaccanttaaatgtnncaaatttgagcctgatcttggntaaatcctgttcctggatccgtccntgttggatctgaatggcaantcaaatcataatcgagcaacaantggaagan

SEQ ID NO: 88328 - DNA, 513 bp, Triticum aestivum
  unsure (1)..(513): unsure at all n locations
  Clone ID: PAT_TA_88328
cccggctccctctccgcgacgtcgtcgacgacnccggcgtcgggggcaaggcgtccaggaacctgaggctgaagcgcccctccgggaggccccangggaagcttgacntcngcgtcgccgtcaaggagccggccangtactacgactccaacgtccctggcggctacccggcgcccgcggggtacggctcctcccgcnatgcctacggtggtgggtatggtgccgganccggcgcgtactgcgccgcggcgggggccggaggctacggagcgtacgcggccgcggcgcctccntcngggtacccgggctacggctccaccgcgccgcctccccaaggccgcancaccgtacggctccgctccacctccctacggcgccgcgcccccggctcatggagcaagcgcctacggctcctctgttcaaccggcatactgcgccacaccgccnactcaagggagcnggcgcgttangctcctctgcttctgcttacggcccncgcaaccnggtcaaggc

SEQ ID NO: 88329 - DNA, 604 bp, Triticum aestivum
  unsure (1)..(604): unsure at all n locations
  Clone ID: PAT_TA_88329
caacaactcgctgtccggcgcagtcccggatggcatgtttgagtgccggaacatcacgagggtgaacatcgcgcacaaccggctcggcggcagcctcctgccgctctgcgggtcggcgagcctgctatcgttcgacgccacaaacaactcgttcgagggcgggatcccggcgcagctcgggcggtcatcgtcgctccagcgcgtccgcctcgggagcaacgccctgtccgggccgatcccgccgtcgctgggcggcatcgccgcgctgacgctgctggatgtgtcgaacaatgcgctcaccggcgtcatcccggacgcgctctcgcggtgcacgcagctcagccacatcgtcctcaatcacaaccggctgtcaggccccgtnccggccctggctgggcacgctgccgcaactgggggagctgacctctccgccaacgaattcaccngggcattgccggtccaactcaacaaagtgctccaagctccctcaagctgtcgctccnacggcaaccagattaatggaacggngccgcctggaaatngcaagttggcttctctnaagtgctgaatctggcgcaaaacaagctctaaggtcngtacggca

SEQ ID NO: 88330 - DNA, 609 bp, Triticum aestivum
  unsure (1)..(609): unsure at all n locations
  Clone ID: PAT_TA_88330
acgacctcctggcgccagaaggagaggtcaccacccaaacttctgctttctccatccagagctctcccggcggccgagcccggggttagggctaggttggtcccggtattcgcctatgcgccacccctagccagtgccccgctcctcctccgccgctgacgatatggatctgcccgacctcgctgtcgtgctgcgcgccgcgctcagccacgtccccgaggagcgtaagaccgcggaggagacctccaaccagattatgatggagccaaacttggaagatctgatatccagcctggtcccaanctcaacaaggngtttcctacagaactgcaaaggcatgttnatncaatgggtttgagccttactcctggttaacattgatcggttgcgccgctcaanaacatatttgnaagncnccttgtacaatggagaaatgataagaaatttnttnctggggcgatnnattatgggttcaacaatatttcantngaacccnaatggatttaaaacaanatngttncttgctgctaaaagtnaaatganaacgaanacaaataggcanttataaatggtggttnacctataaatataaaattataacaggaatgg

SEQ ID NO: 88331 - DNA, 584 bp, Triticum aestivum
  unsure (1)..(584): unsure at all n locations
  Clone ID: PAT_TA_88331
gtgttttaaaaaaaacattaatcatggtttaaattttataaatgtgtatataaaaatgttcctaactgtatagaaaatttctataatgtgtatgataaatagtagacataaaaaacattactagttttcaaaattgttaatcatctatttgaaaaatattaaacatgtatataagaaatatgcagaaaatgtagaatgtgcgtatgcaaataagtttaccctgaaaacttgtttgaaagaaatgttaatcatgaatttttaaaaatctccgacaataaagcaaagaaagaaacacggtataacanctantaacangaanggaaagaccgaatcccggatataacaccgaanngaagnattccaaanaaacattgngtagttaacagnccaaactagaatgaagaaaacgaacaactgtggtggatggttataggacacggtacccaatctgcangttcaaacctggtgccgcattatctgggttatttagattccngcaacccatcatgggaggagcttccctcgatacgagngctacgggactcctnattcacatatagcgnccatcttcaagggncaaggaa

SEQ ID NO: 88332 - DNA, 455 bp, Triticum aestivum
  unsure (1)..(455): unsure at all n locations
  Clone ID: PAT_TA_88332
ctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggtggcgtcgactccttccccttcaangccggcaagtacganatgaagaagttctgcctggagcccacctccttcaccgtcaangccganggcatccanaanaaccagncgccggccttccaaaagacnaaacttatgaaccgttnnactanaccttgacanatgaaggccgctcatgtcngnncgacgcacctcanttccangacaangacgcatcactatgcggcgtcacgtnnactcnccg

SEQ ID NO: 88333 - DNA, 463 bp, Triticum aestivum
  unsure (1)..(463): unsure at all n locations
  Clone ID: PAT_TA_88333
acatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaaagtgggtgccttgcctcgaattcaacaaagttgggttcancttcccgtnaagcacaacgcacccctgggtactacnatggccggtactggacaatgttggaactgctatgtccggatgaacgangccacccaggtgntaanaagtggaggagccacaaggattacctgancctaagtcgganaacggtncgnaaatgcg

SEQ ID NO: 88334 - DNA, 651 bp, Triticum aestivum
  unsure (1)..(651): unsure at all n locations
  Clone ID: PAT_TA_88334
cagcattcagcagcaccagccttctacctcctctgctttgcattccgccttccagttccaattccaaccgcaatcaatggctgccatgaagatcgccctccttgccgtggccgcgatggccgtcttgctaggcaccgcgtcagcggtaacctacaacgtcggcgatcagggcggttgggaccctcagcaccgactacagcagctgggtgtccggcaagaattcaacgtgggtgatgagattcgtcttcaagtactccgaccccaacgcacgacgtgggtccgaggtcaagcaaaggccggtacgatccctggcagcatcgacggcgccatcaaaccttgggctcccggcaacgacttcatcacctcnaacgccaccggcacccggtactcnatctgtggcnccctaacatggcaaccccacgccgccgcaacatgaagtcgtgatnaactcncctcggtcctcctcgcctnntcaccaagcaactgcagncctggcgcnanatctcccccgggncgccttcaaagcgctactccgtnngtgcacaaaagattggctcctcncctacggnggcggttaaggtnaaccataatgatactgcggccaatacaactttaatgtacacaacgtgtatacaggganaagtnttcttt

SEQ ID NO: 88335 - DNA, 536 bp, Triticum aestivum
  unsure (1)..(536): unsure at all n locations
  Clone ID: PAT_TA_88335
caggagcatgcagcgggaggtggcgttcctcaaggacgagctcggcagcatccacgctgtcctcaagaagctcgagaacatggaagaggagctcgatccacagaccagggaatggaagcaataggtgatggatatcacgtttcacattgaggactgcatcgacgagttcatgcatgaacctgggtgaggactctaacagaggagatgtccgatttgttgggcaaaattgctcaattacatcaaccgtttgagacacgtcaccagtttgccaaacaaatccaacagctgaagcatgggtccaaagatgttagtgaacctccggaaaggtataacttgataatgtgcccctaattctaacnngtanctgtaattctccgatgatgcctctacatcaaacacaacttgttngatgaaggcccaaaagntctacaattntttgcggaangagatttcaccgtcacncttaatgnncatgttgggttggaggcaagaaacaantcatcagttcagattntgcaaacaaanacgantcttcc

SEQ ID NO: 88336 - DNA, 628 bp, Triticum aestivum
  unsure (1)..(628): unsure at all n locations
  Clone ID: PAT_TA_88336
gcatccaacccatcttctttcctccgccgccgctccggtggtgcgatggccgcgcgggccctcctcctccggacaaccgcccgctgctgctcccctctccactccccatccgccgccccgcgcctgcacccgcggctccgcagccacgccgccgctccccagctccgcttccccgcgctctccttctccgcctccgccgcgtccaccagctcgcacggccccggcggcggtgacgnncgaaggggaagantgacaagggagcgtacgaagaactacctggggatnagcgacgacgagctcaaggcgcaatgcgacatgggaacttcaagtctccggcccgggggcaacacgcaacaagcgcgatccgccgtgcgcctccggnacatccacggatcgtcccaagctgtggaggataagtcaaacataagatcgttatcngcttgtcccggtttggacctgatggtctaaantnaggaggcgataaactngataatanatctcaattgaantctaaaaatgcaacgaatcnacaatnattaaagatntggancaaattggcaataccaaanttcaaggagaacttataatnnaatgcgttaagttttcaaggagaaatnagcnaaatgtg

SEQ ID NO: 88337 - DNA, 310 bp, Triticum aestivum
  unsure (1)..(310): unsure at all n locations
  Clone ID: PAT_TA_88337
cggctggcgacactgcttaccctagctaggaggagtgaggccagctcgcgctcttccatggccatgagcgagcaagatgggcagcacgccacgaacagccttcccggggacgcggcgaacggcgccgtcnacatcgactccttctcgcanctcccgttcgtgcggcccaagccgcccccggcgacggaggccggcgggtcnagccccacgtcgtccatccgcctcttcggcttcgactcccgcccgacggggcggcgtcctcccgtnaancgacggcgaatctgccgctgtcaactccactgtccccgag

SEQ ID NO: 88338 - DNA, 394 bp, Triticum aestivum
  unsure (1)..(394): unsure at all n locations
  Clone ID: PAT_TA_88338
cagtgacgcgccgcccgtaccagttcgccgcactggcaggcaagctagatgccaggaacaatcacgccgcctttggcatggagcgcgaaacgggtaccgtgacaaggacggcggaaccaaaagatcgctggggttcacgccggaggtagcgagtcacggggcgagcctgcgtgtcaagccccgtgcgtgccgcgcaatcttgggttggattggctggttctggatcggtacatttagtacaaacgcgccgcccgggccgcaccttttgtgatgaccagcgagtgaaggattcatcatcaactaaggnactggnnaagggtccctcgaagnaangccaaacaagntgtttgctngcgttccaananaaaggnaaantntttccctccccctccgg

SEQ ID NO: 88339 - DNA, 587 bp, Triticum aestivum
  unsure (1)..(587): unsure at all n locations
  Clone ID: PAT_TA_88339
aaacagcagcgcgcgagcaatggcgtccacctcctgcttcctccaccagtccaccgcgcgcctggccgcctcggcacgccctgcgcccgccgtcgggcgcacccagctgttcgtctgcaaggcgcagaaagagcgacgaggctgcatctgacgctgccgtcgtcaccagccggcgcgccgcgctgtccctcctcgccggtgcggccgccgtcgccgtcaaagtctccccccgccgctgccgcctacggagaacagcgaacgtgttccggcaaggcgaaagaaagaacacggattccctggcgtacagcgggaaggggttnaaactgatgattcccggcaaagtgggaacccaacaaggacgtgattcccctgggaagngctcccnctacnaaganaactttnacgcaacaagaactctccctttatatcaacccaccaaccaagaaacatcacgatagntccctgaagattctcnccaagtngttctcctcgggcanatctaagggggaaaccanccaaggggttnataaaccttggnaagggaantcggaaancgcccgtggnggcgnaacatataaaaaaagggt

SEQ ID NO: 88340 - DNA, 575 bp, Triticum aestivum
  unsure (1)..(575): unsure at all n locations
  Clone ID: PAT_TA_88340
ggcgaagcacccctgcccttccacattcacggccaactggtcatccatgtcatcccctccgacttcaccaccagacaccaccgatcgtcttcagaagttgctccccactttacctcagctggggctcgggcttggccgcctcaacgcgtctcaagattccgaactctaagatcgcatctcactaggtggatgaaatgcaacaaggggatgaaggtccccttggaactaagggctccgttactctgtgcttcttgggtaaaatccacagtatctacctgggaggcaattggcaaccttcccaagggacgccttngtgccaacgccaccatcgcggctcctcaangctggttacgcttttggcccattgatgacctgtctccaantcctantcaaaacatttggtatgacacgcttcccaactcaanagatttccggaaaaaatgctctgcnataaaancttgcaacncttgggaanaagctcaatggcggcttgngaattgttcctgcctgttccctgaanccccnaaattcccaagttaaacnattaagggaatgcaacttnngaaacatgaaac

SEQ ID NO: 88341 - DNA, 519 bp, Triticum aestivum
  unsure (1)..(519): unsure at all n locations
  Clone ID: PAT_TA_88341
ccctgccgcttcccctcctcaccggccgctccttcctcgcggcagcccactatccccggcgcctcgcctccctactctgccctgccgcttcccctcctcgccggcggctcctccctagcggcagcgaccaatacggcgagacgacgcggccccacgagtgccggcgaggtcagcggtgaatacggcgaggcgccgcagccgcacgagcccccgcgacgtcaacggcgaatagggcaaggcgccgcngccgcacgagcggcggcgaggtcagcagtgaatacggcgaggcgccgcgtccgcacgggcggcangggccaaggcggaccgggcgcacagccgccgcgatgtcaaggggcggaagcggcaatacggcgaagcngttttgtcncggcggccgtaactcctnaatgcttgggtcaactcccgctgtgcgtcccnacgggatcacaacttccaaccgcgtcgntccggtccaagattcccgatntcagggancaacaatggatgtcattttggacc

SEQ ID NO: 88342 - DNA, 635 bp, Triticum aestivum
  unsure (1)..(635): unsure at all n locations
  Clone ID: PAT_TA_88342
ctagtctcgagttttttttttttttttttgcatttaacttccctataaaatcaaatatattacatggaactatttgcgcgctgcagctctttttacctttcaggtgggcattgaccgagactacagcgtacttgaccgccaatgttctcaaacatctcagtacagaagaacgcgcacgcccagttcggcatttacaggttcgacgatgagccactagatggcggcaacagtggtaggacgccttccttcttgcccatctcgtacagagctatgggccgagangccttcggcatctgacgtcctgcgccaagagtttggcaataggggaccacacgcagcttgatnagctcgccaaggnccccgcaagccgtttccttcccttggaaaccctgatanctcctcgtcaactgccccctgttaaggaacangcaactcttngtcanaacacccggngatggacattctgcaccaatnacaagnccaattaacattaattaacagtccccanattaattaacattctcttcnactccggacggngggcaaaaatncanttaacacaacatcaacgggagcccataaaantcaaaggancaccgtnnaaaaggananttccttgccaaaggtananaaaa

SEQ ID NO: 88343 - DNA, 625 bp, Triticum aestivum
  unsure (1)..(625): unsure at all n locations
  Clone ID: PAT_TA_88343
caagaccctgaccggcaagaccatcaccctggaggttgagtcctctgacaccatcgacaacgtcaaggccaagatccaggacaaggagggcattcccccgggaccagcagcgtctcatttttgctgggcaagcagctcgaggatggccgcacgctcgctgactacaacatccaagaaggaatccacactccacctgggtgctcnagctccgttggtggcatgcagttctccgtcnaagacccctgaccggcaaagaccatcacccttggaggtccgatcctctggacaccatcggacaacgtccaagccaagtttcaaggacaaggagggatcccaaccggacaacagcgtctcancctttggcngggaacacttttaggatggcccacttttggcgnctacaaatccagaaggatccacattcacttggggcnccttctgcccnggnggcaataacccctggcanggtttgctccgtccccgggttaaaatccccttgccncnggtccnccaaggatccggccgttcctttatccnaacgcttgttggtnacaaancgggatcatgtncctttnctcaaantcncngggtcgaacttgtgaataaaanatgncctgntcggcan

SEQ ID NO: 88344 - DNA, 625 bp, Triticum aestivum
  unsure (1)..(625): unsure at all n locations
  Clone ID: PAT_TA_88344
caactagctacctagccattatatacaataatggcgtccctcgccggagctgcccgtatcctggtggtggcgctgctggtcgtcttctccgcggtgatcatgggcggccacggagccgccggccgcgacatcaggggtccacaaggggtagtaatcggcagcccaccgcgtgggcatcatacatcggcctcgcattccatgcacccggtcttcaagatgcccccggcggcggcggcgcacctccccctgccccggacagcagagggatttggaggacagcctttgatgcatacgttcaaaacgactatccgtataaccaaattgggaccatatataccagcaaatanccataattcctgntccnntccatcgtgtgctttgggacatcactacttngatgccggataaaactgattatatggcctgccaactttgggcccttgcaagttttttgnacacaatncaaacgttaangtcatatacaccccatatnttaaantgtaacaatgaacgctttggtcaaatattaaattatgngtcaanctccnaaaaagggggggccgtaccaatngcctanatganctatannccccaagggcgtgtttaaantctacggaaacctggt

SEQ ID NO: 88345 - DNA, 566 bp, Triticum aestivum
  unsure (1)..(566): unsure at all n locations
  Clone ID: PAT_TA_88345
tttttttttttttaaccaaaactccagcaggagagggatctgctgagttgagcatcatcaacattaccatattacaatcatctgtctgtgaggtttctgcatagcataataaaaacaggatacataaataaataacaaagccctaccgacaaaccgcctttgtcgcctctagcaaacctacagccactgctggcaacatccaaaaaacaactaaaattaagtatgacgacggagctgcagaaaagagttaatcccaacgacaaaaagaaagcctaacgacgatatgggacaggaaancattcgctttcccctgctgttgtttcaattccctccnacccaaattntcanaaactaatatggtacagggaagaagagcanaagaaaanatgcactatttgccccctaagctacnacngggcctgctgctgcactgttccnaagtcttccanggggggccgcnccttgcccaagaantcnactcnaccgtnngcccttnanggcgccaccggtccganngggtcacaagatccagaccccaaccgncggtttcccgggcgcgctgcnga

SEQ ID NO: 88346 - DNA, 422 bp, Triticum aestivum
  unsure (1)..(422): unsure at all n locations
  Clone ID: PAT_TA_88346
agcagctgagcagcggaaatttagagggtcttataaattacaaagncgctctcgcnggtgcnaaactnagtnatnggnggaagtcggagcggcacaactgctctacaaacagaaggcgcaaggcggcngggcgacggctgctacttctcctttcaatgtcctccctacttctccaacggggaaagccactccgaacgcctccnancccggcnncccanttcttccgccggcnctcngggcgccaacgcgncccgctgnaccggttgatttccggccgaccccgcgcgcnattncgacatctcccgaatactcttcgacaaagggcgcgttttgccgcgcccgtcccgcccgttgtctccctntccggccgtttgggcggttnctgcaatttnnacaacgcngtgacgcnaaggacncccatc

SEQ ID NO: 88347 - DNA, 573 bp, Triticum aestivum
  unsure (1)..(573): unsure at all n locations
  Clone ID: PAT_TA_88347
cctcctcctagcaagctatatacctacatagtacagccatggcccccaccgtgatggcctcgtcggccacctccgtcgctcctttccaggggctcaagtccaccgccggcctccccgtcaagccgccgctccaacggcgctagcctcggcagcgtcagcaacggtggaaggatnaaggtgcatgcaggtgttgnccatccaagggcatcaaagaantccnaacctgtcttaacctgccaccgctcaacacggaggcctcctcnaagcaagtggactacctggattcgctccaaatgggngccttgccttggattcaacaaggtccggtcancctcccgtntanacaatgcttctccccgggaataagacggccgctactggacaagtgggaactgcctaagttcnggngaacgacgcacacaggtatnaacnaggtggaggaggtcaanaaggatacctgaccctaattcgcataatcggtntanaaatcccaantgnatgctaantcaatgctnaaacacnggntcaagatcggaaaggctaanantatcacanggcaaattaatgcaatga

SEQ ID NO: 88348 - DNA, 502 bp, Triticum aestivum
  unsure (1)..(502): unsure at all n locations
  Clone ID: PAT_TA_88348
caaccctctccacccccagcaatccacccctttcccctccccggcggattccctcccctcccgagctcggaaatnggaaaacgcatcatccgggagctggggattcaatgatgactgcaaagctgaggtttgtnggagctcaaagtccaaagaggatgcaccgcttcaataacctacaaggctgggagaaccagaaggaggtcattgtgggaccaaactgggggagcgccnagccaactaatgaggactncaacaaagacctccctnagaatgactggccgatcgcngtgttcgactccgactcaacaacccggnngatttgcaaaagagcaggtcctccatacctccggnccccggacacgcaaagttangagaagatgactncgctanacaacgagaatttaagagacctggacggatcaaatncagannaggactgacccnncaaacaactggnntgttaaaggacgcccactaggaatcacccaatccccatatggnt

SEQ ID NO: 88349 - DNA, 639 bp, Triticum aestivum
  unsure (1)..(639): unsure at all n locations
  Clone ID: PAT_TA_88349
agctttagcaatagntgaaacttgttctttctaaggcggtcaccanatttggaccctcacaaaagagctaacatagcagcgataanantaatcaacggnagacaacctcaattaggacctatgaacctctcagangtcatggangccaactttcatgttgttacaggtcatcttgaatgtaagtacatccataccaacctcaagtcctgttttcaggagaaatttcttccatccatgcttgaacaagatgcagccattcatgtgcttgttccgtcactcaagtcctanntgggacctctgcttgccaaaccataatctccgtcagtccatgcntggggatatccanatganaagctacttcctttgggttttcctacatgancatanactacangcaaaaaagtgtgagtnttanggcccagttcgaanaacagacaagaacatcnagaaacactgagganaataatgcacctatagagcgncataatngaaaanatntgtgcaacagaagcattactgaactaagttaaacaacctgttnanaaacataatcagggaaggnnactagntcactcgaagcaanctgnctangattcctccnaaaaanngggatatgcaacangcngangttgggttgnt

SEQ ID NO: 88350 - DNA, 611 bp, Triticum aestivum
  unsure (1)..(611): unsure at all n locations
  Clone ID: PAT_TA_88350
nanaananccncggngcnaaccncttcnacngcccgnagccnaactccccnaccgtcnacaacnggctttanancgacaagacnaggacaaggagcaaccaccgctaaataagagccgtcggccagagaactgaagcagggtgctcaacaacttgtgcgacgccgccatgtttgctgnccttttggtatctaatcctgctagcgtacgttgctgtcccgagctgatgtggttgtcttcancttctacnactgccnacaatgctggtaatttatttcccttngtccggatgcccctgcatgctaacaatnatggtgtangtgttgtgccccgtgttaacccaagccgtgtggtaatccccccctgtgtgttgngtgggcctcnccaaantttaacacctatngngaaaacaaaaaaaggggggcccggtccnatncccctanannancctataaacccnncaaangcttccttttaaatcctnanngggaaacccgggtttccaattaancctttgnnaaaacccctttcaaatgggnatacaaaaggccccntttccctcaaaatttccccaaaggnannggncccctttgggnataaccggggggttngg

SEQ ID NO: 88351 - DNA, 503 bp, Triticum aestivum
  unsure (1)..(503): unsure at all n locations
  Clone ID: PAT_TA_88351
gccccactctcagagagcacggacgccggacacgcacgagtcttcttgaagcaatggcgaccaccgcgatggcgctctccccctcgtccttcgccgggaaggcggtcaaaggacctgccgtcgtcggcgctcttcggggaangcgcgcgtcaccatgcgcaaagaccgcggccaaggccaagccggttgtcntccggcacccctnggtacggncccgaccgcgtgctctacctccggccgctcttccgggcgaccccccgagtactcaaccggcganttccccggcgactacgggngggacaccgcggggctgttcngccgacccccgaacttccgccnaagaaccgggantggaggtgattcaatgcccggttgggcatgctggggccgctccgtgctcttcccccaactgtcgcccgcaacgctcaatttcggcgagcgtttngtcaaaggcggnccaanttttaacnaaggcgctcnatactcnggaaccaactgtcanc

SEQ ID NO: 88352 - DNA, 372 bp, Triticum aestivum
  unsure (1)..(372): unsure at all n locations
  Clone ID: PAT_TA_88352
gttggatcgggcaggccccggtgagcagcatctgaatctggtcgttggatcgtatcccctgagctttcctgcctaccgcaactggtaaaatgccggattccctggaacttgctgctcacctgttgctatctcggcgctttcttctggatgaagatgacgcgcttccgatcgcgtgtttggagcaagaacaattgtctctccttgtgctgtgccgttgttttcctgaaatttgtacanttgtcacttgcatgctcctggtangacggntatgcctgtgtcctggaactggnggaatgtgtttggatgaacaagcgatgctactgacaatccgcaaatgcaaagttnnagcaattatacttcaaaaaaaaaaaa

SEQ ID NO: 88353 - DNA, 648 bp, Triticum aestivum
  unsure (1)..(648): unsure at all n locations
  Clone ID: PAT_TA_88353
ctcgcttgactcctccttggaagcacagagagagaggagaagnatggcgtcgttcnggtggaaagcncttnaccctggaggaggtcccaaagaaaagctcaaaggacactgcnggctagtcatcggcgggcaaggtgtacaaatgtgaccaaagtttcctccgaatgaccaccctgggaaggcgaacgactccttgctgtccttcaaacaagccaaaggatgccaaccgacgacttcnaaggacgttggggcacaacaacgaccgcccnggcgaatgatggacgattacnacttggggaaatttnaccgacaacgataccaacaaagtcaaattcacgcccgcccaagcaaccgcactacaaccaaggacaaaccccgantntgtcatcnaaattctccaattctttggcccctcnccannactggcctggcctcnccgtacggtttanacaagggngatctnctaacacgtcgtctatacaatcaatcaatcatcntccggaatgtccaaaactgaataattttanggggattgcaaanttgtgtncaaagnacgtcttaaggatcgggaatgtccaaccntcttgcttnggtcacgaatcnngtnaaactannggaaaagtaaaacttggnantttcaaaccggga

SEQ ID NO: 88354 - DNA, 440 bp, Triticum aestivum
  unsure (1)..(440): unsure at all n locations
  Clone ID: PAT_TA_88354
gacacgtcacagcacagcaccgctgctcccccggcgatggcctgcggcggcggcggcgagtctgaggcggagcggcgggcagagctgctgcgcgagataacggaggagggcggcttcgctttcgtcgcctcggcggagaaggcggcggcgggggacctgcgggcggcggaggcggcgcgggagatggcgtgggagcaactccactcggggccctggagcgaggtcggcagcgcgtggagggacgcctacgcgctcgcctgcctccacgtcgcgcgcctccgccgggccgccgccgancgccgcgccgcgctccgggcgctccacatggggctcatcatgnggggaaactctccgcgccgatttncaaggccccctggcctcatcgccgcggacccaacgacgcgaatgtgacggcncggagctgtcnatnaggaacaggg

SEQ ID NO: 88355 - DNA, 621 bp, Triticum aestivum
  unsure (1)..(621): unsure at all n locations
  Clone ID: PAT_TA_88355
tattctgtggggtatgctgctttatgagcgctcggttgtggagtttaaattaggactgccagcgtgggaggattgtctgatggcagcaattgagaagtttaaacttggaggagcttcagctacaaacattgctgtgttgggtgaagaaccactgtgcaaatgaaactgcccaggatggtttggggcttcaaatgtccatgaaatgtgcaagcctgggaatgagatgtacgacattaaacggtgggctgcgtgggtgctccatccttccgtctccgagccattatttaaggcgggagaacccccaactgcatatggcactgggagcatatatagtacccatgaattgctccaacgccatatnaatcctggggcacgttaccaacacaatttcctttggtaggccaattgctgattggggatacaatacatggatttgtccgttgcatttttaaacaccaaagatccgctcccggttgcaaactatcatnccgagggtggacctnccncaattggaacttaatgntttcctccgcctgtctctcaagcnaggaacntnctgtacggntaaacgnatcccctaantagaaaacaacaanttgcaaggntgggaccctatnttct

SEQ ID NO: 88356 - DNA, 631 bp, Triticum aestivum
  unsure (1)..(631): unsure at all n locations
  Clone ID: PAT_TA_88356
atgttgtcgaggttgtcgttagcccgccctatgtcttccttcccaccgtcaagggtaagctgcgcccagagatccaagttgctgctcagaactgctgggtgaagaagggcggtgctttcaccggtgaagtcagtgctgagatgcttgtcaacctcggcgttccctggggtcatccttgggacactctgaaaggaggagcttggatgggaagaacaagcganttgtttgggagagaaggttgcatatgcactccctcaaaggcttgaaaggcattgcatgtgttgggtggaacccnttgagcaagcgaagaactgggtttcaaccatgggcggttttccctgaacagacaaaacaattgctgacaagatnaaaggactgggcaaacgtggtcctcccctaatgaacaatgttgggcaattgnnaccggtaaatttcacaacggtcaagnacagganccatgcaacctgaggacggntcaagacaagtnacccnaagttgctganccagcggtanctatggaggtcgtaacggccaactcaagattgccccaaccgagtcatggtccncttgtggcntctnaactantcacaatataagcgcacgnatcgcnacannttcactggcctttggg

SEQ ID NO: 88357 - DNA, 540 bp, Triticum aestivum
  unsure (1)..(540): unsure at all n locations
  Clone ID: PAT_TA_88357
caaaatcaaggtagggcgggcgcccaacctcgccctaccgggtcctccgcctgtgttctggatgatgtcatgggcgcatgtgttggtgacttcgggttgactaagtttgtacacagttatacttcttctaggattgatggttctacgagcttagtgggaccaaagaggatcaattgggatacattgcaccaagaatatggctttggggagcaaaatctctacccgaagggtgatatttaacagctttgggatcatcgtcctaagaaatgctcacaagggaaagcgtccaactgatgagatgtttaaaagatgggctgacctttaacaatttggtttgaaaancattccctggaaaagattggcgaattctaaattcngaaaacatcccctattatgcgggccaagacggnaaacaagcaagctgtnattnangaaacatcctcaaatgntggaataactgcacancaacccnttaaatggcncaanttccngaaaaaaccaatttctccccaatgaggtttacttgaggcccgaacaagt

SEQ ID NO: 88358 - DNA, 530 bp, Triticum aestivum
  unsure (1)..(530): unsure at all n locations
  Clone ID: PAT_TA_88358
gtctcgagttttttttttttttttttgatagagaaattagaggtatagcaaaaataagcaagtggaaactgtacacataaatccacactagtggagtagttcgaaatcaagactgaaagaaaactttaggagtgaaaagcaccactgcttccgcaccgcaattcggtggaaacaaggaacaaatctcaataatacccgtccnattaagttcaagacataatgggatacacagcaagacaaatataagatcctcccnaatttaaacatccaagttcaaaagggnacaacataaataggtnggtaactaggangnacccantttaagtttcaaaacccaacaagcactacaattttacaatcacccnanccccccctngcctnattccnaacnattttaaataccggaccctaaacttgcnccctttttggnnggattaaccaaacaatccccaagttggctctcaaatatccnggcnaatattnngggacccttggaaaagncctccnagggacnggaccttnccttcccc

SEQ ID NO: 88359 - DNA, 609 bp, Triticum aestivum
  unsure (1)..(609): unsure at all n locations
  Clone ID: PAT_TA_88359
gagtttttttttttttttttttttttgattgaaagggctctcatagtatataccatgtatataagctataggtacactgtgatgatttaattaattaacaatacatatatcccaaatatatttactctgctctcctaccacacgcgggtcctttctcaatcctgtaattttgatncttcacgtcaagattcagctcccggtcccctttgagtcctcaatcctcaacgcccgctttggttttccncccccaatttatcnacgtncttacgtncaataccngcaatgcacgcaagcatcaatttagtacctttanaaattnggtccggtccaattantgcccccaaagnacgttantttcaagcatccgnattaacttncgttccccccaactagaacactttttgcaattgattnattaccaccgcanantttcaattcaacgcntcaatccncttggagggacanacgacgcccaagtccaaagncgcttcccgggccggnccgtggcccncntccctcacnaanaggccaancgcgtctgcggggaccactctcgaaagcttancctcaggccaacgtcacatccaccgtccantttgtccnaccnct

SEQ ID NO: 88360 - DNA, 607 bp, Triticum aestivum
  unsure (1)..(607): unsure at all n locations
  Clone ID: PAT_TA_88360
acatgatccctgtctctcttagatgtcaaggtcgtttctctccatattgtatacctctcataggttttttcctggcttttactttatgatgtgtagagattaaatggtatctgcttggaatattattgtatttggcactaataaatcataaataatggtatgagactatgagtatactcttacggttttacttaatttctacctccgttggatatagcatatcttctttgtattatttcacaggatctttgctagaagttaaaatatcctatataatatggaaaaagagatagcttaaaccggtgcatgtgtaattaactccatatattatttccgaggaagattcaatacatgcatgttcctcctcaaattaagtttcccttggggtgtatataaaggtgatgctcctccaangacaaacagttgagttaggaagaagtacatccatcaantttaacaaaatgcttccgcataacanttaccacaattataatcttaataaancccatacaaatagcnggttagcctagaatcanaatatcannaaaaagtcctaancggtaatagacttttccaatgngaagttganattctaacgaaagacaan

SEQ ID NO: 88361 - DNA, 493 bp, Triticum aestivum
  unsure (1)..(493): unsure at all n locations
  Clone ID: PAT_TA_88361
aaagaagccaacaccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaggccgccggcgccaccctcctcgtcgccgccaccgccacccacaaggcgagctccggcgggatggagatggcggcggaggatggcggctgcggctgcacccagtgcaattgcggcaccagctgcggctgctccctgctgcagcttgctaattattgatcatcgattatgcatgcaccgcgcgcatgcatcatatctatgatcgattcatccatccatctattacaatgttacgctactgatncaaggctttgtatgtatgttaanactgccaacatnagcaaacaagngcatcccatcatttnaccgaccctaaatnaactccgttggttaacctatnanaaaaaaaaaaaa

SEQ ID NO: 88362 - DNA, 593 bp, Triticum aestivum
  unsure (1)..(593): unsure at all n locations
  Clone ID: PAT_TA_88362
ccgccacacacgacgaacaccgggacgaagcagatcggcggcgcgtcactccaatcaccggataaatggcgacggtttcggattctctggtctgggagctcgtcaggaagaacaactgcttcctgatcaagcagttcgggcaacagcaatgccaaggtccaagttcagcaaggagcccaacaacctctacaatgtccaccctacaattactctggcctgggcaaacaagaagactgttgactgtgcagccaagctggctgataaggagatgaccgttggcctctccaacaacgaaatccaaagaagcaanacaagctgctgcttnacccacaagatgtcatgccaagggttccncaagatggcaaggtatcaagacaagtcattgaaactactaaggcnacttaacaacctgnctngcaaacnacgttttacgnaactcaagttgcaatccggtttcaanaaaaaacagcattacangagggcaatnactgtttgggtcgtggttaagttcaacttttaattgtcaaatagggatgattataanggtccccatacggananttcatgtcaatntccatatatttaccctaann

SEQ ID NO: 88363 - DNA, 632 bp, Triticum aestivum
  unsure (1)..(632): unsure at all n locations
  Clone ID: PAT_TA_88363
caaggtcgtcctggccagccatctgggccggccaaaaggggtcaccccgaagtacagcttgaagcctcttgttccacgcctgtctgagcttcttggagtggatgttgtgatggccaacgactgcatcggtgaggaagtttgagaaattaagctgctgctttaccagatggaggtgttctactccctagaaaatgtggagattcctacaaagggaggaaagaaaagaatgacccttgattccgcccaagaaactacatctgttgctgatctttaatgttaaatgatccttttggnactgcacattagacacatgcttcaaacagaggganttaccaattattttnagcctgctgtccctggttccttaatgcaagaaggacttgacnacttgttgactgtttccaacccgacaaccatttgctnattnttngggttcaaatgtcaactaattgggtgatnaaccctttttccaaggtgnacctcaccttgggggcgnagatacaatttacaangcaaggnatcttcggaancctgtggagganaaactgaacggaaancctattagagcaattaaggggccccttcttcacgaatgntacgaantttcgatcaacaatttcncncganccagt

SEQ ID NO: 88364 - DNA, 603 bp, Triticum aestivum
  unsure (1)..(603): unsure at all n locations
  Clone ID: PAT_TA_88364
taaaaacaaaagaagcgattcatccaaagatcaagttatcatcgatttacataccaaaagaacacatctgtttactggaggtatcattagtttacatacaaacacgcactactctaatcccatcagaacactaccacctcagacatgatttagactaacgaagaaaggagcttgtccgtcttgaaccttccaaaaaataaagccaccaactcttcattgaatgcccgctcctttagagcattgttcattccggtgaataaggaggttgtgtgctagattctatgcggtatcgcgccatgtcttcctccagctgatgttggtgttattgatatctcttgaagaaccatctttgctaatgaaagattgttaantgagaaaagaaccttgctgaagttgaagcctgaaataaccaatcagatttgaggtgggagccttgatgtactgtcctgcccttgaaagatatggtgtagatgctctcttcgaagaagnactcctattaagtgtcctgggatcttcatacctggnnaaagcatggcaancaacttggggaaccgatggaagtgtnctactcanaagaccattntgctcaaanacacaggaatt

SEQ ID NO: 88365 - DNA, 498 bp, Triticum aestivum
  unsure (1)..(498): unsure at all n locations
  Clone ID: PAT_TA_88365
atttggtccnagnaggcaagcaagcaagcaagctaggtcttcctcccgattattccccttccttctcgccggtctgctacatcgacggcggctgtcccttgtcgccggccgccgcatcatccaaatcccaaactgccgccgatgcccttgccaaagnagaaagaacaccggggtccctgctcccgggggggaagaaaccaaggnaagggaatnaacaaatggcggatttgnccggnccgcccgttttaagctgctgcaactgccgcaacactnctgctccaacgacgatatatctccnaagctttcnanggaagaatgcgccntctcttttcccaagccataactnacaanggggcnaagaganaggaccnatangggtcaaactttccgaatcaangnnttatcccnaaggcccggtggaattaaacgcctanaagatccaaaattnaggaggatttaattcnaaagnaaatttcaggnattgnncaataatgaaaa

SEQ ID NO: 88366 - DNA, 619 bp, Triticum aestivum
  unsure (1)..(619): unsure at all n locations
  Clone ID: PAT_TA_88366
gcgattcctctcccctcgcctcctcgtcctccccctcctaggggatcgccggagaggaatcgcgacgagggcttcctcctatcagttaaatcaaagccatggagcacaaggagaccggctgccagtctcgggagggccccatcctttgcgtcaataattgtggcttcttccggcagcgcggcgaccatgaacatgtgctccaagtngccacaaggagatggcgaatgaagcaagagcaagcaaagctggcgctcctctttcgacanatcgtcaacggtggcgatgccgcgaaaagaatcttgctgctggcacacgcgtggaatttctcacgttntagcgaagaccttattaccgaaaacctgctgatatccctggccaagcnaggggcgatggcaacccaaaggccaaccngngnacactgcanaanagnccgctgaccggtnaaacgccgtgtgggaactgtntgncaacnacgttatcgggcaacacaatgcaattggctacgcncccggcatggagcatccaagcaaccgtgtaagngngaactnaaaattagagggcccctaatcgaaanaaagncatnatntggcnacncgaacgnncttggatactttanatt

SEQ ID NO: 88367 - DNA, 511 bp, Triticum aestivum
  unsure (1)..(511): unsure at all n locations
  Clone ID: PAT_TA_88367
catctgatcacccactagctagccagctagcagcttaaggaactagcttgcagctagcgatccatggctcgtctcaacagcaaggctgtggcggccgccgtggtcctggcggcggtgggtgctgatgatggccggcagggaaggcctccggcggcgctgtccntgcgggcaggtggactccaaagctcgcgccgtgccgtggcnangaaccggggaaaggcctcctccattnagcaaagaatgctgctcccggcntgcaaggggctgaaccggctggccccgcaacaancccggaccgcaaaatagctgcaagngcctcnaagacctcgccaacaagcatcaaatccnacaacatgggnaagtctccgggctnccccggaaatnccgngtcaagctgccctccccatcaacatttcaacaaactggaacatgtcaactantcaatantaaccttccaacttcatgatggaccctngcttggacttaattcaactttaangatgccaaacat

SEQ ID NO: 88368 - DNA, 618 bp, Triticum aestivum
  unsure (1)..(618): unsure at all n locations
  Clone ID: PAT_TA_88368
gggacttangtcaccacaaacagaaactaaancaggtgttggatttaaagctggngttaaagattataaattgacttacnacacccnagantatgaaactaaggatactgatatcttggcagcattccgagtaatcctcagcctggggtccgcccgaagaagcangggctgcaatagctgccgaacctccnactggtacatgggacaactgttttggactggatggacttaccatcccttgattcctttacaaaggacgatgctatccacatccgacctgttnnctggggaaaagacacccaatggnttccnntaatgttacttnacccatttaacctattntgagaaggtcccctttacaacatgtttactcccattggtaggaactatttnggttcnaaaccctaactgctcctaactttggaggtntaacattccccccnacttatccaaaactttccaangccgcctcaanggtaccaaatttnaaagaataattngacaattangcntcctaatgggatttcaataaacaaaatggatatccaaaaatangaaactgtataatgtcactgngactnatttncaagtataaactaaccaacattttccnganan

SEQ ID NO: 88369 - DNA, 621 bp, Triticum aestivum
  unsure (1)..(621): unsure at all n locations
  Clone ID: PAT_TA_88369
aatattcaggatttancttggcgaaagctccgtgatggacacttggttggaagacatcacagttgaattttctcctggcagatatgcatctgaatgagcagtcgagctttcactgacaccgacctcctggatgaagaatggcggcctcgacaaagaagggagacggacagtgtgactgctgaacatgatattcaccgacgacaccgtgggcctgctcgccggttttctctgcacgcacagganccgacgtggatgcacttcaaatctggtccgacgggaggatggttctcccagggagggtccgattnactccgatgacgtttcccctgttccnatgctccccatacaaattcacgaaattcattctgctccatgttatatgatncacattcctcctcccgtgacgatttcctaagaccaagaccccgaactgaaacatctgacttgatgggatactgacacccatggctatcccgggcattaccatatgtgccgggatacgactgtcantctccgatgatccctctgaataactaactaancgaatcgaaatttggaatgtatcaaacatataaatgctgctttaggcacgtaacnactcattagaacttgggngtatga

SEQ ID NO: 88370 - DNA, 445 bp, Triticum aestivum
  unsure (1)..(445): unsure at all n locations
  Clone ID: PAT_TA_88370
tccaagtacgccatcacctccaagttgtgcatacattccgtcgtcatggacaaaaagaacaacaacggcatgccggacttgctcgaggagcatcagcataacacagagaggcaccctgctgctggaaatgcttcccagagcaagaacgagatgcacagtttggtccagtccaccatggcctcaaagtccaactcctcccaactcccaactcccaacttcaaatgggcggcagcagcaagggcggtaacggaggcgggtgctatcgcctccaaacagcataatgcatcactgtcaagggacaaccacaagggcanggattccaaggaccccgagacaaagcatacatgaaggccaatgccgccaagtctgttggactcccccaagggcaatgctgctatctgcaagacatcaccgatcaagggtcttctctgcttnccgtctcgag

SEQ ID NO: 88371 - DNA, 609 bp, Triticum aestivum
  unsure (1)..(609): unsure at all n locations
  Clone ID: PAT_TA_88371
aacaaatccccaccaatctcgtctccaatcgacccgaggctcgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattcctccagaccagcagcgtctcatcttcgctggggaagcagctgggaggatggccgtaccctcgctggactacaacatccaagaaggatccaccctccaccttgtcctgcgtctgcgttgtggcatgcagntcttccgtgaagacctcaactgggaaagactatcacctttaggttngagantctgacaccatccgacatgtccaaggcaagattccaagacaaggagggatccccccggacaacaccctgatcttggctgggaacaactggaggatgtccacctcgccgactacaacatccagaaggatcaacctnaactggtgctcgctcgtggtggcaataatgcctctaatcaactcncgcncgtacctttcgnctgtgtgcccttgtcagncgtccntttttaatcnacgtgcggttangcaacan

SEQ ID NO: 88372 - DNA, 279 bp, Triticum aestivum
  unsure (1)..(279): unsure at all n locations
  Clone ID: PAT_TA_88372
gagatggcaatggcgatttggatctccctcttggcgatcgatgcagttggttgttggtgactcatctgcactctttgtcccactcccctgctgcctccgcgccccgctcgacctcccgtcggttgtctgcaggatatctcgccccccgcaccaaccacggccccaatttcccgcctcctgccgatttttgttcatctgattccgggaggcaatgccaagtgaggttcaagaatgtgcgcggtcctaacacaaatgggggctgaattctaatttaacnaa

SEQ ID NO: 88373 - DNA, 601 bp, Triticum aestivum
  unsure (1)..(601): unsure at all n locations
  Clone ID: PAT_TA_88373
naggtcttctcnaccnacncgganaacnancctggngtgcncancnagttgtacaagggtganaggacnagnacccgcnanaanaacctcctcggaaagtttgagctgtcgggcatccctcctgcaccaaggggaattcccaagttaacggtctgctttgacatccaacgcaatgggtatcctgaactttcctgctgaggacaaagacgaccgggcaagaagaacaagttaacaatcaacaaacgacaaagggcaggctgaccaaggnaggaatttgagaagatngcccaaggaggctgagaattcaantccagaggattnaggacacaagaaaaaggtggatcccaaaaacccctgggaaatactccgttcaacatgcgcacaccancaagncgagaaatacctccaactgccgggggtgacaagagaaatttaggagncatcgatctgcaccaatgggtgggcacgaacaanccctnagccatnattttnggaaaaataaagactggngccttngaacccatcatcccaaaatttcaagggctggccaaatgagggggattgtgcaaaccactgattgngtggtgcccaatttagagna

SEQ ID NO: 88374 - DNA, 620 bp, Triticum aestivum
  unsure (1)..(620): unsure at all n locations
  Clone ID: PAT_TA_88374
ttttttttnagnaaaaacttttacatgaagtnatttttnccccncggtncaacttgangtaataagaaaaangtcaangaggaanttgaaacggaacanagcaggaacagcaangggtatttcnagagatgcaaagtctagacatgagccgccaccacaagcaaagaagggctccgttgacctaacctaacgacgcaaagtccaagggacgtgcatcaagaaacgcangacgcaatatgcacaccaaactaggtggggctgcaacacactacggcagcctgcgccttcgccgtccaaagcttggatgctcctgcncgccgggtcatcggttcaaatccgaaacaacaacgcccgaaagagggtacnaacanccgttcttcttccaatgcccacntnggaaaganttncccgggaataaggattcaaancaattttttaanccgtcctngacccggnaaaccctggcaccggtganggtnnatccttcccaaaaaccctgaanagacaagangaancttcttctccaatgcanaaaaagctctnacnccccnatnaaaaaggagccaccncggngacttatgttcccaaatncccgccccatcncanactttactgctgnt

SEQ ID NO: 88375 - DNA, 595 bp, Triticum aestivum
  unsure (1)..(595): unsure at all n locations
  Clone ID: PAT_TA_88375
cctcagcaccggagaccgccatcactccggcgcacgcggtgcccgtcgccaaaccgagccgccgtccagctcctcacgcttccgcgcggcacgagctagaacgaatccactcattcagcagcagcagcagcagcagcggcgggtgagcggagtccactgggggccaagcaatggcctccgccgggaggcttcgggaggctctcgcttctcctccgcgctgtcgctgtgctccgcgctctcctcgacggtccgcggcgagcctccaaggaagttctggattcnaggacgacccttctggaaggacgggcgcgttccagattntccggcggcnacttcatacttccgatctccccgagtactggaaaatcccttttaagggctaagnactaggctgaaccaatcaacatacttccttggaatttcacaaccngacacaaactggaatcaaggttcnctacatgancgatcnaagatgcacaagattagaatncgtcatctntgtangtcatanatgtgagatggattaggggattcacatggtgccacatagacagcataacncattacaactaacaacntccttgaaaatggggac

SEQ ID NO: 88376 - DNA, 640 bp, Triticum aestivum
  unsure (1)..(640): unsure at all n locations
  Clone ID: PAT_TA_88376
agtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactactgattcgctccaagtggggtgccttgcctccaattcaacaaggttgggttcatcctccgtngagcacaacgcatcccctggggtactatgatggccggtactggacaatgtggaagctgctatgttccgggtgcaacgacccacacaagtnatnaacnaaggtggaggangtcaanaaggattaccttacccgtatgtccgcatcanccgattcaacaacatgcccaagtgcatncgtcaactnaacgccttaaancaacgggctgcnaagatcccggnaaggctaaanacnatcacaaaggcatattaaatgcattcaatttgtaaancganatgcttgggttctccaattacntctantgtccaaaanagtttgtcagtcagtcaaaaggcn

SEQ ID NO: 88377 - DNA, 632 bp, Triticum aestivum
  unsure (1)..(632): unsure at all n locations
  Clone ID: PAT_TA_88377
cgataatacaataccatggcccccgccgtgatggcttcgtcggctaccaccgtcgcacccttccaggggctcaagtccacagccggtctgcccgtcagccgccgctccagcggcagcctcggccgcgtcagcaatggcggaaggatcaggtgcatgcaggtgtggccgattgagggtatcaagaagttcgagaccctgtcttacttgccacccctctccacagaggccctcctaaagcaggtagactacctgatccgctccaagtgggtgccctgcctcgagttcagcaaggttggcttcgtcttcccgtgagcacaacagctctcccggatactacgacgtcnatactgggacaatgtggaagctgcctatgttcgggtgcaccgacgccacgcaagtgctcaacangtggaggagtcaagaaggagtacctgatcctattccgtgcatcggcttcnaaactgcgcaagtgcantgctnancttatcgcctnaagcacaagttgcaagatccggcaggctaaactncagttnaacaatgctantttnaggcnttgnaactactttgcncaatcncttcgacaaananatcccgtcanngatcggttttcaanaagtttggcatcanttatt

SEQ ID NO: 88378 - DNA, 452 bp, Triticum aestivum
  unsure (1)..(452): unsure at all n locations
  Clone ID: PAT_TA_88378
cgcaagcgcaagtggtgaaatccatttcccaacacagcacacacagttagagagagcgagcgagggagcgagcggcctagcgcacacgtgtgcagccggcggccatgggcggcagcgcggcggctgggaagagcgtggacggcgggggcagggcggcgcanagggtgccggtgccggaggcgcggccgttcctggacacgttccgggccaacctcaaggagaccttcttcccngacgacccgttccgcgcggtggtgctggancggggcttctgccggcgcgcggcggccgcgctccgctacttcttcccgttcctcnaagtgggcgccggnatacaggctcggcaccttcaantcggncntcaangccgggatnaccactgccagctcnccatcccgcaaggcatatcncnccaagcncgcaactgcngccatccnncggctcantcagct

SEQ ID NO: 88379 - DNA, 592 bp, Triticum aestivum
  unsure (1)..(592): unsure at all n locations
  Clone ID: PAT_TA_88379
agagcacgcgcaccggacacgcacgaagtctcctcgaccagcgagcaatggcgaccaccgcgatggcgctctccccctcgtccttcgccgggaaggcggtgaaggacctgccgtcgtcggcgctcttcggggaggcgcgcgtcaccatgcgcaagaccgcggccaaggccaagccggtgtcgtccggcagcccgtggtacggctccgaccgcgtgctctacctcggcccgtctccggcgaccccccgagctactcaccggtgattccccggcgactacgggtgggacacgcgggctgtcggccgaccccgagacttcgcaaanaaaccggaactgaggtgattcacgccggtgggcatnctgggcctcccggtgctnttcccgactgtcnccncaacgggtcaatncgcaagctttggtcaaggcgtcccaattttancaaggnggctcnacnacnggaaccancctgtcaacgcaaanacctgcattgggctgcaatcctncatggcccttaaggnaancttcccggggcccnggaaatnnaaccgcntncccggggaagttnaaccctggctccnatancnaggatnctg

SEQ ID NO: 88380 - DNA, 561 bp, Triticum aestivum
  unsure (1)..(561): unsure at all n locations
  Clone ID: PAT_TA_88380
attcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccatcttgatcgttacaaaggacgatgctatcacatcgagcctgttgctggggaaagacagccaatggatctgttnatgtancttaaccattaagactattngaagaaggttccgttactaacanttacttccattgtaggtaacgtatttggttcaaagccctaacgtgctccactttggagatctacaattcccccnacttatcaaaaacttccaaggccncctaatggaaccaattnaaagaataattnaacaataaggnctccttaatgggaantcnattaaccaaattgggatatcncaaaatntgga

SEQ ID NO: 88381 - DNA, 328 bp, Triticum aestivum
  unsure (1)..(328): unsure at all n locations
  Clone ID: PAT_TA_88381
cacaccctcagccggcttctctgttccccactggccaccggcgacccgatgcggncatagcaaccgcccaagatagctgattagctgatggcggcggccaccaggtgcgtcccggcgcctgcggctgcagcgcacccccggtcccggcaccggctgcngtgccgctgctgcnangacacgctgggcgtcccgcgccgtcgcgcgaccgtgtcgtctgggaccccnggaannaggagcaagcatcagcatcnagcactattnccnggaagctccgnccgnctgccgtnaccgngcgncccgccccngncngtgggancatcgtgctgtt

SEQ ID NO: 88382 - DNA, 366 bp, Triticum aestivum
  unsure (1)..(366): unsure at all n locations
  Clone ID: PAT_TA_88382
cttcactgacaaggacaaggccgctgctcacttgaagggtggtgccaanaangtggncatctctgccccaagcaaagatgnccctatgtttgtggttggtgtcaacgaggacaagtacacctcagacgttaacattgtctcaaatgctagctgcaccactaactgccttgctcccctagctaagatcattaatgacaactcggtattaatnaaggtttgatnaacantgttcatgcancaattgcanacaagaaaaccttgaatgnccccaaaaaagggttgaaagtgnaaggcccaacnttaaaaanaatcccancangnctggtnccggcaaagntntggaaagnnctnccggaactaatggaa

SEQ ID NO: 88383 - DNA, 589 bp, Triticum aestivum
  unsure (1)..(589): unsure at all n locations
  Clone ID: PAT_TA_88383
cttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttgggactgatggacttaccatcctgatccgttacaaaggacgatgctatcacatcgagcctgttgctggggaagacagccaatggatcgttanttacntancattagacctatttnaagagggttccgttactaaacagtttactccaatggtagtaacgtatttggttnaaaagccctactgcccaanttggnggtntacaattcccctactatcnaaacttccaaggccgcncaggtaccaattgaagnatattnanaatatggcnncttattggagtccataaccaaatggatanccnaaaatntggaaacgtntanaantcactgngcctattncangtgtgaaagtaa

SEQ ID NO: 88384 - DNA, 341 bp, Triticum aestivum
  unsure (1)..(341): unsure at all n locations
  Clone ID: PAT_TA_88384
tttttttttttttttttttttttcatccccaacgaggaaaatcatattgagcagattgggaatttttccatggattttcatcacggctggaaaatttacagcagagtanagtagncgatcgatcaacncganaaaattactaaccaaagaaccganagcaactaacaaacagtagtactaacagagaatacatggctggtggcaggctagatgtggcagccncagcannggaanaagcaggacagcgcnaggccgatcacnacngcctccaccacntanatgangcggaangncacctcgtccatgcgccgccgnacgccgagccgggcgcncangctgag

SEQ ID NO: 88385 - DNA, 611 bp, Triticum aestivum
  unsure (1)..(611): unsure at all n locations
  Clone ID: PAT_TA_88385
ccatctccaacctccacctagcttattaggtgctacgaccatctctaacctccctatcatttcctccatcatgttcctatctgcaaaccaaccaatttagagtttagacacatcacatggtatatatacaaatccaaatcctttccacttaactcatcattagagcacaaaccaggcaggcggtggatcgatcgatcggcgccaagaaatccccatccttcaagttcttgggttgatcgagtgatcatggcggcagcagcggtgacgctgctattgcttttcgcctcctgcatgcatgccgccgtgttctgcgcggcggccccgttcggatgangtgccgacggtgacctttcgacganggcttccgctccgctcttccggggatccaacatgggtcgctcctcnngcgggcgaccccgtnancatcaccttggaccgcagaacggntcccggttcatctccaagcgcnacacaacaacggctcttancgccgaccttanctcccgtngggcaaanggnggcgtntcgtcgcttcancgtccaangggactctncaggcaccacanactggctcanttctccgnaacccggcacgtggcgntnnaacaatt

SEQ ID NO: 88386 - DNA, 504 bp, Triticum aestivum
  unsure (1)..(504): unsure at all n locations
  Clone ID: PAT_TA_88386
ctcacatcctggagatcattctgccccgtgtgcaagcgagatgcaggcgctggaatgtcaggcccccctgcctcagaaaccaccccattgtttgcttccgcaggacacttgccttctccgtcatcctcattccggtcgagcatgggagcatcccctcccagaccaataagccggcgtccttcgtcgcagtccatatctcgggtctactctgcttccggtacccccgcantcctctcaaaaacccaaaggcttttaagaaactcatcggccatgagcataagcaagaagcaacgcaaacctcgcaaacatgttctccccctaactcccggaactccctccttccggccgaggtnccaanaantnctttggtcnggaacaactgtcttcaacaatcaaacatnantatgctttngcccacgcaagtttcaatctggntangctngcccaaccggangccggtcttcaaaatctccaatncgganangttacctccggtaaaactgg

SEQ ID NO: 88387 - DNA, 525 bp, Triticum aestivum
  unsure (1)..(525): unsure at all n locations
  Clone ID: PAT_TA_88387
gacagaaaaaagtatccatttaacctgttttccaaaatctcagttgtaaacatcactaaagtttgtcaggccaaaaaaacagaggtacatgttgcaaacactgcagccaaacaaaataatggcaccggagccccactctccaccattcttgatttccaaaattttggctcctgggatgtggtggtagacatgtcagtctctgatgaaatgagccgtcccacccatggcttggtgacaagattgggtcaagattagcctttgagtgctgcagctccatggcgcctttccttccctgaagcgagcttgatctggatnngaagccaccttcgtctgcgccatacacggcccaagaagtgtcacggcatgttatcactgctcttgaaaggcttgccggatgncncagttcaatgaacngncngtaactanccaagttagccatttccatngatctnaacttgccactttgcnacaggcacacannaagccagccncaagnatcnnaaagccacattttgagcaacactc

SEQ ID NO: 88388 - DNA, 512 bp, Triticum aestivum
  unsure (1)..(512): unsure at all n locations
  Clone ID: PAT_TA_88388
gaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcggaggatggccgcaccctggctgactacaacatccaagaaggaatccacactccacctgggtgctcagactccgtnngtggatgcaatcttcgtcaaaaacctgacggcaaaacatcaccctggaaggttgattcctccnaaaacatcgnacaactcnaaggccaagattcaaggaccaaggaggnaattcccccgggcaacaacntccatttttgctggnaancanctcnaaggatggccnnacgccnctgannaaaatccacaaggaaccaaanccaacctggggccaaggcccctgggggatcattttncnaaaaccngaaggaaaa

SEQ ID NO: 88389 - DNA, 546 bp, Triticum aestivum
  unsure (1)..(546): unsure at all n locations
  Clone ID: PAT_TA_88389
ttttcaccanatggattgccccacaaaagaggaagtgctgcttacaactgatcnaactatgtaantccctatatcnacttctcanacngcccgangtacacacccgagatggncannagtatgttcagcatcanaacttcatcgtcnatctccnacttggtggcgaggatggttgagcanttgcgcaacatcnacctcangcgacncgcangtctctgcatccaagggcngntcaacagngacncatagcncatacagccacaggcagtcantccttgannagngtatcacaactctgggatcatatcgangtattgcgcantgtggcagctcttgaaactgcgtccatcctgcnaatcancntcanacgtcnggtcnatctgcggtcaaaanctgatnccagnttanaaggagttcttcacagngcctgacacaannggncaacactgcttcagttccaccgantgccagcntgtccngaaannaatnataaatagnctccatccttggagcacacaatnccgtgaaactncggagtcangattc

SEQ ID NO: 88390 - DNA, 240 bp, Triticum aestivum
  unsure (1)..(240): unsure at all n locations
  Clone ID: PAT_TA_88390
aaaccgctcgcgtcgcancctcctctcctccgcntccggtgggcnaaacantggcgctctccctcgcgcgcagcccncaccccgcnnccgcggcggncctcncgctcccccgcattcaggggngcatttcccatgtacgcnncgctcntcnactcccctcgccgctcctancccngtctccgcctcttcntcccggccgcngttcgtngactgnttccttncnccctggncgcnatgagt

SEQ ID NO: 88391 - DNA, 594 bp, Triticum aestivum
  unsure (1)..(594): unsure at all n locations
  Clone ID: PAT_TA_88391
ctagtctcgagtttttttttttttttttttttttttttttttttttaantgccacggtagctagcatcagagtcaaactgaaatcttanacaccacaagttttgctttacagaggagctgcaaacaacagctacctcataaaaagcagagtcggggtaaaatgaagcacaagaacagtacctacaaacctgactaagccaagaacgcggcatcggtagcgcgtgcaccggccggcgccgtcacctcgccacatctcccgcacctgctactccctgccacgacgactaccanggtgggcgccgccgcagctggctgtacctgcatctgcatggggtgtggcaacgatggcggcccggcanggatggcatttgcgcntgtccggaagccaagcgtccangcaagcggcnttgnanccttgccgatcccggganangcnacggctcccgtcgggnaatcgcaagnatnnccgcactcaangacanacaaacggcgcggnaagaagaacgntgggaccctccatggctcccttaagcnttggggaagaagaaangcgaggtcgcnggggaaccccggaaagaggagccagaccaagan

SEQ ID NO: 88392 - DNA, 651 bp, Triticum aestivum
  unsure (1)..(651): unsure at all n locations
  Clone ID: PAT_TA_88392
atcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctcctacgtttgggaggatctacgaatcccccctacttaatcaaaaactttcaaaggccgcctcatggtatccaagttgaaagagataagtgaacaagtatggcctccttaatgggatgtnctaataaaccaaaatgggattatcgcaaaaattatggnaaaacgtgttatgatgtcnacgtggtggactgatttacaaagatgatgaaaactaaaccacaacattancnctggaganacgtttgncttgtgcnaagcantataaacaaggcgaaacggtgaaacagggnatactgaatcacgcggtaaagtagaatgttagaacttttnaaanattaggtccatgatnatgcnctacgggn

SEQ ID NO: 88393 - DNA, 637 bp, Triticum aestivum
  unsure (1)..(637): unsure at all n locations
  Clone ID: PAT_TA_88393
gagtgattctttttctgtcctcttcaaatttttgtctagttttttatcatatttatttgaaaaatatttggaataatttttgtgcacctcacggtattcacgatagagcatatatattctttataccatagataccgaaggaggtgacgggaccgcgaacttcaccgagctaggctccgactactctgaaccaagcaagcatgtttgaacttttgatatgatgattgttttggcatgtttgcattaagtagtttatggcatgttgatgaacataccgacgaatgtcatgttacatgcaacgatgaggcaagtgagtttcgaaaatccatgaagtgggatggacgtgagtatgcatggacatgtattgggcatgaggatgggtaagatggcagtgttgtagcatgccagtcctatgccaagctatatgactcagtgtcaacccgtatcatccaattccttcaatctcctccctgtactacacagtctccgcaaggatatgctaataagttgtaaccgcttcctggacaacaaaaggaaagcgtgatgatggtcatggnctggataaancatcaccggcagggnatggtttcgatggacnaaaggggacctaaaccctaaaaatgtcatcanatggtnc

SEQ ID NO: 88394 - DNA, 632 bp, Triticum aestivum
  unsure (1)..(632): unsure at all n locations
  Clone ID: PAT_TA_88394
atgtcgcctaggtcatgggcctatgacaaaaagatctgctgacgccgtgaaggattctctggacagagtagtcaccgcacatcccaaccaacttactctaatcttcatttattgttgtatttttaagagagatggctgtagtggtcagtgccttctgtctaaaaatcttcagtcatcctcggaatctacttgagtagagtcaagaccgtaccatgattgctacaagcggtctcaagactaatcagttcactgctgacgaatgcgctcaggttcttctcaagtcctgcggcgcttcatgaagatgattatttcactgatgtgtttggaactttgggatgctctttttggtgttaccgattgatcatttgcagtgcttcatgaagatgattatttctgtcctccgtgttctggctgatgtgtttgggatgctcccttcactgaagatgaagatgatgctgatgggttagcatcgaaacgctgaaactgatngaccccngagatcggcaagggatctgtcaggcctcgctgtgacactacagganacacaacagcatgctggcanacacaacaaggcaaacccgacaanatngttgggatanaccaccagtaatgcactaantggnaaatgagga

SEQ ID NO: 88395 - DNA, 627 bp, Triticum aestivum
  unsure (1)..(627): unsure at all n locations
  Clone ID: PAT_TA_88395
attctcgggggtccttttctacaaatggtgttcttcctggagatctaaactaatgatggagcataggtgtcagcgtcggggtgttcttgtcggtgtccatgtgcttctggctctacttggggctgcagaagcggaagctcatcaaggcaaagcagagcttcttcgagcacaacggaggcgtcatcctgcagcagcagatgcgttcctatagtggcaccgcaggaggtggcggtggcggattcaaaatattctccgaagaagagctcgagaaggcgaccaacaacttcgccgccgattaagttctcgggcggggcggccatggcatcgtgtacaagggtgtctcgaggacaagacgtggtggcatcaagaatcaangtgatggaggcgaccgagacaaggagttgccaaagagagctcacctctccagttaacaccgaaactcgcaaactcacgctgctgcctcaagtggagtgcaatgctggccataatactcccaatgggacctctacactacatcatggcgtaaggcccgaaatacaaggatcatacccctccgtacgnaatctgcgaggccttanaatcatctagctcncccatcccaggnantanaggaaaaccgctaaaacc

SEQ ID NO: 88396 - DNA, 282 bp, Triticum aestivum
  unsure (1)..(282): unsure at all n locations
  Clone ID: PAT_TA_88396
ccagctccccagccacacagagaaagagcgtctaagctccagctagcttgcaatggccgccgcactgagcctccgcgcgcccttctccctgcgcgccgtcgcgccaccggcgccccgcgtggccctcgcgcccgcggccctcagcctcgccgccgccaagcaggtgcggggagccaggctccgcgcgcaggcgacgtacaaggtgaagctggtgacgcccganggcgaggtggagctggaggtccccgacgacgtctacatcctcgaccagccgaaggtcnt

SEQ ID NO: 88397 - DNA, 656 bp, Triticum aestivum
  unsure (1)..(656): unsure at all n locations
  Clone ID: PAT_TA_88397
tttgaagatcaaagatcaatatttcatgatgtaatacatggtacaaaccttgcaatagcaatcgggagcaacggcctaagattaagctcttcccagtcctaggatgctcatagccttgtacaatcaaaataatctgcttcactgcaagcagatcaatgcgaaggcccatgaacccaggtcctcaaagcaaatcaaatgtgattgctcatgtaagcaggataagatcaaatgttaagtccacagacctagctgctgcaagaaaatcaaaaggagaacttgaatcctccagtgttagcgtcgacagcagaatcccaagaatgcgacttcntcttccgagcagcagccttctgctgagcttcaacttcaagctgactaatcgtcccggggtaagtgtgtcgatggcgttccgggaactggtcgtgcaagtnaacctgtccttggtccctgatacaaagctcactgcattgggctcttgagaaatcaagacatcaaaagtcctctgccaatantcnaatgatggaatggctctcaagatgtacaagtgcacatcattagnacaataaactcccggccggataaancaatggcctcccaagtcanaggcctaaantagacancagtanaaggnatgactcgccancactgngacctggggg

SEQ ID NO: 88398 - DNA, 608 bp, Triticum aestivum
  unsure (1)..(608): unsure at all n locations
  Clone ID: PAT_TA_88398
aaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtcgtaacgtatttggtttcaaagccctacgtgctctacgtttggaggatctacgaattccccctacttattcanaaacttcnaaggccgcctcatggtaccaagttgaaagagatanntgaacaagtatggtcgccttaatgggatgtacaataaacancatgggataccgcaaaaaatatggtagacgtgttatantgctactggtggcttgattacaaagtgataaaactaactcaaacatttnccggaaaactttgncttgtcca

SEQ ID NO: 88399 - DNA, 243 bp, Triticum aestivum
  Clone ID: PAT_TA_88399
agttccccatatataatgagttcagtgagagagttcaacagccctctcaaaatttaggcacaattcctcagtaccatcacaaagttcaccaaatggaaaacacagttcaggctcatcactgacatgtgcagtacagttatctgcttgtgcacgatattcacaaggctgagaagcccgaagaagcaggataagaagactgaagtgcaggttatttaccattggcagggacttcatggtccgggg

SEQ ID NO: 88400 - DNA, 582 bp, Triticum aestivum
  unsure (1)..(582): unsure at all n locations
  Clone ID: PAT_TA_88400
tgactccctgggtaagctaaagaatctgcgagcacttgatgtttgtcactgtgactttactgagttgccaccagctatttcctgtttattccatctccgttacttgtcgctgtctcgcaccattcggagtcttccagagtccataagcaagctgctccatctgcaaaccttgtgctttgaagataagtgttcccttgataagcttcctgcaggaataagtaggcttgtaaaaggttttggnccccgngggggcccaaaacccccccnttttttggggggggnnaaaaaaaanttttccccnaaaaaaaaacccaantggaaaagggtttttaaacccaaaantttttgggggncccaaaaccccaaaagggcccnttaaancccccgggggggggggggnttttnaaaatttttttgggggggggaaaacccccgggggggggccccnttttttttaaaaantttttttaaaaaaaccccccnttggggccccaaaangggggggggggggnaaaaaaaattttttccccccnaaaaaaaggggggnnnttttttttttttgggggggnnaaaaaaaaaaaa

SEQ ID NO: 88401 - DNA, 611 bp, Triticum aestivum
  unsure (1)..(611): unsure at all n locations
  Clone ID: PAT_TA_88401
tcgggaccccctacccgagatccgccaggtttgacacagacattggtgctttcattgagagttccactgtgccgtcgacaaaaggtttgatggccccttcaatcgtcgctaacgacactgtccaaggaggaacctttctccctggactgatttttgtgttcggcggcttcgtaccgcgggccaactcgcttggccatctggagcaggttgacagctacgcccctggccatcaggtcaagaattttttggggggnaaaangggggggcccctttttttggggnaaaaaaaaaccccccnttaaaaaccccggggggtttttncccnggcccggggggaatttaaaatttccccccccggggntttttggggggggnaaaaggggggaaaaaaccccntttttgggnaaaatttccccctttttttcccccaaaaaaaaantttttaaaagggggaaaantttttttncccccgggnaaaaaaggggaaaaaaaccccccggggnccccgggggggccnaaaaaatttncccggggcccccccccccccccctcccccccccccccccnttttttnccccncgggggggccccccccccntttttttnccccc

SEQ ID NO: 88402 - DNA, 537 bp, Triticum aestivum
  unsure (1)..(537): unsure at all n locations
  Clone ID: PAT_TA_88402
gtattctaagcgacaacattctacctctcatcctcccagttctgttcctcggccattctagccaccatgccgggctccatcgccttcggtcgcttcgatgactccttcagcttggcctctttcaaggcctacatcgctgagttcatctccaccctcatcttcgtcttcgccggcgtcggctctgccatcgcctacactaaggtgagcggcggcgcgccccttgacccatccgggctgaatttggccccccggggnttttgngggggccccggggnaaaanttttaaaattttggggnccccccccaaaaaaacccgggggggggggnttttccgggggggggcccctttgggggntttttttnccccggggggttttcccnggnncccgggggggttttcccgggncccccccaaaaaattttncccgggggggggccccggggccccccccaaaaaaaaaccccaaaantttcccccttttccccccccggggggggcccggggggggncccccaaaaaaccgggggggntttttt

SEQ ID NO: 88403 - DNA, 554 bp, Triticum aestivum
  unsure (1)..(554): unsure at all n locations
  Clone ID: PAT_TA_88403
ggaaaatccgtgcaagttttaccagttgaaatatttacatttgaacctgtcaattggtcataaagaagctgccaacattctatcttttgcctcttttctgagggctgctccttctgttgaaaagttagaaatgcattttagtgttttggccatcccacatcgtgtctcggagcctatcaagagccttccacggtgtccacatagttatctgaagaacctgcatattacaaggaattttttttttccccggggggggggggaaaaaaaaccccnaaaaaaaacccccaaaaaggggggggggnaaaacccccaaaaaaaaccttttggaaaaaatttttttttttcccccntaaaangggnnttggggccccaaaaacccgggntttttgggggctttttnggggaaaaaaaannaaaaaaaaanttgggggcccccccccccccccccctttngggggcccccttttccccctttgggggaaaaaaaaagggnaaaatttaaaatttttgggggnaaaannccccnggggnnaaaaaaaatttttttttttttn

SEQ ID NO: 88404 - DNA, 581 bp, Triticum aestivum
  unsure (1)..(581): unsure at all n locations
  Clone ID: PAT_TA_88404
aagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtancttatccattagacctatttgaagaaggttccgttactaacatgtttacttccattgtaggtaactatttggtttcaaagcctacgtgctctactttggnggatntacaaatcccctacttatcaaaaacttcaaagcccccccaaggttccaattnaaagaataattaacaantatggcccccttatgggattccattancaanttggatacccaaaatttggannctntatatgcacgngggacttnttcaaaa

SEQ ID NO: 88405 - DNA, 592 bp, Triticum aestivum
  unsure (1)..(592): unsure at all n locations
  Clone ID: PAT_TA_88405
cggcggcggcgctgcttcccatcgacctccgcctgtcctcccgcccgcgtccccgctcgccccgccgagtcttctgctcgcccccgcgccgcctgtcgcctgcaagtccgctcgccgccgcccgctcgaccacgcccccgacgaaggcgcggcgacctcgacagcccttgctcgggcgccctccctggctcggcccccgcgacctcgacggcgtctcttgctggcttatggacatggcgggtccaagatggaagaagggcaaagacggcaaggactttgcagctctggcagcagctcaacccatgtcaagcattgttgctgagctccagtcctcgctgaaagctcgaaacttgtggcaactttatctagtcngggcaaggatgcaacctcggtgtgaatctgcaacaagctttacttcntaaccgtgctgcctttggcgcntgctggatatgccgaagcaaagaaacgtggttcaactggggctaagaagtcttcaacttacatggnttaantcactaatgtcgaaacaaaactntnatnaaggaacttggatactatcnccnataaatattctaaattaaganacaatcan

SEQ ID NO: 88406 - DNA, 603 bp, Triticum aestivum
  unsure (1)..(603): unsure at all n locations
  Clone ID: PAT_TA_88406
catgagagttcatacagcagctgtgatgagtatgatgtcgattgtatggaggagcctcctaagtctacaatatccaaagacgatgtgggagttcatcagccagctgtgcacatcagagaagagaatggctcaagtagtgggaacaaaaaacgtcatgataaacgctctactcaaacactgcctagtactaaggaaactaaaaaaccaccaaagcgaagaagacataccggacagtgttctgttgatgggtctgaggttgaaggaacacaaagaaatgataatatgccagaggttttgagcaacgcaattccggatatgaatagcaatcagatggaggtggtctgtgtcgctaacccgttgacaagcttcaatcatgccggtacaaatggaggatcttacaacatcaaggagatttcaagggaactttgtacccctggtgttgtgggtaataantacagccaagctgcaaatattgctcctcaacattatatggtcaacaaccattactctgaaagaatgttaacaaaccctggctggaatacttcacaaatttggctggtnaatgnttantctctcaatatacaactcgctgaaanacaatna

SEQ ID NO: 88407 - DNA, 485 bp, Triticum aestivum
  unsure (1)..(485): unsure at all n locations
  Clone ID: PAT_TA_88407
ccaaaccctagcttctcctcttcgatccccgatctccatccggcggctcgccggaaccctagcccagatccgcggcaactccaccgcatcagccatggggacccttagggagatcctaccgtcgcccaagacctcgtcgtccacgttctacgaccacagcagcgacccgtggttcaaggagcggtacggcggggagcccccggaggcggcggcggggaagctagcgggccctgccaagcccgtgcctccctacgggaagcgcaccggcttcgtcccccggcggccggaggacttcggcgatggcggcgccttccctgagattctcctggcgcaataccgctcggcatgggccgccgcgacgacaagggcgggtccaagattctcgcgctcaacgtcgaccgcaaggcaacgtcgccttcgacgccgtcgtcaagcaaggcgagaacccaagaagatngtcactcaagcacagcgaatctgccaaa

SEQ ID NO: 88408 - DNA, 595 bp, Triticum aestivum
  unsure (1)..(595): unsure at all n locations
  Clone ID: PAT_TA_88408
ccaagtccacccctccccaccgcggcgcgcacgcacccggccaccacccacccggatccagatccgcccggcggcggcgcaggggggagccatggccggcaccggcggcttgtcggagtcggtgatgcggaaggtgctgctgtcctactgctacgtggcggtgtggatcttcctctccttcgccgtcatcgtctacaacaagtacatcctcgaccccaagatgtacaactggcccttccccatctcgctcaccatggtgcacatgagcttctgctcctcgctcgccgtggggctcgtccgcgtcctgcgggtcgttgagccgccctcctccccgcccatgacgccgcaagctctacacctcctccgtcgtgcccatcggcgcgctctacgccatgtcgctctggttctccaactcggcatacatctaactctccgtctccttcatcaagatgctcaangngctcatgccgtcgccgtcactccatcgggtctcttaangaagngactnaagtatcctcaagctnaaatgtctcatctccttcggngtcgcatgccgctangggangcaagttgactcgtgggtccccaaatcccc

SEQ ID NO: 88409 - DNA, 624 bp, Triticum aestivum
  unsure (1)..(624): unsure at all n locations
  Clone ID: PAT_TA_88409
acaataccatggcccccgccgtgatggcttcgtcggctaccaccgtcgcaccttcaaggggctaaagtccaacggcnggnctgcccttaagcggcgctncaacnggaacctcnggaagcgtcaacaatgggggaaaggatnangtgcatgcaagtgtngccnattnaagggcatcaaagaaatttcaagaccctgtcttacttgccanccctctccacggagggcctcctgaagcaagtcgactacctgattcgctccaagtgggtgccctgcctcnagttcaacaanggtggcttcgtccttcgtgagcanaacaactcccccgggtaataacaacggccgatactgggacaaattnggaanctgcctaatgttcgggtggaacnnacgccaancaagggtgctcaaagaagtngaagaagtcaaanaagggtancctgacnctaagttcgcgtnatcggnttcnanaaactgcgcaagttcaatgcgtaactcaatccaatcaggcaaccggtttcaaagatctggaaaggctaaatacnatttacaanngcnaatttaattgcctttggaattccattntcaaaacctctttncacaaaaaaanttnctcggagattggtt

SEQ ID NO: 88410 - DNA, 604 bp, Triticum aestivum
  unsure (1)..(604): unsure at all n locations
  Clone ID: PAT_TA_88410
ctcgagtttttttttttttttttttgaacactatgaaccattaaggaagaattgttacctcaatgtacaacctttccaaacaaggaaagcatctcatcaagtcaataacaacatccagactaagagcacccatacaaacagataaaaccttgacagtgcacaccgtcttcgtcaggctatcaacacgcaatccctgaataactgtcgagtaaagcgtgaatgtgttactagaataggaagataggcagcctaaggtctccaatttaggcgcggagattaccgatatatgccgggattcaagctgagccaaataggagcaacctttcaagacaaggggcaatctccgatgatgacttcctctaataagatgaagtctccccaataagcttcaaactatgcccctaagggtggatggagttnatcccgncanaacggaagccanacaacngtaatcagnaanattccaaaacggggaagcatcaacaanggntgnatgtgggtcaaanangggatntttnaagcccagntctaanctnaggaaaaaaancttgggcaancntcaggattgganccccaaggggnaacccagggtccnaaannaagg

SEQ ID NO: 88411 - DNA, 241 bp, Triticum aestivum
  unsure (1)..(241): unsure at all n locations
  Clone ID: PAT_TA_88411
gccggtgctcgtcgtcgtcatcgccggcagtgcccagggactggtgggtggaggacctgtgcgagctggacgtggagctctacaagcgcgtcatggtggcgatcaagtccaggggggataggatgccctctgatgtcgtcggggaagctctcagggcctacgccgcgaggtggctcccggagagctgccgccgtggcgagcctgcggacgacaacgacgatncctgcgccttggaagtntc

SEQ ID NO: 88412 - DNA, 505 bp, Triticum aestivum
  Clone ID: PAT_TA_88412
cttctcctagccttggagctgctgctgctcctgctcgccttgccacgccttacttgtgcctcaaattccacgcatccgtcactgtatcggcaagccaaggcacttctccagtggaaatcaagcctaaagggatggagctctgagctggactcatggacaaagggaaccaacccctgtgactggacgggggtaggctgcagcaacgccgtgctgccccgtggtgatgctgtcctagttgtggacaacatttcacttccgtcctgtcacattcaaggcagcattggcgttctgcccgagctcgcttacttgaatctgtcctccaatggcctgaacgggtctattccaacttccctagacttgcctcatcttgtttatctggacctccgtaagaactcgctcctgggctaatcccatcaagcattggagctcttgtcaagctcgtgttcttaaatcatcctacaattttctcaatggagttgttcacatccataggcgggatcgggat

SEQ ID NO: 88413 - DNA, 352 bp, Triticum aestivum
  unsure (1)..(352): unsure at all n locations
  Clone ID: PAT_TA_88413
ctcaanttttttttttttttttttttttttttttttttttacnancaagggcaagcancatcattatcaacaacaattcancagacccaccaaattacctggcaggtacaactattccgatctcacatnccaancggaacatagcacagtgncacanccaatattgcccnagcnagataccaaattaccaaanatggattcaatttgcacgacattgcnnaattttctancaanacccctgaannacnaaagagttcannancggtttgctttttaagatanccttcnatttantcgccntgctggggnaggagcatcctcagtgannctggccttatcanccgttggccgg

SEQ ID NO: 88414 - DNA, 482 bp, Triticum aestivum
  unsure (1)..(482): unsure at all n locations
  Clone ID: PAT_TA_88414
caacaaatccccaagccaatctcgtctccgatcgactccagctccccttcctccggtcctccccgccgccccaagatgcagatctttgtcaagaccctcactggcaagaccatcacccttgaggtcgagtcgtctgataccatcgacaatgtcaaggctaagatccaggacaaggagggcatccccccggaccagcagcgcctcatctttgctggcaagcagctggaggacggcaggacccttgctgactacaacatccagaangagtccaccctccaccttgtcctccgtcttcgtggaggcatgcagatctttgtgaagacctcactggcaagacattacgcttgangtggagtcatccgacacatcgacaatttaagnaaagtcaagacaaggagggatcccccggacaacancgctcatcttctggcaacaacttgaggacgnangacctgctgacanaacatcagaaggatcacctn

SEQ ID NO: 88415 - DNA, 492 bp, Triticum aestivum
  unsure (1)..(492): unsure at all n locations
  Clone ID: PAT_TA_88415
attttattgttatcacaacctagctttattgtatttttagttctttgtaactgtaattttcaaacattccattaccgttcttagactgtggtttacactttggtgttacttgttgcaacttagcttgcatgtatttttagtcattcctaactgtaaatttcatacaacttagtgctccatctacacttggtttataagatttttactgctttcttttgttctatctgtccctcttaaaccatgtaagctttgaatgccaaatttatgttgtacctgcagtttgggtaactgctatttcaagttgatttactgtagtttcaataaaactgactgctccattggaattttttttgcctcntcctcactgtaagacccctgcattagattgtgtattgttctcctagttaaaagcaaatgctccgtattggggcaattcaagcgtanaacaacttatcaacnttaaacanacactccccttcaattgtttttttg

SEQ ID NO: 88416 - DNA, 485 bp, Triticum aestivum
  unsure (1)..(485): unsure at all n locations
  Clone ID: PAT_TA_88416
ctagcctctttcccctcgatccccacagcctctcctgcctcctccatctctctcctcgcgtcaccatgggagccccgccgacgcctgctggtcgtcctccctcgtctctgttcgaagccgaggaccagctcactccacagcttttcttcacccacgacctagggttggggaggccgggtcttctcggtggggtggaggcgcaggggatggccgggaggccgaccgtgggggagcatccaggccggcggatggagcagcgagtcccaagctctaagcgtcgtacacattgcgggatggagaaaggcctcatggggtgcaangggcaacgggggaaagaacggtgggtccttcatctcctctcntctaatcgcgatcctacgactccgccacgttgctcgctcnatggcgtangggcggcanccggacttggcctcgggcgaatccaagcgatctaatatgaaccntcaatgtgnaacaaatttcat

SEQ ID NO: 88417 - DNA, 368 bp, Triticum aestivum
  unsure (1)..(368): unsure at all n locations
  Clone ID: PAT_TA_88417
ggaaggcgancgaccgagcgacnatgtccatggcggtgccgancacgctccgcgccctggcccctccggctctgcacccgtgccctctggggacgancgggtccgcgcgcccgtcgccggcgcaccgggcggcgcgggggatgatgacgacngtggcccngcngaggggcgtggaggttgcggcggcggcggtggcggnggacgcggngtggctggagcggctgccggagaaggagaagccgctgtacgcgcacagcntgccttgcatcgatgcgtggttgcncacngtctgnttcgcgcaatcccgnncaagaccgcgccntgtgggtcnccgnnacgccctctgggaccccnncctcagnctccac

SEQ ID NO: 88418 - DNA, 503 bp, Triticum aestivum
  unsure (1)..(503): unsure at all n locations
  Clone ID: PAT_TA_88418
atctcccatctcgtcattcggaggcagcggcagcgacgacaccggagggacgacccggcggcatagactacctctctggcgcgcagagtactatctttccgctctcatgcggtagggactcagaggtgccgtgggtggtgtaaggtccgggcgagctcggcagcgacaacggccttctccggcttccctctccaccgccggcggtattatcgctagaattgaaattctgccaagcaatctaggagtagaagaatatgttatgcaagggacttggagacgaagcaatggtccctggttttgaagctttgggaanctgccggccggttcgacgggatgacatcaagaaagcgccggcccgcctcggaaaactccggggggtaantggttggcggngcaaacaattacctccattttngggacggtgnaaactaatctgatccaantngntttttccttaaaatttgttacgtttcattcngattcanggtagnaacctgnatttg

SEQ ID NO: 88419 - DNA, 320 bp, Triticum aestivum
  unsure (1)..(320): unsure at all n locations
  Clone ID: PAT_TA_88419
ncgagttttttttttttttttttttttcgtttcttttggattnanacnttctcttctttatctttagttttatctacttatcaatagtatctaccggntcgaactcnaatttnatcgccntccatacttcacaagctgnggctagntcangactccatttgnaagctgctcggntaatttcattaccttcgtnagcaanatcgcgcccntcgttacgacgcttgtacacaggcttccaaanncactcgattananggatgcnccaagtgcatttccccaaggangtccnaaagttccctcgaccagnatngtnaataaag

SEQ ID NO: 88420 - DNA, 487 bp, Triticum aestivum
  unsure (1)..(487): unsure at all n locations
  Clone ID: PAT_TA_88420
agaaatctcaagaggcggcaccatgctcgtgtaccaggacaagctttccggcgatgagcttctgtcggattccttcccgtacagggagctggagaacggcgtgctctgggaagtcgatggccattgggtcgttcaaggagcagttgatgtggacattggagccaatccctctgctgagggtggtggtgacgattagggtgtcgatgaccaaggccgtgaaggtggttgacattgttgacaccttccgtcttcaggagcaacctgcttttgaagaagcatttatctcctcacatgaaagcgctacatcaagaactcactgccaagcttgaaggaatgactagatgtancgcttcatgtgagagaaaactgctcctgtgggggggccggtaccaattcgcctataggatcntataagcgcgctcacgggctcnntttaaactcctgactggaaaactgngttaccaacttaacnccttcaganacccct

SEQ ID NO: 88421 - DNA, 471 bp, Triticum aestivum
  unsure (1)..(471): unsure at all n locations
  Clone ID: PAT_TA_88421
cgcaaccctagagcctcgcctccctcctcccctctcccgggcgcctccaccccccgcctagcggcgcgaagcgaccatgacgttcaagcggaggaacggcgggcgcaacaagcatggccgcggccacgtcaagtacatccgctgctccaactgcgccaagtgctgccccaaggacaaggctatcaagcgtttcttgggtgaggaacatcgtggagcaagctgctgtgagagatgtncaagagnttgtttgcatgatggatatgtgcttcccaagctgtacgccaaggtcacaatgtgtgtcttgttccatccatgccanattntccgtttccgtcccgttagaacaggaggaacgttaacccccgcaaggtttaagngcaaggataatggcccaaggctggaaaggttggccccccttctggtgcctnnngcccccctgctggcntgggccttcccggggccctgncccct

SEQ ID NO: 88422 - DNA, 478 bp, Triticum aestivum
  unsure (1)..(478): unsure at all n locations
  Clone ID: PAT_TA_88422
caaaggtgctttttccctgttaatgtctgagccaaaactgaattatgtggggttaaatgtactgatgtacaagtctgcacgcgaggaacctctcgagcgtagcaactcctccgtccaagttgagcgctgggtgccgtccaggtcgagcactgggtgccgtccaagttaagtcatccaacagcgggagagcgagctttgcttcggggcagcccatcctagacgcgcagttgctctgctctccatgaaccatgcttcccctaatcacccatgaaccatgcttcccctaacaactccaccttgtgtgaantcncagctgagaataaccacaacactacagtcaactcanccaccatgggtgacnggcagcgtccaagtnggaacacggcatcattccaagcagagttantccgtacaaactgacgttatgtanattanggatccanngttnaaagtcaattaattgngtgtgcaaatcnaa

SEQ ID NO: 88423 - DNA, 387 bp, Triticum aestivum
  unsure (1)..(387): unsure at all n locations
  Clone ID: PAT_TA_88423
agctcatctagcagagaggccacgagaggtgatttgaagccataaatcctattctattctttgtaagcagtctgtagcagagtactatgagtataacttggagcagagcaccttcaatctgagcatggccacggggcaatatgcaaaatgctcaaatgaccctcttggtacagaagtgattaatcttgaagaagacatagccaagaaacccctgcttgaaagagcccaaaccaaaaaaagtacatgaatgatggggattgcataagttatgacttnnggagaacaagaaantcccccagattttaagtttggtttcctggccctttacaanggncctttggganaacatgatgatnggngattcataangttaatgataacttggac

SEQ ID NO: 88424 - DNA, 316 bp, Triticum aestivum
  unsure (1)..(316): unsure at all n locations
  Clone ID: PAT_TA_88424
gttcgatagggttgtgggggagattgtgggcttcacccctgtctcctggtaagtgcatggaaataacctactagtttcttagcggtaaggaaacttgacctgaagttgactagggctatacatgcaaccacgtagtagcttcctaagtagtttctaaggaatatgctttgcagggtaggggtagcagtcccgtaagtgatgtgcatgttcgtaagtaatttctagtgtgtgtgtgcactgtgcacagcccggctataaaaggaccccggtcctcacttgtaatcaagacatccaacatttnactcaactgcatcat

SEQ ID NO: 88425 - DNA, 475 bp, Triticum aestivum
  unsure (1)..(475): unsure at all n locations
  Clone ID: PAT_TA_88425
cttccttcctcccccgtcgtcgcggctccagcttagggtttctcgcccccgccctcccgcctcaccgccggccccgtacgccatgtcgaagcaaggagggaaggccaagccgctcaagcaggccaaggtcgccgagaaggactacgacgagaatgacctggcatacctccagaagaagaaggatgagcaaaaggccctgaaggagctgaaggccaangcaggccagaagggtgcgctgggaggatctggtctcaagaagagtgggaagaaatgagtctgccacccttacgtaatgcccagaaaatgataatctatctatctactatctgtgtcncgcttcactatctgtgggtggtaaaagacnactttaagttgtgtttgagcattaacattgtcgcatccgttgctgaaactangnatttaacaactctccncttaccngnatcaaatgtcctactaataatgacatactttt

SEQ ID NO: 88426 - DNA, 498 bp, Triticum aestivum
  unsure (1)..(498): unsure at all n locations
  Clone ID: PAT_TA_88426
tgaaattggttcattaattttgtaagctaagttcatgtttccattgcttttgtcatactgttatttaactatatattagaagaaaaggctactggtaagaacataaaggagctcattcctgccttctaataaattatgtaatttactgttaacactggttgtaggtagttgttaagacacagaattgtactttttcagttatgtttttgcaaatttaactgtattcaacaaggcatctccttttggaacaattaaaaagatttantggtangtgtatattttccnggtacagtatatattaatgccaagtatttttaacgcacctggatctaattttagatcaacctgactanancctgggcctttgatcctggggtaactaaagctccnctataccgggtatcaaactaccanccttgtactnnagatttnagcacaaactagatttccaagganttaattatngataacangggttntngagtgtcaatgtaaatt

SEQ ID NO: 88427 - DNA, 341 bp, Triticum aestivum
  unsure (1)..(341): unsure at all n locations
  Clone ID: PAT_TA_88427
agccaatgggaaatttcccggagaaaccaaactgggcttctccttcaagagcacacaaggcacatggtttacccctacttatcaatggcctgacaattctctgtcatttggagttgcccacgcggtggcatggaaaaagtctggccttatgatgagacccagcacccaagtcagtgtttgccccattctcggaggaagttgatcccgggcatacgggcggagattgtccattcactgaaggaagaatcggtgtntcaatgcggttcncaatgctccanaaaaccttcgggtttnaatccctttcnattgggcgnncaantttaacgggaaatccnaattcc

SEQ ID NO: 88428 - DNA, 452 bp, Triticum aestivum
  unsure (1)..(452): unsure at all n locations
  Clone ID: PAT_TA_88428
gcggagcgtgccctcccctttttcaagatcttgaagaagacgggcccaatggagtggaccccagaggcagaggcagcgctgcaggatttgaagaagtacctctcctctaccctagtgctggttgcacccaaaccataagaaccattgttgctgtacctagcggcaacgaatcaggtggttagcgctgcactaagtggcgcagagagaggtcaacaaagaggcagcggcagcggcagagtcaacggatggcgaacccggaacattccccaagttagggctccggtcccggcaagactgatccctggcaagagctngacccaattgcaacaaggccacacgacagggtgaatnacgcagnaagaacaaaatgatgcacacccatctactccgtttaccccctcctttcaaggggtagtccaangtancaagtttcaaanttccctttgctcctt

SEQ ID NO: 88429 - DNA, 384 bp, Triticum aestivum
  unsure (1)..(384): unsure at all n locations
  Clone ID: PAT_TA_88429
gtttcttattaccttgtcttatcattgttttcatagttgtccttgttgcgtaatttcatttattcaatagatgattattatattgccaacttggtggaatacgcacgatatttttataaatatgatcttgcaatgcatttatttttctccaattgctcctgcagttattttacttatactagcttagataagatcgccaacagtctgggcagtcaaaccactggtaatactcctgctatgcttagttgatttgccacatgtaactcctacaatgtggtaagttggcctttttttaaccaagctccgggaaaaatggttgcagaanggggatgacaggctgaanacagcttcctcaaaaaggaaagaagnaacccctgaaggccc

SEQ ID NO: 88430 - DNA, 330 bp, Triticum aestivum
  unsure (1)..(330): unsure at all n locations
  Clone ID: PAT_TA_88430
gtggggaagaccaagctgccaatcccgagtgcggcgttcgagctcaggcagatcgtcaccgggttttggtccggcggggtcatcatcgacaccggcagcccattcacgtccctcgccgatgccgcgtacgggcctctgagaaaggaactggcccgacaactgaaccgcagcctcatgcagccgccggcagacagcggactggacctgtgtgtggcacggaacgacttcgacaagctcgtgccggtgatgctgttccacttcagcggcggtgcggatatggcggtgccgccagggagctactggggcncccgttggacaatccacgctggg

SEQ ID NO: 88431 - DNA, 359 bp, Triticum aestivum
  unsure (1)..(359): unsure at all n locations
  Clone ID: PAT_TA_88431
tagaagcgcaagctacccagagctcgcgcggtcgcctagcagccagccatggagaacccgtacacgaccttcctcaagaactaccatcagcgccgctactacttctcacccacgctcgtgccggcgccggtggcgtccacgacggcgcctcctccgctctccgcctactcctccagccccttcttctccccgccgcctcctcctgccccgccgccgtcgcccccgctccgggaagccctgcccctcctctctctcgcccccgcctcccgcaggtcgcgtgagcggcggttcggccccggcaaagacgactccgacgacggcgacgaggatngggaaggnngggggaaacaancgccggg

SEQ ID NO: 88432 - DNA, 472 bp, Triticum aestivum
  unsure (1)..(472): unsure at all n locations
  Clone ID: PAT_TA_88432
gacgagcagagaagctgtgagcagagctgaacgtatataattcttttgtgtcgctgttccatgtgtcaaatcggatgctactcttattatagagtgccctgatgcaagtatctgaattatgcctcttgaatttgcgagttgggatatcttgcgaatgtttgaacttttaaactcaaaagtgttcccttttttgtttgattcaagcttactctcgttataatgtattgtgcagttgttgtttcaaactgttttgctacaagtaccataatttgcattgaagatattgtattctgttgttgtatcantgtttaataaaaccacatcacatgatgctcacatgagacatccacactatatgtgttganttgatagtaggagcgtccttgtcatgggcctatacgcattttgactcctangttgtgtgtgcgcgtgtgtttaantgatgtgttcaactttgaacgcntttggaana

SEQ ID NO: 88433 - DNA, 495 bp, Triticum aestivum
  unsure (1)..(495): unsure at all n locations
  Clone ID: PAT_TA_88433
ccggcctctctctgtttgctctcgcgtccgccgcgcccatcctcgtccgcgcctgcgccccgaccgtgctcgccgcctcccgcccgatccaccggtccaccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcaagaacccaacgggaggctgagtccaaggacatgatcaatgaagtccacgctgaatggnatggnacaattgacttcccaagagttcctcaacctgaatggccgcaagatnaaagncaacgatcaaaaggangantcaaaggagcttnaggtgttcgacaagggacaaaaaggttcaactctgctgctgactccgcaaagtcatgacaactccgggaaaactcacgacaagagtggacaaatatcctttanccactn

SEQ ID NO: 88434 - DNA, 496 bp, Triticum aestivum
  unsure (1)..(496): unsure at all n locations
  Clone ID: PAT_TA_88434
cgagtttttttttttttttttttttttttttttttttttttttttaaccaaaagggcatcatatctatttatctttcactgaaatcaaagcaaatagtttagtggactacaccacgcaggaagagtttaacacataacttcaatcncaaaaggataatcaccaaagtacaatacatagctgcatcctccaaaggatatcaaatganaggcatccagaaaagaaagctttatctgtacccttagttcataaaaactatacttggttttcagttgtaactaatccttcatacgaaattccanaacacaagattantgcaatcatacctaaaatatcattatcttcccccaaaaancctgttaangtcgtcnncacaagatggggatgacangatagccgcccaaatcttanccctgctagtaaggtccaaaaaacatngntggnaacccggggttacaatccttanaaggacnnatnacaaggccagcatggctacan

SEQ ID NO: 88435 - DNA, 469 bp, Triticum aestivum
  unsure (1)..(469): unsure at all n locations
  Clone ID: PAT_TA_88435
agtccatcaccatctttgccgactatattgtccctgctgtgctgagggagctaggcatcctgaaatacgagtctaacctatgttgctccatcgactcgaacagcgagattgtgcccggaagcgaagaggaagtggagattcgtgcttgttctgttcatgccgttgaaaaaatgagggaactcatcaacaaaaatttgggaagcagttctgagcattgacattgactctggtctggtcggtaagcgttcaaaacatgcgctgtctcatcacgaacctctcaattacaactganggtacccagancagtgcaacctcctttnccgcggggaaaatngccngtcttgggaanncctttanctccgcaaaaaagggaacgaaatttgccccncccgangggngaaaaaatgnaacgttcnacgtnnggcaaccaaatgggttacnggccaagtntgtggggnatacaacacct

SEQ ID NO: 88436 - DNA, 464 bp, Triticum aestivum
  unsure (1)..(464): unsure at all n locations
  Clone ID: PAT_TA_88436
ttgagcccttattgacctgcaatgttgtatggtgctgagtgttggccgactaaaaggcaacatgtttaacagttaggtgtggcggagatgcgcatattgagatggatgtgtggccacacaaggaaggacagagtatgaaatgatgatatacgagatagagttggggtaacaccgattgaagagaagcctgtgcaacattgcctggtcttacttttcatgttagcatattatattataatgacattaactcttgagacgacctgcgaaaagaacttcatcttttaatatcctttgcaggtgttattaaccactcattttcttcagcatgaacatcatcttggtcggcctattaaccaagtaagttgcacatcttgaatagcatagctcagttgggatctacacttttttttccctaaatacngtatcctgttccgtgagatattacttcngtaataaataaaaag

SEQ ID NO: 88437 - DNA, 487 bp, Triticum aestivum
  unsure (1)..(487): unsure at all n locations
  Clone ID: PAT_TA_88437
ggggcagcaagggacacaccaccatacatgggcatcctcctttctgtctttcaaagttaactacccgtggaggtttgaggaagagctcgctgggaaaattcgttggtgggctcagtcggcgaacgacagagacactctggcaaggtcgagccgccggctaggcttagccaaaaggagggctctctggagggggcagcaagggcagtaactgggcaacacgaatgggttaccatgttgcaatgaanggcgtgggcttatgggtcttgacttgtgagtcatgcttactggggctaaaggcatctgatattttcttgattctgttccaacacatccacagtttatgatcagtaatggatgacgttgtaaattacanctctttcccattnggaganagcatggtagtattttgtattgcaactcaaaactggtaacacactttcctttgaaaaatcattgtcccaccataatttgccctaaaaaaaaaaaa

SEQ ID NO: 88438 - DNA, 374 bp, Triticum aestivum
  unsure (1)..(374): unsure at all n locations
  Clone ID: PAT_TA_88438
gtcgtcacagctcacgagcagcggcaagtcagcccacgacgcgctcgattccaacaacctgaaccagttcagtctccatggatgggccagccgccctagcctagcctcgcctagcanacctnccccgtgccagccgctcccagttggccacccnttctcaggcnagaaaagcacacgcacgacacgcgaggaagcatcatccatcaattcgcccgccgngggcgttcaacatcggacgcaagccgccccaacggaccgggagccccacaaggcggggaaaacgcaacagaatccannaaacaaaggcgcccaaggcaagcaaagaaacaaagaccgcgcggtcgcnccnttcaactagctgncgctttcagggg

SEQ ID NO: 88439 - DNA, 408 bp, Triticum aestivum
  unsure (1)..(408): unsure at all n locations
  Clone ID: PAT_TA_88439
cacgaaacaangaanantaacatccanggngtgcatcaataccttgcacanctgctccatgttcaaaggggncaaggctgangccaaaangggcaaagccancggnncaaggancttcgggtgccgggcgtccacnttcatggncnggagcnggctccggctcgggctctacgataaccccgacgccatcatctccggcgatgtggcccnagaacttctccctcctcaagctacgacnacctccgcncctacctccagtcncancagcancannagcagcagncaccttcccacgctgccnattancaacgngggccgctcctgcncgaagcatgtcgacacccgtnntnatgtcacagcgnatcaagcactngntntgtttnagcatttanctcctgtcangctccc

SEQ ID NO: 88440 - DNA, 291 bp, Triticum aestivum
  unsure (1)..(291): unsure at all n locations
  Clone ID: PAT_TA_88440
gttacccagtgctgaattgtgtgagcgtgtgtgcacgttgaaggacatgtgtgcgctgcatgttctcttcctcgcggtcttgctggccatgtcggcgaccggccacgcggcggccttgcgcgccgatctcaggcacgttgacagcggccgtggcttcaccaagcgcgagctgctccgccggatggccacccggtcgcgggtcgtgtagatngccggtggtcacggcgcccgggccgcggcgccaagccaacccggcgttaacgccccttttacccngcggaacnttcggaa

SEQ ID NO: 88441 - DNA, 482 bp, Triticum aestivum
  unsure (1)..(482): unsure at all n locations
  Clone ID: PAT_TA_88441
cttgaatcctgagatcggggacatcgatgacaaccatgttgggattgatgtcaacagcttggcctcagttgaatcccaaactgctggcttctataacttctacggtgagttccaaactgttgtactcagaagcggtgaacgaattcaggcgtgggtggactatgatagcaaattgtaccagctgaatgttaccttagcaccttgtccttcctttaaaccccaacttccgttgttgtcgaccactgtcaatctgtcctctttgttatcattaggtccagtttatgctgggttctctgcatccagcagaaaatctcctccagcattatgtacttggctggagtctgaaagtagatggggtggctcanccacttcacaactcctgtatcgtcttttgacactgcatatgaactcaaaatctaccaacttccaatttccannaaatgaacatttangatgcgttaatgtgcaagcatcatccaata

SEQ ID NO: 88442 - DNA, 508 bp, Triticum aestivum
  unsure (1)..(508): unsure at all n locations
  Clone ID: PAT_TA_88442
aagtttccgatcgaatcgaagccaaggctttctcgtcctccgagatgcagatctttgtgaagaccctcaccggcaagaccatcacccttgaggtcgagtcctctgacacgatcgacaacgtcaaggcgaagatccaggacaaggagggcatccctccggaccagcagcgcctcatctttgctggcaagcagcttgaggacggtcgcaccctcgctgactacaacatccagaaggagtccaccctccacctggtgctccgcctgcgtggtggaatgcaaatnttcgtcaagaaccccaaccggcaagacatcacctcgaggttgagtcntcggacacatagacaagtcaagggaanattcaagacaaggaggcatcccccccggacaacancgctcanctttncngggnaacaactttaggacggcgcaccttnctgactanaactcaaaagggccaactcnattggtctccgctgcgtggnggatgaaatnttcncaaaactcacgnn

SEQ ID NO: 88443 - DNA, 482 bp, Triticum aestivum
  unsure (1)..(482): unsure at all n locations
  Clone ID: PAT_TA_88443
aacgtcaaggccaagatccaggacaaggagggaattcccccggaccagcagcgcctgatctttgctggcaagcagctggaggatggccgtaccctcgccgactacaacatccagaaggagtccaccctccatcttgtcctgcgtctgcgcggtggcatgcagatcttcgtgaagactctcaccggcaagaccatcaaccttgaggttgagagctccgacaccatcgacaatgtcaaggccaagattcangacaaggagggatcctccggaccancaacgcctatcttcgctggnaaacagctagaggatggccgtacctcgcagactacaacatccanaagganccacctccaactggtggttcgcctgcntngtggnatcanttnttcctnaaaacctcactgggaaagacatacnctgaggttgagantcccggacatccanaattnaaggcaagntcaaagcaaggagggatcccccgg

SEQ ID NO: 88444 - DNA, 498 bp, Triticum aestivum
  unsure (1)..(498): unsure at all n locations
  Clone ID: PAT_TA_88444
gccgccgccaccgtcgccgccgcagcgcgcggaggcgatcaccccgcagcagccaagatgcagatcttcgtgaagaccctgacgggcaagaccatcacgctggaggtggagtcctcggacaccatcgacaacgtcaaggccaagatccaaggacaaggaggggatcccgccggaccagcagcgcctcatcttccgccggcaagcagctggaggacggccgcaccctcgccgactacaacatccagaagganccaccctccaactggtgctcccgcctccgcggtggcgccaaagaagcgcaagaagaagacttacaccaagccaagaagcaaaacataacacaagaagtgaactccccgtcctccaattctaacaagtcgacgacgctaccggcaagncaccaagtcaaggaaggatgccccaacncggatncgngccgggacttcatgggcaacattcattgtcataatgcggaaattcggctcactagttanaaca

SEQ ID NO: 88445 - DNA, 151 bp, Triticum aestivum
  unsure (1)..(151): unsure at all n locations
  Clone ID: PAT_TA_88445
agagaagagagaagcacagcttgatatgnngcaaaccatggngtcnatnaccggcctgtcgcagggcgtgcgtctcccaggccncgacacggtaggcgcgccacacangttcaccttcagggcntcatcatgcngcaggctgctgcngccg

SEQ ID NO: 88446 - DNA, 483 bp, Triticum aestivum
  unsure (1)..(483): unsure at all n locations
  Clone ID: PAT_TA_88446
cgaccacccaacgacggcccacctctcccgcagcaaccacagcaccggccacccacccatctcctcctcctctcactcgcgccgtagcaccatgcgccgcanctgccgcggcaaaggagggccagccgccgccaccccagaacgttttgtatgagcaggcacggcaccgccgccgcctccctaggtcgcgacctgtagcggttcggctactcccggcacagccatcgcgcgagccaagcgaggaggacgctttgaatctnggaactgcagtantnaatagaggaaantacatctacagtttngtccgcgagcaaggcgagcnacacgacattaaattatgcaatggccattcctgattaanaagattagagaagtnaagatattttcgcctaaaatttacagattancgatcanaaggtaaccatcctccacaccngggactnttggttcactcaattagcgagnctttncacngcttatccn

SEQ ID NO: 88447 - DNA, 469 bp, Triticum aestivum
  unsure (1)..(469): unsure at all n locations
  Clone ID: PAT_TA_88447
gttttttttttttttttttgagatccaacccttataattgctacccaattcaaatgacaaactcactgaaacaaacagtgcaatcatagaccagctcttccgtcaaaaccattgcctaacatacaaagtagccccatggatacaatttagatacaatccttaatatgtacaagccccattaaggtcatagataaatgctggtattgatctgtaacctcctgctcgattacaagcttccttccttgcattgtgccgtaagggcagcggaaagcaagttgcaaaacccctccttccttgcattgtgccgtgagggcagcggaaagaaagttgcaaaacccccttccaagaacggtggnatcaagcgtgcatttgctcaaatggacaaattatttacagttacaatgttnaaattacatccaaatgcatggaggccggaattaagagaaacgaaaaaacncaaggcactgtt

SEQ ID NO: 88448 - DNA, 293 bp, Triticum aestivum
  unsure (1)..(293): unsure at all n locations
  Clone ID: PAT_TA_88448
cttcactcctcactccccagcaaagaaacctgcagtggcaagccggaggggaggggctggnggtggcgancgggctnccagngnattggtgacgctctgtggtcngccgcggagacgacnctcaggantcgatntctgtgtggntcctactanatatggcagagcngaacacnaccgagaggttgaagacanntcnataacccatcattgggtggntcacacggttatnatgtatctcannatanaatccaatganttnctgtgtcgtgcgntctcatatgctgngctttcta

SEQ ID NO: 88449 - DNA, 164 bp, Triticum aestivum
  unsure (1)..(164): unsure at all n locations
  Clone ID: PAT_TA_88449
tttttttttttttanttacancttctcttcnttanctttaattttatctanttancaatactatcnaggggctcganctcgaatttgntcgccttccatacttcacaagctgcggntanttcaggantcnatttgcaanctgctcggntaatttcattacnttc

SEQ ID NO: 88450 - DNA, 489 bp, Triticum aestivum
  unsure (1)..(489): unsure at all n locations
  Clone ID: PAT_TA_88450
cagacgtcaggctctctggggatttggagctcctatcaatcttggctaatggattgccagtttcagaagatgtagacatggcaagtgttgagcttctgaaggccccacctgttccaaagaagcgaatttttcttctcgttggtgttttctctactggaaacaacttcaagcgccggatggctttgaggcgaacatggatgcaatatgagtctgtccgctcaggcgaagtagctgtgcggtttttcactgggccttcataagagtgagcaggtcaatatggaattatggagagaagncaactgtatgggtgatatccaatttaagccatttgttancactataccttgatcactctaaagacgttgcaattttgtactttggggaccaaaattatgcctgcaaaagtacacatgaaaacagatgatgagctttgttaaggattgatgaatcattccaacctgaagaaggcaaccccatggccttttttgg

SEQ ID NO: 88451 - DNA, 489 bp, Triticum aestivum
  unsure (1)..(489): unsure at all n locations
  Clone ID: PAT_TA_88451
cttccaggccgccccaagagcttcgtgccagcggtctgcgtcctggccgcgaccgtgctcgcagttgtcgtcttctccgccgactcgccctggtccttcgtgcaagatgcacctccatctgacctcaccgccgaccagctcctcgacggcctgctcaccgcagaattcagcaagcggtcgtgtcggagccggtacgaagttcgccagctaccacgagaagaagaagaacacatcgcataaaccatccccctacttacttggcaagtccgggaggcacgaaccctacagaagcggtgcggcctggnacanccccgtttaaggcggcgtctggcactcaatccggtnagggcgctgccggcaangatgccgtactcgtttccataactacgcggctcggaaccgatgtcgcaacgttcgcttctcnaagccgtgccaacgacgtgtctcccgtcacaattcaacatgatttancgcctctcngcaaccttc

SEQ ID NO: 88452 - DNA, 492 bp, Triticum aestivum
  unsure (1)..(492): unsure at all n locations
  Clone ID: PAT_TA_88452
ctcgtgccgattcggcacgaggtccgtccccacacacacacgcacgcgtttgacattttccgcccaccaccgccggagggagctccagccatggccgccaagtgctacccgacggtcagcgacgagtacctggccgccgtcgccaaggccaagcgcaagctccgcggcttcatcgccgagaagaactgcgcgccccttatgctccgcctcgcgtggcactcggccgggaccttcgacgtggccaccaaagaccggcgggccttcggcaccatgaatgccccgccgggagctcgcgcaaggngccaacgccgggctcganatcnccgtcaagctgctccagccatcaaagggcanttcccatcctctcctangccgactttaacagtcgctggatcctcgcgttcaaggcaacggcgggccnaagtnccttcaacccggggaaacaagacaagccgactctccaaaaagctctcctgatctaccaaggtctga

SEQ ID NO: 88453 - DNA, 288 bp, Triticum aestivum
  unsure (1)..(288): unsure at all n locations
  Clone ID: PAT_TA_88453
ttccctccccgccgcctctgaccccgccccgccggagcgccgccgggatcccgaccggagatgccgatgccgccgccgccgccccctcccccgccgccggagcccccgcagctccacggcgtggtcatcatcaccctcccgccccccgaccagccctccaagggcaagaccatcaccgccttcacctacaccgacgagccgggcgctggcgctccggccccgccgccgcatcgggggcctccgatggtgcgccggggaanggaaggccaaggcgatttnaagcgggcg

SEQ ID NO: 88454 - DNA, 363 bp, Triticum aestivum
  unsure (1)..(363): unsure at all n locations
  Clone ID: PAT_TA_88454
ggccgccactcccgggcctcctccgtcagccgcttctccggcatcctccgcggcggcagcgggcgcaagggcgggggcgggggcgacctcaaggcggtgaacgccaaggggtggcccgagtgcagcgtcatcgaggaggagggctcctacgagggcctctccggcggcnacagcggcctctccggccgctgcaagctcgcgctcgccttcgtcagcttcctcctgctcttcaccgtcatctgcctcatcntctggggtnccgcccgcccctangancccnaantcctcgttaangtagtacanncatactatatccaantcacntcattcatccanccgtntttgtnttacntcctccgctaa

SEQ ID NO: 88455 - DNA, 499 bp, Triticum aestivum
  unsure (1)..(499): unsure at all n locations
  Clone ID: PAT_TA_88455
atcactcaagacctgaacttagagtcaggcgacatgctggattcattggacaacatccaggaatccaaatttctgagttcggaaattcctcgacctctgagactcagatggggtgaggcttcggatttaattccacccacccaccccaacataagcgatctatccaagatcaacaagagcccgatgaaacagtacatcattactaggccagattcctcctccgttaagaacaggctaagggactaccgcgaggaagacgcaatctcaacttctgcaataattgcacggacaanggaatactcaacgccataagtggccgttgatattacacacttcgctgacttggcgtccattgtacgaaantactgtgtngatgggaaagccctggnaaaccgaancnaattttgggacatccaacctgaatacaaaccattccgaaataaaaggtgcatcatcacaaacaccngtcaagcactaaagacaaaaactctacnttgga

SEQ ID NO: 88456 - DNA, 502 bp, Triticum aestivum
  unsure (1)..(502): unsure at all n locations
  Clone ID: PAT_TA_88456
ccaaaccctaccccgccgccgccgtcgccgccgcagcgcgcggaggcgacctcccaccgccgccaagatgcagatcttcgtgaagaccctgacgggcaagaccatcacgctngaggtggagtcctcggacaccatcgacaacgtcaaggccaagatccangacaaggagggcatcccgccggaccagcagcgcctcatcttcgccggttagcagctcgaggacggccgcaccctcgcccgactacaacatccagaanganccaacctccacttgtgtccgcctccgcggcggngccgagaagcgcaagaagaagactacaccaagcccaaggaagcanaanacaagcacaagaagtnaanntggcttcccccantnttacangtcgacgaacccncccggcaggttaccaagcnaagaanggntgccccaaacccnaacgggggcggggacttcatggcnacatttgacgcnctacgggggcatgggggncactntttnaan

SEQ ID NO: 88457 - DNA, 485 bp, Triticum aestivum
  unsure (1)..(485): unsure at all n locations
  Clone ID: PAT_TA_88457
acaaacccagccttgtacaacaatgctcgtgacaagaataataatattgcacaggtgctcaattggcccccgacttgtgtcatggcataatattttgtcctggctagattcgattaacgtgatacaaggcagagatgtgcttcgctggaaccttatgacattagggtctttcactttagactctacgtaccgtgcgctcacacattttgaggtaccggtgagtaataacaaaaaaaattgngaagtccaagatttcagtaaaagtgaaaatttcatgtgatatctttgtaggagagtgtgttaaccaaagacaacctcacatgacacaattggcaagggagtacgaaacgatgtttttgtacccatgacgagaaaacaaatactcctttttaaatataaattgcatgctctacgtggcctgtcantgtgacaacctgattttgggccttcctttcctttggtttccgangttttgcctgagttcc

SEQ ID NO: 88458 - DNA, 236 bp, Triticum aestivum
  unsure (1)..(236): unsure at all n locations
  Clone ID: PAT_TA_88458
actgaatctaccctgctatcacatgttccctcctcctggncttatattgccacgaaatttcccattgccttgcagtttgtttgattcantgattttgctatcctatagtcctgcatgggtccccgtccccaggcaaaccaatctcagtggagtcatggagatcaaaagatttttccangttgatataattctatnaatnatanattttttcctngagagtaacangtgnatccatt

SEQ ID NO: 88459 - DNA, 349 bp, Triticum aestivum
  unsure (1)..(349): unsure at all n locations
  Clone ID: PAT_TA_88459
gtcaccctccgcacaccaccacgccctcccctcaccctggtcctaggtcgggcagtgcgaggcggtgctcccatacccgcgacggccgcagccttgtccaccccgatctggagctggagatggtcgccgccgtggtgaactacccaatcgtcgcggggttcctcaccttcgcggtcgcgtagtctgccaagttcttcaccacctgggtgagctggccgctcccctcccctcccccgccccgcgttacattctggccgaaggtttggctctgctcctccggttgctgcttgtgtganaatgtggaaccggtggaanactttncttttgggngccggaattcctacctaat

SEQ ID NO: 88460 - DNA, 489 bp, Triticum aestivum
  unsure (1)..(489): unsure at all n locations
  Clone ID: PAT_TA_88460
ctcgagccctccgccgccgccgcgacttcagctctctccttccttctccgatccaagatgaagttcattgctgcctatctgcttgcttacctctctggcaacgccagcccctctgcagaggacctgacatccattcttgagtcagttggttgtgaaattgacaatgagaagatggaactcatgctgtcccaagtgaagggcaaggacatcaccgagctcttggctgctgggtagggagaatttgctgcggttccatctggtggtggtgggttggctgtttcaactgctgcccctgctgctgggaggtgctgctgcccctgcagctgatcaaagaaagaagagaagtcgttggagaagaagagagtgatgatacatgggttcatccgttcgactaattgtgggcacttgtgtctgaataacttcctgggcaagaacanatcaatgattttaaccttaataactaattgtgaacctgcaaaattttgntat

SEQ ID NO: 88461 - DNA, 478 bp, Triticum aestivum
  unsure (1)..(478): unsure at all n locations
  Clone ID: PAT_TA_88461
tatctgcacactatgtgtttatctatttagttggtcctcactgttactaaaaatagataggttgtccacgatggatgtcgaatttggtgttgaaattgttaatgagaatctatagagtgcctaatgttaacctttcttctatgccccaaatgcactatcagtgttggtcagctacaaagaacatagcatgatatcgctggattaaaatggaggtacattgattacaatccagcagaggaactcaacgagtcaaaaaaccatagaaantaccaaccacctcacacttgatctgttagctttttaactttcaataagtacatgtaaggtcatgtagatgantattcataaanttaaagtgtcccctttgtccttcattttgggttacttgaaccttttaaaatggacctganccctactacagctatgttctacaatgctgatctatatttggtgccnatcctgggtcaaaatctgcccg

SEQ ID NO: 88462 - DNA, 496 bp, Triticum aestivum
  Clone ID: PAT_TA_88462
ctctctcccgctcgtctctccctctccctcctgcgagcagctacggtggccaattccggcgagctccggcgggattcgacaacgcctgccctacagtcgagcgccgcccgaccccgcctcccttgaacaccgagctcctctgtgccccgcccgcgtccctgcgtcgccgccgccgccccacgctgcctcgcgcccggatcctgctgcgggaggtccagccactctggatccggcctcctcctcgccggagtgacgcccctccgccgaagcagcgccggccaagcccatcggcaccaagatacagagaggaaaatggtccatgccatggtgtcgctgctgtttaaaatgctccaaattcttgaacatgaggagatgatgtccgccaatgatcgtagactgggggtggggtgaactccaacttgctggctgggtattacaatacattaacttcctcctaccaaatctagtatctactagacaacaagaaaatagatcc

SEQ ID NO: 88463 - DNA, 496 bp, Triticum aestivum
  unsure (1)..(496): unsure at all n locations
  Clone ID: PAT_TA_88463
aattcctggatctatcgaacaatcaactgttcggagatctccctggttgcttgtggaacttgaaagaactacactccttggatctgtcgaccaatgcttttgccggggaagttccaacctcgactcactatagttcttcgctaaggtcgctgcacctgtcaaacaataacttcacaggttgctttccagcaatgttaaagaactttaaaaacattgttattttggatctggggaacaataagatgtttggcgcacttccaccgtgggataggggaaagcaatcctttgctgagaaccttgggactgtgatcaaacatgttctatggaantatcccaggcagcttctcaactgtcccaacttcaaacgcttgatctaacttaaaataattcaataggtccataccaaaaantttgtcnactttccttgataagacagactccattaagcaaccgttatataagtngcaaatanatactactacaacatgaagatttg

SEQ ID NO: 88464 - DNA, 503 bp, Triticum aestivum
  unsure (1)..(503): unsure at all n locations
  Clone ID: PAT_TA_88464
gtttttttttttttttttttttttttttttttttttttgaagaaatancagccacttantcaagggcttgtttattcagatgaagagtacacaagttattacangcacaatcagtatttaaggagccctatgtactgggcaccagttacaatactcaatataggattgagtcgatactcaanaaccanatcaacttttanaccancaagcagtctcatcgaccaatctggtganccttggtccttggacaggaagagaacccaccantnactcaaagcaatgtcaccacagtgccaaanagtgcntcncttantcctcgacgctgtgggtacttctcgtacctgacaaactcacangacagttgtgtagctgtagtacgtgggnatganagacttccnnaacaatncctcaaattttccccgtggcatacngcccaaggtgccggattgaanatcaacanntgttanccccggaacccactgnnanaacaggccattttgttg

SEQ ID NO: 88465 - DNA, 354 bp, Triticum aestivum
  unsure (1)..(354): unsure at all n locations
  Clone ID: PAT_TA_88465
cgacatcgccggcggcgaggaactgtcggctccgacagccggggtggttagaaggcacggacgggcacggggagataggggaaatggacaggggctcacgaggggtcgggagagaagctcggtgggctcggggaagcctctgcaacgacgaattgacgacggcgatctccgggcaccagagatgaagacgacgacgctccggtcgactgcggcctcctctggtcgcgtgcgtcgcgtgtgtagctccacggggtcagggcagagctcagggatgcatagtgggagcgagggggtggctggccgcggtgtttctcaacggagtggcatggcggcttcngcanttangggaaaacg

SEQ ID NO: 88466 - DNA, 405 bp, Triticum aestivum
  unsure (1)..(405): unsure at all n locations
  Clone ID: PAT_TA_88466
gaaggacggggcgttcgagaggcggttccagcaagtctttgtggcagagcccagcgtgaacgacaccgtgagcatactgagggggctcaaggagaggtacgaggggcaccatggtgtaagcatacaggaccgtgcattggtggtagccgcgcagctctcgtcaagatacatcacggagcgtcatctgcctgacaaagcaatcgatttgattgacgaggcatgcgcaagcgtcagggtgcaactccgacagccagcctgaagagattgacagcctccnagaggaagaagattcaactgaaaacgttctccttctctcaaacaaaggacaaagacaagggtaaccaagatattttaaggaagtcatttacaatttgccctttttnaggaaaaactttagcccccagt

SEQ ID NO: 88467 - DNA, 456 bp, Triticum aestivum
  unsure (1)..(456): unsure at all n locations
  Clone ID: PAT_TA_88467
caaactccctgcgccaccacccctggcccaacctctggcgccgccgccgcccctaactccggcgccgtctatcacacccaatttccagcgccccaacttccggcgcaagggtgcccagtccagccctgcggcgtcaggaaggtagattccgtcagctgaagaagttcaaacagggcgagcgcaaaacagtgtgcgagcatctgtgcgggcatctatctctccgttgctgttcttttttgtcatcctgggtgccatccggtccatctgcatnnaggcatcctaaggcagcattgtgttcgaggtcgctactccttagcgtcnaatntccatagcagtcctactatgaagaattagcaagcaagactggaagaaaatacagttnagaattttccctcatccaagaagggatgcaaggcaaccgccaaatggacaaggcctcctcaacctgtgctccaa

SEQ ID NO: 88468 - DNA, 332 bp, Triticum aestivum
  unsure (1)..(332): unsure at all n locations
  Clone ID: PAT_TA_88468
cgccaacaatcccgaggcggcggagcaaccgaagcattcccatggntcgcacctcctcgcagtcgcagtcctccgtggccggcgccgccggcgcctcccgcccggccancgtcggtccccgcggcacggccgccgcganggcgggcatgcgccgccgtccangccgnacntcctcctcctcnggcgcgggnggnggnggcngcntctccggtggtgggaacaacatnctccgcttctacaccgattangcgcccgggctgcncctctcncccaccatggtgctcntcatgtccgtctattcatcngcttcnttanctcgctgcaacgtcttc

SEQ ID NO: 88469 - DNA, 484 bp, Triticum aestivum
  unsure (1)..(484): unsure at all n locations
  Clone ID: PAT_TA_88469
cttgagtttactcaatctcgcattagcctattgtgtttgaaatttgcttacatgaaaacagatgttgaattttcctttgatttatcatttgtcagtttttatctttttgatatttgcatgggatggatttgaacttcactcttgctaaagccctgtatgcgagtttgtttgagttacttgtanaacaaattaacaaggccttcttagttggcaagcgtcnagttgggtgggtcaatcagtttccccctgcatctgcgaagtggcagaagaaggctacgatggatgtgctcanggcgttgccatctccatccccgcaccatctttgtcacatgcagcatctgacttacctcctcaangcacgagtgggctcctcaaaggagaatgagattgangatggaggcactgaacccgcatgcatgatnacgatgcataaaatcacgtcngcggccccgcgggttgacnttnggccgccaanaatgacaag

SEQ ID NO: 88470 - DNA, 483 bp, Triticum aestivum
  unsure (1)..(483): unsure at all n locations
  Clone ID: PAT_TA_88470
ggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttgggactgatggacttaccatcttgatcgttacaaaggacgattctntcacatccgagctgtttctgggaaagacagcaatggttctgttatgttacttatccattanacctattttaagagggtccgttactaacagtttacttccattgtangtacgtatttggttcaaaaccctaacgtgccctacntttggaggatctacaatccccctactttatccaaaactttccaaaggccgcctcaatggtaccaatttgaaagaa

SEQ ID NO: 88471 - DNA, 384 bp, Triticum aestivum
  unsure (1)..(384): unsure at all n locations
  Clone ID: PAT_TA_88471
gcgattgctgaccagatccaaagccctagcgctcgccgccgcccgcgccgacgcggncgcgccgtcgccgctcgccgccgcctggggcgcccgngcgctctccgccctcncncgcgatccggnggacgcatcccccgcctcgtcaccncggnagccggaggaggtctcgccgctcggactctccaacattctangatatgaacangcctctcnactcggtggcacacacnttttccctcnctggttttctantggagcctccaatgaatcttctgatcancagacctcatngacagttnctgntgatggtacaatctgatncactggtantcacangaggnanccccagngcattgnccatattcaccccantnangcaccatt

SEQ ID NO: 88472 - DNA, 477 bp, Triticum aestivum
  unsure (1)..(477): unsure at all n locations
  Clone ID: PAT_TA_88472
ctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcttacctgccaccgcttagcacggaggccctcctcaagcaagtcgactaccttatccgcttcaagtgggtccttgcctcgagtcaacaagttgggtcancctccgttgagcacaacgcaactctgggtactacnattggcngttttggacaatgtggaaactgcctattttgggtgcactgacccacanagttttaaccaagtnggaggaagncaaaaaaggnaccttaccntaatccccaacanccgntttaaaanagg

SEQ ID NO: 88473 - DNA, 446 bp, Triticum aestivum
  unsure (1)..(446): unsure at all n locations
  Clone ID: PAT_TA_88473
gctagctagcagccatggccgccctctcctctgcagcggtgtccgtcccttccttcgccgccaaggctgccacccccatgcgcagcagcaggatggtggtgcgcgcctccctgggcaagaaggcggcgagcgccgcggtcgccgtggcggccagcgcgatgctnctgggcgggtcggcgatggcgcaggacgtgctcctgggcgccaacgggcggcgtgctgggtgttccgagcccaacgaatcagcgtcaanccggcgagaccatcacttcaaagaacaaccccggtncccngcaaacgtggtgttcgacgaaggaccctnccgtccggcgtggactctccaagattcccaagagganactcaacgcccaagcgaacttctcaatcacctaacntcccggnactacgttctacggcaaccgcagcccgggccggatggtcggaaa

SEQ ID NO: 88474 - DNA, 430 bp, Triticum aestivum
  unsure (1)..(430): unsure at all n locations
  Clone ID: PAT_TA_88474
cttgcgtgttttcccctcgcccggcgctcttggcgcaaacccttgggaggcagagtccagccatggcgtgcgcgctgctgcctgcaggtgtggccgcggtcctaccgtctcctcgccggagcgccgccgcctcgaagggacagcggagtcaagttgcgtgcacgaaccagcttcactggaagcagctttaagttagctccacagacccaggaccttgttngctgctgcacatgttcattttaggttcgcaaattntttctcttgctaccggattggccccaagtggaaatgttgttgtcactttatccatttcaaaaattgctatatttgcctggttacagatcaagctttttggtcttgtccattaatgatgtacattttttccccaaagnccaagatatcgtaaangcagacantgataagcattggc

SEQ ID NO: 88475 - DNA, 458 bp, Triticum aestivum
  unsure (1)..(458): unsure at all n locations
  Clone ID: PAT_TA_88475
gcgaggccgtgctaaggctttcggagcgccgaagctcgatgccgtgtacctggtcagcgtccacaaggatttgtcggtgagaaacttgatctcatacgtcaaggatttggcagggccgcgcagcaacgtgtgggtnatcggtgcgcanaacgcttgcaaatctacgcttatcaatgcgtttgcaaagaagcaaggcgtttaaatcacaagactgacagaaccgccttncgggaactacatttnggcatattaaggatgacaggtttttgcctgcaaaggctaagatttatgataccctggcttgcttcaccatatattatttcnattaaggttaaacaccgaaggaacggaagatgttagaaatcaaggaaagacttccggcacggacttcagggttaaaggctggacatcttccacattggagggtttacccccnggtttactanaacttcatccaa

SEQ ID NO: 88476 - DNA, 474 bp, Triticum aestivum
  unsure (1)..(474): unsure at all n locations
  Clone ID: PAT_TA_88476
agtcctactccattgatccccactggtacatggactctggggcgacagagcacctgaccagtgagatggggaagcttcacacccgtgaaccctaccatggctccgacaagatccacaccgccnatggagcaggtatgcacatctctcatattggtcaagcatcacttctcactagacatgccaataggatcttcaacttccgcaatgttcttccgagtccatctgtgacacgtatcttctttcagttcctaaaccactccgtgataatatgtgctttgtgaatttcaaccttntnatcttttaattaaggatcgggggaacgaaggaaattctccttagtggggcgggtcttccaaggctctatntccgggagancctggcgtccctgcgtctttagtggaatttgggtactcgtcacaattggnagctngtctgggcacccggcanacctttgnccggaagtttgcgtctccn

SEQ ID NO: 88477 - DNA, 473 bp, Triticum aestivum
  unsure (1)..(473): unsure at all n locations
  Clone ID: PAT_TA_88477
gagttatagggagggacttatgtcaccacaaacagaaactaaagcaggtgttggatttaaagctggtgttaaagattataaattgacttactacaccccagagtatgaaactnaggatactgatatcttggcagcattccgagtaagtcctcagcctggggttccgcccgaagaagcaggggctgcagtagctgccgaacttctactggtacatggacaactgtttgggactgatggacttaccatcttgatcgttacaaaggacgattctttcacatcgagcctgttcctgggnaagacagccatggtctgttatgtaacttanccattagacctattttaaganggttccnttcctaacaagtttacttccantggtangtacgtattttgttcaaagcctacttgtccnacttttggaggattaacaattccccctacttntcnaaactttccaanggccgctcaaggta

SEQ ID NO: 88478 - DNA, 360 bp, Triticum aestivum
  unsure (1)..(360): unsure at all n locations
  Clone ID: PAT_TA_88478
ccaccgaccaacatggcagcntctctccaagccgcggcnacnctgatgccggccangatcggcggccgggnctcctccgcgcggncgtcgncncacgtcgcccgggcgttcggcgttgacnctggcgccangatcatctgtcnccctgnantccgacatcatggaggnctcaancaactgtgccnacgccgccaanatggccggcttcgccctcgccatnctctgctntcctcgtctccgcntgggtgnagggcgcgancgcngagggggtgcccaacacgntgaccttcgacnatgatncatagcangacctacattggaggtnaacggtaccgcancgctaaccactgtccnaccaat

SEQ ID NO: 88479 - DNA, 457 bp, Triticum aestivum
  unsure (1)..(457): unsure at all n locations
  Clone ID: PAT_TA_88479
caccggcatgcacctgacgctgcaccacccgcagagcccctgctcgccggcgcctttgccgtcggacctccccttctccgccgtgatcgtccacgacgaggcgcgcatcgcccgcctcgcctcgcgcctcgccaagacaccctccagccgcccgacgtcgctccgcaagagcaccggcggcgcccacctngggcgactccgcaagccacgtcggttccgctcgcgccccggcgcgtcggtcggcgttgggcaactacttcacccagcttgggctccggcacgcccgcgactcctacgccatggtcgtccgacacgggtcatcgtcaagtggtncannctcccctgcgttggtgtccttncaccggcaggccggccgtttanaacccggcgcgtccacaacttaagcgcctngcgtgttnggncccncatncngggacttccaggccgcaccttaccc

SEQ ID NO: 88480 - DNA, 468 bp, Triticum aestivum
  unsure (1)..(468): unsure at all n locations
  Clone ID: PAT_TA_88480
gatcctcccgcgtaccaagccaccgaccaacatggcagcgtctctccaagccgcggccacgctgatgccggccaagatcggcggccgggcctcctccgcgcggccgtcgtcgcacgtcgcccgggcgttcggcgttgacgctggcgccaggatcacctgctccctgcagtccgacatcagggaggtcgcaagcaagtgcgccgacgccgccaagatggccggcttcgccctcgccacctctgccctcctccgtctccggcgcgagcgcggagggggcgccaagaagctgacttcgacgaaatncaaagcaagactacatgangtnnaaggtacggnacggcaacaattccgaccatgacgggggnccatncttcccttcaaggcggnaantacaaataaaanttctgctggaccactcctnaccttnaaggccaggnatcagaaaaagaacccccgcttcaanaaaca

SEQ ID NO: 88481 - DNA, 432 bp, Triticum aestivum
  unsure (1)..(432): unsure at all n locations
  Clone ID: PAT_TA_88481
gttgtaaatagcaagagtgtgcattgataaagcagagcaagcgtagcagtagtagattcagctgagaactggaaagaaatcaaagaaaaaagacagaatcaaacgacccaaccctggagcttgtttgtagtgttctagcattttcattcttgagcatggcctcccgggaaggaaacagatctatgccaccaaaggggaaagggtggcagctctccatgccttgtaatgaggaaagaagttgggctacttcagagttggagcatcaacatccacatgcttcactatattagaatcattattccttctctttggtacctctgtgtacgatgccaaaacaccataacatgtanatatanccaacatgaggatctctcacctacagaatngnaatntagtaccacaaaaaagttgttacctaatatcatcattttg

SEQ ID NO: 88482 - DNA, 474 bp, Triticum aestivum
  unsure (1)..(474): unsure at all n locations
  Clone ID: PAT_TA_88482
cttgagagagcgcgcgcgagatggcagcctccatgatcacctcgccgattgtggcgccnacgagcctgccgtccctctcccgccggggctcctccttcgccgtcgtctgcagcggtngcaagaagatcaaggtcgacaagcccctcggactcggaggcggcttgacagtcgacatcgacncccacggcaggaaggtcggcaagaagggcgtgtaccaatttgtttacaagtacggcgcccacgtccaccgcgacagcccaatctacacgcccggaagaatggctgaatctggtgaccgctacgcccngcngaacgacngggttcttatcttggccgtcaccttgcccggctcctcggcgcggctcctcctcgtctacanaacagcgctnttgcccgcnaagaaanactacctttaaaanaaggcngtctcttcttcatcactcctttactagtnactctctgtgaagtaattan

SEQ ID NO: 88483 - DNA, 446 bp, Triticum aestivum
  unsure (1)..(446): unsure at all n locations
  Clone ID: PAT_TA_88483
ctcgccatgggcaagattaagatcggaatcaacggtttcggaaggatcgggaggctcgtcgccnagggtcgccctccagagcgacgatgtcgagctcgtcgccgtcaacgacccctttatcaccaccgagtacatgacctacatgttcaagtacgacaccgttcacggccactggaagcacagtgacatcaagctcaaggacgacaagacgctgctctttggcgaagaagccagttaccgtcttcggcgtcaggaaccctgaggagatcccgtggggtgaggctggtgccgattacgttgtggagtccaccggtgtcttcactgacaaggacaaggccgctgctcacttgaagggtggtgccaagaangtggtcatctctgcccaagcaaagatgcccctaagtttgtggttggtgtcaatgaggacaaatncactcagacgttan

SEQ ID NO: 88484 - DNA, 497 bp, Triticum aestivum
  unsure (1)..(497): unsure at all n locations
  Clone ID: PAT_TA_88484
tccagcaccagcaggccggcggcaagcagcgcaagcacaacaaccaaatggccaccatcagcgccgccgcggcgaccaccgtcgtcgcccgtgccgccatcgccaggccgcaggccctaggtctgccccagctgaggacgaggagcgagagggtgaggtgcagctactccaaggacgccaaggaggcgacccctgccgccggcgtntgcgnggggntggcgtttccctactccccgcgggcggggcgcggtnaccgcttccgcggggccggcgctggngctggtcgacaagcggatgtcgacggagggaccgggctnagcctggggcttaacaacaactgctgggtgggtttctccttggcgtcttcggctcatctgtcctctacacgtctanactcccgctcaacaagacnaagattccggnggnttccctcctaantanaanaattcctcntctctcanttatccgtccccaacatcccatatcggttaatttat

SEQ ID NO: 88485 - DNA, 486 bp, Triticum aestivum
  unsure (1)..(486): unsure at all n locations
  Clone ID: PAT_TA_88485
cttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatcgacgccaacggcaggaaggtgggcaagaagggcgtgtaccagttcgttnacaagtacggcgcccacgtcgacggctacagccaatctacacgccagaagaatggcctganctggtgacgctancccggnggaagaacggggtnctaactgggggttaaccttnccgggncctcctgggggggggctctcctngtntaaaanaanacnctttcccccgcaaaaaaacactactntaaaaaaggcngtctctgcttgaagaagtcctttaacaaaanantcctccgggaagtntcaancacgttcaatnttt

SEQ ID NO: 88486 - DNA, 450 bp, Triticum aestivum
  unsure (1)..(450): unsure at all n locations
  Clone ID: PAT_TA_88486
ctccattcctccgcctcccccgcagatccgccaccgccaccaccgcccctttccccctcccccatgggccagtgcccctccgctccccgctaccaccaccaccgcaagccccctcctccgccgccgtcccccaccgcgcaggcagcgtcgcctggtttctgcagcgccgcaagccgncgaggacgcggccgcggaggctgactacacttccgacctccccgaggagctcctcgccgtcgtattcgggctcctcggctccggcgaccgcaagcgctgctccctggtgtgccgccgctggctcgccaccgangcctcctcgcgcctgcgcctcgccctcgacgcgcgggcgcccctcctcgccgcggccccggncatcctcgcgcgcttctccgccgtatcaaagctcgcgctcaatgcgaacgccgcgccggagaacgtcggcgatccccn

SEQ ID NO: 88487 - DNA, 355 bp, Triticum aestivum
  unsure (1)..(355): unsure at all n locations
  Clone ID: PAT_TA_88487
gatctctaggggccggcgccccccccccagggcccctatataaagaggggggagggagggctgcgcacccaaacccctggcgcctccctctttccccgtaacacctctccctctcgctgagcttgngaaanccaacnaaanattnccgntgcttncaacaacnangccgtcttgctgctgggatctccatcaacctctccttccccattgctggatcaangaangaggagacntttctcccaactgtacgtgtgttgaacaccggangtgccgntccgttcggcncttnggttnatcggttaatttggttaacaacaattanganntcaatnaaccaatnnctcttaaactttcg

SEQ ID NO: 88488 - DNA, 280 bp, Triticum aestivum
  unsure (1)..(280): unsure at all n locations
  Clone ID: PAT_TA_88488
cagaaccctaacctcctgctccaccatggtctcctccctcctccgctccggcnagcgcctcctccgcnaccaccgnggccgcctccccgcggccttctccacggcggccgccgaggagctcgtcgangtgcgnaagttgcccaccgactacgacccctccaccttcgacccgaccgcgccgccgtcccgcccgccgccctccgaccgcntctggctcctcgtcnacgatgtttcngntctcagcctctccnatgccgccgatntctccgcnctcctgctt

SEQ ID NO: 88489 - DNA, 442 bp, Triticum aestivum
  unsure (1)..(442): unsure at all n locations
  Clone ID: PAT_TA_88489
aacacaggttcgattcgacggctcctcccatcgcatggggatcgcacaggctgccgccccgctgcgcctgcatctcggatgctccggcgcggcgcccccgcggctcacctccctcagggtcggggtcggatcccatgcgaggaagggcgggaggcggcggaaccctccccgcgccgccaagctcgctgcatcccagcaagcaacccgagagcgcacgaccatgaccccgccctcaagcctcccgctcccgctcccgccgggcgatatcgccgggaaggacttnaacggcgcccgccgattangcgccgcaacaaaggcggcgcncggcgaaccacntggaggaagaaagggtttggcgctcctccgggaatcaatggtganctactgcggaagcccgttggnacatcgccgcttgtaacccaaanactcancccgctcaann

SEQ ID NO: 88490 - DNA, 424 bp, Triticum aestivum
  unsure (1)..(424): unsure at all n locations
  Clone ID: PAT_TA_88490
gccacatccgtcgcctccgccccgcgcccgctccgcgcgacgccgcgccggcatccctgcgcgccctgccgccaccactacgccgcgccgccccacgccctccgcaggccgcgcctcgccgtctcggcctcctccgccgaagaaaccagcagcgcctcctcctcgtcgtcgtcccggttctacttcaacttcaccggcttccccttcccgctcggccccttcctcaaccgccgcaccacccgcaccgaggcggtgaagggcagcgtatggctgttcgagcangagcangcgctgggttcaagcagcgtctccaccaacacgcgcatgaccgtcgtcaagtccgctccggcnggtgtgggttgcacgccccatcggccccaacaaggaatgatccaancttattnaangactngggccccccgtt

SEQ ID NO: 88491 - DNA, 319 bp, Triticum aestivum
  unsure (1)..(319): unsure at all n locations
  Clone ID: PAT_TA_88491
cagaagctctgccagctgctcgaggagtacaccaaggtgctcatcgccgtcgccgacaatgtcggctccaagcagctccaggagatccgcaagggtctccgcggtgactccatcgtgctcatgggcaagaacaccctcatccgccgctgcatcaaggtgcactccggagaagaccggcaacaaggactccttngagctcaagcaacctcctcctccggtaacgtttggctcatcttcaacaagggtgactcaaggangttncaagaagtcccaagtaaaaggtttgtgtcctgctccctgtttggctaattgaactgta

SEQ ID NO: 88492 - DNA, 488 bp, Triticum aestivum
  unsure (1)..(488): unsure at all n locations
  Clone ID: PAT_TA_88492
gcagcttcccattcctcgccgccgccgctccgtacccgctcgaagccaacccgaccatggcggacgtcgacgttgacacggaggtggccgcgggcgcgcagccgaagaagaggacgttccgcaagttcagctatcgcggcgtggatctcgatgccctcctcgacatgtccaccgacgaccttgtccagatgttccccgctcgcgcccgcagaaggtcaaagaggggctcaaagaggaagccatggcgctcgtcaagaagctgcgcaaaggcgaaaaaggacctnctgctggtgaagaacctgagcaattaagaacatctccgtaacatgatcaattgtcccctaanaataattggaaccttaccgngtcctaaaaatggnaanactttcaacaagtttgagattaaacctgaaaatatngcattactggnaantttccaactcctaaaagcaantnaacacggttngcccgttccgggcnaanaccnc

SEQ ID NO: 88493 - DNA, 486 bp, Triticum aestivum
  unsure (1)..(486): unsure at all n locations
  Clone ID: PAT_TA_88493
atccagcccccctacgatctcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaaggacaaggagggcatcccccccggaccaagcagcgtctcatcttttgctggcaagcaactccaaggattggcgcacctttgcngactacaacatccaagaaggatccatctccactttgggctcaaagtccttggggggtatgcaatnnttggtcaaaaacctcaaccgggaagacataaccctggaggttgaatcctcaanacacattganatgttaaagnaaaattcaaagacaagganggatccccccgacaacacctgatcttttcnggaacaacccaagattggcgcaccttgcggttaaaantcaaaaagg

SEQ ID NO: 88494 - DNA, 392 bp, Triticum aestivum
  unsure (1)..(392): unsure at all n locations
  Clone ID: PAT_TA_88494
gccactcacacacacacacacgcatcgagccagggagaggagctcccttctgctcgcaccctcctggccagctgtgcccctccatggcgctgccttgctgcttcctccagcgccaagccgccgctgcgtcaagtcccctgtgcatccccttgccggtgccctgtccctgacctcctgcgatgcccgccgccgctgccttcttccaagcgccgccgcccgcttctccgccgccgcgcatcttcttnaaggcgctcngagcacgagtccgtcngcgcccgctcctcctctctgcgtccggcgcgccgcaacgcttggctccttcnangcgcatttcgtctttgctcctctctcaaaccgttaccgagctctngactntcgtcngcctggcttct

SEQ ID NO: 88495 - DNA, 479 bp, Triticum aestivum
  unsure (1)..(479): unsure at all n locations
  Clone ID: PAT_TA_88495
cacgcatagcatgcgcgcgcgcccatgtcctcctcctcccctctccccttcctcttcctcctcctcctcctcctgttccctccatgctgccgctgctgctcccggcacctccttttccatgccggcgccaactattccacctcgctcgccgacatgctccaggtcnaggccggcnacntcancgacggcctcangcgctacctggcgcgcttcggctacgcagtccgtccctgacgacgccnacggncagtcgtgggtgaggtctaccagtccaacctcnggctcnccgtcaccgggcgcntctacaaccgcacctcnactcatngacacccggcgcttgcggcntcacggactngcactcnaaacgaagcaacngccgcttcgctcttcaagggcaagctcgntgggcgcgcccnccgggcatttctggtcactacaagctaggtgntttaanagganaaatatacgatatangntan

SEQ ID NO: 88496 - DNA, 461 bp, Triticum aestivum
  unsure (1)..(461): unsure at all n locations
  Clone ID: PAT_TA_88496
ccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcctacctgccaccgctcaacacggaggcctcctcaagcaagttcgactaccttattccgcttcaaatgggtgcctttcctccantnaacaaaggttggttnaacttccgttagnaaaacgaacccctgggtactacaatgccgtactgggaatttggaattnctantttcgggngaaccanccacanaagggtntttancangggnaaaggtcaaaaggntncctaacntattcgaanaancgtttnaaaattcccagggaatggttanttna

SEQ ID NO: 88497 - DNA, 320 bp, Triticum aestivum
  unsure (1)..(320): unsure at all n locations
  Clone ID: PAT_TA_88497
tactcgatagtgatctccacattttgataggacaaacataaagaatagacaattcagttgggtgtaggaacagcaattttatcattcacatcangtaatctacaatctacaacaatatgttccgtgaaggtgacaaaacaaaactggaggcaattttggtacatttgggagttcaaaagcctatagccattcccaccccngattggcgctttctctnccccgttttattcttccagctttcaaggntggggttcccntttccgttagggttccccggccngccctggacccaagnncaaattaagggcccgttgtgcttg

SEQ ID NO: 88498 - DNA, 326 bp, Triticum aestivum
  unsure (1)..(326): unsure at all n locations
  Clone ID: PAT_TA_88498
gatcaataggctcgttcgatcggagtagtaattaagccagaagttgaccaaggagctcgcactatcaaggggcacgagcacgcgcgcggaccaagggctactataggctgttgttggtcaagccagctctccttccggttccggcacggccaattccaagatggagatggtgaaagcatgcatgcggcctgccgctccgctncttcgcggccccgcttntncttctncggcggaatngngtgttcgggggnctnaacggaacgnctctcccaaattccgnctcaatctnaatatnctantcgnggggangaaacngagaaaagagt

SEQ ID NO: 88499 - DNA, 485 bp, Triticum aestivum
  unsure (1)..(485): unsure at all n locations
  Clone ID: PAT_TA_88499
gaacttgaaagttacaagttccgaagaagtgggagcaaatttatcctccaaatttaaactgctacgttaaggagagaacctcttattggaatcttgtgtgcttgtaccaaatagaaatacctcagttcaaatttgtaggtngtatgtgccttaaaagggaccatgttatttgtgtgggaagaaaatttaacctgatccaatgaaattgccaacaataagtaggtgtataccaanttcctaacagttttttgggtacaaggatattgnaaaagaatttttaagtnngggtttaccaattccaaangttttttgggtacaggatgattgaatgataaaacngttaaataatgttctgcctcctaacnnaggttngttnttncccccgaaaattnncanccaatccggnattccaancaaaggngccgganttaaacccccatttaacaatgggttttttaaccaanaggctacangggagcttaaaa

SEQ ID NO: 88500 - DNA, 454 bp, Triticum aestivum
  unsure (1)..(454): unsure at all n locations
  Clone ID: PAT_TA_88500
cccaagttaagtatacccgagtattctcacgcgtgcgcataatatgctgaatagatagctcatggtttgttcctgtacggttcttgctaaatgggtagctcatggttctgtgtagcagaatatgtttaaattttctggggtacccttttttactctgaataagcaacagaagtgctcaacatccatcatgcataaccctgaatatttatggcctttgttganaagtncttcctgtgtacgttaaaatgcctgtaatcaatggtttgttttngaaggttagggaanttttactggacaagtaancccagancgggnaatttttttgaanaatnctgtccttnaagttgcncaaagaaggggaagacgctttcatccaaagtacctatcatcaagagacaactcccttggcgccctttgnccttttngaatccggagcatcttnaaaanctcaaca

SEQ ID NO: 88501 - DNA, 479 bp, Triticum aestivum
  unsure (1)..(479): unsure at all n locations
  Clone ID: PAT_TA_88501
ctcagacaccattgacaatgtgaaggccaagatccaggacaaggagggcatccccccggaccagcagcgcctgatctttgccggcaagcagctcgaggatggccgcacccttgcggattacaacatccagaaggagtccaccctccacttggtgctcaggctccgtggtggcatgcagatattttgtgaaagaccctcaccggcaagaccatcaaccttggaagttggatcatcttgacaccatcgacaacgttgaaggngaagattcaaagacaagganggattccccccggaccaacaacgctcatctttngctggtaagcaacttngaggatggcgcaccttnggcggactacaacatttaagaaggancaaccttcactttngtgcccntctccgttggtgggcaatnactcctgggcatngactnttttncnccgggtcaanaagccctctcccgnnccttaaagatcctggnc

SEQ ID NO: 88502 - DNA, 455 bp, Triticum aestivum
  unsure (1)..(455): unsure at all n locations
  Clone ID: PAT_TA_88502
aaaggaatacttcctacaaaagtggaagaatgaagcatcgagattgcagtggagagataaattaataaagagcttcacaggagctggaaaagcaaaggatcttcagcaatgtaacgaagtatgtcttagtcatcttttgtacatttgtgcttctcttattcttttatttttttctctaatttttttgcctctgctttatgatatgaagttattttttccaaacgctacacaatcacactantcgtttcctgggtgggactgttgtgcccataaatcatcctgcctggattcaaaagtaagatgggagatngcacataccacaagacaatnaanacatgatgattcgaaaacttcaaacgacttggganggatcttgncaaaaanatatgggatcaaacactacgaaactgcatacccaacttacggaacaattagggangtaagataaantcttc

SEQ ID NO: 88503 - DNA, 327 bp, Triticum aestivum
  unsure (1)..(327): unsure at all n locations
  Clone ID: PAT_TA_88503
ccttttgccanntggtggagcttanntanggggttcttcaagattaagcaactaacatttnacaacctaatttttgggtcccncaactttgattaaanggctcaatttagcaccctctcaaatctcgttaaagctccgcaactngccttttgccttgaagatcaanatgtcatgggaannnaggtaattccggganaggttaacggcacttnaagtngataatggttggaaaacaatccagactaattnagtttgctaacngtaccggtgtttgcaatctgncaagnanaaggcaattnaaangnataagatnctaagttacttccc

SEQ ID NO: 88504 - DNA, 456 bp, Triticum aestivum
  unsure (1)..(456): unsure at all n locations
  Clone ID: PAT_TA_88504
gttggatgatgtttgaatgagcacatgtttgaatcagcacatgtttggctgatttaaatatgtgtatttttttanttgttttgctcatttgaattctagtcaaacttaactttgaccaacatttaaacaagtctaaaatatcaagatgaaaaactaagcctggatccttcttagtcaatccaaaatgaagctgtgggtgaggtttttgaaattttcatgaaaaatgtgctaaaaagaggggtccaaaggtagggtaaacngctcatttctaagcaaggtgttttttaccttggccnaaaatatcaaataactttcctacacatatatcctatacatacagacaagtgcgctggttttccatttttggatttttttaatttgttttgcncaattngaatcctgggcaaacttaactttgnccaagattaaacaattcnaaaacacaanntggaaaaa

SEQ ID NO: 88505 - DNA, 445 bp, Triticum aestivum
  unsure (1)..(445): unsure at all n locations
  Clone ID: PAT_TA_88505
gataccgagaattctaccggtgtgtcttcgacattgccaatggaaccaaacgactgcctcctgtggaacatggtgcatcgcctccacgcggcaacccggtcgcgttgggctgcttgggtttggagtggagctgatggcctctcgctcttgtcgcgaggagagatggctctggcctctgggtgagcacaaaagtccatggcgaagctgttctctcctatgtactgcgccacaacccgntgagtgngaaaaacggggcgggcctgtcctncnaattggaaaanttgtcccctgcaanacnggngcaatgctttcccggtctttttcccaaaacaaaggcnaaggagngaaccctggaaaggggtcattcgggttgccatttccggttccccggttacnaaaagggggccctnagctaaancggtgggggcaaaatttncccggnggn

SEQ ID NO: 88506 - DNA, 448 bp, Triticum aestivum
  unsure (1)..(448): unsure at all n locations
  Clone ID: PAT_TA_88506
gccactctttccctccccaaatagcatcgcaaccaccacctctggcctctcctgcatcgcgcccatgctcctctacgggcgcggctctgccccgcaaccatcgccgtcgacgaagcccgacaaccattagtggggaaccctccctcccgcccgcttgctccgacgcggatccggacaaccccgcaaccctcccctccggtgagctcctcttctccttctcatcggggggttcccaacccttcccccacctccccgacttcatggnttgcctggacaagactgcccttgccattgggcgcgacaagtgcctgtactttgcccacgaccaagcactgtgctcatcttaattccgcgtcaccaatttcataacaattaccggaaaggatgcagnttcaacacgatgcctgaaaatgcactttcaaatctcgtctccgttccgaanaagaaa

SEQ ID NO: 88507 - DNA, 451 bp, Triticum aestivum
  Clone ID: PAT_TA_88507
ctagtctcgagttttttttttttttttttttttttttttttgatgtcaaccatatacgtgaccttgcatgtaccagtgtgccgtctttcgctttctgcggctcttactaatctgttccacacttattaccatcggtctattacattttttttatcaatgactacaattagaaaaaatatcatggtttttccacattgtttcacgcatacatccttgaccttacaataaaatatcattgccttaattgaaacttaccaacaaaatcaaatagtactactatttatcagttcatcagatgataggagagctgaacaacagattccatagtccgactctttcttggtatcttcctccaaaacaagaaacgacaatttgatcaacgttctaacctgcacataactgaattgcccgcccaatttgcaaccaaaaattcttcaaccaagatcacatt

SEQ ID NO: 88508 - DNA, 390 bp, Triticum aestivum
  unsure (1)..(390): unsure at all n locations
  Clone ID: PAT_TA_88508
gaacagcatcaaatctgtttatccgtacccgctcagcaatctttcgatcatcctgtcaagcggctcggatgtcttggntagtatcatctacaacagcacatcacatgcttttgtattatctgtaagccaagcgcaacacaagtggcantgggggggcataanttgcgaaaaaacttgncggntgatttancaanggtaactaatggncgaaataaatctgggattccaagttcaacgggtgattananccaactngancaaattaaaaccgnggaantnaacaanattnancaaaaaaccnccnncttaaaaaaanaaaaccggaanngggtntttttgggtccaaatncctgggttttncccctaaaantanancttccctggtttttt

SEQ ID NO: 88509 - DNA, 446 bp, Triticum aestivum
  unsure (1)..(446): unsure at all n locations
  Clone ID: PAT_TA_88509
agaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttggactgatggacttaccagtcttgatcgttacaaangacgatgctatcacatcgaagcctgttgctggggaaagacagcaatggtctgttatgttagcttatccattagncctattttaagagggttccgttaccaaacatgttnacttcaattgtangtaacgtatttggtncaaagccctangtgcccnagnttggagggtnnaanaatccccctacttntncaaaaattncaaaggccccccnaaggg

SEQ ID NO: 88510 - DNA, 320 bp, Triticum aestivum
  unsure (1)..(320): unsure at all n locations
  Clone ID: PAT_TA_88510
actacctttccccaaaacaattgatgctctctcactgctgctgcaccttctctccttgctgaacctctactaccgttaaactgcatctctctcgttgtgtaattttgtgaacagttactgtggagacttgatcaactatattttgtactagttcaatattttgtgccatgttcatcaagctagtggtttgtaaaacttcagattacttcttgtgaattatgtgttgaaatttagtgtggagttgtaatatgtcttactatttcaatgtntgagaattttctgtcagttagtttcttggtgataccctggattaccnngan

SEQ ID NO: 88511 - DNA, 478 bp, Triticum aestivum
  unsure (1)..(478): unsure at all n locations
  Clone ID: PAT_TA_88511
cgactccacgcctccagcacagcctccctccccatctagcgcggcccccatcgccggcgacttccagatccgcctccctggccggcgaacttccagatccacctccgtcgccgtgtggaggtggctccctccccgaccagtcttacaaaatcaggaagttgtagcgctacaaaggccaagtttgagaagtgacattgccacacctcaaccctctcgatcaagaagtccaatccaggcatgtttgaagaaccacaacanagcatcttcaagacgcanatccaagtanattgggaaggaacgtcactcgatnttcnaaantatgttcctggtactcctcaataagttcagtcngcactnggaaccaagaaaagactttcaattgtttggnacaatacagngtgnaagagctggagttaacttgggttngaaactggttacatattangtttggcttcacattgtcaatnanatagcnant

SEQ ID NO: 88512 - DNA, 462 bp, Triticum aestivum
  unsure (1)..(462): unsure at all n locations
  Clone ID: PAT_TA_88512
cccttcccgcagccgccccccgtgtcccgcgcgcaccttctcgaagcctcctccctccctcccccatggcggaccagctcaccgacgagcagatcgccgagttcaaggaggccttcagcctcttcgacaaggatggcgacggttgcatcaccaccaaggagctcggaaccgtgatgcggtcccttgggcaagaaccccacgggaggcggagctgcaggacatgatcaacgagtttgacgccggacggcaacggnacatcgattccccgattcctgaacctgatggcgagaaagatnaaaggacacgctccgaggaangagtcaaggagcttccgcgtttttgacaagacanaacgttcactcgggggcggggctggcactnatacaactccgggaaanctacgacaagaggtgncnaatatcgggaaggcggcnttgacgnaangcagttaatacaaggatt

SEQ ID NO: 88513 - DNA, 476 bp, Triticum aestivum
  unsure (1)..(476): unsure at all n locations
  Clone ID: PAT_TA_88513
tcgagaccctgtcttacttgccacccctctccacggaggccctcctgaagcaggtcgactacctgatccgctccaagtgggtgccctgcctcgagttcagcaaggttggcttcgtcttccgtgagcacaacagctcctccgggtactacgacggtcgatactggacaatgtggaagctgcctatgttcgggtgcaccgacgccacgcaggtgctcaacgaggtggaggaggtcaagaaaggagtaccctgaccctattccgcgtcatcnggcttcgacaacctgcgccaaggtgcaatgcgtcagcttcatcgcattcaangcaaccggttgcaagganccggcaaggctaaatacgatttaaacaatggctatgtatattgctttggggacttantttttccangatcngttcccgacaagananattttccttccgganatcgttttggncgaaatagttgtngacancanatg

SEQ ID NO: 88514 - DNA, 473 bp, Triticum aestivum
  unsure (1)..(473): unsure at all n locations
  Clone ID: PAT_TA_88514
gtttttttttttttttttttttttttttttttttttgaatactactcagactttcataaactcattgagccaacaacgaatattgttaatgttattgttagaagctgtaaatctagacacactgcanaaacatatggacagtgtgctttggttctctgaagccaaaagttgtgcaaggaagtaggatcactgttgtgtcacgtctgacgacttgtgtccagcatcaacttcggacgctctgtaacccagcccgggtcatgactgctccttcatgccttagaattgtgtgagccccgcgacgagcctggaattagtggatccatcgccnttnttatnaggctccaatacgtctttgganccnaancccgacggagggagtacaacatcatggcattcaacngaacccactcttggtggtgctggancancatgtgtttcaanacgtcctgataacttaaaanctggttacttgg

SEQ ID NO: 88515 - DNA, 494 bp, Triticum aestivum
  unsure (1)..(494): unsure at all n locations
  Clone ID: PAT_TA_88515
agcacattgctcctccaccatgcccttccctcaatctccctaagcctcgtggcattgccagcacatctccgttgatatggacgacgacccactaccaatcgcaacgacacaaggctgtagatcggcagccggtcgctgataggctatcagaactggcaagcagtgttccatctcacattttcggcatcttcgtggttccttctccaagatttgcctcccaggcatcaaatcgacggggccaatcccctgggtgaagaagctttgggattgccggggccgcgttcgcttgcaccttagtggtnctatgtttgcttgctagaccagtgatctccgccccttacttcacatatgatccccctaacctgggggcagcatcatctctcctctcgtttcccacgttttccaaagggaacttggttcaacaatctacaagctggaggaactcactgactatcgttctcctatttatgaaatgtcaagaatcaatgttcann

SEQ ID NO: 88516 - DNA, 484 bp, Triticum aestivum
  unsure (1)..(484): unsure at all n locations
  Clone ID: PAT_TA_88516
gatccatccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcacttttgttgccattgacatctttaatggaaagaagcttngaggatatcgttccttcatcccacaactgtgacgtcccccatgttgaccgccaagattatcanctgattgacataactgatgatggtattcaagcttcctaactgagagtggcaacacgaagggatgactgaactcccactgatgagttctgcttggcaaatnaagactggtttgctgatggaa

SEQ ID NO: 88517 - DNA, 501 bp, Triticum aestivum
  unsure (1)..(501): unsure at all n locations
  Clone ID: PAT_TA_88517
aaattatcacttaagtggtccactgtgccaaaatgttaaccattctattagtgcattggttctcacattaaatttcatttcatctctcatattgaactatgtcctcatgtacagtatgaatgtgcaccagatcccaatttttctgcactgctcttcggattatgttagactgtaaaaaatgtgcaaaaaactcccttctctaactaatctccacataaagtagtaaataacagtgcattgtgaaaattttgattccgagagtctatagttgggctgttaggaaatggagatgatgaatgacggttggggcgaccaatttaaagcatggtgaangtgctgatgttgaagcagtgcacttctggttattttggtcaacttggggctgttaagaaatggttaatgtgaattgaatagccccgatgaataaattggctgtattactagactgggcatgaaattnaagcntttaacttanccgctgccttaagtccggngtaaatg

SEQ ID NO: 88518 - DNA, 482 bp, Triticum aestivum
  unsure (1)..(482): unsure at all n locations
  Clone ID: PAT_TA_88518
tcgacccgaggctcgtcgaacccttcttccccaccgcctcaagatgcagatcttcgtgaagacactcacgggcaagaccatcacccttgaggtggagtcgtctgacaccatcgacaacgtgaaggccaagatccaggacaaggagggcattcccccggaccagcagcgccttatcttcgctggcaagcagctggaggacggtcgcacccttgccgactacaacatccagaaggaatccaccctccaactgggtgctccgcctgcgttggtggatgcagatnttccgtganagacctcaaccgggcaagacanaatcttgaggttgatagnccgacncatttacaagtcaaggtaagttcaagacaaggagggattcccccgaccaacaangcttatcttccccaggcaacanctngagatggtcgcaaccttncngactanaatcannaaggnccacctnaactngtgtcgctcttggnggt

SEQ ID NO: 88519 - DNA, 480 bp, Triticum aestivum
  unsure (1)..(480): unsure at all n locations
  Clone ID: PAT_TA_88519
ctttactggccaccacatcacaaattatgtttgaagagttcataaactcaatgcaagcatctttgagctggctgcaatggtgctggtcggctagagctagcgtggtcgcgacagtctcagcacaaagaacctcgcacagcttgctctcgcacatcaatttcatcctttccatggcatacctatctgcagcgacaagcaaatgcctaagcatttcttcatactcttcatcattgagctcatccatcggaggcaacgaatccttggtagatgaagtgaagcagtcctctgaaagcagcaggctgcatatcttcgacagttatgctgcgcctttttttgtccctcaattgggcccgttagaactctgacctgaagancgccgaacgcatcgcaaggantatcttatgagctgagaaaaatcatgtttcacatttaangatacatcangtccctcctgtggtaccaacaattacgnagattatc

SEQ ID NO: 88520 - DNA, 483 bp, Triticum aestivum
  unsure (1)..(483): unsure at all n locations
  Clone ID: PAT_TA_88520
gctgctagctgccaagacggctccaccgcgtgtggctccggctcttcccgccgtcccgggtcactctggccttcctcgtggcgcccccgcttcgtcgcacgctgaataatggggtgtggggggcacacgagcacgccatctccgcgccgtcgctgctgccgcggagtctctctcccatagacaacggctaagcagtaagcacatgacatgatcaccgccgcgctctgttttggaaggtgatcgggattctgattcaagtggccatggccaagatnactgttctccatcctgctcaacgggccggaggcanaaacaatggtttgtgatgccggcaaggatgctggactggganccagcgccaaatggtnaanccgtngcgtngatctaacnacgccttcccgcgttgccctcctttgtgganaaatcnggnacaaattntcccatntgtattgncgnggggnaaaagggccattaagttcnccg

SEQ ID NO: 88521 - DNA, 512 bp, Triticum aestivum
  unsure (1)..(512): unsure at all n locations
  Clone ID: PAT_TA_88521
tctccgcgcacccctgccgccgccggatgatgctcgtctacgagctcatgcccaacggctcgctgcaggacgcgctgctggggaagaggtgccccgagctggtgtccgagtggccgcgccgcctcgccgtcgcccgcgacgtggccgccgcgctccattacctccatttcgttgtgcatccgccggtgatccatggggatgtcaagcctagcaatgtgttgctggatagcgagctccgtgctcgcctctcagatttcgggctcgcgcggattaagtctgaagaagaagatgagttagatagcggtgtacttggggacaatgcggttgggaaatggaaatccaagtggtggatgccatgatgatgtaancagtgggccggcgaaagcatgactgctgttggnagtgaatggggaaagacgggtgccaacaaanctccagaggatgatgangggtnaacaactgcctcacatgcanangcggatcaacttccggatccataaaacaatgttgtg

SEQ ID NO: 88522 - DNA, 226 bp, Triticum aestivum
  unsure (1)..(226): unsure at all n locations
  Clone ID: PAT_TA_88522
aatctgctcgtcgccagggatgttgccgtcttcatgcgctacgccgtcggggagctgttctcgggggaagcggagggagctaagggagaggccacggnagggaggangaggtcgatgatgagcccccgtgcttcaccgacggcatgaagcggagggcaaccaagaagttcgactanggancatgcgngtcatgctcanntacanctccngcgtcnacantgagtcg

SEQ ID NO: 88523 - DNA, 330 bp, Triticum aestivum
  unsure (1)..(330): unsure at all n locations
  Clone ID: PAT_TA_88523
tataaagagaacttcnanatangcaaataantaacatgcaanccagttaacnaantttttcttttgaagctatcagtccataaactaacaaantacacatgtacgaattacccctttttcctcctcttcgacgacacatctgcttgtctggattctcaacggcatcaatcaccacatcccccgacanctacgtccatggctgcttctttccgtangaccttctccctgtngncctcctcccaagccancagncatggcatccccaagcancatnagncagcagcatcaagcaaccantctacattntgagganttcatcncancgccctt

SEQ ID NO: 88524 - DNA, 496 bp, Triticum aestivum
  unsure (1)..(496): unsure at all n locations
  Clone ID: PAT_TA_88524
tttttttttaccaagcaaagcatccaaccatcagatatgcatatgaccagacctgaccaattgtgccatagatgtttcttagttcagataactataacaggaatggttctacttctagggccatacgaaaacccctctaactagatatcacatccagccaactacaacagagctccaattaaacgcccaccggctgtgcacacacagacgtcgcgtatcaagaatttcaaccacttcttctccttctccttcctgggagacggcgttggtggccgaggcgtgcgtcgcctcggcgtcggcgagcgccttccgcgtctgctccagcttcctcgacgccgcgtcgtgcactgccttgtccttgcggttgcgctgcaacatctcctcaagccgcccgacctggctcctcaactccttaactcgtcgtcgtacgcaacaaaagacttcngttgtctccttctgggatgccgttggnctgaccgatggcnatcttctggnt

SEQ ID NO: 88525 - DNA, 503 bp, Triticum aestivum
  unsure (1)..(503): unsure at all n locations
  Clone ID: PAT_TA_88525
gagttatagggagggacttatgtcaccacaaacagaaactaaagcaggtgttggatttaaagctggtgttaaagatnataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgttnacttccattgtangtaacgtaattggnttcaaagcctacgtgctcacntttggaggtctacgaattcccctactaatcaaaaacntncaaaggcccgccnnatggaccaagtngaagnganagtngaccattg

SEQ ID NO: 88526 - DNA, 496 bp, Triticum aestivum
  unsure (1)..(496): unsure at all n locations
  Clone ID: PAT_TA_88526
agtccccctccgatctcaccgagaaatcgacgcgaaggctctctgcccgtcctcaagatgcagatctttgtgaagaccctcaccggcaagaccatcaccctcgaggtcgagtcgtcggacaccatcgacaatgtcaaggccaaaatccaggacaaggagggcatccctccggaccagcagcgtctcatctttgctggcaagcagcttgaggatggccgcacccttgctgactacaacatccagaaggagtccaccctccacctggtgctcaggctccgtggtggcatgcagatttttgtgaagaccctcaccggcaagaccatcaaccttgaggtcgagtcctcggacactatcgacaacgtcaaggctaagatcangacaaggagggatcctccggacaacancgtctcatcttcgctgggaaacaactcgaggatggcgcaaccttgctgactacaacatccagaaggatcaacctcaactggnctcaaggtcg

SEQ ID NO: 88527 - DNA, 159 bp, Triticum aestivum
  unsure (1)..(159): unsure at all n locations
  Clone ID: PAT_TA_88527
ncgccgcctcctttcctaanaatctacacaaagattcgtacgaaantcctccncaaatccnccacatcccgtttctgntcccantcncaccccaatcccctccangnnaccctcgccccnctcgcctcgcngccatgggcagcgccgcctcgccgccgc

SEQ ID NO: 88528 - DNA, 273 bp, Triticum aestivum
  unsure (1)..(273): unsure at all n locations
  Clone ID: PAT_TA_88528
ttcggttcgggtccgagagtanctagcctagtctagggtttccgtagttcggngaggacagaaaggnanagntccatggcggtcacggagtancgctgcttcgtgggcggcctcgcctgggccaccgnngaccacaacctccatcangccttcagccactacggngacatcctctangccaanatcatcaangactgcnanacggncangtcncgtggcttctgcttcgtcaccgnccgncancttttgnttctactgcnccangccntcttg

SEQ ID NO: 88529 - DNA, 475 bp, Triticum aestivum
  unsure (1)..(475): unsure at all n locations
  Clone ID: PAT_TA_88529
tagtctcgagttttttttttttttttttttttttttttttttttttttttttttttttttttttttgttcaaacaanantatgcccatttcggttttganaaacacttcttttttgncaaattggccncananactgancctgaatgcatcaaaatgtccatggnaaatagtatttttacaaaattctcgcaagctanacttgatagcncnagcanacttcccctcggtanttaanacctgattgaaaactctaccatccgtgaagactatatcancanagtggcnancctgttctcnaccgtcggctganccaaccacaanaccgttcacgtggttaccgcatcgagtgatanaacgctcgtaaaaaacatcagaggcctcncgggccnactttcttccaaaggacgtaaaccaacatcacgataacggtgcggncggctttggaaagctctaaacgntcgtantcanatgcct

SEQ ID NO: 88530 - DNA, 526 bp, Triticum aestivum
  unsure (1)..(526): unsure at all n locations
  Clone ID: PAT_TA_88530
cgaatccccacctcccctcctttcaccgtcggccaccccaccctcgacccgccggccgccccaccctccccgccttttccagcacctgctagcctcncctcccctccaccaagctcgtccactggatccagtagcccccgcacccctccctccggngccgcggagacacctccccccaactccggttggatccgccaacttccctgactgcgctgcatcgctggatccgatgccgtcctgggcagcanccacttctccctcctctccttcttcatcccccganatgggacacaccaacggntgaggttgcngatgtcggatgcacgccggccttccttccgacgacctgctccggcaaaagagccanctacnccggcctcctcatgtccgggcgactctcatcanngcgacatcttgcccatcctctcccatgtgggccagccgtcngatcagcgtcaccgtcctccttctcccgtgcctncacgtcgtcgtcccgccngatncgcgtccgtcctgtcggcccatg

SEQ ID NO: 88531 - DNA, 524 bp, Triticum aestivum
  unsure (1)..(524): unsure at all n locations
  Clone ID: PAT_TA_88531
gtcagacctgtgcagccaccgaccccgaggtcggagtcatcatcttccaagcgacttcgttctgtggtgtctaccgtagaatcagattcagcagctaatggtaggttgcagaaaatgaagtctgatgtgagagtaccaggtgcgacagcagcatttagagccgcagctgaggctgctgaagatgttctcaaggacaggtactcctcaagaaagcgtctttgacaggttgggtagaaggcctctgttgactaccactgaagaaccattcgatttcaagagaaaaagttccagaaagatggacaatacaagcacatagattatgtccaagcaagaaaacaagtagaactcatgaaagaaatcagtatgtttccaaggatacttgtatgtatgacagcggnactgagaagntgctgatctgcattcgatattgatcggtatgatacaccggttcaatttgatntatggngtgaaccttacagaataaatgtctctatggagnanaaatctcaataagcgtaaataag

SEQ ID NO: 88532 - DNA, 467 bp, Triticum aestivum
  unsure (1)..(467): unsure at all n locations
  Clone ID: PAT_TA_88532
aaacgttcctctcctccttccctgtctacgtacacaagctagcaccggcaatggtttctgccggcggccatggcggctacagcgacgccgatgatgccgtcgacttccgcggcaacccggtggacaaatccaagaccgggggatggctcggagccggacttatcctagggacggagcttgcggagcgtgtgtgcgtgatgggcatatccatgaacctggtgacgtacctcgtcggcgagctgcacctctccaacgccaaatctgccaccatcgtcaccaatttcatgggcaccctcaacctcctaggcatcgtcggcggcttcctcgccgacgccaagctcggcggtactcacatcgccgtctcgggcacatcgccgccgcaagcgtnagcttgctggcggtggacacgtggcgccgancatgagccgccgccgtgcgtggaccncggggcgcgcaagggcacgcaa

SEQ ID NO: 88533 - DNA, 517 bp, Triticum aestivum
  unsure (1)..(517): unsure at all n locations
  Clone ID: PAT_TA_88533
tcatgctcgtctcctcacttgtctaagtccttggacactcttatccatgcctgccctctacacattactcctacttctcctcgtctcctccttccacgctcctccatgttcctctacaacttcacatgatactctcacggcaggccaaacgcttgccgtcggcgacaagcttgtctcaagcaacggcaagttcgcgctcggcttcttccagcctgcagcacgcaccaccatcagtaagtccgacaccaccacctcccctaactggtaccttggcatatggttcgataagattccggttttcactactgtctgggttggtaatagagagaagcaatacccggccccgagctccacctaacacacctcaaaatctctagcgatggcaatcttgccatcgtgaacatgccggtaccgagtctgtactctggtccactcacatcatcaatagaacacaaacaacataaacacagtagtacgcgtttcntgaaaacggnaacntgtctcacaaaggccatan

SEQ ID NO: 88534 - DNA, 340 bp, Triticum aestivum
  Clone ID: PAT_TA_88534
gatgtgcctccatggtcaagctgccggggcgccgaggagcgtggtcgtggacagggcggaagagctgcgggaacggggcgccggtgcttcagggatagagcgagcaggaagagttgcagcggcggcggcggctacgacgacgggcgagcgtgggcggcggctccgagtcaggaacaaaaaggggattcacattgctttaagattcgttcgtccaggtgtcaagcgctggagagggtctcacgtttgagagcgtacgaccaggtccgtataagatttcttccgtaaactaccgtctcagtttatttttaataaacccttcagctttgaggcggcgaacacg

SEQ ID NO: 88535 - DNA, 511 bp, Triticum aestivum
  unsure (1)..(511): unsure at all n locations
  Clone ID: PAT_TA_88535
ctcgtgccgcaacgatccggccaggaacccagatttttacaactggaatcgggtgaagctgcggtactgcgacggcggatccttcgcgggcgattcggagttcacaaatggctcttcagtcatctacatgagaggtcagaggatatgggatgctatcatcgccgatctcctcaccaaaggcctcgccaaagccaaaaaggtgctgctctcaggatgctcagcaggaggctagctacattcttccactgcgacgactcgggggagttctccgggggcgtcnccacagtgaaatgcatgaacgacccgggttttccttgatgtgggatnacatttccggnaacaacaanattagactttctttaacaacctaattctcctcaaggagctnagaaaattttacaaagacgtctaaatcaanatcatcctaaccngnttttccccaanaagcactnaaaaattaaaccatatnatctaaatcacgtagatgtnanattcacaaacttggcccctn

SEQ ID NO: 88536 - DNA, 543 bp, Triticum aestivum
  unsure (1)..(543): unsure at all n locations
  Clone ID: PAT_TA_88536
tttttttttttataaagtacccaaatcttaaatgagtctgcatcagattcacaataggtggcctgatactttacaaagatgaaaaccaacagctcaatgcaaatggaacttgaggtagaagtacgggagtatatagtacataagacacagggaaatatttcaggtaagaacttcccagccaagcacaaagcgccgtgaagaacaaaaagggaggtgctattctacagataaatgattgtagtacctctgaaaccatccaggaaaagaatggtctgaattttagctctctccattcttttcggcgctttggtggtgccctgggaggcagcagcatgaatgaacctcaagaatttcttccggggaaccatcgaattgccctnaacaaagcttaaggagcaaattctccgtccaaagnatcttcggtaaactnncaaccatcgacactaaangnacccagcacaccagattacccaatnaantacaacctnggtggtctgatggtccgcgnagcactggtaactaaggtctcgcgggananaattn

SEQ ID NO: 88537 - DNA, 500 bp, Triticum aestivum
  unsure (1)..(500): unsure at all n locations
  Clone ID: PAT_TA_88537
gcgcctggctccctcgacatcatcgtcggcttcatcatcaacaacaagaccctccacgcaaattttccaagttgcccggaggctacacccagtgggtggcgctcgcgcgcccccactcagccggcggactccgtgtccgcgcccggcagggccctgcgcccctcagccggtggactccgcgtccacgcccagcgccctcgacatcaccgtcggcttcttcaacaacggcaagaccctccgcgcaacttttccaagttgcccggaggctcngaggctacacccagtgggtgcgctcgcatgcccccacccgaaacacgccgtgcctgttgcacgcccgtcgccggctgcanccggcatctactgcttcatcgacgcccgctaaaaacctccgcgcaacttttcaagttgcccggaggtcaaaagctatgtcngggggatganaacgggtangccaanatgnaaangcttcaanaaatcgggacaacannccctcatcnntn

SEQ ID NO: 88538 - DNA, 243 bp, Triticum aestivum
  unsure (1)..(243): unsure at all n locations
  Clone ID: PAT_TA_88538
tgcttcgctcccgcttcctagtcctcgtcctctcctcaatcgccgcgccgcgcctcggatctgcgcgccggaggagcccgccggccgaatccatggcgcgggccgctcggcctggtctcgccctcgcgctcctcctcgccaanttaagcaacgtgtttctctcgccancttcgctnacaatnagcccgctgcaaaggggggcttnaaggnntgggcgataattncggggaaagggcaanattg

SEQ ID NO: 88539 - DNA, 493 bp, Triticum aestivum
  unsure (1)..(493): unsure at all n locations
  Clone ID: PAT_TA_88539
gacaaatcattgacacacttcagtatcagaaaatcttcaagatgctcatgttttgaaaatatacgaatgatgtttgcctatgatgatgtcaaaggtttcattacaaatatacatgcaaacactttaaatactgagcatatttattctaacttcatcaataaatttttaatctttttacaacattatatgttcgtcttgtatgctgtacacttccatgtcatgtcgtgtctcagtttgcactacatttatatgatggtaatgttggaatgtctttgtaggttgtgggcaactgaactgggcgacggatatgttatcactgttgggagatgtcaantttaacctcacaantcccactttgtccaagantcccgcttgcaaacttgggtgctcccacaagacgaagaaggaatggngaattagacattctgacaccccggtggacttcancattgaaccgtgcaaantcgctaggnatgacgtcacgctgaacgcg

SEQ ID NO: 88540 - DNA, 515 bp, Triticum aestivum
  unsure (1)..(515): unsure at all n locations
  Clone ID: PAT_TA_88540
gtcagcctcagctcactcgaagttagcaatggcggccgcgaccatggcgctctcctccccggcgatggccggcaccccggtgaaggcctccagggcggcgcccttcggtgagggccgcatcaccatgcgcaagacggcgggcaagcccaaggtggcggcgtccagcagcccgtggtacggctccgaccgcgtgctctacctcggcccgctctccggcgaccccccgagctacctcaccggcgattccccggcgactacggctgggacacgcgggctctccgccgaccccgagacttcgccaagaaccggaantggggtnattcactgccgctggcaatctgggccccctcggntgcntttccccggactgccgcccgcaacggntcanttcggcnaggcttttngttaaaggcggtccaatattcatnnaggncgctcaatacttcggaaccaacctggtgaccgcaaacaccngcatcgggctgcaagtggtgtnatggcgcctgagggtacgc

SEQ ID NO: 88541 - DNA, 539 bp, Triticum aestivum
  unsure (1)..(539): unsure at all n locations
  Clone ID: PAT_TA_88541
cccgcccgcaggccgtcaaggccatccccaagctctcccacctcaagtcccccgctaatcccgacgccgtccgctccttcctcgctggcctcggcctctccggcgccgatgtcgccgccgtcgtcgcaaaggacccgcagttactctgcgccagcgtggagaagatcctggcccgtaacgtcgacgagctaaccggcctcggcctctcgcgtaacgacatcaagcggctcatctcgctcacgtccggcggcggccatttccgctgcagagccatcgtccccaagctgcagtactacctgcccctcttcggctcccccgagaactcctccgggtctgaccgcatttctacctcatcggcgtcgacatcgagaggacgattaaaccaaactcgcgctcctgcaagagtgcgggtaagtgcttgtgatattgcaaactgtgccgctaccacgangatgccaacacagctggaaagatcaagctatggtggatgcncgaaggctggtgtgcccgtggtctgaatttaagactgtggatcntcc

SEQ ID NO: 88542 - DNA, 310 bp, Triticum aestivum
  unsure (1)..(310): unsure at all n locations
  Clone ID: PAT_TA_88542
cacggatcactaggaaacaacatgaacatatggcataacaacaaaaaacaggacaaggacatagtgaaattcgaagtccctgaaatcagcatcaacgattacgctactttgcaagctcgtgctagtcaccacaaatatcacaaaaatacatggcaagcacccctttaaagatngcatggcatataagaaaacacatgttaagctnaagatnatngcatccacacatttatcatggnaaaaattccnaaaggngaatttcttaaacaaatctccaanncccntcctgaaanagncncttcccaaaatcatt

SEQ ID NO: 88543 - DNA, 491 bp, Triticum aestivum
  unsure (1)..(491): unsure at all n locations
  Clone ID: PAT_TA_88543
tcaagatcacctgaccagcaagacatttcttcttcttcctcttcctctgtttcaccggctagccatccatgaacaccgccagctccagttccgccgcgctgaggtgcgcgggcaagcctgctggcttcggcgccggctttggccggaggagcggacactgcaactgcagggtgaaggcggcggcggccgcgagcgcgggtgtccgctcgccgagcagaggcgactactacaaggtgctgtccctgggagcactcggcggacgtntggcgcggaggaggtcaagcgcgcgtaccgccggctgggcgctgcataccaccggacgtgtgcccgccgtcgcgccgggccgatccacggagtcttcngtcgactccancgcgcctacgagagctctcccgacctgccacaaggngcaatacacctcaactcaagacgggccggctccgcaaggcgccgggaaaatggttccccaaaggacttttggaagccaatnn

SEQ ID NO: 88544 - DNA, 482 bp, Triticum aestivum
  unsure (1)..(482): unsure at all n locations
  Clone ID: PAT_TA_88544
ctcagctcactcgaagttagcaatggcggccgcgaccatggcgctctcctccccggcgatggccggcaccccggtgaaggcctccagggcggcgcccttcggtgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcgggcctctccgccgaccccgagaccttcgccaagaaccgggagctggaggtgatccactgccgctgggccatgctgggcgcgctcggctgcgtcttcccggagctgctccccccgcaaacggcgtcaattccggcgaggcgtttttgttcaaagggcggtcccaaatttcaagtgaaggcggctcgatactcngnaacccaactnggtcacngca

SEQ ID NO: 88545 - DNA, 476 bp, Triticum aestivum
  unsure (1)..(476): unsure at all n locations
  Clone ID: PAT_TA_88545
ctagtctcgagtttttttttttttttttttttttttttttttttttttttttttgcacccatccctgcatcactaattcaacggatggaaaatgcatgtaacaaaacaaatcaatactatccataaaattgctgacattcccaaaacagaatgagaattattgaatgatgatattttgcaaaaggggaaaaaagaagagagaacattcttgagaagagcttgtgtcatctcctgacggtgtaggaaggaaccctgtcttccttcgacggcggtgatgatatgccataattcctttccccggtaggcacatcgtagaactgtgccaagtactccaaagnttcaagggtcccactgnaaacttccanaagcgatccactccccctggtgcaatgtgcccaatccctcgcaatcattcaaaaatccaacaatttggngtaataagagcncnattttccccnaaaanggaccgttggccg

SEQ ID NO: 88546 - DNA, 172 bp, Triticum aestivum
  Clone ID: PAT_TA_88546
gagattaaggtccgtcccatctgcacggtgggaacacaagacaagcagagctcgatcaacgactgaaggttaagctcatcgactccgatgccaggtatctgagtcagagtgcatgtaagaagaacaagattatggggacatgaaggctcgtcctagccgccagccggaacta

SEQ ID NO: 88547 - DNA, 218 bp, Triticum aestivum
  unsure (1)..(218): unsure at all n locations
  Clone ID: PAT_TA_88547
gaaacactcagcgccatggccatggnttccancgctctcncctcgggcctctccctcctccacgccaagcccgccacnacctccctgccccgaccacacccattcttccccatccacggtcgccgccnctccgtcgccgtcgcttgcacctcaaccgccgcggcctccccgaangtgctgnatctgggggacgccatcncggggctgaacctgnatga

SEQ ID NO: 88548 - DNA, 494 bp, Triticum aestivum
  unsure (1)..(494): unsure at all n locations
  Clone ID: PAT_TA_88548
acccaaaccctaccccgccgccgccgtcgccgccgcagcgcgcggaggcgacctcgcaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagtcgaggacggcgcaccctcgccgactacaacatccagaagganccaccctccacctgggtgtccgcctccgcggcggtgccaagaacgcaagaagaaactacaccaaagcccaaagaagcaaaagcacaancacaagaagngaactcgcntcttcaatttctacaaggtcgacannccaccggnaaagtgacaagttcaaggaaggagtgcccnannccactgcgggccggacttcatggcaacaatnntacgcactacggcggaatgcggcnaactn

SEQ ID NO: 88549 - DNA, 495 bp, Triticum aestivum
  unsure (1)..(495): unsure at all n locations
  Clone ID: PAT_TA_88549
agactactttcggcagcacggtggtctaatattatttgatgaaatgagatcaaagcaaggtatttcattcaaaatcttcacggaagaagaactacaagaagccacgaacaggtttagtgagcaacaagtactgggtcaagggggctatgggaccgtgtacaaggggattcttgaaggcaacgtggaagtagcggtgaagagatgcaagaccgctgacgagcaacaaaagaaagaattggtaaagagatgctaatcttgtctgaggtcaaccatagaaacattgtgaagtccttgggtgttgcctccaaagtggaatccccatgctagtatatgaattcctcccaaaatggnacctcntccagctcatacacggtaaccatggctaactatctcccttgggctaccncttggggatngcccacaatcggccgatcatctcctatctcaatcatcggnttcacacgntctccatggtgattcaatctccaatatctn

SEQ ID NO: 88550 - DNA, 462 bp, Triticum aestivum
  unsure (1)..(462): unsure at all n locations
  Clone ID: PAT_TA_88550
tagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaacttctactggtacatggacaactgtttgggactgatggacttaccatcttgatcgttacaaaggacgatgctatcacatccgacctgttgctgggaaagacaaccaatggttcggtaagtacttatccattaaacctatttgaagaaggtcccttactaacatgtttactccattggangtaactattggttcaaaacctaagtgctcnactttggaggtntaagaattcccctacttatcaaaaatttccaaggccccccaaggganc

SEQ ID NO: 88551 - DNA, 479 bp, Triticum aestivum
  unsure (1)..(479): unsure at all n locations
  Clone ID: PAT_TA_88551
gcgtgggaaggtctcgatggcctcccggtgtcgtggcggctccacggtagctcgacggatctgttcacaacagcggccggcttctctggcgtcggctcgtctgcggtcaagccgtttcggccttcaccccatctcctcgtcgcccgggcgttactcccatcaatgggctggtcctcccccagctgcggtccactgcttgtctcgcgccccggtgctgcaggaccgagctcgtcccgtgcccgatgcagcaggaccgagctcgtctcgcgcatggtgcagcaggactgacctcgtccccctctcgggtgcagcaagaccgatntcgtctcgcgctcggggctgcaagatgggtcngtggatgcattttggccgatttattggnttcgacgctngggtcccccaaggaaggcgaaagtggaactttccgctcgtctcttccttggggtgcgacggnctcggtgagtggttccaagcttggn

SEQ ID NO: 88552 - DNA, 464 bp, Triticum aestivum
  unsure (1)..(464): unsure at all n locations
  Clone ID: PAT_TA_88552
aacaaacccagcaaaatcccatctctcaacccagtgaatctgcttcccctttcccttgtctgagatctcagcccgagcctgcacgccgcaacttccaccgaaatcctcccctcctagccgcagcgtcgccggattgattcaagaaggcattcttggtggccggagaagcagtctttgggtcctctgctcgagatcatcatcaaacatgtcgctgctatcgaattacggttgggcactgtggatgtgactgggtactctgcttgcttacaaaggacggttgggtgattactactgcatggctgctaaagntgccggaaagcaagcctggattatgatcgaagcatgaagttcaagttgcatacactggagatggaaggaataccangcttgggttngcggaaaatccaacgatngaatggtggagattncgtnaggtcattggttaaggtggtatgatacaagat

SEQ ID NO: 88553 - DNA, 472 bp, Triticum aestivum
  unsure (1)..(472): unsure at all n locations
  Clone ID: PAT_TA_88553
cgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcaagctgattgacataactgatgatggatatgtcagccttctaactgagagtggcaacacgaaggatgacctgancttcccactgatgatgttctgcttgggcaatnaaaacggntttgctgatggaaggctaaccggtcngtaantcnccaagggtgaaaanaatttgcctgttaanganccggtgggnaantaacactntcctngttncnactgcgaacttggaccaatgctcctgggtgtttgagatacacatacataggatcaaagatnctgttgg

SEQ ID NO: 88554 - DNA, 482 bp, Triticum aestivum
  unsure (1)..(482): unsure at all n locations
  Clone ID: PAT_TA_88554
ttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcaccctacgtacgtgtgttgggtgtgagagtatacgtgaaataacagcnctatctgatggatccaacaagggtgcgtttcctntccctgtggtttgcttgcccgcctcccatgctctgccaatggggccttgngtgtaagtgtgtgtcangtnccctgtattgctcaancnaccccaactatggatggagtgatganatgtaana

SEQ ID NO: 88555 - DNA, 467 bp, Triticum aestivum
  unsure (1)..(467): unsure at all n locations
  Clone ID: PAT_TA_88555
ggtgaccggtgctcgttggtgctggccgttcttcctcggccgcgggggcggcgaggcggcggcaggtggcggctgtggtgcgggcgtctcggcggcgcccgatccagatctgaaggcctccgtctacttcaaccaagggctgcctcgaatggtcctgctttgggcggcctttgtcgccggagttgtacctctttgggctgctggaggtgggaggttggctccgggagaaaccgaggccagcaatgctggcacgacggcggcgacgcccgagggcgccgtaccttcttgtaagntccgtccaagttcctccttcccctcctccttccaaccaactcgtaagcccgggcgaaacccaanccttgccgggancaagcgaaacggcctccggcgtcctcacctcttgggtgtccttccttggtgacttggggtggatgtnatctttggttgctnggcngcgttggtgnttt

SEQ ID NO: 88556 - DNA, 474 bp, Triticum aestivum
  unsure (1)..(474): unsure at all n locations
  Clone ID: PAT_TA_88556
gcattcggccagccgccgccgccgccgcgcgacctctgctcctccccggcttcgaactcaggccgccgctccgtcccccgtccccgtcgcacctcccctcgagccgccggctggccctctcccactcgtccttctccctgctcccattcctccctcgcgggaaccctagccgccgccctctcccactcgtcctcctccccgctccccttcctggcggcgcacccgaccgccgcgcgactctgctcctccccggcgtcgaactcaagccgccgctccgtcccccgtccccgtcgcaactcccctcgaaatgccggctggcgctctcccttcaacggaggattgggttaaaccgttaagagcggaggcgtggctngtgcaanacgctgttgcngtccttttcttcctcgccgtcttctccgctccctcctctggaccaaagtaatgccggcaacctcgtcaaacccgggtaanngg

SEQ ID NO: 88557 - DNA, 175 bp, Triticum aestivum
  Clone ID: PAT_TA_88557
acaatcacaatcaccagcaccagcaccatcgcgcggcccccgttgcgttggtgattaaccacacgaacgtaggtacgtaagcgcacgccaaatcggcggccactgagagagacggagccaatcgaaatggcaatggcgacgtacgatcggatcgatccatggagctgttggtccg

SEQ ID NO: 88558 - DNA, 465 bp, Triticum aestivum
  unsure (1)..(465): unsure at all n locations
  Clone ID: PAT_TA_88558
gaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttgggtggagcttttgcccccaagccatcatctgggtcctcacaaggccagggaagtgcctgcctctgatcctcatcctgaggaacagactgaaatatgctctcacctaccgtgaagtgcaatctatccttatgcagcgtcatatcatggntngatggaaaangccgcactgacaagacctaccctgctgggttcaaggacacatttccattcccaagacgggtgaagaactacaggttcctttatgacaccaaggnctcttccgccttaatccgtcaaggatgaggatgctaattcaaactctcaagncaagtcttcaattcng

SEQ ID NO: 88559 - DNA, 477 bp, Triticum aestivum
  unsure (1)..(477): unsure at all n locations
  Clone ID: PAT_TA_88559
ctcatcttctccccatccgcccccatctccattcctcctcccctccacggcggctctccattggtaatggcgatggcggcgtcgtggtgggcgctgctgatggcggtggtggntgcggcggcggcggggtgcggcgaggcggcgcngacggcggcggccgangcggcgcacgacntgctgcagtcccacggcctcccgcgcgggntgctccccgccgggatcncggcgttcacgcacgaccccgccancggtcggttcnaggcggtcctggagtccccctgcacggggcgcaccgangttggnctgcggtacaacntgacngtcgccgggcagatnacgtnnggccggatcncggagctctcgggtgtcgacgtgcaggacctcntcntctggttcgccgtgctagcatccgcgttgacntgccctcctccggcgtnatctacttcaactccngggcgtctacaacactncctctng

SEQ ID NO: 88560 - DNA, 468 bp, Triticum aestivum
  unsure (1)..(468): unsure at all n locations
  Clone ID: PAT_TA_88560
cttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcnacngaacggggaanggcgtcctccgattaagcaaggagtgctgctccggcgtgcaagggctgaacgggctggccgcagcaacccggacgcaaagatacgtgcaagtcctcaagagctcgccaacaacaacaaatccaacaacatgggcaagnctcccgggttgcccgnaagtnccgctcagcgttcccttcccatcaanaatntcaacaaactgcaacaattccactaattaaatatataacctcccaactggnanna

SEQ ID NO: 88561 - DNA, 181 bp, Triticum aestivum
  unsure (1)..(181): unsure at all n locations
  Clone ID: PAT_TA_88561
gattctcttctcgccggcgggatcgatccgatcgaggttgattgggtgagagcgaatggngcggtgatcggcccggtcggtcnggcggctcgatngcggcnaagccnggacnaggcngccgngtgcgcttcancttaggcggncacgcgtttgaaaccaccancaccangctcgcnaacgc

SEQ ID NO: 88562 - DNA, 473 bp, Triticum aestivum
  unsure (1)..(473): unsure at all n locations
  Clone ID: PAT_TA_88562
gttgtgtgctgctgagctatgtgccccttttccaaacatggcgcccgggtctccgatccgtgtcgccgcaggccgagttgtcatggatgataatgaagctacagtacccctaatctgaatttgcacattgatcttcgcttcttcagtgcgtcctataaaaaaggtacccagcaagaggacagctatggtgatcaatgatgtatagttctacatatgatgaagtgaaattcatttgcaagttggagtgtactgttctttgccacaggcctccgcaacacatagcgtcttcctcttcccttccaattcacctcctcctgttggtgaaattacaacaaactgggagttgttgctttcatgctgatgaggggtgcaaaactaacttaaaggagtgtcnttgtctccgcaaanggattttgcttggtgcgtcactcctatccggagatcaantctgtttgcccngtaggttttacttn

SEQ ID NO: 88563 - DNA, 443 bp, Triticum aestivum
  unsure (1)..(443): unsure at all n locations
  Clone ID: PAT_TA_88563
cgaatgcgattgatgtccaccaagaggctttgcatctgacgcttcagccagaagtgatgcttatcttgtttctgatgcagggcaacgagaagttctcgatcatttagaacacgagagcgcttccgaggcctttgagcaatagtgctctcaatggcttcagtttgagcacggttaggtaagcgtgtattgccaaccaaaggataaacacgagtgactgcctggacccttcaatgggttgccttaagctttggtgatnaacaattgtgaagacaaaccggtccctnggcaagtcctgggtanatggttcaaactgacatacaactctggcaaaaaatnaanatngttccancaaaaggctataatttacactnatgtactggattangccaagaccaagganananatttangcaaagaattaaanctgatcaacagttctttta

SEQ ID NO: 88564 - DNA, 345 bp, Triticum aestivum
  unsure (1)..(345): unsure at all n locations
  Clone ID: PAT_TA_88564
caggttccgggctccagctcanccgccacaccgncgcatctccaccgcttccccccctaaacccccgccgccgaccatggcgtcctcctccgtctaaaccctactgctgctcctccctaaaccccgccccttccaacgccatcgccaggcgcgctgccctctccgccctccccgccncnaagccccgcngcttctcccatggcctcgccaccntcnccgcnaaccctanggnctcccgcnccgccgtcctccnccccgtccgcgcntgcctggnggtgccncggcggacggagtacgtcccggancgaatcgacnacccaactacgttcgcatcttcgacaacac

SEQ ID NO: 88565 - DNA, 472 bp, Triticum aestivum
  unsure (1)..(472): unsure at all n locations
  Clone ID: PAT_TA_88565
ggcgtattaactagaagctcaataataagggatccatgaatcctgattgtttatatttatggagagttactttgtatgcaacttgatatactgctggcaccggacactttttctacatctgtatggtctagaattaattttgcttcttgttttcccattttaaatttgatattaccacttgcatctaaatcttcgggggctataaatatgattaagactccttgctagctcatagaaacaattcagcatctttccttggtgagaatacctggnttgggttcatatcttcctacaagtagcgatttctacttggttcctttccctggaatccgtcctgattacttccttttcctgccttgggtcctttcaagagaatggacgaccaagagatcgaaaagatatcctgataggaagcgtaaaacacaaagcaaacgggaantcttgcatcanactcaaacggntcctgcaaatt

SEQ ID NO: 88566 - DNA, 461 bp, Triticum aestivum
  unsure (1)..(461): unsure at all n locations
  Clone ID: PAT_TA_88566
cgtcgggtggtggccgctctgttcttccctcccgctctggttctcgcagtcacatgtcgtgtgacgcgggggggagttctgatccggatggtgcagcgctgtgttaacgcccacggccatgattgatcaccaacgcgcagaggaaatgcaagttaataacgaggcacctccagggtgtctcaagccaaatatttctcaatataaccctcaaagaacatagangtgggcattgaaggatttcctgagaataatgaaaaaaagaatgatagtattgcagcaagataaatatggggggnaactcctctcccaaatcaaggatttagcaaaccttttaccgcaagaattttagncctggcccaagttatccggattacaaaacctggggaagcanaaccttagggtttgcnaccattttntccanataatagganactgttccccattaanaaantaattcccct

SEQ ID NO: 88567 - DNA, 448 bp, Triticum aestivum
  unsure (1)..(448): unsure at all n locations
  Clone ID: PAT_TA_88567
tttcccaaccacttacttagctagctagcagccatggccgccctctcctctgcagcggtgtccgtcccttccttcgccgccaaggctgccacccccatgcgcagcagcaggatggtggtgcgcgcctccctgggcaagaaggcggcgagcgccgcgggtcgccgtggcggccagcgcgatgctnctgggcgggtcggcgatggcgcaagacgtgctcctgggcgccaacggcggcgtgctggtttccgagccaacgaattaagcgtcaantccggcgagacatcacttnaaagaaaaccccggttccgcaaagtggtgttcacnaagacncttgccttcgnggttgactctccaaatntccaagaagganactcaacncccagngaactntcaatangctaacntccccggactangtntaacggcaacccaagccgggcggatgtnn

SEQ ID NO: 88568 - DNA, 471 bp, Triticum aestivum
  unsure (1)..(471): unsure at all n locations
  Clone ID: PAT_TA_88568
cctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaattcgagaccctgtcctacctgccaccgctcagcacggaggcctcctcaagcaggtccgactaccttatccgctccaagtgggtgccttgcctccgantcagcaagttgggttancttcccgtngagcacaacgcacccctggggtactacgattgccggtactgggacatgttgaagctgcctatttcgggngcaccgacgcaccaagtttagnaagnttgaaggangtcaaagaaggntncctgaaccttattcccacaatcggatcnacaantcgcaagt

SEQ ID NO: 88569 - DNA, 220 bp, Triticum aestivum
  unsure (1)..(220): unsure at all n locations
  Clone ID: PAT_TA_88569
tctccttcctccctcgctcgacagcgccgcacccatccctccttgctgctcgtccggatagccgccggccgccgcatcccttctcccccttcctcctccttcctccttcccgctggtgccgacgagcgcgaccacgccctcctccggtccttcctcccccccgcagccaggagtcgagcctcgtcgcgaggaancacggaaggaggagtcaaccggcggc

SEQ ID NO: 88570 - DNA, 444 bp, Triticum aestivum
  unsure (1)..(444): unsure at all n locations
  Clone ID: PAT_TA_88570
ctcgagttttttttttttttttttgtgtgtgaagcagtttcggttctcataatacaagtgtgtattgacttgtattcaactattacaagtgtatggtatacaattttgatatagaaatatcacggatgcccagcctgtcatcaactgaatgatcaaaacttagttattttcttttcttaaatgtttggcagaccccctctcccgccagctgctattcaaatatgggaagatcaaaaggcttggtctttgacccgccttctgaacctcttggaagacgacgattgagatagcgcggagaaggctttgggatgggatccttgtccatgtccaaggaagaagcgatccatctacanccgattcatcctgggtgaaaagcggggcaaggatctccctttaccaaccgcaaaacacccatcttttgananactctcctnaaacctcggg

SEQ ID NO: 88571 - DNA, 434 bp, Triticum aestivum
  unsure (1)..(434): unsure at all n locations
  Clone ID: PAT_TA_88571
gcgatcaggagccggtggagggcggcgagaaaagggcgaggctgctgcttgacggcgacttcggcaacgtgtccgcgtttgggccggacgccgtcgacttcgcggggttctacaccgacgacgcgttcgccaatgcgccggtgccggtggaggcggccgccgggtccgggcggtggtggtgccggctgcacgtttgcgtttggagttggacagtgggtactgagtaagtgacgcccaacagaatttcccccgccgncttttncaactgcctggtttaatggccaattattgaatgcttagcccgcaattttgaccgtaattttcccanctgccnttnttcaagggataacaatttcaattccgttttccccgnncttttaaccaacattggttttaacgnccgtttttaaggnccncccctggnangtanggtn

SEQ ID NO: 88572 - DNA, 447 bp, Triticum aestivum
  unsure (1)..(447): unsure at all n locations
  Clone ID: PAT_TA_88572
cataaaagttgccaactcagagtcccactcagggtcttacgcaccatactgggtaggaagtccaccgtgcgcacttggtcgagccatgcctccatcttcatctcccccttcagtggaggagccaggatccgaggaaaggtatcagaagtcgaaaccagttacaactaaaaaatgtgtctaagcaccccagtgctggattttttctcaagagttggaacatctggctacctttttttatctactttcaatctaaaatttgtttcatctaaaaacctgctataataactagaatgttccaaaaactgagctacaatgttttgttttggagtcaaacagatagttcccccaaagtttctgcaaaggataaaaagaagagcaacacaatangcaatnaatttacctaaactaaatgggttnnaaattncanaatttcccccgcttttgttt

SEQ ID NO: 88573 - DNA, 448 bp, Triticum aestivum
  unsure (1)..(448): unsure at all n locations
  Clone ID: PAT_TA_88573
agtgcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcangtgtggcccatttagggcatcaagaattccgagaccctgtcctactttgccaccgctcagcacggaggcctccatccaagcagtccactactngatncgctccaagtgggtgccttgcctccgantcaacaagttggttcacttcccgttgacacaaccacccctgggtactaatatggcggactggaatgtggaactgcctatttcggtgcaccgacccaacaagtataccnaggttgnaggagtcaagaaggatacc

SEQ ID NO: 88574 - DNA, 470 bp, Triticum aestivum
  unsure (1)..(470): unsure at all n locations
  Clone ID: PAT_TA_88574
cagcagcgagcaatggcgtccacctcctgcttcctccaccagtccaccgcgcgcctggccgcctcggcgcgccctgcgcccgccgtcgggcgcacccagcttttcgtctgcaaggcgcagaagaatgacgaaggctgcatctgacgctgccgtccgtcaccagccggcgcgccgcgctgtccctcctcgccggtgccgccgccatcgccgtcaagtctcccccgccgccgccgcctacggagaagcagcaacgtgtttcngcaaggcgaaagaaagaacacggatttcntggcgttacacgcgaagggtttcaaactgatgattcccnggcaaagttngaaccccaacaaggacgtgattcccttgggcaagtgtccgctacnaagacactntnaagcaacaaacactttccgtttttatcaacccactacaagaagacatcacgatacgntccctgangatcctctcca

SEQ ID NO: 88575 - DNA, 483 bp, Triticum aestivum
  unsure (1)..(483): unsure at all n locations
  Clone ID: PAT_TA_88575
cggnngcctccggtatcttccactatggcctctcngtncggtgtgtgctttggtnangggttgacaacttactgaaccgtaccccgtntgcnacagggacaagtggtggtaccaacatntagggaagctactgactaagactcaacctangactgactcaggtggtccaagtatcctccaacaatattaccatcantgggataaatcaccactcctcaagcctcaccatgccataccggacatactcgtctcgacnagggantagggacaagcacatntctacccaagacaatgactttcccggcttccttcnaagtatgcatgaggagcttacgangatgatccaatctactagtgcatcatttctgatcacanaacaacccaaagtgtactcatgtactanacttacttncatnacagncancgcatatccantcaaatggngttgtttcctttcanaacancacancnaatattatcnng

SEQ ID NO: 88576 - DNA, 300 bp, Triticum aestivum
  unsure (1)..(300): unsure at all n locations
  Clone ID: PAT_TA_88576
ggaagactctcctaagcgtttgcaagatccatcgggatgttgaggtggctgaacttgctgccggcaatgttctactactggatcctgaggattcttcagtttatattcttctgtcaaatgtatatgcagaatcagggaaatgggctgatgtttctaaggacaagaaggttaatgaagcacggaaaggcttaagaaggaacctggctgtagctggttgaggtgcaaaatgagatgcatggattccttggtaggagataactccatcccgagattcnaaggagctgttatgacatgctgcat

SEQ ID NO: 88577 - DNA, 168 bp, Triticum aestivum
  unsure (1)..(168): unsure at all n locations
  Clone ID: PAT_TA_88577
agcgcaagcgcaagtggtgaaatccatttcccaacacagcacacacagttagagagagcgaacganggaacgancggcctaacgcacacgtntncaaccggcgggcatgggcggnaacgcngcggctgggaaaancgtngacngcgggggcaaggcggcgcaaaaggt

SEQ ID NO: 88578 - DNA, 446 bp, Triticum aestivum
  unsure (1)..(446): unsure at all n locations
  Clone ID: PAT_TA_88578
cctacctaagctaagctaaacagcagcgcgcgagcaatggcgtcaacctcctgcttcctccaccagtccaccgcgcgcctggccgcctcggcacgccctgcgcccgccgtcgggcgcacccagctgttcgtctgcaaggcgcagaanagcgacaaggctgcatctgacgctgccgtcgtcacaagccggcgcgccgcgctgtccctcctcgccggtgcggccgctttcnccgtnaaggtctcccccgccgntgccgcntacggaaaaacancnaagtnttcggnaaggcnaaaaaaaacacggttttggggcgtaaagcgcaangggttnaaactgatttccggaanttggancccaanaaggactnanttcctgggaaagttcccnctacaagaaaanttcaacccacaanaactccccttataacaacccncaacnngaaaaca

SEQ ID NO: 88579 - DNA, 334 bp, Triticum aestivum
  unsure (1)..(334): unsure at all n locations
  Clone ID: PAT_TA_88579
angntaagccctccatcgtttctctccacagaacggattcaatgtctggaaatccagcagccacggtcccggcgggatcgctcgccgaggccccggcgcccgtgcccgtgcctgccgtcgccggcgagcgcggcctgtccgtgtcgcaagccatgtccaaagtcatgganaaagggcaagacggcttatcccgtatataacgccggngaacccggactgtngacaanngcggggggctaagnnctcnaaaccttgngngcggatttttcaacctaggaaggccttctnggaggcnnaaccaangggggttataaaggacncccnnaaaanaaac

SEQ ID NO: 88580 - DNA, 496 bp, Triticum aestivum
  unsure (1)..(496): unsure at all n locations
  Clone ID: PAT_TA_88580
ctccgctccttctccttccttcnagtttcagccatgggtaaggagaagactcacatcaacatcgtggtcattggccatgtcgactctggcaagtcgaccaccactggccatctgatctacaagcttggaggtattgacaagcgtgtgatcganaggttcnagaaggaagccgctgagatgaacaagaggtctttcaagtacgcctgggtgcttgacaagctgaangccgagcgtgagaggggtatcaccattgatattgccctgtggaagttcgagaccaccaagtactactgcaccgtcattgatgcccctgggtcaacgtgacttcatcaagaacatgattactggtactccaagctgactgtgctgtgctcacattgactccacactggtggtttnaggtggtatcncaaggatggcaaanccttaanaagcctccttgcttnaanctggngtgaacaaatatntgcgctgaacaaatggtgcacancccaan

SEQ ID NO: 88581 - DNA, 463 bp, Triticum aestivum
  unsure (1)..(463): unsure at all n locations
  Clone ID: PAT_TA_88581
tatcacagcactttgaagttgggaacacacacacagatatgtggccgccggcgacgtggacgcacgtgccgacttgatttggttccaagttacaagcgggacggcatgacgccgaatttgtcggcctcggtgacgacgtggttgcgggtgatgtcggccagcgagttgcagccgctgagcgccatggtcagctcgaactcgtcgcgcagcatcttgagcacgttgctcaccccggcctccccgggcaacgccagcgagaacaacaacggccttccgatnaagacncggcggcgccnagagcgagcgccttgaagactccgtnccgccgngcaaacgccntcaaggaagacgggatntgcccgccaagaaccttcaagactcttcaaggcgctatgtccccggactaatcaactgccggcgcttgttggcacatatccggcgccctttcangggaactgttctc

SEQ ID NO: 88582 - DNA, 342 bp, Triticum aestivum
  unsure (1)..(342): unsure at all n locations
  Clone ID: PAT_TA_88582
gttgtcatgaagctgtggcgccctaactttaaagctcctcctggtcactcttggaggtcaagggntgcaaagttctaanccaagggaanttccgttggagttttcccaaccgtacaaaaattcaacaaagttnancanaacaaggtgcctgggnaatgcaattntttgggggccnntgctcccggnaaaattttccaaggttcnanccancaanttgnaaaantccaggnaaaancttttngggagggngaattaaantttcccaatnnaaagtgggnanaatncccccccaanaaaaagngggggggnactccttttttncccanaananttgggggtctt

SEQ ID NO: 88583 - DNA, 189 bp, Triticum aestivum
  unsure (1)..(189): unsure at all n locations
  Clone ID: PAT_TA_88583
gacgagccgggcgctggcgctccggccccgccgccgcatcgggggcctccggtggctngcccggggaaaggaangccaggcgatcgaggcgggcggtctcacggcgggcgggcgcgatggtcctcgtgctgggcgcgctcgcgctcgcggcctactacagcttctactcggacgtggccgtgatctgaa

SEQ ID NO: 88584 - DNA, 466 bp, Triticum aestivum
  unsure (1)..(466): unsure at all n locations
  Clone ID: PAT_TA_88584
cgaatgggcctggtaaatgctcatgtcttgagctgtatcgaaccctttttgggataactctggacttttttgcttagttgttatgatggcgtgcttgcaggtctctctgaaaatgaagagccggcatgttgcagggacaatcaccaagaagaagaaaggtgagtggcaggccatcatagcaacaacggtaacatcatctcattatccatccatggctctgaggtctgatncatcatccatgtcgctgcangcgtggtgatagacgtgtgcaaggacgtggcggcgtggcccgggcggcactgctggaggacggcnacaacggcgctacttccggcttaagacggcggacaacgggtgatcaattcnagtgcacaaccaaaaggaatacaactgtgacaagggcttgngcgcctctcaacatcgcancaacggaactccccgtaatgacgtntatnaaaaanactgc

SEQ ID NO: 88585 - DNA, 234 bp, Triticum aestivum
  unsure (1)..(234): unsure at all n locations
  Clone ID: PAT_TA_88585
gacttgagcaccggtgaagacctccgtgtgaccccggaggcattcgatgcagtgactccagcagccatcgatgagagcagagtggctgtggcaaccatccgccagaagtctgtgttnactgacgtccgtactgaancgcaataccgtcanatcgaaattttgganatnattttcccnnggncccatttaaaaancccggggtannaagccccaaaggggnnaaaaaaaaacccc

SEQ ID NO: 88586 - DNA, 350 bp, Triticum aestivum
  unsure (1)..(350): unsure at all n locations
  Clone ID: PAT_TA_88586
gtgagaacagcgaagcgcgacaggaaaggcactgaactagtttgcaacaaagaagagagaaaatgtctaccgctgaggcaacccgttgaggagaatgtttacattggcaagctcccccancaaggttancctttttaaggaaaatgnccaatttcanganaaaggtggcaaaaacggctaatttaggttaanctcactgtttaaggaccgaaacctgctctctgtggcttanaaaaantgtaattggtccccgggggcttcntggangatcanccctatanagggggggggnaaccccntnaaaaaaagcnttttcnccaatnaagggngncttcaanatttnaccactc

SEQ ID NO: 88587 - DNA, 484 bp, Triticum aestivum
  unsure (1)..(484): unsure at all n locations
  Clone ID: PAT_TA_88587
ncgcatcgattagaaacgattacgaaaactctcgggtcctctnaacttctctgaactctgaantctaaacaacaacagganatggcnactctnccccgccgccgccccgcttttgcttaaccggnggnaacgggttaaaaggtccttggttcgtcaancttgctcttctcccgcngntaancccttcaagccaaacgttcggcnaaccaaggtgattccgaaaaaaccgtttccttaacgcaacttggacggacccccggcgaaacctccggtgtttaaagggggcaatgcttcaacaacaaaacggtggcnggccccntttcccggttccaaggnctttttcaaatttccaattccagtttcccnacaaaaaanaggttattccaaaaaaagatatttggaactgctttanggggcacatantgtncnaaggtttgcanntctttcattntaaaancncacgggntccctaaatcncacaant

SEQ ID NO: 88588 - DNA, 220 bp, Triticum aestivum
  unsure (1)..(220): unsure at all n locations
  Clone ID: PAT_TA_88588
tctgcatccatcacaacatgaanattacactttctgncaangacctaatggcttgcngtnggtttatgtgtggcnanggttgtgatggaggatatcctatcaccncatggcaatacttcgtcnacaaanggtgttgttactgacaantgcnatccatactttgatcacagttngntgcaagcatcctgaatttcaaccngccaaacctacacctgtgtgt

SEQ ID NO: 88589 - DNA, 381 bp, Triticum aestivum
  unsure (1)..(381): unsure at all n locations
  Clone ID: PAT_TA_88589
tttttttttnanttcgnttcntttttatttaaaccttctcttcttnanctttagttttanctacttancaanagtatcaaccggctcgaactcgaanttgatcgccttccatacttcanaatgtggnggatantncaggacnccatttgcaaactgctcggataattncattaccttcgcgagcaagatcncgcccttcgtnacgagcttgtacacangnttccaaggccacnctnttaacctgntgcaccaggtgnatttccccaagggatgtcaaaaagttccnccaccaanntgtnatacagaancccccnaaagnttcgggaaaaagctggaatatgcnaaacangantaccacctggggccaccggtanaacacct

SEQ ID NO: 88590 - DNA, 508 bp, Triticum aestivum
  unsure (1)..(508): unsure at all n locations
  Clone ID: PAT_TA_88590
cccgtgtccagaatctaccccccggctccaatggcggcgaaggaaccgatgcgcgtgctcgtcaccggcgccgcaggacaaatcggatatgctcttgttcccatgattgccaggggagttatgcttgggtgcaaaccagcctgttattctgcatatgctggatattgaattttgctgctgaagctcttaaaggcgtcaaatggagttttattcaatgccgcatttccactttccaanggaatttntttgcaacaactgatgttnttttangcttgcactggggttaaagnttccggttanggttgggggggttccccaagaaaggaaggatggaaggaaggtntttttnncaaaaatgtttaannctnaaaagtcaaacanctggnctntaacccangannccccaattncaaggtttggttntttcaaaccnnaaaaaacnaattcncaaccnnaaaggnttngcccacaanccncgnaaaaaaanantttttnccccccnaaanaa

SEQ ID NO: 88591 - DNA, 493 bp, Triticum aestivum
  unsure (1)..(493): unsure at all n locations
  Clone ID: PAT_TA_88591
gcgagcccgggtgcacggtggctctcacagacttccaccactgcgtcgacgcttcagcgagtcctgcgaccgagccgacggcctcgtccaggttggccgccgccggcctcggccccgccgcctcccgccacaacgagatgttccgcgcgctcatggacctccaccgctgcctcgacgccttcaagcgattccccgcgactgagccaagggcctcgtcaaagccggccgccacggccgcgccgcctcccgtnaacgacaagctgttccgtgccgtgcccgtggtccanaaagatttccnggccgccgctgccggctggaaaaaaaatcgcctccggacaagcaactggaanccaaggacaataccaatcaatctacccgtctccnatcangtatgttaacatctgttttcaangtaatgttnatcgtccnctaatttcccggttganggcaaacaagttancaangttaatnaaatttacggaaaggaaaatgn

SEQ ID NO: 88592 - DNA, 239 bp, Triticum aestivum
  unsure (1)..(239): unsure at all n locations
  Clone ID: PAT_TA_88592
agccggtgcactcgccgccgcttccagccgcccccctaaccctcggnaaagccaataancagttnatntccaagtttccnggagaaaaatgggatccaaagtttcccggttcaanccggaaacaannggagcttnccaacctggctttacccggggattccttggnttcccgttnnccccgngaattcccactttttaaggggccattttcaaaacccagcatctgcngtntccggggg

SEQ ID NO: 88593 - DNA, 487 bp, Triticum aestivum
  unsure (1)..(487): unsure at all n locations
  Clone ID: PAT_TA_88593
ccaccatctaaactcctcctcttagtctgatttttggtgatcaaaatcaccttagtgtgtgatcatcgctagacaaactagttaccacgttacctagctggtttaaccacagcaagttacaaacaccttcttactgatttacttttggagctaagtgcaaatctcttctttgcccctggactgatttatttcttcagttggactaaggacaccaaggtacatctactggacatggtcggccatgccaaagagcgccgcttgcgccagtgcgcgtggtgatcacgcttgcgtcatggctgaacgcgtgctctggcttgttccggncactgttctcgtctcctccctcctcgtctcgacctccattcngtgtccaanagctcgcccgtgctcgacgcattgcctgcatccgctgctncgtcgtgggtcgcatcaaangcaacnctaagagcagtccccgtccaagcccagccncgacccaataaagatg

SEQ ID NO: 88594 - DNA, 495 bp, Triticum aestivum
  Clone ID: PAT_TA_88594
ccttgaggttgagtcgtcggacaccatcgacaatgtgaaggcgaagatctaggacaaggaggacatctccctggaccagcagcgcctcatctttgccggcaagcagctcgaggatggctgtacatttgctgactacaacatccagaaggagtccacccttcacctggtgctccgccttcgtggtggtatgcagatcttcgtcaagaccctgacgggcaagaccatcacactggaggtggagtcctcggacaccatcgacaacgtgaaggcaaagatccaggacaaggagggcatccccccggaccagcagcgcctcatctttgctggcaagcagcttgaggatggtcgcactcttgctgactacaacatccagaaggagtcaaccttcaactggtgctccgccttcgtggtggtatgcaaatctctcaagacctgacagcaagacatcatgttggagtggagtcctggacacatcgacaacgtgaagcaagatca

SEQ ID NO: 88595 - DNA, 492 bp, Triticum aestivum
  unsure (1)..(492): unsure at all n locations
  Clone ID: PAT_TA_88595
atggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaagttcgagaccctgtcttacttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactggacaatgtggaagctgcctatgttcgggtgcaccgacgccacacaggtgctcaacgangtggangagtcaanaaggagtacctgaccctatgtccgcgtcatcggttcacaacctgcgcangtgcagtgcgtcactcatcgcctnaggcacggg

SEQ ID NO: 88596 - DNA, 464 bp, Triticum aestivum
  unsure (1)..(464): unsure at all n locations
  Clone ID: PAT_TA_88596
gaaagagtcagtcttgaaaactgttaatctagcaaacggtgaggcctatattggtcccttctcctttacagagtgctcccagaggaaaaggttaagattgacagcacgagtgaaaaggcaggatcttagtatcagagttcaggaagcaatcagtgatccttttgttgtcaaagtcggccgaagtaaacaaaacagaaagagttatcctccatctaaagaagaagctgtataccgtttggagaagatttccctaaagggaaaacattgtactctccttgctgaaaaaatattactacggtgaancaattcagcgtcattattacagagatgaatcctggtctcaaaagnttcntgacatganggaagattgnagtaccttgattaacatgcaacactcnatcctggctgaaatcaatcnttggtgttaggaaatactgaacctatcaacgattcnaaactgtggg

SEQ ID NO: 88597 - DNA, 172 bp, Triticum aestivum
  unsure (1)..(172): unsure at all n locations
  Clone ID: PAT_TA_88597
cgaaatccttctcccggaattttcttttgccgtggcccgcgggcatcgcctcatttgcggattcctcccatccgccaccctcctctcccctccctccaatagccaagcaagaacccggacacaagcaaaggntttganangacgactacaaccantangaggacacagngaa

SEQ ID NO: 88598 - DNA, 478 bp, Triticum aestivum
  unsure (1)..(478): unsure at all n locations
  Clone ID: PAT_TA_88598
acagcagagcgattcctttcggatttttctctgataaatggcaaatattattacattaccagaagttcaagagagaaatgaaaaatatcttcaaaacaattaactttgtttaaacacacaaggcatactgcggatatgcagtgccttcagctcattcagtttgttcactctagaaaacttcatctgctttaaatttcgccatcccaaaggtcctccaaggttttgtaaacgcttagagggtgaaccgcaaattcccctttcatcaaccttgcctgcatttttcaagtcaaaccagatatcagatgtgaataatgagagtgtaaggactggagctatccaatgatatattgccgagaaaagaatggtcttgatctttgaagtantgtcgatttcaagttatgttagataacagaagaacaagcgttaagactcagacatgcctgtttgatttcngagaacttgcaataaatctcaggag

SEQ ID NO: 88599 - DNA, 190 bp, Triticum aestivum
  unsure (1)..(190): unsure at all n locations
  Clone ID: PAT_TA_88599
ggaagcagaggaggggcggagcgccgccggccacatcaacatttcggcgaccacgggaggggcggcgcgaccacaccaaagatttcggcaacnacggaaggggcgggcgtctcaactgccttaattctaaccatacnggcgggccggnaactcaagcaatccaanggcccctggagcangaaaacggngg

SEQ ID NO: 88600 - DNA, 486 bp, Triticum aestivum
  unsure (1)..(486): unsure at all n locations
  Clone ID: PAT_TA_88600
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtngaaggatcaggtgcatgcaggtgtggcccatcnagggcatcaagaatttcgagaccctntcttacctgccancgcttaacaaggangcctcctcaagcaagtngacactttatccgctcaagtgggtnccttgccttaagttaacaaggtccggttcanctcccgtttananaatgctctcccggggtactaacaacggcgctactggacaatttggaactgcctattttngggtgaaccnacccacaaagttatnacaggttgaggaggcnagaagataccttaccgtattccnaanaccgatcnacaaatcgccngtgatgcgtcgctcattc

SEQ ID NO: 88601 - DNA, 176 bp, Triticum aestivum
  unsure (1)..(176): unsure at all n locations
  Clone ID: PAT_TA_88601
cttgtaattttgagttataagtaaataaaagtgcgatgatcatcattattagagcattgtcccatgtgaggaaaggatgatggagactatgattccctcgcaagtagggatgagagtccgaacgaaaagaaaaaaagaaaggccaaaaagagcccaacaaaaaaagaaaaatntgg

SEQ ID NO: 88602 - DNA, 463 bp, Triticum aestivum
  unsure (1)..(463): unsure at all n locations
  Clone ID: PAT_TA_88602
caagatcctagttgtctacatctgtctacaccgagagcttgtttctgtatcaatcaacatcttagctgtctacatctatcaacactgagggcttgtttctgtatcaacatcttactgatacatcagttaaagatggaaattattttttgctttgattttttgaatcaaaatcttagttgtttacaccatgagcttggnttcctttcantgggagggatggtgttagcgaaggccgattttgccaggccttatcaaatggatgcaaagtagcttaatngaagcggcaaatccacttcacntnanaagagttnagccgggttccgatgggcntgcataaattanatttggaagttngtttattggaagttgaataccggtccnccttgagacacccaaggccanaacttnaaaaaggcngncataaaaatatccacccncaaggaaaacccggncnacttagatt

SEQ ID NO: 88603 - DNA, 264 bp, Triticum aestivum
  unsure (1)..(264): unsure at all n locations
  Clone ID: PAT_TA_88603
gttggcttctcctccccttccggttcgggttctggttcggttcgggtccgagagtagctagcctagtctagggtttccgtagttcgganaggagagaaagggagagatccatggcggagacagagtaccgctgcttcgtgggcggcctcncctgggccaccgacgaccacaanctccagcaggccttcagccattacggcgagatcctcgacgccaagatcatcaangaccgcganacgggcaggtcccgtggcttccgcttcg

SEQ ID NO: 88604 - DNA, 480 bp, Triticum aestivum
  unsure (1)..(480): unsure at all n locations
  Clone ID: PAT_TA_88604
gttgtctactccggctttcaccgtacattctgattcctgggccaaaaagtcctagagggctgcttttccagaggaaaatttgaagccctatggtaaatgcgaanaaaaaaggggggaanccaagcttacntgngacggtcgctgctaanagagaaggaggcgatggattgatcaagtcccacggtttanggcaaggagagcctatgcgggagatgtangccgacactatngctgttccgcttagcacaactnctccgtttaagatttgaagaagcaatcattcctccggtttctcttcattcaatggaagttatgtncccatccttccgcttcctcggtncaagtaatttaanacnggtngtggtcaattaatttgggcaattttggaggcnggnatccnatttctaactccnaaatcctaaactaanatttccgatgccctganaaattnttttggncctatgaaaaggngggananag

SEQ ID NO: 88605 - DNA, 290 bp, Triticum aestivum
  unsure (1)..(290): unsure at all n locations
  Clone ID: PAT_TA_88605
gctaggtccgtgcctcggccggcgagaggttgcctggcgaggtctccgcgtgcctctttcctcccgcctctgctcccctttctgctctacgtcctcgggtcccgggcctcgagcgggtctcaagccttcgctggtttgccggggcgcgatgccgtgggcacagccagagggtgagggctggacagccggtaggagcctgagtcgcgatgctcaggtacccccccctttaaagcgcaagcttgggttagatntcggcgctctactcctcgggtccactccnaagggggggg

SEQ ID NO: 88606 - DNA, 305 bp, Triticum aestivum
  unsure (1)..(305): unsure at all n locations
  Clone ID: PAT_TA_88606
ctctcgtcgcgtcctgtggtatggcgccgcagcgncctcgggcgctcctccgactaccccgcccctcctcgtaaccaccgtccgtgccgatccaaaccccgnggaccaccacggncgccacggcaagcctaaaagancaagcctctctcctccacccggacagccatggnggccgcacttcncgccgacgcgcactcgcatcncccgcnggcatcctggagacggaggcctctcctcncggtaccttcgagccgntctccgctgactcatgttctancntaagctccantnggaatctcancaga

SEQ ID NO: 88607 - DNA, 509 bp, Triticum aestivum
  unsure (1)..(509): unsure at all n locations
  Clone ID: PAT_TA_88607
aatcagcaactgaccctgtaataccttacctagctagctaggtgtagtttgcttgagccaagatgttgggggtgttcagcggcgaggtggtggaggtgccggcggagctggtggcggccgggagccggacgccgtcgcccaagacgcgggcgtcggagctggtgaagcgcttcctcgccggcgccgagcccgccgtgtccttgnagctgggatcgctgggcaacctcgcctactcccacgccaaacantcctcctcctcccaaaggctttcgcttcaaaaggatgaatnttctgcctnttccaaggaatccctggacaacttggggcggntgaacaagcaatacggctctcccaagggcggaacgaagtgtcccnnnattcaaggctanaaangcttaagganaaggccccctaccccgccagntcaagctctccaactaaccggaantacccttcgtgctcttcganaatcaactctccctctcgtccaaccaaccggaggnaagntg

SEQ ID NO: 88608 - DNA, 490 bp, Triticum aestivum
  unsure (1)..(490): unsure at all n locations
  Clone ID: PAT_TA_88608
gtctcgagtttttttttttttttttaagtccaaccattcgatcttcgtaaatgatctgggtccatagcgtccaatgacggcttcacgtttgattttcacgatcccaaccacaaccccaatggttggaccatcccgtgagggatcagaaacacacatgcatcacgcatcattaagaagaaaaaaacatgcaggttgggccatcgcacgcatacaggatggaccatgccatcagcgatgaggccatcccaaaaaaaggtctaatgtgcctaacgaaatcgaaaatatcatatctctccaaacagaatatgtgtccacatggaatccaatttttttccatcgtgcaaacatgagaaacttaaccatccatataagaccttccccacgacctcatagttcgttgtcctccaagattttaggttacaacttctacatgatctcctcgcaatcatctcctcggngaccaaactcgagataactcaagaattactcc

SEQ ID NO: 88609 - DNA, 510 bp, Triticum aestivum
  unsure (1)..(510): unsure at all n locations
  Clone ID: PAT_TA_88609
aaggcgcggggtcaaacantangcatngganatatatgttggnctagaaannccaaacattccggacccccaaccgagcagagccccagtctggttanttcgcatacctgnacaatccaaccccccaaccctgactatccagtcatacctagatgcaccaaaatgggctaaggcccatgcataccgttttgacccaaaactagtagttatgacctagtggctataaataccccattctcctctccatctcggacaaacaaatgtgattagacattggagccttgtgcctcttttccaagatctccccatgtggagatntcaatnacaaagactnccagtgtatatcatagattcaacttgttaacccttaacctggatttgattggattgatngactggncaagtggatntggtccaatttatgagttttttgtttgaaaaaaaaggggggccggtaccaantcgccctatatgagtcntantacgccgctcacgngctcntttanaagt

SEQ ID NO: 88610 - DNA, 481 bp, Triticum aestivum
  unsure (1)..(481): unsure at all n locations
  Clone ID: PAT_TA_88610
gacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgaggngttttgaatgaccaaggccgtgaaggtggttgacattgttgacaccttccgtcttcaggagcaacctgcttttgacaagaagcanttatctctcacatgaagcgctacatcaagaactctctgccaacttnaanggatgacctanatctttcaaagaaaatttgatccgccacaaatacttcttaacaactcaaggacttcattctttgttggcgaaagcatcatgatgatggcgcgttgtgttcccctactacaaggagggaactgctgatcaactttcctgtactttcacatggctgaaaaancaaatgctaacccac

SEQ ID NO: 88611 - DNA, 483 bp, Triticum aestivum
  unsure (1)..(483): unsure at all n locations
  Clone ID: PAT_TA_88611
cgcggctcgcctatcctcaccagctgcatcatccatctccagagtcaacagcacctaccccgcttcttcttccctatcctagctccccatagcacaagaacttcgagagatcccgaatcgaatcccaaacggttcgatggcaagcatccctgagttctactccctccctgacaccttctccggttccgaccaggagtacatatctattctcagaaaatatcgtgggtctgaggtcgaagccctagtccgccgagctctcatcaactatgaactcgctagtctgtggctcctcgcgcgccatggctatgaggtcatggatgtctggaagacggatcacgggacttggtcgcgaaaaaattggtctccatccctaacacctcccaaggtaattccccaactcacctaaattcgttgggacgaagacacattgganntnaaaccacggatggcagcaaggcgttgtggatgacacggncaactant

SEQ ID NO: 88612 - DNA, 160 bp, Triticum aestivum
  unsure (1)..(160): unsure at all n locations
  Clone ID: PAT_TA_88612
aggatgagatcgaggcgccctccacggcgtcggggacgancctgtccancatcccctccacggcgtcgctctcgtagcagatcgcctcnatctcatcctgcctctcctgnaggctaaaccccgcgccccaggncgcgaantcctcggcgtcctcgggatt

SEQ ID NO: 88613 - DNA, 452 bp, Triticum aestivum
  unsure (1)..(452): unsure at all n locations
  Clone ID: PAT_TA_88613
gtaggacggactatcagtacaccaagagcatcccttgcgacaaaagcggtgagaagtacaaacaatgtccacactgctcaaaacatccattcacgtggaaacttcaaaagagtagatacagcttctccaggtcacacaatccgaaatgctaaccgatttggttctagtgctccaatcagtaccctgtcccttatgaacaatgcattgccacatgtatcacagccagttcaagctataccaggaactaatactgctcatgtatctcagcaagttcaaccacaaggaaccaatcctttcagtggtactgtcaagaaaagtgcccctcagagatctctcagtgcgccaatagcatctcaggggcaacaaggtcagctggcacatcttctcangctgcctcanatgtantgcatggcgtaggactcaactttcccggtgcactcgcttatgaatga

SEQ ID NO: 88614 - DNA, 493 bp, Triticum aestivum
  Clone ID: PAT_TA_88614
aaattgagcgaaatctactttttcaggctttaaacccaatcattcatatttgttgcgaccaaatgttctgttataactttaaaattgaaaaccaagtttccctggacaattatacttttttgtgagcttattattcacaagttatagtaatatggtattatgggctttgctcctaacatgataaggaggaaagaactgcaggctatattgtttgttgacattcatgatccgcgctcgcaggttccgacttttgtgagctactgctgcagatgatatttggtccccatcctttctactggctcctaatttttgtgtgatgaacaaatggtttagatttaccgtgtaaagctgagatctacattggtccgggaatttaactggttacctttgtttaatttaatgccatgcgaaacctaatgtagatttcatgtcctcccaatgatgttagtaagaagattttttttgcttcctcaaagtgtaaactgttgtcaag

SEQ ID NO: 88615 - DNA, 264 bp, Triticum aestivum
  unsure (1)..(264): unsure at all n locations
  Clone ID: PAT_TA_88615
ctttcttgcgaggganagagggnancgagcanccantgagntaggcgtcaatggcgaccatagccacnatgaccatgctnaagcccgccaagatcacggncaggtcggtgccttcgtcgtcaccgtcgtccaacagcaaggtggtngtccccnttgcatctcnctgctcagccngcanaagancgcggacaagaagggggtcctgnccgtgtngccngcggacgcngtcatgttgaacnccttcttcanctcgctggactcgtc

SEQ ID NO: 88616 - DNA, 494 bp, Triticum aestivum
  unsure (1)..(494): unsure at all n locations
  Clone ID: PAT_TA_88616
cggcctcgcctcctacgcgctccagtacggcatcctcctcccctcctccgcgctcgccgccaccctcccctaccccgcggtgttcttgatctgcctggcagcagggtgcagcatctgctggttcaacacggtctgcttcgtggtctgcatacgcagcttctccgcagccaaccgccccctggccctctccctctccataagcttcaacgggctcagcgctgccttctacaccctcttcgccaacgctctctccccttactcaccatccgtctacctcctcctcaatgccatcctccccctcgccgcctccatcattgcgctcccagcgattctcctctgccacccacatgatcacagcagcctccgcactgtgccaaagcatgacaggcgtgtcttcctctgcttctacacatcgcaattgtcancggcatatatttagtgaccttcggtctgtcacacaaccaagtctgctgcaagggcatcctcatgggcgn

SEQ ID NO: 88617 - DNA, 433 bp, Triticum aestivum
  unsure (1)..(433): unsure at all n locations
  Clone ID: PAT_TA_88617
cggcgccgacgactccgtcggactcgcatgacgatgccggcatcatccggtggctggacgcgcacccgccgcgctcggtcctgtacatatccttcggctcgcagaacagcatcaacgccgatcagatgacggagctggcactgggcctggaggccagcgggcggccgttcctttgggtcctccggccaccgctggggctcgacgcgaaggacggattcaggccggagtggctcccggcaggcttcgaggagcgaacggccggggccaagaggggactgctggtgcgcggctgggcgcgccagatcggatcctggcgcaccgtccaccggcgcgttcatgaaccactgcgggtgggaatccatccctggaaaagctgtgccacggcgtnccggttatcggtgggcgctgggggcccagcattcttcaacgcgat

SEQ ID NO: 88618 - DNA, 432 bp, Triticum aestivum
  unsure (1)..(432): unsure at all n locations
  Clone ID: PAT_TA_88618
ctcgatcgatgccgtcgccgtcggtagtgcgcgtgctctcgacgcgcacggtcgccccgccgccgcgcccgcgggagcgcatcccgctcacctgctgggacgccgccatgctctccgccaactacatccagaagggcctcctcttccacaagcccgcctcctcggcggtgcacgtcgtcgaccacctcgccacggccctcggcgacgcgcttgtccactactaccccgtagccggccgcttcgccacggagcagcacagggacgagctcaccggcgccgtcgtgggctgctccgtccacgtcgactgcgaaggccaaggcgtgaggtcctgcacgcggcggccgacgggtgacatggcggacgtggccccgcccgacgccgactgccacgcgacctgctggngcattcttcccgctaacggacgcctcaacn

SEQ ID NO: 88619 - DNA, 426 bp, Triticum aestivum
  unsure (1)..(426): unsure at all n locations
  Clone ID: PAT_TA_88619
attggtaggagcccatctctgccttgctggccctggcctcctctcccccctcttgctcttcttttaatggcttctctgccccctcggtttcctgcccccgctcgctcccctgggtctgggtactagtactagtagcagtaggctggggttggcttgggtgtggcttcacaactcacaaggagaggaggagagaccactctgcctctgagctgttccttccacttccagcgagtgctcaatcaccgggagaaaagcaaagcagcaagcctgcggcgaggctgccggggaggggattttttcctttctgtcaagctccttgcttgcttgcttgattctcttctctttgatcctggagcgcggccgccggtccgtccagtccacccaaccctcgctgttcgtgcgcccgagctcgtgcccgcccgcgcn

SEQ ID NO: 88620 - DNA, 410 bp, Triticum aestivum
  unsure (1)..(410): unsure at all n locations
  Clone ID: PAT_TA_88620
gggacgtgcaggcccgcctcaagaagctcgccgacgccaccttctcccagtccctggaccgacggcagagctccgccggcgccaagagccgtgggtcgtcgtcgcggagacctcccggccccggctccgctgcctggcgcgccttcaggtcgccggtcatccacaacaaggacgacgtcgtcggcatccatgttcaggcgaaggggcgtcgacgacgggcagggccacgacgagtggctcaccaccgtcgccgcctcgccggacgtcatatccatggcttcgtgcccatcaactccctggctcaacggcgtccccggccgcggcttctcaacacgccgtcaatctctactcagatacaagcgccgatagaggagctggagcantcctggagttcaaagtgcccggnantg

SEQ ID NO: 88621 - DNA, 460 bp, Triticum aestivum
  unsure (1)..(460): unsure at all n locations
  Clone ID: PAT_TA_88621
aagttttatcggccatcgatacaacttatgcacaccaacgttcactttacctaaaacaagtaataaaactagttcacgagaatacaactagaagtactttgcaagataataaaagttaattggtttagtagagagcttttggagaacattgagaaagatttgtccctaggtgattgataactagaccggtaatcattagtgtagttttatatgagggacgggcgtaagctaacatactttctgtactaagaatcacatgaacttatgattttaactctatcaagcatccgcaaatactaaatatcataaggtaaaccaaaccatagcactaagtaacaagtcccttttaattccatatgcaacaacttgcgaacccgagttaagtttaagtcgctcaagcaaccctaacaataagaaaatcatgaacatatgcaataccttatagcagtaatccacangg

SEQ ID NO: 88622 - DNA, 492 bp, Triticum aestivum
  unsure (1)..(492): unsure at all n locations
  Clone ID: PAT_TA_88622
tccaagccttctcttcccacatgtcaattgaagcatgaatgctggataatgtaatgtatggtgaaggatcatctggtcttatttcaagaatcttctttgctgccagccttcccaactccacattaccatgagtcctacatgaagctagcaaagcttcccacacgagttggtccggatgacaaggcatagcatcaataaactcgagtgcatccgaaaatcttccagcgcgggcaaaaagatcaaccatgcatgtgtagtgctccatcttaggcttcacactgtacttggtgttcatcagtttgaaatactcacaaccctcaagcaactaggcccattccggctgcaagatgataacaacccgacaaaagtgtaatcatcctgggacaaacngcttcctcctggcatcaagtcaaatactgaatggctgccactcattccatgctgtgaaaaacttgtgattatgcatccacgagataagccctancctcattg

SEQ ID NO: 88623 - DNA, 460 bp, Triticum aestivum
  unsure (1)..(460): unsure at all n locations
  Clone ID: PAT_TA_88623
cagatttggtgtgggctacataggctgctggagcgagattacaatataaatagcaattcatattagcctgcgcatacatatgtgtgctctgctctgcttgctgtcaagtgtctgtggtgaccacctctctagatcactagctatctataaagatcttctcttcttctctctagtccacatgcataaatatatacatgatcgatcgccactgttcttcctctctgcacacagctacctacagccagtagtaaaaagttgaaaaggttgtgctcttgatttcaagttcacaggagagctagatgctagcaatgaacaaacatcgtcaggaggatcgtgtgtttccccggggttcaagttccaccaacagaggaggagctggtggggtactacctggctcngaangtggccgcccaaaagattgacttggacatcatccaagaagtggtntctaccggataaa

SEQ ID NO: 88624 - DNA, 276 bp, Triticum aestivum
  Clone ID: PAT_TA_88624
ttacgttgaggtcaccgcaatcaaagatgcattttcagcactgcagggttgagcaaaaactgcaaacatttaatattgctcagatgttgctgctgcaggatgacctaagactagtttcctttacttaatgctttaccttttctcgatagaaatcgtgttatgtcgtggatcgtcttccattttacaagtaaatctatgttcgtcgtgtatgtaagctgtggttcaacctatatcaaataaaaattcagcacatgaactttctttaaaaaaaaaaaa

SEQ ID NO: 88625 - DNA, 475 bp, Triticum aestivum
  unsure (1)..(475): unsure at all n locations
  Clone ID: PAT_TA_88625
tacctacatagtacagccatggcccccaccgtgatggcctcgtcggccacctccgtcgctcctttccaggggctcaagtccaccgccggcctccccgtnaagccgccgctccaacggcgctagcctcggcagcgtcagcaacggtggaaggatcaggtgcatgcaggtgtggcccatcgagggcatcaagaagttcgagaccctgtcttacctgccaaccgctcaacacggaggccctcctcaagcangtggactacctgatncgctccaagtggggtgccttgccttgagttcaacaagtcgggttcatcttccgtngagcacaatgcgtctcccgggtactacgacggcgctactgggacaatttggaactgcctatttcggggtgcaacgacccacacaagtatacnaaggttgnanggaagtcaanaaggattacctgacgcgttacttcgcatcatcggatncncaacat

SEQ ID NO: 88626 - DNA, 478 bp, Triticum aestivum
  unsure (1)..(478): unsure at all n locations
  Clone ID: PAT_TA_88626
cgcagccgcataccgcgcgcgtgagcccccttcccctctccccaccaccccgcccctgttccccggaagcgcgcgagctgccgccggaatcagcaggccgcgaagatggtggccgccttcgccgtcactccctcctcgtccatatgcggcgtctgcgtcccgacggcgtgccgtccggaggcgcggggcatagtgccggcgccgaggttcttccataaccggaaccaagcgaacacacggtctgcaacagcttgggtccttgaaggccggtctatgggactctctcaaatctgggttttaaaaactagcaatagtacagagacagttagagccactatccacagcacttgaagaagaagaaatgtacctgangaattaatgctcctagaaaggaactccctgacggtacacagaacaaatcttatttcttcanctggtgatattgatgtatatgatctccaagccttattgacaaggg

SEQ ID NO: 88627 - DNA, 468 bp, Triticum aestivum
  unsure (1)..(468): unsure at all n locations
  Clone ID: PAT_TA_88627
ctcccgtcccgtcccgtccccagccaacctcccatctccgtctcgcgtcgcggcggcagttccactccctcgccatgggcaagattaagatcggaatcaacggtttcggaaggatcgggaggctcgtcgccagggtaagccctccagagcgacgatgtcgagctcgtcgccgtcaacgaccccttcatcaccaccgagtacatgacctacatgttcaagtacgacaccgttcacggccactgggaagcacagtggacatcaagctcaaaggacgacaagactcctgctctttggcgaagaaccagttaccgtcttcggcgtcaggaacctgaggaattccgtngggtgagctggtgccgatacttgtgganccacggtgtcttcacggacaaggacaaggcgctgccatttaagttggtgccaagaaggtggcactctgcccaagcaaagatccctattttgtggtng

SEQ ID NO: 88628 - DNA, 492 bp, Triticum aestivum
  unsure (1)..(492): unsure at all n locations
  Clone ID: PAT_TA_88628
cactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgttgcgtggcgtacgtgacggggagggcgtcctcgatcagcaaggagtgctgctccggcgtgcangggctgaacggcctggcccgcagcagcccggaccgcaagatagcgtgcaggtgcctcaagagcctcgccaccagcatcaagtcatcaacatgggcaaggtctccggcgtgcccggcaagtgcggcgtcagcgtgccttcccatcagcatgtcacaactgcaacatgtcactagttaatatatatccttctactncatcatggaccnctgccttgagcttaattcacttatggatg

SEQ ID NO: 88629 - DNA, 499 bp, Triticum aestivum
  Clone ID: PAT_TA_88629
gaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctctacgtttggaggatctacgaattccccctacttattcaaaaactttccaaggcccgcctcatggtatccaagttgaaagagataagttgaacaagtatggtcgtcctttattgggatgtactattaaaccaaaattgggattatccgcaaaaaattatggtagagcgtgttatgagtgtctactggtgggacttgattttaccaaagatgatgaaaacgtaaaccacaaccatttatcgctggagagacgtt

SEQ ID NO: 88630 - DNA, 489 bp, Triticum aestivum
  Clone ID: PAT_TA_88630
cagaaaataggaaatttatttttgaatataaaaacatattctttttcatcagccccgcgaggaattcagctactttacatttctatacagctcatggctttcttctctgcaggattatgatcaaacaaacagaaaaaaggtcagagagatacattctgtgacctccctctctatacaaactgcttcactacgatggccagatttttcctttccataatgccagccaagcaatcagcatgcttgatcagcctgttgccctcgttgacaatcatcatggccgcaccatgttggcgcagttggcacctctgacctatgggctatggaccaaacgtcagttgatgtgctcctcccctgtacaaaaatatacacttcttctcttccccgcccttctcttgccaaccgatgtgacagatctcaatgcgatttgggtcgatcggtcacatttggcggtcacttctttccgctctggtctcgagctgatccgaaaat

SEQ ID NO: 88631 - DNA, 481 bp, Triticum aestivum
  unsure (1)..(481): unsure at all n locations
  Clone ID: PAT_TA_88631
cacaaacagaaactaaagcaggtgttggatttaaagctggtgttaaagattataaattgacttactacaccccagagtatgaaactaaggatactgatatcttggcagcattccgagtaagtcctcagcctggggttccgccccgaagaagcaggggctgcagtagctgccgaatcttctactgggtacatggacaactgtttggactgatggncttacaantcttgatcgttacaaaggacaatgctatcacatcgagcctgttgctggggaagacagccatgggtcggtaagttncttatccattagacctatttgaagagggttccgttactaacatgtttacttccattgtaggtaactatttgggttcaaagccctaagtgctcnacntttggaggattaacaaatcccctacttattcaaaaatttcaaaggccgcccaaggtancaagttnaaagaataanttaacaantatgg

SEQ ID NO: 88632 - DNA, 491 bp, Triticum aestivum
  unsure (1)..(491): unsure at all n locations
  Clone ID: PAT_TA_88632
cggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaangtccgcactgacaagactaacctgctgggttcatggacatcatttccattcccaagactggtgagaactacangcttctttatgacaacaanggtcgcttccgcctnaatcttcaaggataagatgtaanttaaactctgaanggcaggtcttccanttcggcaaaagggnaccctaacttaanactatatggcgcacanccgtaccanaccacc

SEQ ID NO: 88633 - DNA, 206 bp, Triticum aestivum
  Clone ID: PAT_TA_88633
ctcttgccttacttggagcaaactttccatgtttgtatattccgaagcaaacgtcacaaagtgagccttctgatgttgaggttcccctcgggtttcctccaccagatggcagtctcatattccatcgcccttgatagcagcattgctgcagttaaactttgggaattgccatgagacgcacatcttttattgttaaaaaaaaaaaa

SEQ ID NO: 88634 - DNA, 483 bp, Triticum aestivum
  unsure (1)..(483): unsure at all n locations
  Clone ID: PAT_TA_88634
tttttttttttgttcaaagcggtccagttgaatcttctgctcgcaggaggcacggcgtggccaaacagtggcagggcctacaccacatgcaccaaaggaaataacgctaaccgacacaaaacatatgcggggttctaaaaaaactgatacagctacagtgatatgatgtcgaatattaggatataaattaccgagccgacacaaatnaattcaagatttaacacgctncaaaatgtctgcataatgaaagcaaaagatacaattttattccaaggaaggtcactaactaatgtaccgagtgagcaacgatacgcctgatgcagtanattccactgaaatcctagagtgtcctctccttatccttccatgctatatttgccctatacnagcaacaagagtaaaagatcatcgaaaaggtacttgggcactttcctctctttnanagacaacanaggttgctcttctcccaaagccagaaaccgg

SEQ ID NO: 88635 - DNA, 421 bp, Triticum aestivum
  unsure (1)..(421): unsure at all n locations
  Clone ID: PAT_TA_88635
cgctctcgctctcactctctcccggccgaacccgacgacgggcgccgccttgccgcccctctccgccaccgctcctcccgccccacgccgcccccggcgcccctctccgccaccgctcctcccgccccacgccgcccccactgccaccacccctcccgcctcacgccccacgctgcctcgttccctgcctcgttccccaacgtgaagcacgcatttttttgtcgatcctcctgccgttcctgtccgacgaccatgtgtttacctcaccggggcacggcagcggggcgccctcctttctcgcattcctggcgcggcggctgctcggcggattgcaaagaggaagtggaggagctcacaagtacccgccggagtcaaagnattcnaggataaggacaagccggcggngcaaccaatgactgga

SEQ ID NO: 88636 - DNA, 485 bp, Triticum aestivum
  unsure (1)..(485): unsure at all n locations
  Clone ID: PAT_TA_88636
atcaaattcagcttctgaacctacaacttccgagtctgcgcaggacaactgtacttcagaatctggtgaatcaacagatcatattgtaggagattttcccatgcagaaaacaggattacaaggttcattccaagccaatgatgttaccggaacaggttctggaccaccatcacctggatcctaagtctactcaagactgacttaatgattgggatgtggtgcaacccttctgttgaagggaacacagattangaaantttgcaattctggaaatgcatctaattngagatgatcaagttgttaatggatgcctaagaagtgcaanttgctgcaaatgcctacatgtcctgccggttatcccgattactgntctccnagacattttatataccctggcaccccancaattgggcaagttccttggngtnnaaaaacanaacgttcacangttcaantttcaaggaccaacttaacagcatacagtn

SEQ ID NO: 88637 - DNA, 488 bp, Triticum aestivum
  unsure (1)..(488): unsure at all n locations
  Clone ID: PAT_TA_88637
gttcgatccctccatagcagcgataagacccatcacagtgtgcgtgagaaccaatagctgaaacaatgggtttctcttcttcctctcggcgctcacgcatagcttcggtgctacaactttgcgtttgcatgctgttatgcagagtagagggaggatcatctcacgagcaaccccttgaagaagggataaacaccctccgtaccagcgccatcatgtttnggcccgagatagcctagaccaggattttcatcccagattgcttggaccaaaccaacgaaagaccatcacggcaagagagattcctccttcatcccgagtctacattatttacattggcaaagttaaagcaanggacaccccgacacgttcntggcttccgcacaatgactgctnacaaccttcttcggaagccaggnaaaacctatggcccgttgtgtanaactnccanaaggtcctcaagcttccanggcatctaaaccaaagaaagc

SEQ ID NO: 88638 - DNA, 459 bp, Triticum aestivum
  unsure (1)..(459): unsure at all n locations
  Clone ID: PAT_TA_88638
cagcancggagttcggttgcttgccgcanccttctcgttccatacgcccctnaactgcggagttcttagcgaagctctgtcggatttccgccatacttccactaccacatcgtcctgctgccaagatcgatctcatccacctctcccccttgctttatgtancaagccncaagtgtgttcaattcgaaggcatcgtttgtgcggtgctacatcggantgatccgattaaagtacgaccgcancacccacgattattanattgtttaacgtgtgtgttctacaaggcaatagcanatatntggcagcatacgcacagagaatctngattggttacattagacgacatttttaagtccaggccctccagattaattcaagcccnttaaataaggaaatctgggaagagtggtgccctaataanaanaggaatacaacagggctttcttcaacntaagtctt

SEQ ID NO: 88639 - DNA, 468 bp, Triticum aestivum
  Clone ID: PAT_TA_88639
ctcatccaactcctcaccgaccagcgagcctacgaaggaattactcactcccggtggggagcatcatggaattggcgatggagaagggttgctgatgacgaagatcgaaaatccccctctctggaaccctaaacggactccagatctggcctcccgatgaagaacaggagacggcggcggcagctccgtctcatggaacgcggtaattcttccctcctgatttttctctggaaaaataggattttgtagcgtcggtttcagggtctgcgggggccaccaagtggggacaacccactgggcgcgcctggagggggttggcgcgccctgggggttttgccaccaagtgcccctccggtgattaatggctcagaaattcccttattgtataaaaaatctccaaagttcgttaatctaaaactttattctgataaaaacaaacatggaatctgctaaaaaactcatccggtt

SEQ ID NO: 88640 - DNA, 463 bp, Triticum aestivum
  unsure (1)..(463): unsure at all n locations
  Clone ID: PAT_TA_88640
aattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttgggactgatggacttaccagtcttgatcgttacaaaggacgatgctatcaatcgagcctgttgctggggaagacagccaatgggttctttatgttacttanccattagactatttnaagagggtccgttactaacagtttactccatggtaggtacgtattgggttcaaagcctactgctccacgttgggaggtctacgaatccccctacttatcaaaacttccaagg

SEQ ID NO: 88641 - DNA, 483 bp, Triticum aestivum
  unsure (1)..(483): unsure at all n locations
  Clone ID: PAT_TA_88641
caagggtccctcctccaactccaactccaactcgcccccctccgtcgncggcgtcctcatcctcctcctctccgccgtnccgggccgcctcgcctcgatncccgtctccgatggactggggcagctaggaggaggagaaggnctgcaccgggagattctcanggacgaaacggtgctgaggctcaaggaaatcggcaagatatctgatggcgaangcttcctcnaaaggacattcctgagtcccggcntccttcagagccactgaagtcattatcaactgggatgaaanatgccgggacttgcnaacgtggggtggatnaaatgggcaataaatcatgggcgattttgagaccgtccaattcaacaagaaaaaggnnttattgantgggatntcaaaatggaatactggtcattngntgctgggatgttccgacnggggctttgggtattatnttgggcaaatctcctgctcctgangggcct

SEQ ID NO: 88642 - DNA, 211 bp, Triticum aestivum
  unsure (1)..(211): unsure at all n locations
  Clone ID: PAT_TA_88642
ctcntgccgattccgnangaggaaaanttccgggccagcgctcctgccccgaagatntacaangngtacgggatcancgcggggagcgtcattgccgcaancaanagnctgtnagatcncacactcntcnagggtctgtcatcgttgatgggaaagaacaaacaccacacttntaggnctcgtgcccagaancttggnataaacgggggga

SEQ ID NO: 88643 - DNA, 484 bp, Triticum aestivum
  unsure (1)..(484): unsure at all n locations
  Clone ID: PAT_TA_88643
gtcncactcgccccgcccacctcctcctgttcctcccgcctcgcctcactctccctccaaaccccgcctccctgtacacgccgccatcatctccttcgtccggccggcganccatgccgcgcccgtctgctccgcccgcgctcgcgacgccccctctcctgttcctcctgcctcatctctctctctctccctcctaaccctaacccatgcncactttcctgtgncgccaccggccatggctgctctgggtcgcgcgccgccgcgttgctccggatcnacgacgctcccccgagcntcctccctgtcntccagggcncactctcccgcacaaatcgcncgctccttcctcncangtgaaccanggcgagcgcatcagcggtcgggtccaaccgcgggctggntctccaccaccaagaaactgccccgcgtnatgcttctttctctcncaagnnagatgggcctnaagccattggagaagcgggnt

SEQ ID NO: 88644 - DNA, 371 bp, Triticum aestivum
  unsure (1)..(371): unsure at all n locations
  Clone ID: PAT_TA_88644
cccctgcaattggctcgacggnaancacgtggtcttcggcgaggtcgtcgagggcatggacgtcntcaanaacatcgagaaggtgggctcccgcancggnacctgctccaagcangtggtcatcgacgactgcggccanctctanatccgcccgcgcgcgggtcgcctttcgccgtcgtcgtcnccgccccgtgtgtcccgtgtcgtgtcgtccatctaaataaaagagtcntgtgtcntgtcgtgtcttcccctggaccgtccgatgaaatctccgtggttggtttaagatggttttangtggactccttgggctgcnggatctctgtccggncgncntgggttancttcctgtgtcngcngctatcnta

SEQ ID NO: 88645 - DNA, 486 bp, Triticum aestivum
  unsure (1)..(486): unsure at all n locations
  Clone ID: PAT_TA_88645
agttcaaagngttatanggagggacttatgtcaccacaaacaganactanggcaggtgttggntttaaagctggggttaaagattatnnattgacttacnacaccccagagtatgaaactaaggatactgnnatcntggcagcattccgaagtaaagtcctcaagcctggggttccgcccgaagaagcaggggctgcantatctgccgaatcttcnactgggnacatggacaactgtttggnctgatggacttaccaatcttgatcgttacaaaggangatgctatcacatctatgcctgttgctggggaagacagccaatggntctgttatgttgccttatccattaagacctatttgaagagggttccgttnactancaatgtttacttccattgtaggtaacgtttttggtttcaanagnccctacgnngcctctacgttttgggaggatctacgaattcccccctacntaattcanaaaact

SEQ ID NO: 88646 - DNA, 479 bp, Triticum aestivum
  unsure (1)..(479): unsure at all n locations
  Clone ID: PAT_TA_88646
ctcgcactcgccccgcccanctcctcctgttcctcccgcctcgcctcantctccctccaaaccccgcctccctgtacacgccgccatcatctccttcgtccggncggngacccatgccgcgcccgtctgctccgcccgcgctcgcgccgccccctctcctgttcctcctgcctcatctctctctctctccctcctaancctaanccatgcccactttcctgtgccgccaccggncatgctgctctgggtcgcgcgccgccgcgttgctccgctccaagaagctcccccgagcctcctccctgtcctccaggcccantctcccgcanaagatcgcccgctccttcctcccagtgaacacnggcggggcatcaagcgggncggtccaacgcggggctgcttctccaacaacatgcaactggcccgcgtatgcntcttctctncccaangagtggggnccgcaagcaatgggngagcgggng

SEQ ID NO: 88647 - DNA, 466 bp, Triticum aestivum
  unsure (1)..(466): unsure at all n locations
  Clone ID: PAT_TA_88647
tgctcgcccanacgcgcctcccgcctccgcctccgcatcccgcccaaatcctgcccgcccgcctcgccggagggggnggtatggagttccgccgcaagctccacttcctctcgggcgagntccatctcgacccgttcccgctcctcgcccttcatcctgagctccgctccgcgccgctcgcgcttctccatggctccctccgcctcctcctctcaaaanggactctccgccgggggacgcctccccgcgtcttctcgggattcncgtcggtcctcanctctcctcctgaggaagtccctccgcttcctctccgccgncggngcngggtaacccctcctctcctccgngncggggggggnccgttnccctcgcctcctcggncgcgtncatccngggngancctccggcccgcgctttactttcttcgncaaacgngttttccctggcgaacggaggnnccttcccg

SEQ ID NO: 88648 - DNA, 565 bp, Triticum aestivum
  unsure (1)..(565): unsure at all n locations
  Clone ID: PAT_TA_88648
gaagggaaggctggaaaaaatgggggggcaacaatcccccccttggatttggggtcaaaggngaattgagggatgggactgcaaaggtccttccttccccgtcaagtttggggtaaaattggngcctggacaaacttcctggccgggggatcaatgggaccaantgaaggagggcaaagggcgtaaagaaatggtttgggtggggcaaaagtgcctaanggctttttcctactgaaaaaatgggaaaaaagggaaaaantcnatgggaaagtaaccntgagatgtgttaagtaaggatatttcccaaagggaacacccaaagttggccctttttttggtcctgaccaanctgcccgcctgccttgttgaagttattccnggggaaaccggtttatgcacnnttgggnaattggggtggncctntgttttggaaaaaacnaangaaaaccggtgccccgnccngttaaattccttaaaaaaaccnaaaatggcaaanaaataaaggttggntcccccttggngggnaaaaaaaaaaaaaaagggggggggcccgggnaccccaant

SEQ ID NO: 88649 - DNA, 334 bp, Triticum aestivum
  unsure (1)..(334): unsure at all n locations
  Clone ID: PAT_TA_88649
agcaanaaacgccancccancggcatccatggncggcggcggctncgactccgancccgccgggcaaccgcgggangaacccanactccccttcggctccttctnnctctccctctcnctccgnaaggacaacgnccccgccannctcgnctccgtnncctccggcgttcgtctgnncaaccaaatctcnaacctcgccgnctgnctaaaaacctccggcggctcctcctncccgcggcgggggaaacgcattaaanncggcgcgggggtccctcctctccccgctcaatggttcctcnnccgggggtctctcggntccttcntctccgggggg

SEQ ID NO: 88650 - DNA, 423 bp, Triticum aestivum
  unsure (1)..(423): unsure at all n locations
  Clone ID: PAT_TA_88650
ggggggtccgctccgcccgagcccaataatggggngaggngtcccggnggggttcctgcacgccttgtnngncttggagctanccttggtgggggngggccgangcgtcncggcggangacgttaancanacaggcacgcaccgccggcgcgcttgccgtggggcgtccgcttcgcccgagcccaaaantggggcgagaggtcgngccggcggttcctanannccttgtctnccttgaatctggccttggnnggccgaggggtcnccgcggaggaaagacaaagaggccggccgtgctctgttggggngaccgtccncggcgctccggctccancaaatgacggangaaagccaagntgtgggtttttntttccaacaaacaacaagtcaatcggcggccgggcaacnatgccaaggcatgga

SEQ ID NO: 88651 - DNA, 469 bp, Triticum aestivum
  unsure (1)..(469): unsure at all n locations
  Clone ID: PAT_TA_88651
tttcaatttcaactgngtggggatcaaggacantaatgtgttgcttgggcaaccgagctaanacgggggatgccancacctacttgtntctgtacaggaactccggggattatttctgtgagtgcctaaatatatatcctctgctctccaaatgggaagnggttggggntttcatttctcccccttccagttcngctgagcancntcaattcccctttccccancncgaaggaaatggnggctccgttaggtgnccccnagtaaggatgcaaagaagtaatgtttgntcttcnccaaaggntttcaaataagtaaactttgattcaagagctccgntgngntttactggaaaagnantttgntcntangaatttcncngagtaaggagntcctttanggggtaataacntaccgtnnacaaaatgntttggncctggnngggtaggntcccaaaaatnaaagaagcttt

SEQ ID NO: 88652 - DNA, 473 bp, Triticum aestivum
  unsure (1)..(473): unsure at all n locations
  Clone ID: PAT_TA_88652
ccgcgcatccaccgctgctancaaggtcgagcaagcagcacanagatgggtggtgncttctcctccaccgtcggtggcccgggttctacgccgaccaanttcctcctggaagaanctcaagaancangtgacctcggccgtgaactaccatggcaagagctccaaggncaacangntcanggtcatggcaancgggaaacatcnnccagaagaggnacaccgccaagtgggagggtcntgngttcgatatctccggcgaccaagcangncatcaccaaagggaaggggatcgtggggctccctcttccangcgcccactggggacgggaaccacgaaggcgtcctcanctcanacnaagtaagtcagncaagggnnctcaagaagtaagactttncnacaccatgggggaggggttctanattnnctcctgctttcatgggnaaancttttttnttcatctccccaangaaag

SEQ ID NO: 88653 - DNA, 471 bp, Triticum aestivum
  unsure (1)..(471): unsure at all n locations
  Clone ID: PAT_TA_88653
gttcgatnccctctccctcgccgccgccgccgccgccgccgccgggcggcgcgccagcatcgctgccatgctccgcctccggggctgcatcctcccccgcctcctctcatctcccgccacctccctccaccgcctcctctccgcgggcgtttctccgagccctcctancttcgccgtggaggagtanctcgtccgccacctgcgggctcaccccagcgcaggcccgcaaggcctcccccaagctctcccacctcaagtccccggncaaccccgacgccgtgntcgccttcctcgccgggctcgggctctccgccggcgacctcgccaccgccgtccgcaaggaccccaggttgctctgcgcgggcgtggagacaacctggcccccaatgtcgcggagctcancggcctgggnctctcgccttctgagatcgcgcgcctcgtctcgattaatggcacaanttttgctggaan

SEQ ID NO: 88654 - DNA, 275 bp, Triticum aestivum
  unsure (1)..(275): unsure at all n locations
  Clone ID: PAT_TA_88654
gngctgggatgttgaattgtacngagaattgctcaanaaangtggggggaaagaaaggatggcagcanatttcaacaaagacantgtgggcagctaaagcgccnaagactgncnnagaaagaaaggnatttattgnttctcttcacaaaaggaaaacaaaattgnttatgggcctaattgagaaaaanntgcttccnctccctccangtgttcaaagggtaattgntgaaagctctaagaaaangggngaaagttncagtatgcaatacttcaaa

SEQ ID NO: 88655 - DNA, 173 bp, Triticum aestivum
  unsure (1)..(173): unsure at all n locations
  Clone ID: PAT_TA_88655
cagagncctnaccctaaggcatctcctctcctcccaaacccaaaagggggggttncaagagnttccgggtnncgggggggccatgggttccggagaacggngaacttcnccttccaagccgggatnaancaagntggtctcgctcatcaanaaaaacttctnttccaacaagg

SEQ ID NO: 88656 - DNA, 418 bp, Triticum aestivum
  unsure (1)..(418): unsure at all n locations
  Clone ID: PAT_TA_88656
gagagcangggcgccggacacgcacgantcttcttgaagcaatggggaccancgcgatggggntctccccctcntccttncccnggaaggnggtcaanganctgccgtcgtccgtgctcttccgggaggggcgcgtcancangcncaagaacgcgggcaaggncaaaccngtgtnttncggcagnccgtggtaagggtccgaccgcgtgctctanctcggtccgctctccggggaacccccgagctanctcaccggggaattccccccgcgactaaaggtgggacacncacgggngntgtttggccgacccccagaccttcttcaanaancggggagntggnggtgatcactgccggtgggcnatgntgggngcgctcggntgggtctttcccnanctggtcgccccgcaacgggggt

SEQ ID NO: 88657 - DNA, 436 bp, Triticum aestivum
  unsure (1)..(436): unsure at all n locations
  Clone ID: PAT_TA_88657
acatcaanttgacgtccanttgcagcaagcaacggcggcgatgatggtggagaggtgggcanggttcnggtcggnnatggagaacgtcatcttcctcnggtccgttgtgtagnaataagtncctcccaccttccnnctctanctcaacgactgggtnggcaaggtcggcgcctgcttcaanccccacctgcaggttaanaactccngacgtacggggggcgagcgcttccatcgnaangacttcttcctnccccgtccgagggcnacctcaatnaangnctgcgnccgcccgggcacgcaagctcaattggcgngctcgtccanggagangnaaagnaaactcccngggnnaacggtcgaccgaaccaacnaagggagggncaggcgancggacntcctcnctgccaanaaancaancctgggtgggtangggcct

SEQ ID NO: 88658 - DNA, 476 bp, Triticum aestivum
  unsure (1)..(476): unsure at all n locations
  Clone ID: PAT_TA_88658
ccgagcaagccacactctccancaccancangccggngggaagcagcgcaagcacaacaaccaaatgggcaccatcancgccgccgcggggancancgtcgtcgcccgtgccgccatcnccaggccgcangccctangtctgccccaactgaggacnaagagcgagagggtgaggtgcagctnctccaangacgcaaggaggngacccctgccgccgccgtccgcggggntggggngtccctactcnccgcggngggcgcggtgaccncgtccgcggggccggcgctggtgctggtcgaccaacggatgtctanngagggnaacgggctgancctggggcttgancaacaanctgctggggngggtnctccttggggggcttcgggctcatntggtcgntctacaacgtctanaacttcgggctccacnaaggangaagaancccggngggctctcctccnaaacttacacaaant

SEQ ID NO: 88659 - DNA, 359 bp, Triticum aestivum
  unsure (1)..(359): unsure at all n locations
  Clone ID: PAT_TA_88659
ggggagatgnnggtgttctccgggncctcgggctcccgnctcccctcgggcctcccctttttgntgcggggaagggctaaatttgtgtnccgcnattcctccnnctccgcttnccggggcgcctcctcntcaagctgcgcccgtntgtgngggngtgngccgcggaaaccgtgggtgttccgttgggctcggggaaacccnggaagatgtnncaagaggactcnccacaangttgggttccgagatgatngattctatancaanaaacaaaagggtgtntcactcancaaatatncaagtttnaagggaantggntggcaataggtcntattcgggggaaagttcctatcaatgccttc

SEQ ID NO: 88660 - DNA, 505 bp, Triticum aestivum
  unsure (1)..(505): unsure at all n locations
  Clone ID: PAT_TA_88660
ctcgagttttttttttttttttttctctgcatttcttacatcaagtttcaaccaagtaggcgngctaacaatgtttcaacaaaancaaatagcanttcagttttcacganntattantcatatattcnaataatatcngccttccngaaagatgnttacattcaagccaattaagcaggtgggggtctncctcccccttnactgngngatttattaaatatttccacaaaaaagctcacagggncacgggacacataanaatccgngatntcatnctcctccgagatttcgggcagctcgggnaaaaaaggggngagaatccaaaacaagcgggggtggtcanccgtcccaagaanaaagggctggnaagggnattttgcagggccatccaaggccaaccttccaagcaatcccccaatgaatttcgctccaaatgnttgggcctgncantggggncgttcaatcccggggtgganccanaaaatccaaacaaacggcaaaaggg

SEQ ID NO: 88661 - DNA, 227 bp, Triticum aestivum
  unsure (1)..(227): unsure at all n locations
  Clone ID: PAT_TA_88661
aacccctcctcctggcgggcccctccccgcctncggctncaantccaaagacctgcgngccgncgncgcccccgccgccgatgcggtcgatgaaganggcnccgcctcccctcccccctcagatnctngnaggggaagtgggaaacctggtggttatncagctccggccccccacgggtnatngacgggcatctnnctcgcccngggcgaaaaatgaagcccgtccc

SEQ ID NO: 88662 - DNA, 491 bp, Triticum aestivum
  unsure (1)..(491): unsure at all n locations
  Clone ID: PAT_TA_88662
tagcaagctatntacctacatagtacagccatgggccccaccgtgntgggctcgtcgggcaactccgtcgctcctttcnagggggtcaagtncancgacgggctccccgtcagncgccggctccaacggagctagcctcggcagcgtcagcaacggtgggaggatcangtgcatgcaagtgtgggccatcccagggnattaanaagttntngaccctgtcctacctgccancgctcannaagggagggcctcctcaagcagggcgactacctgatccgctccaagtgggnggcttgcctccagttcancaaagggtggggnttatnttccgtgggcanaaanaaaccccctgggtnctaacatgggcgggtactggggcaaatgtgggaagctggcnatgttcgngngggaccgacgccacncaanggtgnttnanaaaggtggggggngggcaatnaaaggngtaaccctgacgcgctatgtnnngcatt

SEQ ID NO: 88663 - DNA, 480 bp, Triticum aestivum
  unsure (1)..(480): unsure at all n locations
  Clone ID: PAT_TA_88663
tgcaattttgtattctcacgattattaggcaaattcgctgacaggaaaaaaaccacactgggtcaaatttgcagcctgctgggacgttgaccatgggctgaggtccaggtcagtggtggtggccgaggcagatctggagtaggctggatctgggaggggaagaaggcagggccttggcggcgaatctggcctaagcgggccgacgtgcncggtcaacgacgcccacatttgcattggctgtctcacatgcaaggcaaggggagcaagataangggacttggngcacgttaggagggcctggtcgactggggaacaaacgggggattgncanagacaccgggactttgaagccccgggggaggaaccattggcaacccccggggcatccaatnggcttgggctccctgagggtggcaccaaccccgaccnaangaatnagggccanggcaacancccggcgcatgaaccgctcctggctgt

SEQ ID NO: 88664 - DNA, 292 bp, Triticum aestivum
  unsure (1)..(292): unsure at all n locations
  Clone ID: PAT_TA_88664
ctttgacgccgctcttccttcgacgccatggaaggtaggcgagcgaaccanatccagcttgtacaggngtacaactcctcctcctcatcgtcttgtcttcttggncggcctggaaggngatggcggggccgctggagttcctggaggcgcantgctcgacacggcaggtgctgccggactggcacaccgacctctaccaccggaggntctagcancaagctcancctcaagctccagcaattcctcancctcgccgtcgtccangtattgcaaaaagaaaacccgtgtggtg

SEQ ID NO: 88665 - DNA, 476 bp, Triticum aestivum
  unsure (1)..(476): unsure at all n locations
  Clone ID: PAT_TA_88665
ggacaancagcganaggcgccacttcntccanctccggncccgggaggatngcttcgctgccaaatcgctcgtccacggggggatgggggaggggtcatctccggcgatnnccaaggatgtcaccgagctgatcgggaaaaccccgttggtgtncctcaacaaagtgaccgacnggtgcgtggggcgcgtcnccgccaagctcgagtccatggagccctgctccancntcaaggacaggattgggtacaagnatgatcaccgncccgggggnagaanggggttcaatcttcncaggcaaaaagtgtgctngttgtancaaaccagtgggnaaananagggnattggggntggccntcatnggtgcngcccaagggntacaaancttttactcanaaatggcccccctcccatgaggtntngggggaggagggantcanacttngaanggccttttnntgggtgganctgatnctca

SEQ ID NO: 88666 - DNA, 549 bp, Triticum aestivum
  unsure (1)..(549): unsure at all n locations
  Clone ID: PAT_TA_88666
aaaactccgttttccaaannccccaaccttnctncaaacctcccccttnngggatncaaaggaaccctccgtccaaccaaagaannctccccccctgggttggntcnatncctcccccncccccgccccaaaaaaactctggtcgcgcctgctcctnaatttntgggcctcncgaagggaggagngctgggtgattntttcccgtccgccctttngtnggtttgcagggaggccanncaaagggatcccttcccttctatccccctccngttttgttccccggttgttcgaaggggggggaggaaggcaaacaaaanaaagngggggggggncttttgtcttnctcctgccgcgncangcccaaggaagtttnaangggccctttaangattaaagaattggggggggnanatccttccntcccaantggcggaaagaanngggggtttatnnaacngggggtaaaactcncngttccaaaaaggtgtcaanaannggcaaatntgncaattgtggcttgaccnattattgccnnaataaaaatctccn

SEQ ID NO: 88667 - DNA, 536 bp, Triticum aestivum
  unsure (1)..(536): unsure at all n locations
  Clone ID: PAT_TA_88667
accgcgggtgggcnggacggctcctaagaaactaagtgggattcccccggggctggcaanggaaattccnggcaacgaagcaacaagctnccgcccgcaacgaaactggcaatggccaagtttnaatttaagtggctcaaaatcngggccctggcaagcaanaaagcgctccaaaaccctaaacgtgnccgttgcttcccgcccgcatttcgctggggctngaacttgcnacgtaactggggcttgtggggtggggtaanagtggncngaanatgcttggcccgtgtcctcccgcngaagggtgncctcngcccgaacgaacgcgggtggggaagcaaatggcgcccgaaggggccgcnccccgtnggaanancggtttggggggccgccngttgggtggngggcgggaccctnggaacaataaaaacttccnnactttcanccgtttgatggacaataaaaacntttggggggattttcttcctnccggnctaaaaaaggancngggggaaccncnccctggnccggggaccctt

SEQ ID NO: 88668 - DNA, 655 bp, Triticum aestivum
  unsure (1)..(655): unsure at all n locations
  Clone ID: PAT_TA_88668
ccgcgggtggggggacgctctaagaaactagtgggattcccccggggcttgcanggaaattcggcaacgaaggtcncaaagggcgttgcgttctcccaaaggccccgggncgggcaaggcgccgccaagcaaggtttcaaccgttgaggggcgtccntccggcgggagggccgagggccgccggncgccgccgcggtcctttggcctcaatggccagccgggaagtccgtccggggagcgcgttcgcctcaaggtggtgcaacgccgggcaacccgtcgccgggncatcaaaggtttggggccccccgcccggccggctctcccgggtgggactccccccgggaaacgggncaaactcgggaccgaaggcaaaggggaactttcganccttgcccccttgaaagaaaccgggtttctaaccttgcaagcccgcctgccaaaccgggcgggaaggcgggncgggttgcggggccaaaagggaagttccggcccaanggaacaattcctcaaanccttcaaagggccgcctcaatcgnanaaangaaagccaaatggggccgtntcggtnaattgaaaccgaaccttcnncctcaaaggggccttcccttaaccntggcggcctaacgaaaccctcaaagaaaccgttcaatcttcc

SEQ ID NO: 88669 - DNA, 478 bp, Triticum aestivum
  unsure (1)..(478): unsure at all n locations
  Clone ID: PAT_TA_88669
ggaggaggcagcggngccccaaccccgccgtcgctccaatcccaccaagnggcgtcctctcctcatcccctaacgccgccgntccaagcccctcaccttcctcgggcgatttaggcgccgtcancacccctcangcatgnancntctcctctcctccgcagttccgcctcttcctctggnggcatccaacccaatcatcatctcctactcccctctcttattcccctgtgcctcgacgaagtgggccaanccggcgcacgcancatagggcggctgcggangcaaatcatacgcgggcgcgggcgcgggcggagctacagtggctggtggtgganggnaatcncatcgaccgcgtcnctccccaaactgccgcgataatggagggagccgncagcgccggncangtacagaccgacggggctcgtcgggtcggccgttcttgggggcaatctctccccccgtgtcggatcgcgcatnn

SEQ ID NO: 88670 - DNA, 549 bp, Triticum aestivum
  unsure (1)..(549): unsure at all n locations
  Clone ID: PAT_TA_88670
gnggctggcggcaagggaaaaatccaagtgggcccggctggcaactcctttggncgggccttaaaatgggacaatgggttggntntgattgggccgaggatgctgccaagggtaattccaactgtccntggctggcaagctccttccgggaacgtgggattgggggaatgggttcnaaaagccggagnccgctaataaaaactccctggaattttcctttgntttctttaaaacgaaccaaatctgggtgaggngcaaagaacnggatcantgctaagtgggaagttccaagtggctaaatgggaagttccncccgagggaagaanaaggggtaagcntccctccaaagaaanttaatctccctccgggnaacaataatccctcctttcctaacaaggggcangacaacttccntggaaattttctgtttccaanacaaaaacnttgagccttgataaaaagaactaaatggttcccngnatggatngaatcgaangggggggaaatccttatccnattgagtccaaaaaaaaaggnggaaaaangggg

SEQ ID NO: 88671 - DNA, 433 bp, Triticum aestivum
  unsure (1)..(433): unsure at all n locations
  Clone ID: PAT_TA_88671
gcccccttctcanctgctcgaattcnaggncggnaactcncgcggngattgtgctcgtcatcancgtcgccgcgggcancgtcgtctccggggtgcgggagcangtcaggaggtccgccgcggncggntncgtctgttccaaggaccaactcaagctgggangtcccgtacattcgccatcgacgtcgtccantccgtgtncatcgtcgccatccgccatcggtttgccggtgctccganccgtcccctaactccccgatntcgccgtcgcgctcgtgancccgagaacgctgntgaggncccggtgattnactaccgtcnacganganctttcttctctttnaaaggagcttcnanatggnggggttcntnggggccaaattccaccgcccgacngggtactanctacaatggggggcancncnaagaccaa

SEQ ID NO: 88672 - DNA, 400 bp, Triticum aestivum
  unsure (1)..(400): unsure at all n locations
  Clone ID: PAT_TA_88672
gtcaccacaaacagaaactaaagcaggtgttggatttaaagctggtgttaaagattataaattgacttactacaccccanagtatgaaactaaggatactgatatcttggcagcattccgagtaagtcctcancctggggttccgcccgaagaaacangggctgcaagtagctgcccgaatcttctactggtacatggacaactgtttggactgatggacttaccaantcctgatcgttacaaaggacgatgctatcacatccgagcctgttgctggggaaagacanccaatgggatccgttatgtagcttaaccaantaagacctatttgnatgaaggttcccnttaccaacaatgtttaacntccnactggtgggnancgtaatttgggttcaaaaag

SEQ ID NO: 88673 - DNA, 346 bp, Triticum aestivum
  unsure (1)..(346): unsure at all n locations
  Clone ID: PAT_TA_88673
ggaaganccaaaaaaagcngngagccaagggagcancctaagcacancacaagnggcaacacaaggcaaggagtggggcgcatcgcatcgcatcncacccgcgtggtgggatggagcggggcgggancgccgcgctcgcctgnancttccgctcctcctctccgggttcccantgttcgcctctcctccgcccccgtanacgctcgcccgcgggcgccggggctcctccgcttcctctcgccgaccgggcggngcttcanctactggantcaaaatanggtttggtagacacaancaaagggggcttnaaccggtactcaattgacgacaattcaaccccaatttt

SEQ ID NO: 88674 - DNA, 432 bp, Triticum aestivum
  unsure (1)..(432): unsure at all n locations
  Clone ID: PAT_TA_88674
ttccttnccttcccctttccccanctgngtgngagcgggcanccanaccaaccgcgtccanatncggngggcgatntctcccgcccgtctccccatggggggcggagccctggtcctggccctcgtancggcgctcgcggtcgcgctggcgggggcaaantccgagggcgaagcgctctcggcgctgcgccgcancctgcgggaccccggcggcgtgctgcaaanctgggaacccaacctcgtcaacccctgnacctgggntccangtcacctgngaacgcganaaacgcgtcaacccgccnaaaatnttgggaaacttgaatttatctgggcatctggggcccgaggcttggnaaaantgggggcaatttgcaataacctggaanctttacaaaaaaataatatttgaaggggacgatnccaacngggaac

SEQ ID NO: 88675 - DNA, 270 bp, Triticum aestivum
  unsure (1)..(270): unsure at all n locations
  Clone ID: PAT_TA_88675
agctgaatccaacancgtcattatgatgggtgggaacaaatccgaccttaaccacctgaggtcagttcangagggaagaaaggcaggcattaacaaanaaggnagggnganccttccttnntacctccgnactgggaaccntnaacctncaaaaagngtttcaaactaaactttcccncatccaacaaattataatcaanaaagggctcnctggccaangaagntggaagaantggnactcccactcnaaggaacaacaacaatgttggc

SEQ ID NO: 88676 - DNA, 470 bp, Triticum aestivum
  unsure (1)..(470): unsure at all n locations
  Clone ID: PAT_TA_88676
ggcaagctcgtcgacatcctcgcccagcgcttcgacgtcgtcgcccgctgccagggtggngccaatgctggacacaccatatataattccgaggggaagaagttctcgctgcacctcgttccatcggggatcctnaacgagaacacgcantgcgtgattggcaacggggcagtggttcacctcccccgggttcttcaaagaaatcgatgggctgggngtccaacggagtttcaatgcaaagggagaattctggtgtcaagatngcgcccatcntctgtttgnttttcaacaaagatgtccatgggcttcnagaggtggngctcggggaactccttcatangaacgaacaaaaaaagggggaatccnggcccttgcctatttcccaaacaaaggncaatcaaagaaaccggggcttcaaagggtccccctngattntggcgggcaaaaatgggacaaccttttgggtgggc

SEQ ID NO: 88677 - DNA, 412 bp, Triticum aestivum
  unsure (1)..(412): unsure at all n locations
  Clone ID: PAT_TA_88677
gaacctctctgccaagcttgaaggggatgacctanatgctttcaagaagaatgttgagtccgccacaaagtatcttcttagcaagctcaaggaccttcagttctttgttggngagagcatgcatgatgatggcggcgtggtgttcgcctactacaaggagggagctgctgatccaactttcctgtactttgcacatgggctgaaagaggtcaagtgctaatcccactgtatgctaaaatcnaagctgtcctcantaatttttgctcttatcnaagggntgncaagtccgactccccaatgttggngtcaagtaaactgtcanatgttgaagtggtccttggaaaactttcctgataaattgtggggaatttgcttttgttatggggaatcccnngaaaanttgggtggtggg

SEQ ID NO: 88678 - DNA, 615 bp, Triticum aestivum
  unsure (1)..(615): unsure at all n locations
  Clone ID: PAT_TA_88678
cgcgggtggngggcggccctaanaaactaagtggattcccccggggctggcaagggaaatncgggcaaccaagctngacccaaaaaattttaactaaaaaagatgctaggggagaaacttaaagagcttancaaagcactgggccccggnagggaanggacttggtgcttngaaagaagccccaaaatgcttccantacaaggggcgggatnctgcgggtaaacctttcaaaaacaaaccgaacaatctcccctaaaggnttcaactttgattttgaacccgaaanacnggaaaagntaagaaggcttaaggggtagtttcaaccctttaanaggaaaatggttttctaaaagggcggggtccgggcccaaaaaaaangtccntttccctggttanagnaatgggggctgatccgaactggtggctttcgccgaactccccggncncngcccaaatccttgggtggccaaccggggtggnaatcctccccgcngccctttccttcantctaantggggaaaggggggccttcccnttggggcaaaatnanaaacggggcccnaaatttccctgggcccgngaacctntcggaaanaaaaggttangggggggnng

SEQ ID NO: 88679 - DNA, 501 bp, Triticum aestivum
  unsure (1)..(501): unsure at all n locations
  Clone ID: PAT_TA_88679
gttttttttttttttttttcaaacgagaagcgacacccacagatacactgtacaatccaaagttccaaacgagaagctatgatacacgtgacttgtttggtccctagctacaantcgacattggtgatgggcccctggaaacaaaacctggcgttgacaaccatgcgccgacgctgagcancaacacgccgccgacgggcaacggcgtgtagttgaaagttgtccttgggcaacgggtacgccaaccggcaaacgagaaaaacaacgggtgagggnacgccaanccaaaaggacgggggggccaanccgacgggggaaccccgtattctncccnaagggngggaacggggccccggnnangaaacgaaactccctccccccggtcggtcaacccgggaaagaaaaaatgggcaagcnccgttaggcgaatgttncttgcccccaacngtccccgnatngaanaacaaaccgcctggggaaangccaccntggactnccccc

SEQ ID NO: 88680 - DNA, 468 bp, Triticum aestivum
  unsure (1)..(468): unsure at all n locations
  Clone ID: PAT_TA_88680
tacaaccatgggccccancgtgatgggctcgtcgggcaactncgtngctcctttncanggggtnaagtncaacgccgggctccccgtcangcgccgctccaaaggggctagnctcgggaaggtcaagaacggtggnagggtnaagtgcatgcaagtgtggnccatccagggnatcaaaaaattcgagaacctgtcctaattngcaaccgctcaancangggagggcctccttaaagcaaagtcggnctaacctgatnccgctccaagtggggtggcttgcctccaagtttaaaaaaggggtgggttcancttccgtgagcaaaaacgcaatcccctggggtaataaaaatggccgggtactggggcaatggtgggaancntgcctaatgtttcgggatgcaaccggacgcccaacncaaaggtggattnaancgaaggtngggngggaggggcaaagaaaaggagtan

SEQ ID NO: 88681 - DNA, 244 bp, Triticum aestivum
  unsure (1)..(244): unsure at all n locations
  Clone ID: PAT_TA_88681
ctagtctcgagctttttttttttttttttttttttttttttttttttttantganaacaaaatttgtttgttaaatagnaanccatgtctgagattgcaactgggaanagctagagctggttaacaatattacaatancatgccatgcagggctaaaactcaattaggcttcanaagtttgccaattattacatctcttaacaatggntttcgacgctagcaatacaaaatgaaaanaaaaaaa

SEQ ID NO: 88682 - DNA, 381 bp, Triticum aestivum
  unsure (1)..(381): unsure at all n locations
  Clone ID: PAT_TA_88682
agatnccccgccccgcatcccgttcgttcccgcgcgcgcgcatggcggagcangccgcccgccacctccgtcgccgcggncccgtcgccgggtggtggtgctccttcaccggngtcccgcccagccccgancaacgactcccccaccgaaccctctcncacgccgccgggccagctgnagcaagatntgtgttaccngcggcgagggcccgcngaaagcaancanaactgncgccgaaatccccctcctccttccangggtcgccctcctccaanctggggggnctcatcgactanccgggnncgggtnctntccccgggggcgggtctcnccccatcganccccgacgggcgnacaaacatcctnccgagtccccaacat

SEQ ID NO: 88683 - DNA, 458 bp, Triticum aestivum
  unsure (1)..(458): unsure at all n locations
  Clone ID: PAT_TA_88683
gaaaagtctcccanctttacgcggcgacgggggtggngacgacgacggngagctaagttgccgcgggancgatgtctctccctccgaccgacgggggggacgattggttcctccactgcggnatcctcgaggacctcccggncgctgcctgcggcgctttcccgtgggangcatccgtctcctcgtccaatccaagtgcggnaagtaggcaagccatgtnaacaagttanatntccccaangattccggcaagcaataaangcttaaggncagagccctgtggnagggcgacatctaaagnttgtngggaaaaagtgagaagagacaaactgaatgacaagntcccttgaattgggtaataaantggattctggtaaagccantaaaagctgacaaagctgctaatcctgaagtgattgcgactcncaangggtaatcaaccttcctggctggnaagn

SEQ ID NO: 88684 - DNA, 176 bp, Triticum aestivum
  unsure (1)..(176): unsure at all n locations
  Clone ID: PAT_TA_88684
cagaaatccccatctcaaaaacctagccctcatncccnattcctgggagcgagatggacaacccnagggtggtttttcttatnnaccgtcggcggcgcgcccngcggggggcatcatnatggagcttgttcaaagacgccgtgccgcnggacggtgggngaaattcctncgggctc

SEQ ID NO: 88685 - DNA, 473 bp, Triticum aestivum
  unsure (1)..(473): unsure at all n locations
  Clone ID: PAT_TA_88685
caagaaatgcaaatggcccaaatattaatgatcgtgtcgtttttcaggaattgcaatggaccaaattgttgtccaaggcctggattcaaaacatgtagctgtaatgctaatcaatcatcancattgcttatcagtcgtaatcaattcctacttttttttaactttcccctttttgggaaaaacgggagcattatcagtcaactgaaaagagtatgttataaagtncaatgaaatctgggaaaagaacnaagggaaatcnttcncntccanttgnccgtcatacaatctaactccgcaacaaattggggggaaagtaaattaattttccccnanatttaatttccaaaaagcaaaggaaattcaacgcacctttcccccntccccaaaaaccctaaantttaaggggnaatngattccccaagccaaanggaggccaatgccgcccanggagggaagggagggnggagcnattg

SEQ ID NO: 88686 - DNA, 452 bp, Triticum aestivum
  unsure (1)..(452): unsure at all n locations
  Clone ID: PAT_TA_88686
ctctcaaanagcanggacgccggacacgcacgagtcttcttgaagcaatggngaccancgcgatggggctctccccctcgtccttcgccgggaaggnggtcaaggacctgccgtcntcggcgctcttcggggaggngcgngtcaccatgcgcaagaccgcggncaaggncaagccggtgtcgtccggcagcccgtggtacgggtccgaccgcgtgctctaactcgggcccgctctccggggaccccccgagctanctcancggggagttccccggcgactangggtgggacancgcngggctgtcggncgaccccgaaaccttccccaaagaaaccgganctggnggtgattcaatngccgtgggccatgctngggcgcggcttcggctgcgtcttccccgancctgctcgcccgcaacgggggttcaaattccgncaaaggcctngtggtt

SEQ ID NO: 88687 - DNA, 192 bp, Triticum aestivum
  unsure (1)..(192): unsure at all n locations
  Clone ID: PAT_TA_88687
ggagtcaaagttacgcaacgccaaccctagctnactagcaatgggcaaaancaacgaaagaacccancatcaccatggnaganctgcggggacnacgtntccccncccaaccatgggagaacatcggcgtcctctctgatgtntccatngncaagcaaaaanctccccnttcggcgtcgtctccaacaattt

SEQ ID NO: 88688 - DNA, 466 bp, Triticum aestivum
  unsure (1)..(466): unsure at all n locations
  Clone ID: PAT_TA_88688
cgaggatccanttttagttggnttcccgggtcccttcncngggctactaaattcccgggggaagcggatggatttggcgtcngtcaacgaggagctcnccnagatcgacgggcanatcgccgacatcttccncgcattgcaaaatgggttccaaaagctcnacaagatcaaggatgccaaccgccggngcangcaactcnaagagcttactgacaagatgcgagactgcaaaaggcttatcaaagattttgaacganttgtcaaggatgaagcaagaaatgttgntnccgaacacctcnaaatttctgaaacgaagagaaaacaatcnctgntcaagggaaatgnactcctaatgtttgctccngnacaaacaaacaatgcaaggtgaaaaataaaccgaaggttgancctttttgatgcccccaanntgggggaaagaaagnccnttgggtggannaaaaatgtt

SEQ ID NO: 88689 - DNA, 442 bp, Triticum aestivum
  unsure (1)..(442): unsure at all n locations
  Clone ID: PAT_TA_88689
ctangcgtctcccttcgtccccccctctcgccgccgcgtcgactcggaagtaacaagcgcgctgccgcccaacccttccgatggnggacaangagcccgtcgtggagcgccccgtcgcggaggaggaagganaggactccgccgccgcggncgccgccggngaggaggagganaccggtgcccaaagtcgcccccatcgatgcggctcgaggagatcgctgtcaccaacggcgaggaggacgaaggactctctcctcnacatgaaggngaagctatacaggttcgacaaggacgggaaccaaatgggaggagcngggcaaccgnaccntcaatctggtcaancataaagngtgaatggnaaggtcnnccnttgttnttctnccaaagncaaagannattaaanattttncnttnagccaccctaantnatcttnacaangaa

SEQ ID NO: 88690 - DNA, 407 bp, Triticum aestivum
  unsure (1)..(407): unsure at all n locations
  Clone ID: PAT_TA_88690
cgtttcccggccggcacagggtangctaagccaggaccagcgcccagctctggtcacggggagcgtgtgtgtgtgtgtgtgtgtggctgcggcgggccggagcgggcgaggatggggaactgccaagcggcggangtggcggcggcggtggtgcancacccgggcgggcgggtggagcggctctactggtccacgcccgcggcggaggtgatgcgcgccaacccgggccactacgtcgcgctcgtcacgctccgcgtcgccgaggagcgccaggacgccgacggtggcggcgcgcgccgcaccgtgcgcctcaccccgcgtcaaagctcctcaaagcccaaaggagacgctgctcctcggccactcctaccgccctcatcaccgncaacgaggtgaccaaangcggt

SEQ ID NO: 88691 - DNA, 299 bp, Triticum aestivum
  unsure (1)..(299): unsure at all n locations
  Clone ID: PAT_TA_88691
tcgagattattttttttttttttttttttttttttctccanggaaataatagtcttgcaancttcacatttacgangaacgaccgagttcaggacaaggagtggcaggataaatagaagtcancaaacanagaaagtagntctcgcactgcttaccaaccatttnnacgggtgngnaataaacacncgtccancancgtgggcacannaaaatatagngcataantctctanggagatgtcncaantcttaaaanggntaggnggaacngggtgattttacttgcggggncagggaaaa

SEQ ID NO: 88692 - DNA, 204 bp, Triticum aestivum
  unsure (1)..(204): unsure at all n locations
  Clone ID: PAT_TA_88692
tcctctcccctcgcctcctcgncctcnccctcctaagggatngccggngangaatcncnacgagggnttcctcctatcaattaaatcaaagccatggagcncaatggaganccactttnagnctccggagggtgccatcctttgngtcaataacngctggttctttngnaaatgcggggaccaagaaaatntgctccaagtggc

SEQ ID NO: 88693 - DNA, 482 bp, Triticum aestivum
  unsure (1)..(482): unsure at all n locations
  Clone ID: PAT_TA_88693
gtctcatcctccccagctcggtttttgggccattctaagccancatgcctgcctccatcgccttcggtcggttcgatgactccttcancttggnctctttcaaggnctacatcgccgagttcatctccaccctcatcttcgtcttcgccggngtcggntctgccatcgcctactccaaggtgagcggcggngcgccgcttgacccatccgggctgatcgccgtggcgatctgccacgggttcgggctgttcgtcgcggtcgccgtcggngccaacatctccggngggcatgtgaaacctgncgtcacctttgggctcgncctcggggggcaaattaacaanctcaacgggaatnttctaactggggtttggccanctnccccngnggccatcngtcggggggccttcctcgtccaattntggancgggnggtggggaacccctacacanngggnttttccggggtggggngncnttcaaggg

SEQ ID NO: 88694 - DNA, 491 bp, Triticum aestivum
  unsure (1)..(491): unsure at all n locations
  Clone ID: PAT_TA_88694
ttttttttggctgttaaagggctcaagaagtatcatttagtaagagaaattatatctacttgaatatattgcaacatccaagtctgttggtacacatgtttgtaagtgtgtttctagtgcacatgcttctgccagtacatcttcctggatccagcacatgcttctagggcaagccagctctgtaacataactacacgttctcactatatcatgacctcaagggggggtaacggttacggtgttgtaagataaacgaaaaggggcaaaaatgttaagtgtctgtcaagtacatcttcctggatccaagtgtcatggtgcacaaggtatgaccgccatggcttcgtcatgaaccaaatgaatgatgccggggttcgccacccgatatggatgatatgtncacgattcaccaaatcctcaccaacaatcctgggacttttaagtctccctactccctggtgaatcncaaagggtaactgcgggggatcttgttg

SEQ ID NO: 88695 - DNA, 476 bp, Triticum aestivum
  unsure (1)..(476): unsure at all n locations
  Clone ID: PAT_TA_88695
gaccaaaattaaaagtctccaattactancaagcatgggtggcaagancaactcaagnttnaacttcctcaangaaangctggncctccccacgcgaaancccaagntcttcgnccccatcctcanctttgtgggcgncatcgccttcctcanccccgcggncaacgtgggcttnaaccaancgctcancgccgagatggtgnaccangtcnccngagatgnaaaacaacganccctccaagcggcgagnangncaaaggtcctggggggggataagtcaaganggcaaggaggtcgtcctcaacgncgtcgcctcangggcggtaaccctgncgntcgttttcgccaaangaaattctcgncttttccgnggggtccaagaaggnatccggggaacggtnatcccctccccgggggntcctcccgnaaagggggngcaantgggggcaaaccttganggggcctctccncancgg

SEQ ID NO: 88696 - DNA, 493 bp, Triticum aestivum
  unsure (1)..(493): unsure at all n locations
  Clone ID: PAT_TA_88696
acgccgccgccccacttgcctccctcacgccgccgccccacctgcctcccccgcgccgcgtgggcaccatttctgcccgcgctattgccccacctccttcccccgcggggncgcggngcnatcccgacaacctcctaccttccaccccgcgtcggnccctccctgcgatgcgggcgacctcctccttccaaccagcancgccagagacccgcccccgtcgcgcgccgncgaagccccacccctccaactatcancanacaccgnctcttcccctggnagnaccttctcgtggnatcnccccctacttnccatggncatggccggggntctaaccccccctgnnccanatagcaacggantttgngccggcctccatcaaccttccggangaagggccttcncaanaaagttagnttccgcctctccccatgggngggattcngcctntcccaaacnggccanaagcccttctctcaactaagtaagcnggtcg

SEQ ID NO: 88697 - DNA, 488 bp, Triticum aestivum
  unsure (1)..(488): unsure at all n locations
  Clone ID: PAT_TA_88697
cttncccgccgggcgctcgcatcgccgggganatcgccatcttcctccgcaagctgacaccaagcggggcgccctctcctgttcttcgggtgggantggactaacanggagtggggattgattgcccgccgggcgggctctccgtcccctcncccacaaatgaangaagcctttgatncgcccgcctcggnggngggancaacgccagaagcaaaaaanantggatncctcttcaacaaaaaaaacatctggagcggcgcngntgctganggaaancaacaatcctcnccttgggcaatgggaaggggtggaaaatgaaaangaagntgaatttctttctnaatcaaacaaggnttttgtcaattctggnttaagaaacaaantccttccggaggggcaaagtaatggtactggaaantggggtcaacaatgtntatcccaangggaagcaatgttaaccaacgaaatnnaatatgatnaaggcangg

SEQ ID NO: 88698 - DNA, 478 bp, Triticum aestivum
  unsure (1)..(478): unsure at all n locations
  Clone ID: PAT_TA_88698
gattttgccacttccagttgtcgcgggagtgcgtggtcgcgtttgacgcantctcaaggatgcggatcgagtctggcagcgcggccatggggagggcaagcgaaaacgcggcatgctgcttggtttcccgtgcgagctcgtgccatagacaatggttggtctgaggcacggaacagcgggtggcaccgcggctttttagctacgtcccatgagatctatgatgaggtaatggcggcgccggacaaaggtagcaagtatgtacaacaccaagcgagggccgttgatttgcttatatccggtttcgctattaagttactgaagcaaggttgggaagtgcatgcccgtgacttcgtcnngacaatcgagtgggaaacanttgggcgtgacttcttcaaggcgtccgagcttgctttggcatgatttcattgggncatcnagtgggagtgggttgggcaagggcnttcacnttgcccnggca

SEQ ID NO: 88699 - DNA, 486 bp, Triticum aestivum
  unsure (1)..(486): unsure at all n locations
  Clone ID: PAT_TA_88699
caagggcccaaagtgatatacaacacaaagctcaaattcaaagcctctcgagctacacccaaagaaacaatggcgtccctggccggagctgtccaactcctgggtggtcacgcagctggtcgtctctgcgctgacgctgttcctaacaatggaagcatgtagttgcttttgctttgcaagatccgatcctctacatcaaaccacgtccttattccccccgctgatgccgcggaccgctgcggtatatcaacactaagccgtggaacactaaaactcaataatctcgaagccttattagtcatcgagttgcagcagcgacgtgcaagctatgaaagttgatgacaacatctccaaggnttccggattccaaggtccatgggacatgatgtgctccgaagcaatatacttgatggggacaagagggagccggacgaaatctancgttcgagcttctgaaagaacaatcaatgggaatttctcccgaan

SEQ ID NO: 88700 - DNA, 480 bp, Triticum aestivum
  unsure (1)..(480): unsure at all n locations
  Clone ID: PAT_TA_88700
ctagtctcgagtttttttttttttttttttttggtaaagcgttgtaacctctcgagagaggccgcgtttgaatttattgaaggggaccgataactctggtcaagagatttacattgtcacaaccgactcatatctctagattaataaacacctaacctagatacgtgtaggtttataagacaccctacacaagttacatgactcttgttggcaccataacacatctaacaagcacaacaagcaaactttaacattcaaccaagtaacgagatacattgacttcaccttatagtgatgatgatattctcaatgagaaagcatggacacaagaaaattaatagnataaaattaagttctgcatccctccttatttggggtagctaaagtaagcttaattttcctccaatgtttctgggaccgtttgggccaagttaacaacaagagatgncatagacccttggcaagatnacttaatcaagg

SEQ ID NO: 88701 - DNA, 490 bp, Triticum aestivum
  unsure (1)..(490): unsure at all n locations
  Clone ID: PAT_TA_88701
gagacgctgcaatctctgtgtggntacggggtcagcgagcanataacgagacggagccgtcgtgaggntgcggntgcgcccggngattcccccctccccgcgcctagcccccaccaaatcggnagcgtttccattccattccgccagaggcanagcggnagcgcgagcgagttttggttggtggncacaaacacacaagacgaacacggnggtacagatggngtccccgtcctcgtcgctctgctccaacctcgggtaaccgcgcgccgcctccctcggngnccgccgccgcgccgggttctcctcngtccangaagctattccaantgaaggnatcaaagggcgacaagtttctccaagaagtgacatcaattgtgtccccttccaattctctctggcaaacnttcgccaaagtttggtggaaaaaaggnaaaaacttgtgggnggngggcaaagaatgttacctgggattcaatgtttgatgtcaagg

SEQ ID NO: 88702 - DNA, 467 bp, Triticum aestivum
  unsure (1)..(467): unsure at all n locations
  Clone ID: PAT_TA_88702
gggacttatgtcaccacaaacagaaactaaagcaggtgttggatttaaagctggtgttaaagattataaattgacttactacaccccaagagtatgaaactaaggatactgatatcttggcagcattccgagtaagtcctcagcctggggttccgcccgaagaagcaggggctgcagtagctgccgaatcttctactggtacatggacaactgtttggactgatggacttaccaagtcttgatcgttacaaaggacgatgctatcacatcgagcctgttgctggggaagacagccaatggatctgttatgtagcttatccattaaacctatttgaagagggttccgttaccaacatgtttacttccattgtaggtaacgtatttgggtttcaaagccctacgtgcctctacgtttgggnggatttacnaattccccccacttattcaaaaacttccaaaggccnccc

SEQ ID NO: 88703 - DNA, 499 bp, Triticum aestivum
  unsure (1)..(499): unsure at all n locations
  Clone ID: PAT_TA_88703
ttttttttttcggacggngggagtaagtagcattattatacctgaccaatcaagtgatgttcaagacagcatctaacactttatatacactctcaaccatgtctttttttttttttttgcaaactactctctccgtataaaaatatatgacgttttttgacacagtcacagtgtcaaacagggagcacacaagaaaactctgcctgtctcttctgtatgtgctgattaaatcttctcgtgtgctttctttttctctctatcttaaactgaacaaaatgttgcatgggtcttctccacaagctctgctcccctgcctgccactttaccaaaacatgtcctgcactgagatggttaaaatactcaaatgccgacgggcgtccaaggagctcccgagtgctgcgccaccgangaagaacgtgttgggngacnaatggccccngctgggnnggcaacgcngggcangcccgattnccnggggaaaggngggngcccccncanc

SEQ ID NO: 88704 - DNA, 284 bp, Triticum aestivum
  unsure (1)..(284): unsure at all n locations
  Clone ID: PAT_TA_88704
gaaggcggagcatcccggacggcgtttgctgagtttcttatagatctttagagcctgatatagaacttcgattagattatcgtcgtgttacagttttgtcgaatcatatcacgtgaaatgaaaaaaaacataacttagattatcgtcgatgaattctgacggcgaggtgatcgctgtcgcggtgacggcaaggtgatagccgtcgaaccgcgacagcaatggccatgttcanggggggaggaagaacttgacccccttctcaaatatgatcggnattccataca

SEQ ID NO: 88705 - DNA, 362 bp, Triticum aestivum
  unsure (1)..(362): unsure at all n locations
  Clone ID: PAT_TA_88705
aatcaactttgattctctanaaaccacnactgtgngaccattaacacggttaangctaaacctgcttgangtccacgcaaananaggtatcctttcnacaactatactagcatnaataccgaatttaaacgggaaanagctaangtnaantttatctgacatagancactcatatcganaaaatggggttgggacnatttaccaacaaaaaaaaagggggcaccctgcccttttttaaccaaatgccgaatcgacgacctacgtctaaaaaacgagaaattttttggattttgnanaanaaaaacanagaaattccattanttttcactttcccnntntaatttanntnagctttntcccta

SEQ ID NO: 88706 - DNA, 473 bp, Triticum aestivum
  unsure (1)..(473): unsure at all n locations
  Clone ID: PAT_TA_88706
ctccctttctcctacggnggntccccgactctcctccgccgccgcccgctaaaccctaaccccaaacccctgaccacgcgcgccaaagcctcgcctccctcgtcctgcccggcgacgagcgctcgcctccgccttctccctcgcgccgcgcgccgccgagctacgggggcggcggatctccggggacgatcgccgccatcgtcaccgccctcggcgggggccccgcggccgtcggcatcgtccgcctgtccggtgccgacgccgtcgccgtcgtcgcccgcgtgttccggccggccaagaaagagccggcgccctggagggcccgaagccacttcgtggagtacggggtccgctggacggagatgggagcgtcatccaatgaagtgctgggtgggtgcccatgctggctccgaggtcctaacacccgaagaaggatgtgggtgggaagctccaantgccatggggaacgaact

SEQ ID NO: 88707 - DNA, 569 bp, Triticum aestivum
  unsure (1)..(569): unsure at all n locations
  Clone ID: PAT_TA_88707
ggttcgtaagnctggggggtnaaatctgaaaaangggtgggaggatgggaaaancactcctgaagaatgngggaagagaacaatgatgagcgggaacaatgggcgccaattggcgacaaagctccccaaacaaaaatctgtcaaaggtccacgatgangggtccatttnccggncaaagccaaaaaaaactcttccnggcggggcaanaaantcctgtttaacaanaanccctccnggcggggggggngaaaacccncctgatngtgnctacctggggggnggggaacaaagaaagattntcaaacccaagcgggtccttggctgggttgnnaanaaaaatgccctgggggccttccntcccaagtggggtccgaaccaacnaaattttttgggccaacccgnatcaaatttttgggccttggtccttggnaaaggggggtggtncaaaattccgggnngggggccaaccttccccaagggaaagggncnaaaggggggccccccttcctaaaagtgggcccccncngngggggggttancaaaaaaaaaatgggntttggaaaanaan

SEQ ID NO: 88708 - DNA, 488 bp, Triticum aestivum
  unsure (1)..(488): unsure at all n locations
  Clone ID: PAT_TA_88708
gctatatacctacatagtacaaccatggcccccaccgtgatggnctcgtcggccacctccgtcgctcctttccaggggctcaagtccaccgccggcctccccgtcaagccgccgctccaacggggctagcctcggcaagcgtcaagcaacggtggaaggatcaggtgcatgcangtgtggcccatcgagggcattaagaagttcgagaccctgtcctacctgccaccgctcancacggaggncctcctcaagcaagtcgactacctgatncgctccaaagtgggtgccttgcctcnaagttcaacaaggntgggtttatcttccgtgagcaaaaacgcatcccctgggtaatacgatgggcggtactgggacaaatgtnggaactggctatgtttcgggtgnaaccgaccgccacccaaggtgaatnaaacaaaggtgggggggagggtcnaaaaaaggagttaccctgaacgcctatgttccgnaat

SEQ ID NO: 88709 - DNA, 499 bp, Triticum aestivum
  unsure (1)..(499): unsure at all n locations
  Clone ID: PAT_TA_88709
tctgcgccacgttcttcacgcgctgggcagcgagccggcagatcctccatgcttcgcccgccgctgcgcctccgacctctcctcctcctccccgcccagccggtaccgccgccgctgcttcccgccgaataatccataataaaagtagcccccgataaaacgggccggccgcctccctcggccccgacccgcacgccacgcgggactcacccanccaccctcttcctccccctccctcccatcttcctccctaggatgngcgcctccccccggtctcctccggtcggaaccctanccaggcgtgcangngcgcanacangnggggggnccccngcggccgnngccgatgggngangtcggggtanctgganngctngcccaatccttcgcggnggctccggccgccgatnnggnttccgtntantnaaatcaacgggtttttcttctngccggttgccgggctggggtcggtcctccgcccaanggcnggccgggggtt

SEQ ID NO: 88710 - DNA, 458 bp, Triticum aestivum
  unsure (1)..(458): unsure at all n locations
  Clone ID: PAT_TA_88710
ccgctactcccctgcctcccccagagctcgttagggttttctcctttttcgggggaaaaatctcaagaggnggcaccatgctcgtgtaccaagacaagctttccggcgacgagcttctgtcggattcgttcccgtacagggaagctggagaacggcgtgctctgggaagtcgacggncattgggtcgttcaaggagcaattgatgtggacattggagccaatccctctgctgagggtggtggtgatgatgagggtgtcgatgaccaagccgtgaaggnggttgacattgttgacaacttccgtcttcaagaagcaacctgcttttgacaaagaaacaatttatctctcacatgaaagcgctacaatcaaagaanctcctctgccaaagctttgaaaggggatgacctaaatgttttcaaagaaanaatgttgaagtccggccaacaaaagtatcctcc

SEQ ID NO: 88711 - DNA, 488 bp, Triticum aestivum
  unsure (1)..(488): unsure at all n locations
  Clone ID: PAT_TA_88711
aacaacaccttcaatgcatccgatgctccagcttggttcaacgctttgccgtctttgacttcattatacctagagaatctgcaaatcggcgggcaagcttccgcaagaacttttcgccctttctgcaattcanacactgaagcttcggggcaaccgcttcaatggnaccctaaatattgggtcagactttggtagccaactccaaacaattgatttgcagggcaatcaaatcgatcagctcactgttgggggaanccaatacaacaagaaactcatactttttgaaacccantatgcancaagggaacaaagagcaatactgcanaaccggcgacacaaatccaacccgggggggccaccaaaantctaactttctaaanaaatgctccggggctggcaancgaacatgcctccccaaagccaagcttctgaggncccaaagctggcacatntggntgtgnncgtacaaaagggacactggttcttcn

SEQ ID NO: 88712 - DNA, 476 bp, Triticum aestivum
  unsure (1)..(476): unsure at all n locations
  Clone ID: PAT_TA_88712
gcaagctatatacctacatagtacagccatggnccccaccgtgatggnctcgtcgggcanctccgtcgctcctttccangggctcaagtccancgccggnctccccgtcagccgccgctccaacggngctagcctcggcagcgtcaagcaacggtggaaggatcaggtgcatgcaagtgtggnccatcgagggcatcaagaagttcgagaccctgtcttacctgccaacgctcaacaaggaggncctcctcaagcaagtcgactacctgatncgctccaagtgggtgccttgcctcnagttcaacaaagntgggttcatcttccgtgagcacaacgcatctcctgggtactaagatngccggtattggncaatgtggaaagctgcctatgttcgggtgcactggcgccacacaaggtgatnaaacaagtggggggagggcnaaaaaaggagtaacctgaacgcgtttgttcccatn

SEQ ID NO: 88713 - DNA, 527 bp, Triticum aestivum
  unsure (1)..(527): unsure at all n locations
  Clone ID: PAT_TA_88713
gnttttttttttttttttactgnaatccgcttancaagtttcttgggtgaattccaataanaacaaagggaagcnccaaaccgggagggaatggagcctgagttttanatatacaaatgcaaaagcaaatttgggggggtcctggtaatgatcgaancccgantttaaggattaaggtacaagggcatcnaattataaagaangatactaagagaagcaaaagntatcgccaatggnnggcgcccttcnatcgtggggttnaccaaagtggatcaaatttgccaaaaaggtaaanccaacaaagggcccgtttggcctngtatgaaaaggnccgcgaatgncaaaaanggttaangnngctggcnccctccttggccgtncaaggntggcaaatgggccaagaaggaaaagccaccccctangggctttgggcaaggggnaacgcccnctnaaacccttccacngnaaaaagggggtngnncccttgggnccgccaaagggnaagggttcccccnggccnggggggg

SEQ ID NO: 88714 - DNA, 256 bp, Triticum aestivum
  unsure (1)..(256): unsure at all n locations
  Clone ID: PAT_TA_88714
gcgggtgngcggggcgctctaanaactaattggggattcccccggggctgcaaggaaattcggcacgaaggggtacaataacaaaaacaangggtncccctgactccccaagacttgtngggnggccaaaagaatgtngaaagaaaaaaagccaatggggaagcaaanaaggggtcggtccncaataaaccncnggggantccgggatntncccccctgttggctggatgntacnggaaaaggggaaaatttttcc

SEQ ID NO: 88715 - DNA, 489 bp, Triticum aestivum
  unsure (1)..(489): unsure at all n locations
  Clone ID: PAT_TA_88715
gttctctccacctattccacctcctcccttcgcttatatctctctctccacccccaccctcctcctccagaaaagtcattttttantccgggttcccgtcgaagcttcnaggatcctctcgcccatccgcgccgtcgggcgcggggcctccgcacgtcgaggngggcgtccggacccttcactggattgaactaagaaagctcgcgacagtgcctgttgtggtggcagtggcactaaacagctggaggaagagcccccntgatcaagggtgctctttgtgatttttgcggggagnaaagggcaacaatttattgccgatngggntgncgcatccttatncttatcgtgcgaacgtaatgtgcattcggctaacaacctttcccacgcgaaatangaggacccttctgtgtgntcggtgtgnttcacaaacagcaagcantccggtggtctttgnngagaaaaactcactttgccaaaaaatggtgngtt

SEQ ID NO: 88716 - DNA, 361 bp, Triticum aestivum
  unsure (1)..(361): unsure at all n locations
  Clone ID: PAT_TA_88716
gncttctggaggtgcanctggtcgacnccaagggcctctccggcaccgntttcntcggnaagatanncccgtatgtggtggngcantaccggagccangagcgcaagagcatcaccgcccgagatgccgggaggaacccgatgctggaacnatgtgttgnggtttcagatcaactccnccgctgccaacgggcaaganaagctcgtcttccggctcatggancacnncaccttctcccgngacgntttcctcggncaagcaacnatcaatgtnnntgatctgntcancatncgcatggagagcggnanctcgcggntgaacccggncatntacagggtggncacccgccggnnaactcgta

SEQ ID NO: 88717 - DNA, 509 bp, Triticum aestivum
  unsure (1)..(509): unsure at all n locations
  Clone ID: PAT_TA_88717
gcangctttgactccatcgcctctccctcctcttcgtctccgggcgggcaggtagttaacagctccagcagccatggggaaggagaagatncacatcagcattgtggtcattggccatgtcgactctggcaagtcaaccacgaccggncacctcatctacaagcttggnggcattgacaagcgtgtgatcgagaggtttgagaangaaaccgctgagatnaacaaaaggtctttcaagtatgcctgggtgcttgacaanctcaaagctgancgtngagangggtatcancaataaataatgctcctgtgggaagttcnagaacaacaantnctccntggcactggtcaattngtggctcctggggcnaccgtnggtttnaatcaaagaaacaangttcactggggancctcccaangcctngaattgtgnctggtggcttatcaaattnactccnaccaactgggnggggttttgagggtnggnatccncaaangnttggcaaaaccgt

SEQ ID NO: 88718 - DNA, 232 bp, Triticum aestivum
  unsure (1)..(232): unsure at all n locations
  Clone ID: PAT_TA_88718
ctcggtcgatctgtgancatctcaatcnagctgcatctgcaggtgnnctaataatanaccnaagctgagcttgcgtgtaccactgnacgtatacgcacatcaaattaatctgacactaantaagttatcaggngcggggagagaaaaancnacacnatgggttctgntttctnanccaccgattggtnctccggcgtcgancccgaccaccttcctcnggnaagaaagtggg

SEQ ID NO: 88719 - DNA, 411 bp, Triticum aestivum
  unsure (1)..(411): unsure at all n locations
  Clone ID: PAT_TA_88719
ccatttgcggnttgcttgctagctccaaccannccaaaaaggggnanccctccctctcgcatcgcacactcgcatacccacctanctagctctanccactanaagtgagntaagccagtcctacctctgcaanaagaagcacttgngggccagctactcgtaagcaagtccatctctccgatgagaaggcaggggngnaatgagggctccccgtcgatcatncacacgtcctccataaccctcctccangagcggntcangaacctgcagagggtcaaggagatgcnggaggggagggaactgcancgggtggatcaatccgccnacgccgncgacgnngccggggtcccccngttgncgtccgngncctcctggntnctttgncnctgcangccggaccggcgggccnaa

SEQ ID NO: 88720 - DNA, 369 bp, Triticum aestivum
  unsure (1)..(369): unsure at all n locations
  Clone ID: PAT_TA_88720
ctcgagttttttttttttttttttttttttttaaggtaaaaaggaattaatttactggaaactcttanatttgtacatcactaagcacctagtcgactctctctctctctctcaaaaacaaagaggagggaaaacatgtatagacaggtgacaccaatgtcgatggtggctagctacttctccttttgttcttacctctgccaagagcttcatgtcgttgctgttccccttcgctgccatccccagcgacaggggcaacactggcttctcgtcgaccttggcttcttgacgggctgaccgacctcacctttcagggctgccgtcccgacataccaccactcactctcaagttatggtgtcggggggggc

SEQ ID NO: 88721 - DNA, 478 bp, Triticum aestivum
  unsure (1)..(478): unsure at all n locations
  Clone ID: PAT_TA_88721
gtctcgagttttttttttttttttttcggtgtacacttgccatttcgagaacaggcttaatttacagtanattgattaaagaagactanatttagagctaacttgtgtatgacaagaagagaaaaaaaggcaaacacttggatcnatnaagagctctaagctaactagcatggnaaatcggaagcaagcaaccatggaggaaaaaaacgctagctanctaggtcagcgcgaagtccatgcaccgcttcttccaagaccgcgtgcaccggagtgggcgccgctacgtcggcgtccctggatctcttggtcatgccgtagttctcgtgctcgggcgcatgcctcggcnccggcgcggnganaangtcgacgccgaagagacnacggtcctcaccacgggtgccggngacggggtggtcgccgtccccttggtgagggacgtcntcgcccaaggtcntgggtcttggcccncaannttgan

SEQ ID NO: 88722 - DNA, 569 bp, Triticum aestivum
  unsure (1)..(569): unsure at all n locations
  Clone ID: PAT_TA_88722
aacgaagggagcaatcaagtgcattgtaaaagttccagggagtccgctgaatcatttttgcncanaggatgaacgtcaagggnccttgcgctgggaanggaaacattgtggaaagaacctccatttgggcggctaaccgaaaaaaagnatacacaattcctggcttgtgattatcanggaaancantgtatggatgtacaaggaagcttcgctcaaatttgcaccaagctgatacgaaagcaactcttttgggtantccgctcantaataactccgtataccccnatggggnagtggaattttggatggaattcaanaaanttgntnccgnggacaacaactatgtggaccggnttttgcaacggatatgccggngcaatccantttgggncattatttgggaaaaccanctgggcaatttattttancggagtccngcaactaaaangggtaaccacttcaattggaagntggtggtgcctcaaacgcaaataattccnnccggaatattnccntcaangntaatttcctgggattcnatgggggtggggtcccnaaatctggaaggc

SEQ ID NO: 88723 - DNA, 458 bp, Triticum aestivum
  unsure (1)..(458): unsure at all n locations
  Clone ID: PAT_TA_88723
cttngtactcgcctctctccgcgcaancgagccttcgccctcctccttccccatttcnncagcggggnaggccnccaancaaccccacccgccggcatganggagggaatctcnattcatatnggtcaggccggcatccangncgggaacgcgtgctgggagctctattgcctccagcatgggattcancctgatgggcagangcccggtgacaaanancgttgggggaggnggtgatgctttnaacancttcttcancaagantggtggntgggnaaaangncccccgngntgtcttcntngatttctcancccactgttnttgattaggnggggggatggggnttattgccaggctcttcnaacccngangagcttnttaaatggnaanggaggntggaaccaacaaacttctcccgtggggnattataccaatgggtaaagggaggattggtggt

SEQ ID NO: 88724 - DNA, 477 bp, Triticum aestivum
  Clone ID: PAT_TA_88724
gtcgaatcggcgaaggactcccgcttgagccgaggggccatgtccgggattgggctccgccgggctggtactgggttgtgctaccttctggtgagcgcagcttagtaaggagtcagcccgtcgtcgacccagagcttctttggtggcggtcacgtgggcctgcattggtgcacaggcttgagtcccccgtgcaggtggtacagcaccgtgtcacgaaggaggatgcgcacgtccagcgctacatggttgcgttggcggacggcaggttctccaatacctggcagattctttgaggatctcatcggagctatgatcctgtgatggttccttctctttgggtgtccaccgcggcctactgaacctagaggagctattatttgagatgtattggtgatattatatgatgatctttgttacaaactactatatatgtattcgatgatggattattaattacctattaggtatttgcttatt

SEQ ID NO: 88725 - DNA, 476 bp, Triticum aestivum
  unsure (1)..(476): unsure at all n locations
  Clone ID: PAT_TA_88725
aagcattgcagttgaactgttgggatagaagtgagcttgtagggatttcaagcaccacataacgtcatgcacagccatctgatgacttcatctgttctgatattggatagagggcccaatgaagagggtgtgctggggaatgtgccncatttttcaatttaagagtcncattgcagaggtggccctacatctgtagcatagctgttacaagcagtctattgaaggntgttacttaccgataaaggtggtcagaaaaggtgtaccgttgatgtttctggcgctatgtgaactgccaatccaaagacttccagcgaagtacagttcaaattgctctgactttagtcattaatagtagtacgatagaagttgcgactttctttgtgatgccttgaaactgtttgtcgtgtactattctacccaagntgattgcgccaaaatccatgtgttgtgatcactacaaaaaatttaagggtagg

SEQ ID NO: 88726 - DNA, 496 bp, Triticum aestivum
  unsure (1)..(496): unsure at all n locations
  Clone ID: PAT_TA_88726
ntttttttttttggggggaaactaccaaaatcaccttctttttttttatcaaatcatcatatggaaagatgacttcgcaccacacttgccacttggtaaaatcacattctcatcaagaaaaaggctttcaaagaagcctgggcttcaaactatcgttcatcacctgagagcaagcatgatgaaccaagtaaaaatgaaaaagaatctatacgcatttaaaaaaatacaacaatctactactcagcatggcattaagcctggacggtgcttcgctccggtgccacctctagcatcgacaaaaggtcggaaaccacaccgctaacagggacaacattcacaaagcggtcactgggaaccattgactggcgtcttggncaggactgaaacttcaggacaggctgacaatccttcaatcaacttggnccatgtttttccttcctcgttgagatcggactctctcaagagantcagtactttatctaggggagcgacattc

SEQ ID NO: 88727 - DNA, 325 bp, Triticum aestivum
  unsure (1)..(325): unsure at all n locations
  Clone ID: PAT_TA_88727
aaaacgttaacaacccaaacangggcctctncaatggaatncaangagggnccaagangccccnctccccnccactaacccaatgannccaacaacaacngcggcatggtncaactncaagatncaaccccctccctttntggcggtncctcggctccccnctccccgggcggcggcgccgncgggcggccccgcctggcctcgccgtncgcttccaantggggaagattcccccgacgtngataaccgatntngtttaaangaggagggggtgncgttnttggngtctccccggggcgccggggncgcgggttggtggtacgtt

SEQ ID NO: 88728 - DNA, 485 bp, Triticum aestivum
  unsure (1)..(485): unsure at all n locations
  Clone ID: PAT_TA_88728
cttctctccatcgatacaacaagatcgaagatgatgcctgcaatgggaaaggatatacacttcggatcatcaattggtggcgctggtggcacgaacactgctaatggtggtaatggtggcaatattggtgctcctgcctcgcgggccgactcttgcgccaagccgcagcaggagctaccatctctgacacatcagtatgcggaacaatacgtgtatgcatacccagcaccaccggcatacggcggncctccaaagcccccgccggcgtatcgctatggctatgggtatggtggaggtggttctggtgggtacggctacggctacggctaccccgagcccgatggtatttgggatgaacctgctggggcatacggcggcggcaagataccaaccaacacagccgcccgtattatcatggcggcggtcgtggnggggtaacccttctcctcanttttggtcnttggagctgggtggctggtaaantn

SEQ ID NO: 88729 - DNA, 178 bp, Triticum aestivum
  unsure (1)..(178): unsure at all n locations
  Clone ID: PAT_TA_88729
cgnccctcctcgcgcgtcgtgntccatccaacccaagtgantaaggncgccatgtcnggctccgaggnccaacaattccagtccaangcgggcgcgggggcgtccaagacctaccctatgcaaggcggngncatccggaagggngggttcctcntcancaaaaaacgnccctgcaagg

SEQ ID NO: 88730 - DNA, 257 bp, Triticum aestivum
  unsure (1)..(257): unsure at all n locations
  Clone ID: PAT_TA_88730
cgagttttttttttttttttttatttcggttcttttttatttaaaccttctcttctttatctttagntttatctacttatcaatagnatctaccggctcgaactcnaatttgatcgccttccanacttcanaagctgngggtagntcangactccanttgcaagctgntcggntaatttcantaccttcncgagnaagatngcgcccttcnntacnagcttgnacacanggttctaaagncantcnattanctggtg

SEQ ID NO: 88731 - DNA, 301 bp, Triticum aestivum
  unsure (1)..(301): unsure at all n locations
  Clone ID: PAT_TA_88731
aggaggaatcccggnctcctggttgcaaaacaaagaatccatccanctggtcctcctcaatcgagatntccgcaacgngggcgggctcgtggtgaggtgagtgagtccaccgggcatggggttcaangggctgggctctcgtcccaaaaagggctcgccgtcgncttncgtcgcgcaaaagggnggggcaacaaatggggnancgcccggtgggggncaatgggctncaacatnaacgaggtcaaaaattgncaaaaaagcccttatgctnccccaccgcgangggggaatctccangtca

SEQ ID NO: 88732 - DNA, 515 bp, Triticum aestivum
  unsure (1)..(515): unsure at all n locations
  Clone ID: PAT_TA_88732
cctccacagaccccgcccctgcctggcctccttctgtaactcctccgtttctgcaacccaaaagcaccatccatctccagcaatgtccattcccgccctccgctccttccccgccgtctacggcgtgaagccgaccgcccgcctggtccgacaccattcccggctcggcggcgggctccgggccaagctccgtcgccgtgaacggggaagtggggctgagaaacaggagcangaagaaagaggacgcggtgaagaaggagaaggacaagaggactggagcccctctacnacgatgggttcggggggcggtgaccgtcaaaggactacttcgcggccgccanggccctgtgnaagggacgacggaaggggccgcccgcggtgggttaaccccgtcnagtgngggcaanccggcggtggagggaaggcgccccctggctggctctttttggncaagnaaantgattggtgttggggatgggggntcaaatctggaacaanaaagncttttggggaaa

SEQ ID NO: 88733 - DNA, 283 bp, Triticum aestivum
  unsure (1)..(283): unsure at all n locations
  Clone ID: PAT_TA_88733
aaattttcccctccccgcaagcccggtccctcctcagagcccgcactngtagcccgancggtcggttccaccgncgtgggctgtagccgccgtcgctgncatggnnaaacgaaagngtcccccaagtcnggtgngatcccgccctacccnnaggtgagtttntcccagnttttgaagctctggcntcaagtgccttcnggcggtagattcgnncggggnggggcaacaatttccangttttgggcagtaagatccatctcccttgncngcncgcgcgggctga

SEQ ID NO: 88734 - DNA, 158 bp, Triticum aestivum
  unsure (1)..(158): unsure at all n locations
  Clone ID: PAT_TA_88734
agtgaggggttcgcccanccgccgtctccgacngatggngggagccatccggngcccggcgaggctggggggaaccggcaagaggtcaacaaaaagggtataagnaagggaaaanggtngcacgattccaantanggggnaaaancccccaaaacttt

SEQ ID NO: 88735 - DNA, 206 bp, Triticum aestivum
  unsure (1)..(206): unsure at all n locations
  Clone ID: PAT_TA_88735
gncggttcgagctcggatctccccctaantgcagcgaccggngacggggaccgggcccgcgagcactccgctctatcccccctgattgcagcgaccggcaacgacggattgaaggaggncgccccacnancggatctcggntncancgcancaanccgcccgcaagcctttccccactgattacancgaccggngncaantctcgg

SEQ ID NO: 88736 - DNA, 276 bp, Triticum aestivum
  unsure (1)..(276): unsure at all n locations
  Clone ID: PAT_TA_88736
cttcatttaagtanagtgtgtangagaagtgggacaaatgaacagagagtatcaataaagctagatgccccttcttcttcttcttcttcttcttcttcttcttcttcttcntcttcttctccttcttcctcctcntcttccnaattaatctcttcttggnaaatagtcatccacaacttaatacattggactttaantgattccacatctccttccaaatgcttgggatgtaagactcaacatgntttccttgnatggttctaatttggggggggg

SEQ ID NO: 88737 - DNA, 448 bp, Triticum aestivum
  unsure (1)..(448): unsure at all n locations
  Clone ID: PAT_TA_88737
cagacacgccgctgcttccttcccttcccctttccccacctgcgtgcgagcgggcacccagaccaancgcgtccagatncggtggggcgntctctcccgcccgtctccccatggagggcggaggcctggtcctggccctcnnancggggctcgcggtcgcgctggcgggggnaaactccnacggcgnngcgctctcggngntgcgnggcagncngcgggancccggcggcgngctgcaanngntgggagcccaccctcgtcaaacnctgcaantggttncangtcacctgcgagcgngagaancgcgtcacccnccctanatcntnggancttgcatttatcttggncaactgggcgggcgngcttggtnnattggaggattttnnttaactggngaangtttnntaaaataanattgaaatgaanggatnccatcggaaactttggg

SEQ ID NO: 88738 - DNA, 518 bp, Triticum aestivum
  unsure (1)..(518): unsure at all n locations
  Clone ID: PAT_TA_88738
ccgccgccagcagctgcgcaaagggtcgacaaaccctaaccctagtccanagctagcttagcttccttcctctcgatntanctngagccatggggccgaccaagggngagggggcgggcatcgggatcnacctcgggaacanctactcntgcgtcggggtgtggnancacgaccgcgtccagatnatcggccaacgaccangggaaacgcancacgccctcgtacgtcgccttcaacgactccgggcgcctcaacgggngatggcggcaagaaacaagtccncatgaaacccaacaaaaaccgtcttcgatgngaaagcgtncttattgnaaaaaggtttgctgatgcccctggnccaacngtggtattaannatgtggggcgtncaaaggttattccctgggccccgcaagacaangcctaatgatttgtnagtggaanntacaaanggggggagggggaaaagcnangttctcaacctgaaagaaaattttttccaatggggccctcaaacaaaaa

SEQ ID NO: 88739 - DNA, 527 bp, Triticum aestivum
  unsure (1)..(527): unsure at all n locations
  Clone ID: PAT_TA_88739
cccagcacttgattgaatctggagtccacacaaaggctgcagaggaggaacaagaagcactaagttgcatccagatcaggagataaaaaacaaggaacaagaagcacaccaacggcagacaacagctcaaggaaaggagcacggtaactggcgacatgagatcggactgaattaatttggnatttttaacttctctgctataaattgtgcttcaggccgcagntctcttagttnccttcttgcgctatggngctaatcaattaacgtccctccgaaagccattaaaatccctcnggcctggncccctgggtacnggngccaaattgatgctgcaaaagaatttaagaccggggntcangcaaaaaagaaaaaatctttagggtttcacantgtnnggattttggcaaaagaacgaagcggtcccgccantggcataatttccnaatgggntttgcatngctgnnggtccccnttgggggtggggagaanggaaggnggggggaannttcaanaaccccctggggntg

SEQ ID NO: 88740 - DNA, 410 bp, Triticum aestivum
  unsure (1)..(410): unsure at all n locations
  Clone ID: PAT_TA_88740
acgaagctccgtggcggcgagccctggttgctgggggaaagaaaagccaatgggattctggtaatgttagcttaatccaaatnagaccctaatttggaagangggntcccggttaccnaacaangtttnacttncaattngtaggggaaaccgnaatttggttttaaaaaggccctaacgtggcnctacggnttnggagggatcctacgaaatcccccctaacttaatncaaaaaacnttccaaagggcccncccaangggnaaccaaagttgganagaaaaaaagttgaacaaaggnatggggccccccctttaatgggggaatggncccnattaaacccaaaaaattgggganttanccgcaaaaaaaaaattattggnaagaagcggtggttaatgaggtgggccca

SEQ ID NO: 88741 - DNA, 472 bp, Triticum aestivum
  unsure (1)..(472): unsure at all n locations
  Clone ID: PAT_TA_88741
ctccaagtcctccactccgcgatgcggggggtangggntttggtcggcgtggccgtgtcctgntcggntccgggcggncaacaactcantcanctcantccagtggtcaacaantccactgtcggcatcancanttcttccgcanggggncncgtcngaggggggttcnatngagatggncaaagatcaanattgtnntggggatggnggcgccgacccnccnnaagccaatccggntccggcaaccnnctggcgttaanggggggggggggnatgattgatngtcaagcaagctctttaaccaactnttttangggcacacctttatttggtngggggngttttanccaanaantggggcngccaaaaaatggntcanaaaacaatgggggggtnanggaattctnaccaaacaaatntggggggnaactttttttctcaaacaaaaaaaattcccngggggccgggaatc

SEQ ID NO: 88742 - DNA, 239 bp, Triticum aestivum
  unsure (1)..(239): unsure at all n locations
  Clone ID: PAT_TA_88742
agccgtcctcctccaccttgcctggggtccgcctcctccanctctctctctcttctgngncaaaggacantccctcnttgntgggaccccgccctgngttcgcctccgccanacncttcctccttgccgncgacgggagnggtgtgaactggagnaangnccgtgactaaatncgatganttgaccgggctgggtccangcngaggnaaggacccccnccacancaacaacngnggggg

SEQ ID NO: 88743 - DNA, 494 bp, Triticum aestivum
  unsure (1)..(494): unsure at all n locations
  Clone ID: PAT_TA_88743
ggccgggggtcgncgcggtgggcggcgctgctgctgntcctcctcctcctcgccgncgnggggcgctcctccgcncatcccggggcgtgnccggtgcccgccgcggcggaggccgtctcgggcctccccgcacctgctccccgctggatcgccgccccggcgacncggtcggcgtcatcgaaggagangangctacattgngcnagggcaagtcaatcttctttacttgaacanagatgagtanattgctgtgnntttctangcntcatgnnggcccgttttcacaangaggtgcaaaactaattttcgagaaagttngggtcaacctantcccaacctaattcgggcaatttttgcaatctcnnaaggaatctngncaaacttanggcccaagncatnnatatccnaagagtatngggatttcatggantntatccaaacaaattnttttctctcctgnangtctnaataaatgnccaaantggcgtgtaacc

SEQ ID NO: 88744 - DNA, 360 bp, Triticum aestivum
  unsure (1)..(360): unsure at all n locations
  Clone ID: PAT_TA_88744
tttatcagaaaacgtagcgcattcaaagtctgatataagtatcanaatgtgggaggnatttacaatantcanttgtccatacccatgtcattgagtaatactcaatcactactacagaccaaattgggtnacantttnagcgccagtctatgatcangtgagagatacatcnccanttcntgggctgggnggtacaanggacaaacagaattgccccnaccanatcttgnttggntagacagaaagancngcaacaaaaggcctggggacagnaatcctacaaacaccantttgtggggggggggtcnatcntggggaancngactcccacactgntacacantgnggggaattccaaca

SEQ ID NO: 88745 - DNA, 493 bp, Triticum aestivum
  unsure (1)..(493): unsure at all n locations
  Clone ID: PAT_TA_88745
gcacaatggaaaattcaatgcatatacctactcaacaccaggatcaagcagcagcacgttgagtgaaactaacaaatttcagtcactgtctgctggatttttttaagccataagagtaaggaaagcatctgaatagatctcagtattcaaaattaaaattaacagacctacaacatgcatgtttatgtataacatgtctgcaagcagtatcttttttgaggattacatcaagacttaggccaacgncaaggctgcattgttttccttccagagctgatcatggagttggtccgggacaccatacgcanccacaagggctccatgaggctttaacatcattggctaagttcatgagccagcccattgtttggccctcttgacaagttctgatgtgataatgcagaatcaagcccctagctcatctccccactggcgtngtcgatctccaccaccaaagggaggctcaaaatacgttatacaattccttcaatcc

SEQ ID NO: 88746 - DNA, 177 bp, Triticum aestivum
  unsure (1)..(177): unsure at all n locations
  Clone ID: PAT_TA_88746
gcacaatgnaaaattcaatgcatatanctactcancaccaggatcaagcancagcacnttgagtgaaactaacatatttcacgtcactgnctgctggatttttttagtcanaacagtaanggnaagcatctgaanacatntcaatattcaaccttaaaattaacanacctataatca

SEQ ID NO: 88747 - DNA, 236 bp, Triticum aestivum
  unsure (1)..(236): unsure at all n locations
  Clone ID: PAT_TA_88747
gatccatccaccccagaggccaagaagagaggagataganagagaggccggcggcggcggtggaggaacangcgatcggggatggtgcgggnngcnaaagtcgagttcgacgagaggccgccggatgacttntaccccaataacccgtacggggacccggtggtcgatgntggnagtanagggagcaactgttgcgggagaagtggntccagatttganaccgccaaatnttatcc

SEQ ID NO: 88748 - DNA, 486 bp, Triticum aestivum
  unsure (1)..(486): unsure at all n locations
  Clone ID: PAT_TA_88748
ataacgntanantgtctgannaccatgcagtggcagcanatannaaccaaaaggaggagcancggcaactgcaaccagagtctgtagagaanatggatgctcccagcagggatagtggcaatgttggnacaacattcctacatctaaaccancttncncctggangtggctttgacnaaggncctagcctgnnaatgaaagatgnngacatngataacagttaggaaaaaanttgtgataaattcgngtgttanggattgctgtttcgagcanggtgtaaatgcattnagtcatggtccatnacaatcaatgggcctctgatgaaangtcntgatatttggatggcacattttgattgttantacattgatgattcncaagtgacaaaaaggagtgagattccacctggcagngggggnttcanggganacacatcctcaaacatcattttgtgcnncntgggaggggangccatgcctgacnant

SEQ ID NO: 88749 - DNA, 428 bp, Triticum aestivum
  unsure (1)..(428): unsure at all n locations
  Clone ID: PAT_TA_88749
ccggcatcctcgtgccggccttgaggtagttgcanacaanctccgcgtcccacggntggtcgcantgcatgggccaggcnagaancggcttgccgtggntcatgctctccatggtcgagttccanccacannggntcatgaacgccgccgttgcgctgtgtgctaggatntccagctccgcgtcccacnngntggtcgcagtgcatgggccangcgagaatcggcttgccgtgggtcatgcactccatgggcgagttccatccacanatgggtcaatgaatgcccccgttgcgctggggtgctangatntccanctggcggngcccacccngtgaanaanaancaccgtcccttccgtctgtttgggttggnaatctgacaaagaanttcttttggggggtctcgcccggcctccaccnaatatattt

SEQ ID NO: 88750 - DNA, 478 bp, Triticum aestivum
  unsure (1)..(478): unsure at all n locations
  Clone ID: PAT_TA_88750
actaaattattaatcactcccatctgcactgttcaacgatcgacgacttgagtagactactatagcaggtagagtagagcatgcagtatgcgttcttgtttggtttttattattattatctggaaaaaaaaagtatctcgctcgtcctctaagagtgattagtgattagagatgcaagtgatggatccatatgctagtagcttgtaccagaagagattattatgatgagatgcgctcggctgcttccagacacgcccctgacgtgtccacggaaagctctcgggccttctaccttttgttctccacacnacatattagtgcgtacccacgctatcgtagtaggagcacttagcaatggtacagattgagcgcacagccggtggattcttttccngccaggaagctcgtactcctcnctaggggnagtagtaagaaactattgtcaccgncnccgacggaaggnacgtgggcatncnan

SEQ ID NO: 88751 - DNA, 162 bp, Triticum aestivum
  unsure (1)..(162): unsure at all n locations
  Clone ID: PAT_TA_88751
aaanaaagtctcgagttttttttttttttttttggtgggcngccncctccaangtgcgtgncttcgggtgttcttcctcactaacannaactatgcctcaagttctcaaaatcctttctggcaacgancttcaatangaangtgcctggngataggaaacag

SEQ ID NO: 88752 - DNA, 496 bp, Triticum aestivum
  unsure (1)..(496): unsure at all n locations
  Clone ID: PAT_TA_88752
tttttttttacctccaaacatcatatttaatcatattcgatccaagtatatagtctccacaatacagacaaacttgagatcatgaaattattttccatcataatcaagcttgttcagagagtgccaactgctcaccttgaaagagcaaatgacatctgttaggatcgaaagtatgtgaatcaagtgttcgcagcatggttaagcactcagttcaatacaactccttccaggttccttgaccaaacctttcttgtttagtaagcgtcctataggttgccgccttcttccaattccccaaacaactgngcatattagacactaagacacaagtgaccagaatcttgagggnccaggttaagtaattcctcngatactgnatccatcgaagaatcngcacaatgagaactgtatgcacntactaataggaggcaaaaactgattctgttactgaacagggatcttcctaaaggaactcccctagctaatactaaatttg

SEQ ID NO: 88753 - DNA, 300 bp, Triticum aestivum
  unsure (1)..(300): unsure at all n locations
  Clone ID: PAT_TA_88753
ntgggacctgcaacccggtggccgntacntcttcacgcgcaacatgtcctgcctggncgcctttgcantcngggaaaagtacagggttggtaatgggttcaatataantgcagcccacacngatagtccatgcctcaagctgaaancganatctgcntccttcaaatctggccatcaantggttggtgtacaaacgtacgggggtgggttgtggcacacatggtttgataaanatcnaacattggctgggcgagtcatcctcaatgctccaaatggttcatttaagcataagcttgtcaa

SEQ ID NO: 88754 - DNA, 476 bp, Triticum aestivum
  Clone ID: PAT_TA_88754
ctgagacccaacccaaataacaccagcttcatccccacatctcctccgccgccaccctctcgcgccaccccccgtccctgccgccggcggtgatagctccgacgccgacctccgtccgcccgccgccctaacccccgccctcgaccacatcccccgacctcgagctccacatccccggcccctgcttctgccgccgccgccccttttctctcccgcaaagacccttgtccagatttatcaagccgcaggcccgtttcattggtgggcagccggtggccttcgaggtgcgttccccgtcatgtgctaggtgccacacacctggtcgcaggtcgtcctcagaatagctgtcggctctctccctccttcatgtacgcaggccagatgaactgttctttgctagacaggcctgacggctgaagctagtttgattggtgcgttcctagcaagattgatgtgttgcgcttcacatctggggg

SEQ ID NO: 88755 - DNA, 498 bp, Triticum aestivum
  unsure (1)..(498): unsure at all n locations
  Clone ID: PAT_TA_88755
cttgcaccgatcagatccaacttctgcgcaagatgctggacaagctgtgggacgacgtggtggccgggcctcgcccggagacgggcctcgacaagctccgccgcgccgccgccacccaacccctcgccatcaacacagctgcaggggaggcgattaagcagtcgccgtcgatgccgacgaccccgaccacgccggtgacgccgtcgtcgtcgacgccgccgcgtggcggcagcgtgtggcggagcgttttccaccccgggagcaacctggcaccaaaaagctcggggccaactcttcgaacgcccgcaagccaaactccccaccgtctacgactgggnntttacaggacgaagacaaggnccaaggagnnaccaaccgcttaattaanagccnnccggcanaagaaattgangaaaaggaaagnttcttgccaccgccgccaatgtttggctggctcctttttgggtaatnctaanncctggcatanncgttacgttg

SEQ ID NO: 88756 - DNA, 221 bp, Triticum aestivum
  unsure (1)..(221): unsure at all n locations
  Clone ID: PAT_TA_88756
gcgagctaatctttcttcttccgaaaacaagtgcgaagtccgcctcccnactaactgnaagcggngaacaagacgggcaccaccaacanggggggnccaaaaggancccagatngggcaccggggggctgctgggacaattccccgggagccctcnggcccgagganctctttncaaagncggcctcaangggtcgggggtttnacaaaganggantttcc

SEQ ID NO: 88757 - DNA, 296 bp, Triticum aestivum
  unsure (1)..(296): unsure at all n locations
  Clone ID: PAT_TA_88757
agcggaggncgaccgccgcaactggctgcgatactcnccggcgccgagcanctggccggggtgctccgggtccgagccnaacgtctccatctgctgtcctnggcggagggccgaagggggaatgaatccgcngtcaaccaanggcgccgccatctgcgcgctaatcnccngtcccggngctgancgtcccccgaacgccatccngagtccggcaatccacttccgagctggngtttccttccnccggcgnaactttcnnaaccagtncgttaaangnngccggttgggagggggaa

SEQ ID NO: 88758 - DNA, 218 bp, Triticum aestivum
  unsure (1)..(218): unsure at all n locations
  Clone ID: PAT_TA_88758
gnggtctctaagatatgctcccccctcctccctcgcgtcgccccgcangggcgagtcgggggcgatccanatnccgttcgtcgacagcccccttcctccgnttctccccttgccgncgncggaggnangcgtcggnaaccangtgngaacgccgntgaaggtgggggggaggtcttncgtcgnntttcntccctgcngaacagacctagggttccatc

SEQ ID NO: 88759 - DNA, 494 bp, Triticum aestivum
  unsure (1)..(494): unsure at all n locations
  Clone ID: PAT_TA_88759
gtacagccatggcccccaccgtgatggcctcgtcggccacctccgtcgctcctttccaggggctcaagtccaccgccggcctccccgtcagccgccgctccaacggcgctagcctcggcagcgtcaagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtggggtgccttgccttgagttcaacaaggtcgggttcatcttccgtgagcacaatgcgtctccccgggtactacgaaggncgctactgggacaatgtggaaactgcctatgttccgggtggaaccgacccacacaaggtgatnaacnaaggtgggggagggtcannnaaggagtnacccttgacgccgtacgtccccaatcaatccggatttcnacaaanattgngccaaggg

SEQ ID NO: 88760 - DNA, 198 bp, Triticum aestivum
  Clone ID: PAT_TA_88760
gaggagaagcggcagcagccagcagccaaaaccagcagacacccggcacccggcgtggcggcttggagggccctagctgtggtgggcagcgagagttggcaaggccggcggccaacagttggcaacagcgagaagcgagtgaaactgtgaaagatgtgggttgatttgcggaaaggaggagaacagataaggtctggt

SEQ ID NO: 88761 - DNA, 500 bp, Triticum aestivum
  unsure (1)..(500): unsure at all n locations
  Clone ID: PAT_TA_88761
cagtaacagcggcagccgcacatcagcagcttgctctgttccatccggcagcaatggcggncaccaccaccatggggctctcctcccccgcgatcaagctcgccggagcctcctacgccctcggngggggggggcgcatcaccatgcgcaaggccgcgcccaaggnctccgcctccaacagcccgtggtacggncccgaccgcgtgctctacctcggcccgctctccggcgagcccccgagctacctcagcggcgagttcccgggcgactacgggtgggacaccgcgggcctctccgccgacccggagaccttcgccaagaaccgcgagctcgaggtaatccactgccgctgggccaagctcggcgcgctcggntgggtcttccccgngntgctcgctcncaacggggtcaanttcggggaagcantctgggttaaaggggggctccccanatnttcancgaggggggggctcccaatttttctcnggnnaccctangng

SEQ ID NO: 88762 - DNA, 480 bp, Triticum aestivum
  unsure (1)..(480): unsure at all n locations
  Clone ID: PAT_TA_88762
gaggatagctagcancttnagcttnnggtcagtggcaagcangcaaagcaagaaaggaagaagaagaaaaaaggncatgggatctgntactctcctcaagtcctccttcctccccaaaaaaggcnaatggggngtcgcgcgccanngtcnccgccccgagggtgtncatggncgtccgcgccggggcctangangattanctcgtcaagaccgncgaaaancatcncntctccngggggcggggatcctggncatggncgaatncaacgccanctgngggaaaaggctccactcnatnggnctggngaacacaaaaagngaaccggnaaagcgttccgcaacgcctgntgggtctcccgttcccctgggcctcgggaaaacaaaatctcncggggggccaanccctctttctagggngacgnnctaaccaaatnccaaccgttctgaacggggaaaaaaaatttttcgacaatcctntgt

SEQ ID NO: 88763 - DNA, 528 bp, Triticum aestivum
  unsure (1)..(528): unsure at all n locations
  Clone ID: PAT_TA_88763
cgggctcccttnccctcnccgncggggggcaaggngggcggggctgggtgggaatggaagncctggattctaagtccantaatggtgtgagggnccccccccgggaaanaaagtgggagcngcgntttgggtnttggtctangggggtgntnaactcccccttggggncaccctgggggggaaaanggggggggaanggtgatccttggnaagggntncttcggggggttccctcaancgggattcnatggggaaagcttaaggcccgnccgggtttcgtncccantttctccccccnttttttgctggnnaataaaacccaaanaatggggggcgncaagnanggtcctccttcctccaanctggttcctacnaaacaanggantgtggggaaaaanaagaataagaagcaaccaagggagattgtacattgcctgggcaaacttggcangganngggctcccgttggctaaccctccctccaancntgnatggcccccaaggggggggggggttaaannggggggg

SEQ ID NO: 88764 - DNA, 491 bp, Triticum aestivum
  unsure (1)..(491): unsure at all n locations
  Clone ID: PAT_TA_88764
ctttgctaaccaatagctctttccaaaccaatagcagagctgatggcacactgtcaaagcttcttataatcaatggatggctactgcatgcagaggcgcgtaagcgctcaagtaaagtcaatttgattacatcggcggagtcgtcgtttactttgattccagctcttgcttgggatcgggcgggcaatggcgacaacttgttaacccggcccaagggggtcggtcgaccgatcaagcaagttgcatgctcatggtaaaatcaacgcttatccaagcccacttgatcatccatcggtccagccaatcagttctttatgcatgcatggttacttgactatagggataatcacanctagtaagctatgcntatgggtggntctttgcaattttttgccaatgtgtgacaatgaacntgaaaagcacaataaagtagatgatccatggngcctggcaaaaacatggggttgcaattttcctggtctgcaaggggg

SEQ ID NO: 88765 - DNA, 485 bp, Triticum aestivum
  unsure (1)..(485): unsure at all n locations
  Clone ID: PAT_TA_88765
tcgagttttttttttttttttttgaagaaaaaaatactgtaaactaacagtggaataacaaagaataaaacatgcgaagtgcaagaaaaaaagaaatgataattacataagaaatacagtacacatcactaaaaaattactataaggaaaataaattacagagcattttactcagatagaacttcaggtacagccaagggggactaacgacattccttctcacagtagatgataatttcctcttcaagcattttactttttgattcaaatagaacttcaaaagagctttctcaaaacctccttcatcaccagaaagttcctgcaaaaataaaaaagccgacagnctgaaattaaataaaatgatctgaagaagcaagaaaataaaatatacctaaagaagaagaaaagaaataactaccaatngacatagcacaagaaccattttccgcaaagggattaagcacaaacagttcaccggacagaan

SEQ ID NO: 88766 - DNA, 435 bp, Triticum aestivum
  unsure (1)..(435): unsure at all n locations
  Clone ID: PAT_TA_88766
gtcgcctctccgcctctatccatccgccgccggatncancancggtgtcctccanggagcccgccatggnggtcggcgcctttccgtctcgataagtttggcgctagatccacagtgngacccgccgtggaggttgtcgcctctcccgtatcgatccgtctgccgccggntncacgggagantagacgagatncgccgcccattcgagcggtgctgtggnccttcaaanccgggngttgatgcttcaatgccgctggtcnccctggggcnttgctttttttggngtcctcctttattttatttttcaagggtancaaanctggagtggggggttgacggnggccccngccgcncatgaatctggcccttgcaaatctccaagccgnctccttcgntcgagacancgggccggccccanaccgctcgaagnccanc

SEQ ID NO: 88767 - DNA, 516 bp, Triticum aestivum
  unsure (1)..(516): unsure at all n locations
  Clone ID: PAT_TA_88767
gacgtgtacaaagaatattaaggagaacggngtcggggggcangagcccgaggcgcaaccgcgcaaggtcgagccagccacggagatactcttcctctgcagctacgacaactgcgggaagacctttgttgacgtggctgccttgaggaagcatgcccacgtgcacggcgagaggcagtatgtttgccangagcccggctgtggggaagaaatttgtagacaagctcaaagttgaaggaggnaccaccttactcacacanggacaaaaggatttcgtttgccccacatccaagntgtgggtaanggccttcncaattggattttaacttgcgtgcacaccctccaaaaanacatgctgnggggnaaaattatcaanttatgcccccttcccaancatgtgggnaaaaaggattttacaancggccttccaaatttaantnccatntttaggnccacatgcannggcntggttncccctattgcagggggannnaaaaccccncctgcanaaaaacc

SEQ ID NO: 88768 - DNA, 482 bp, Triticum aestivum
  unsure (1)..(482): unsure at all n locations
  Clone ID: PAT_TA_88768
cttctccatcctcatggcttcgacggggggcggcgctgctaaccactgcgcggcggcggccttggggcggcgtggcggagcgggtgctggagacgggggcgtccattggtgttggagacggcgtccagcgatgctgcaaccggtcgagcatggcgctgcccaccatgggcatggtgaccacgtcgacgggtgctgcaaccacagtggcaaaatgatggaactgtggtggaggatgctggaaccggctgagcccggtgctgcgacgaggcggcaatttttggtgtggcgaagtttttgttggaaccaggcatcaacggtgctacaaccaagccacaaaatttgctggaacctgcatccatcggtgctggaaccggacgcnccctcccaccgcgggacggttttttgctggaacttgctacttttttttgctacatctatttttttggattttgcntcctgtgattttgatgggactggacgcc

SEQ ID NO: 88769 - DNA, 445 bp, Triticum aestivum
  unsure (1)..(445): unsure at all n locations
  Clone ID: PAT_TA_88769
caaccctagtctagtgctagtgggcacttctggcgcttgcgtaggcggcagattagcagcagcggcgttgcaggtggccggcgccgagtggcgcagcgctgcagcggttgccggtgaaggcggcggcaggcttgctggcgtggagccatggactgcgagtgggagcgagcggggggcgtgtgtggtcggagagcgaggatggagattctggaagaagaagagataaggctgatatgggtccacaaaaacatgtgggcggggacgtggaagggaaggaccancgcgtaagatctgtgtgaatccgacgcancgcgcggagccggccgaaaaaccggcgggcgtctcctcggtccggccgctccatgcaacgggctctggttggcgctcccaaatcttcaaacgacgcaacccgccccggcggctgccgtccccagatttttccgnt

SEQ ID NO: 88770 - DNA, 417 bp, Triticum aestivum
  unsure (1)..(417): unsure at all n locations
  Clone ID: PAT_TA_88770
aacttgagagagcgcacgcgagatggcagcctccatgatcacctcgccgattgtggcgccgacgagcgtgccgtccctctcccgccggggctcctccttcgccgtcgtctgcaagcggtggcaagaagatcaaggtcgataagcccctcggnctcggaggcggcttgacagtcgacatcgacgccaacggnaggaaggtcggnaagaanggcgtgtaccagtttgttgacaaagtacggtgccaaacgtcgacgggtacaagccaatctacacgccagaaggaatggtcttgaagtctgggggaacgctacgncgggngggaangaaccngggctttcnttatcttgggggccgttnaccctcccccggggcttccctccgggggggggggggtnctncctccgntttaaaaaaaac

SEQ ID NO: 88771 - DNA, 236 bp, Triticum aestivum
  unsure (1)..(236): unsure at all n locations
  Clone ID: PAT_TA_88771
ggcgtccangaacggcctgtcgcagggcgtgcgtctcccaggcccggtcggnangngcgccagcangttcaccgtnagggcgtcttcngtggaggccgaggccgccgggcgccgcgcggtccttggtctcatggtcaaacggagtcntcgggaacgcgttcgctcangtggtgcangccggcaccgtcgnggncatcaaggttggtnccccgccgccgctctccggtggngtcccc

SEQ ID NO: 88772 - DNA, 162 bp, Triticum aestivum
  unsure (1)..(162): unsure at all n locations
  Clone ID: PAT_TA_88772
ctctaacccncggacctagggttcgcgccgccaaccggcgaccccgccacgtctacgtgcggcggtggaagacgncccgtcccgtccgncgnttccccagtancgtncgncggcggaacccgtnngcgttccgccnggcgccacgatnaanggtcggtatcg

SEQ ID NO: 88773 - DNA, 445 bp, Triticum aestivum
  unsure (1)..(445): unsure at all n locations
  Clone ID: PAT_TA_88773
ctctcctccagataatacattaccatggcccccgccgtgatggcttcctcggctaccaccgtcgcacccttccaggggctcaagtccacagccggtctccccgtcggccgccgctccagcggcagcctcagcagcgtcagcaatggcggaaggatcaggtgcatgcaggtgtggccaattgagggcatcaagaagttcgagaccctgtcttacctgccacccctatccacggaggccctcctgaaacaggtcgactacctgatccgctcaaagtgggtgccctgcctcgagttcaacaaggttggcttcgtcttccgtgagcacaacaactcccccggggtactacgacggncgatactgggacaatgtggaagctgcctatgttcgggtgcactggacgccacacaaggtgctgaacgaagtgggaggaggtcaaananggagt

SEQ ID NO: 88774 - DNA, 459 bp, Triticum aestivum
  unsure (1)..(459): unsure at all n locations
  Clone ID: PAT_TA_88774
gcaagctatatacctacatagtacagccatggcccccaccgtgatggnctcgtcgggcacctccgtcgctcctttccaggggctcaagtccaccgccgggctccccgtcagccgccgctccaacggggctagcctcggcagcgtcagcaacggtggaaggatcaggtgcatgcaggtgtggcccatcgagggcatcaagaagttcgagaccctgtcctacttgccaccgctcaacacggaggncctccttaagcaggtcgactacctgatccgctccaaagtgggtgcctttggctcgagttcancaaggntggggttcatcttccgttgagcacaaacgcatccccctgggtactaacnatggncggtactgggncaaatggtggaaagctggcctatgttcggattgcaaccgaccccacgccaagtgattnaccaaggngggnggnggggcaaana

SEQ ID NO: 88775 - DNA, 445 bp, Triticum aestivum
  unsure (1)..(445): unsure at all n locations
  Clone ID: PAT_TA_88775
caaggntcgtggtccttgatagttggaatccctgactttaattccttcctgaaattcatgctataagtaaatcttcactgaacacaataatgcataaataaatcctttgttgattttattatgtgatgttctatttatgccttaagatacacaatatttgcattttgtattttgtangctgtcctttttaattttgtggccgagtattgtacttatgttctgataaacatgctgtgntaaatattcanggntgtgntgacattgacaagtttgataaattcnacaagctgtntcaaaaggataggagttcatgtctccacgggactagatcgcataanttggnctantgtntgaactgaaggaggatgtcgatcaaaaaccnctttattcaaaaantgggntactaacaatgggaagggagnctcctttnttaacaanacaagca

SEQ ID NO: 88776 - DNA, 465 bp, Triticum aestivum
  unsure (1)..(465): unsure at all n locations
  Clone ID: PAT_TA_88776
ctcccgtcccgtcccgtccccagccaacctcccatctccgtctcgcgtcgcgggggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacgggcactgggnagcacaagtgacatcaagctcaaggacgacaagactctgctctttggnggagaagncagttaccgtcttcggngtcaggaaacctgaggagattcccctggggtgagggctggtgccgattacgttgtgggangtccaacgggtgtctttaattgaaaaaggacaaggggcggctggctcaactttaaangggtgggggccaaaanaaaggtgggncatcn

SEQ ID NO: 88777 - DNA, 234 bp, Triticum aestivum
  unsure (1)..(234): unsure at all n locations
  Clone ID: PAT_TA_88777
atgaacaatggnagcccaaggtcttctctctgggaggcanctgctggggagggctctgtaatcctccatctccangtcgtcttcctcccggaaagtcccccttcgtcgtcaggggatcgatccaaacccccctgccaagcaaaatgacaacangcagctgtngttcgcgtccaannagtccctcacctacctccacggganngatgcccggtgnnttttntttctaccccttgg

SEQ ID NO: 88778 - DNA, 360 bp, Triticum aestivum
  unsure (1)..(360): unsure at all n locations
  Clone ID: PAT_TA_88778
gtgccctagggccgccgccgtccgaccccgccgtccgtccccggncgctcccgttccatcgcgcctccccccgcccgtccccccgccggcgtctccgccccgtccgcagccttgaacattggttttaaagggcagtgcttaagaaggtgtggagcaaaatcttttcantcactatcnagttgtctgggtgtttttatcactcaaagtaaagtaattttatccgggcctgtagagctgctcaaatatggaggacagccaggtattatttcaaggggggaaganagtccaggctttanttnaatgcngaaaaaancccgggcntttaattcaangggggaaaaanagccggggntttaattt

SEQ ID NO: 88779 - DNA, 397 bp, Triticum aestivum
  unsure (1)..(397): unsure at all n locations
  Clone ID: PAT_TA_88779
gcaanattgntttgcgtacancacntngaganaacttnactnctatggncgcanccattgangttgtnatgcttgntgagggatacatgtaagngggaacacatgggancatgtggtccacatacatacaggggatattgttcacnnnatgatatcgcaccaccttntagcatgcaggcttcanttgngcaanagcacantcgntgcattcntgctctcntgtgntcgactggnggtcgtcggtggcaatgggtatgagattctgcaacatgccaagacggntgcnttgaaatccccggtaagcattttgcatctctccaaggaangggtgcccccatccatgaccacantttganacnatgntccgnccgatttggatcgacggnggtccctnggt

SEQ ID NO: 88780 - DNA, 284 bp, Triticum aestivum
  unsure (1)..(284): unsure at all n locations
  Clone ID: PAT_TA_88780
atgagcgcacgcgtctgtactatgttaaaagtaaaaatctancacatcatttgnagggnacaaatatctttttttttaaanaancctatttttttgaattatttggattgcttaccacatgtgtcacntggtaatggaacaaatatctttgcaggacnaaaccctacaagtcgttgtttctcntcatctccaanagtatccagtgtattttaaccactctttcaaccttcattgtaagagtgggtttcgtcgcacaatnaaacancaccnccaaaagggggggn

SEQ ID NO: 88781 - DNA, 441 bp, Triticum aestivum
  unsure (1)..(441): unsure at all n locations
  Clone ID: PAT_TA_88781
cttgattgacgaacgcacatcgcgcagcgccgctgtctccatcttccgaagtcgcgcaatccatccccgcggcggtcggctgcgggcctgcccatgcccatcggcctgcgcggtggcggcccccatagctccctcgcggcggtggcggcgggcgactcccccacaccgatggacgacgacgtccatggctcctgcacggtcgaggccatcactccctgcggcaattcttttctcttgccattcccacacagcctctgtatgctaagaatgtttggatttgtttctgtttatccatgaataatttcttccccgggatttatatcccgatttctttctttccaaccaatatcangtctttatgttcaaaaccgagggacgaacccgaattatctggtaaaccgaagtctcggncaantgattttctggatgaccgatnggtcn

SEQ ID NO: 88782 - DNA, 351 bp, Triticum aestivum
  unsure (1)..(351): unsure at all n locations
  Clone ID: PAT_TA_88782
agcaaacgtaggtgaccacccaataaagattcaccctaatgttgtacagctccatacaaatcatatttttgagatccctgaagcaacaaattatttctcagccatatacttggntgcatggggaatttgatcaaaagagaanaaacaaaactcactttttatcactctttatgctggggctcangaaggaatttaaatccagctctaactgatactccatgatccgtgnattcttacatatagatgcaccaagcaatgcttgntgaccaccttgaagctggggttanaaagaacttctgngagcctctttttctcccncggnttatataaanccaagatccgccacatggg

SEQ ID NO: 88783 - DNA, 456 bp, Triticum aestivum
  unsure (1)..(456): unsure at all n locations
  Clone ID: PAT_TA_88783
gcgactaggaggcgaattgggcagtggaacgatatggtgcgagctcggcggtggcaacgaccttcttcgacgtacctctccacctccggtggtctgctctccgggcaaagaaaaaggaagaagaccagaaaaggagatgaaagaaaagaggggagcttgcatactgaaggaggtgatggaatagaccttcgctcggtggagctcctaagaagaaagaaggaacagttcatcgaaaacagacaagaaagtcaagaaacagagctatcacctttatctggatctaagaagcccatggataacaatgtttcagtcgctagagagattgctgaacatatgaagttgatgtaaaatctctggtcacctacaaattaagctacttgangaacaagttcangagtagttaagttttcaaatttggtactattctgttttgtaatagtgttttctaaaatttcc

SEQ ID NO: 88784 - DNA, 473 bp, Triticum aestivum
  unsure (1)..(473): unsure at all n locations
  Clone ID: PAT_TA_88784
agtttagaattcttggatctttctaacaatcaaataaatggttccatccctccaaccttctggaaattgacctctgttacaacactgtcacttgattccaatcagcttaatggcctattaccgccagagttaggatctcttgttctgctcacaaaactgaacctaagtagcaacctgtttctaggaaacattccacctgagataggacattgccaccttttatcatcgttactcttatcagacaacttattgacaggagaaataccacaagaacttgggtatctcaccaatctatatgagctagatttgagtagaaacaatttaaatggtgccatcccaacgactttttctaatcttacgcaactgtatagactgaaattatcatataactatttggctgggcagagttccatctaccgctgcaacattgatctcacttgaccataatatgggatttatgcggcgattcctan

SEQ ID NO: 88785 - DNA, 467 bp, Triticum aestivum
  unsure (1)..(467): unsure at all n locations
  Clone ID: PAT_TA_88785
gttgattagcactctagagctcaatcaatccccangcggncacctttagtccccaactccggcgaggtctcccgctcatccatccccacctccggccggccggccagccagcgattctcctccgcccccatctaaatcgccatctgtggtgcccgatttacagacaagcagcggcgagagggcagaggcaaggggaactgttctgttcgccgctgcaagagggacggggagccggcccggcggcgcagcggcaccggcaccggcaccacgctcatccccacgaagagcctagttactgaagtccctctgttggatcaaagtcttcctttttctacaagaacagaaggagtaatctccctctgcagttagtctatcctgtggttactgagtaactgggaagctggacctactggcctcaagttttctcacgcttcaaggggcgctctgctataaaatcgctaaatggg

SEQ ID NO: 88786 - DNA, 462 bp, Triticum aestivum
  unsure (1)..(462): unsure at all n locations
  Clone ID: PAT_TA_88786
cgaagagcgggttgaacgaggccttcacgagcctcctaaggggttttgaggtttgtgatgtagttttgccaattgaataatattgacaagaatgcacctgttgtctatgcagtaagcccctgagactgtgattgccttccgacggaagcgatcggaggatcaaaaagatatgctcaagttgctaaccttgatttaacttggaatataggctgcctcccctcttgcagctgcccggaatacggaagtggccgaactgcagcgaaagctggatattgcggaagatgacattgctttgatcaacaggcgtcttgacnactcgcaaggtatatatgtcgagcattccttacaccaatgtgcttgtaattgtaggcctggcacanaaaagggtttatatgaaatgttcatgattgcaagatggtgctgccgccgttgaanctcttcanacgggagctangcccgggg

SEQ ID NO: 88787 - DNA, 477 bp, Triticum aestivum
  unsure (1)..(477): unsure at all n locations
  Clone ID: PAT_TA_88787
ctgggcctcgccgaccctccgccccgcagtggtgcgcccgagcttgggcgcgccgccgctgtgtccgcgctggtcctggatcctaggcgcggtcctcctcgaccttcgatcccctcgcttcaanggnggcgggancccgtccttccattgatcgcccgattccgggcaactccggngccttcctcgggctgccgctcacggtaacggatcccctcgccgccccctaccgattcgccctgcagngcagccttcctcgccgccccggngaagccccttggtcaccgaggagatgagttgcaccgcctgtgaggcanccctcccgattcatctctttcctcgccagcatcgggccgcgngaggcanggagctcaccatcggccatgggatgcgggcctanaaantgctgccggccccctgccctgccgtgcgnncgacgggcaatgggactangccgcncgagtagggagcaacgccacg

SEQ ID NO: 88788 - DNA, 461 bp, Triticum aestivum
  unsure (1)..(461): unsure at all n locations
  Clone ID: PAT_TA_88788
aaaacaacaacatctctattcgaaaatctttgtgaagaatactctcacaacagagcacctcactgatgactgcccaacttctaatcagcagaactttcatcaatttggagttgccaaccgtattcctccatccagtggtagacgggaaaacaagggcacataagagaaaaaaggcctaaacttctggtagttaggctcaacatgatatacaactgtgctctcatgatgatccagatcgtatgcaatcagttcattgttccaatgagctataaagaatattatgttggcatgtggatgtactccaatgacttcaaggtcgaagccgagctgaaacatcacatttggngctacatttgaaagcttgcgcaacaatttccaatgcatgcatttgtcatccaggtgngtcccatcccactgatagatctcagcaccaaagaacgtnaactgatatggtcgnaaat

SEQ ID NO: 88789 - DNA, 460 bp, Triticum aestivum
  unsure (1)..(460): unsure at all n locations
  Clone ID: PAT_TA_88789
ccaatgttcactgcttgggagcttggcgagatgtacattacacagcttttgaagctttccttccttgaacattcgaagattgcaagatcgttctatgacgatgccaatgttacagcgttcaccatgcacgacttggtgcatgatctagcaaggtcggttatgggcgacgaaattcttctggctggcaatgatggcaacattgagggaaaccgctgccactatgcgctgctcaatgattgtagagagccattggagttacggaggataagggcaatccgttttatgggttcggatgaaattcgacttgatgatgctgcattttcctctgctaaatccctgcgtgtcttggacttgagcgagtgctctattcatgaattgacaaaatcaattggccgattgaagcagctgaggtatcttaatgctccaagagtacaacatgaanttattccgggatagtatn

SEQ ID NO: 88790 - DNA, 405 bp, Triticum aestivum
  unsure (1)..(405): unsure at all n locations
  Clone ID: PAT_TA_88790
agcaaaaccccactctcagagagcaaggacnccggacacgcacgagtcttctttgnagcaatgggcgaacancgcgaatngggctctccccctcgtccttcgccgggaagggggtcaaggacctgccgtcntcggggctcttcggggagggggcgcgtcaccatgcgcaanaccgcggccaaaggcaaaccggtgtcctccgggancccgttgtacnggtccnaccgcgtngctctaactngggccgcnctnccggngancccccnagctnactcaacggnnagttccccngngactaanagggtgggaaaacgcgggggntngtttngtccgaancccncataacttccnccaanaaaaccggggaagctgngagggggantccanctncccgggtgggccaat

SEQ ID NO: 88791 - DNA, 466 bp, Triticum aestivum
  unsure (1)..(466): unsure at all n locations
  Clone ID: PAT_TA_88791
gcggcgatggccgcgggggccgcggtgggcggtggtcggcgctcgcggcgagcgcgctaatctagcttcgcggggggcaagctactgcttcggtttatactcgccggcaatcaaggcgtcgcagggctacgaccagtccgcgctcgacgccgtcgccttcatcgacgtgggcgccaacgccggggtcctctccggcttcctctccgcgtaggccctcgggggcctctgacgcccctgcatcgtcctcctcgccggngccgcgctctgcgccgccgggcacctccacatgtggctcgccgtcgccggggctgcgccggncccgatcccgctcgtctgcctcagtgnctctacatgctgctgcccgcgcaggcgcagaccttcctataaacggccgatgtcgtaaccgcntgtctagaaattcccggaccacggcgggnaaccgtcaaaaggcatccgtaaagggtcn

SEQ ID NO: 88792 - DNA, 273 bp, Triticum aestivum
  unsure (1)..(273): unsure at all n locations
  Clone ID: PAT_TA_88792
gtcgggtgnanacttctctcccacccncatctctcnctccctcccctgttcctcgccttatctccattgccgcctgctgcntcagcttgggnttacntanccagggaacgangaggancgggttgttgtcatggcngcgtctgcggcggtggngatggaggatntgcggggcancttcaaggangggcggncgcnnccggccgnatggcgtgacggcgnaggtcatggcgntcgacanggatngatcgagtgataaggaggacgacatcacct

SEQ ID NO: 88793 - DNA, 458 bp, Triticum aestivum
  unsure (1)..(458): unsure at all n locations
  Clone ID: PAT_TA_88793
tgctggacatcccgccgtcgttcctgaagcgaagctgcagagcctgccgttcccgtccaccaccgcctatatgcccaccaagcttcatcatcctggngcaccagncgtggtacacnctcaccctcggcctcggnaccaagaagtccaaggtgggtgctcttcgtgttcgantcggaggccatnaangcggccgtggaccaactttggncgggcatgatcccgctcggggacgtgaacaanaanctcatccgcggggctcaccgggcaagcganatggcgcgcttcanagttcaagganagggggtgcctcaacatctacngtctacncccgtncgnccgggctggggcgccgcccgggcttcctttctgcgncggaacgaccctcaagggagggantaactgcanggcccttggtggggggctcaaaaggactttctttgggccaanaacnggccaat

SEQ ID NO: 88794 - DNA, 558 bp, Triticum aestivum
  unsure (1)..(558): unsure at all n locations
  Clone ID: PAT_TA_88794
aaactagtgggatcccccggggctgcaggaaattcggcacgaaggagttatanggganggactttatgtcaaccacaaaacaagaaaactaaaagcangtgttggatttaaangctggtgttaaagattataaattgacttactacacccccanagtatgaaactaanggatactgatatctttggcagcattcccgagtaangtccctcaacctgnggtttccgcccgaatgaagcaggggctgcangtagctgncnaaatcttctactgggtacatggacanctgtttggactgatggacntaccantcttgattcgttacnagnggnacgantgctatcacatcgacgcctgtttgcntgggngaagacangccaangggntctgttacnggnagctttatccatnacaccctattttgcacgaagggttccngttaccaacatgntttacttccacttgncggtccccgttcntttnggttcaaaacccttaccgtgctctncgttttggaggnttctacnaaattcccccctacnttattcnanaaaactttc

SEQ ID NO: 88795 - DNA, 483 bp, Triticum aestivum
  unsure (1)..(483): unsure at all n locations
  Clone ID: PAT_TA_88795
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcaagcaaggttgggttcatcttccgtgagcacaacgcatccccctgggtactatgatggcccggtactggacaatgtngnagctgctatgttcggggtgcacccgaacgccacacaaantnattaaacnaaggtggagggagggccaatnaaacgggtnacccctgaacncgtttnntcccgcatnn

SEQ ID NO: 88796 - DNA, 484 bp, Triticum aestivum
  unsure (1)..(484): unsure at all n locations
  Clone ID: PAT_TA_88796
ggctaggcaagttgactcgtctcatttggttggccatgggcgagaatggccttttcgggtcaattcctagagctccttgacctcggatcctgcaacctaacaggagccattccaacagaactcgaacagttaagtcaactgtcacaattgaatctttcggagaacgagctaataggacccattcccgcttctcttgataatgcaactgaattagcaatcctattgttggaccaaaacatgttgactgggaccagtacctagaactatcggtaacatgaactctttgataatccttgatatttcaactaactacctacatggggatgtcaacttcttacccgttttctctgatcttccaaatctccaataccttaggcatcaagtcaaataatttcaacggggtagccctccctaaacaatgttngggaacnggcaaagctactgccgggaggactgggngggagaccccttctccttccccaag

SEQ ID NO: 88797 - DNA, 500 bp, Triticum aestivum
  unsure (1)..(500): unsure at all n locations
  Clone ID: PAT_TA_88797
nttttttttttgcagttaaacgctacctttcatttcctcaaatctttttaattacaagatctaactaacaaacaagagaataaaccgaatcccttaatccctatcttcacaatgaaactaatatactttggaaatcaaacatgtactggaagtatgaaacccttttgtcctctgtagtcgaactctatctgcagctattctgaatgggtatggcagcaatcaaaaccactgatgcacaagaacgccgctctcccggagcgaagctgaagagctcgaggcactcctcgtatgtgttctganacttaggcgaccgctcgccaagggagcacctttgccaccggttgtaatggcactcgagggaacacctcggtcgaccaagcaagattgcgccccggtgttcgaagaggcctcggggatcaaagtcaaaactcaagtcccctcccanatccaatcttcaacnccaaggtnagncctgnctccgacaccgttctgctttaagg

SEQ ID NO: 88798 - DNA, 344 bp, Triticum aestivum
  unsure (1)..(344): unsure at all n locations
  Clone ID: PAT_TA_88798
ctcctacccaagccgtgcaccgccgcacctaccaccctccggcgagcagccacgaacaaccacccagcacgagccggtgtcagatncaggccgctcgccgccgggggaggagggatnaatgnagcgacngtcgtccggtggtgccaaggctgttttgcccccctccccccgccgntgaaagcctccgcatcttcatcctntgacgggnttttgnctagggacnaccccgattcnnagcagtcctgaggngaataagcatgcggnncccctgcagtcctctgnncctcngatnnaactcttncccnaaattnancggaacgnagntttntttttttctcctcctc

SEQ ID NO: 88799 - DNA, 366 bp, Triticum aestivum
  unsure (1)..(366): unsure at all n locations
  Clone ID: PAT_TA_88799
ttctctcagtctccaccacttcaccctcccctccangcatacancacttcaagaaaangcgcanatccatggngttctacgatgacganaagtggnangttctccantaagagccggaacaacggcagctgcaggcgcgtctccancnggagggcggcggcggngatccggttcctcaatgaggtcaagcangcataangggaccatgcgatcnggccggcggggganacnccgnccgcncgcnggcncgtcctcgngtnaggcgaggtgcgccngtgcctntcgnttctncgaagccagggtngccgncccgcgtctgngttgnaaagggangcaagggcngccgncggntttcttntcattcaa

SEQ ID NO: 88800 - DNA, 444 bp, Triticum aestivum
  unsure (1)..(444): unsure at all n locations
  Clone ID: PAT_TA_88800
gtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcancatggttgggttcaacttccgtgagcacaacgcatccccctgggtacnacnatnggccggtactgggncaatgtggnagctgccnangttcggttgcaccgaccccacgcanggtgatcaacnaaggtggagggaaggtcanaataaaggagnacccctga

SEQ ID NO: 88801 - DNA, 479 bp, Triticum aestivum
  unsure (1)..(479): unsure at all n locations
  Clone ID: PAT_TA_88801
ttttttttttgttttagtacccatgacatttagttgagtagaatcggactgataactcttgcctctctcagtagtagtttcaacctattccaattacctttgacgatttggcctatatgcctcttccagttagcaaagccaaattacctcctcagtcacttactgactcctcagtggtatcgccaataaattctcagcactttgagagtggcttcatcccagatcacctaagcacaagcccacaaaggttagagctgaaggttgctgctgccccataacaacctgaaccacattcacgaaccgaccatcaagactacagtctttttgtcattctgacgttcagcaagtgtctgaacaaaatcccctgtagatgtagtgattcatcaccggcactgggntattatcattttagtacaattcccatccctaaattttcaaaggctgggctagcaatatgttttgnnggcctcntggcacag

SEQ ID NO: 88802 - DNA, 478 bp, Triticum aestivum
  unsure (1)..(478): unsure at all n locations
  Clone ID: PAT_TA_88802
aacagtctcgagttttttttttttttttttaaatggagaaataccttacacatcgactttgttacagttcgtaactctgtatttacattacatacaaatttaacctgcgccgagatcatcatctgcagatttccattatttcagagatcatcatccgcagatttccattatccgcagattatgtggttgagcccgaaccaatctaactgtaggttggngcatgatagttgtgggcgtccgagttctcttgctacattcaatttacatgtgacgggagtacaacaatggtagaatttatgtgtctattttgaatcagcctttgaaaagagcttagccgccctaataaaatgttcaaacacttccgatgccccctcaaggaacacnttgtcctccagaaactcattatgatcgtggaagtaaaattgggcgtatttatcattgggaggaaaatccaagggggtgggncnacccatccggn

SEQ ID NO: 88803 - DNA, 407 bp, Triticum aestivum
  unsure (1)..(407): unsure at all n locations
  Clone ID: PAT_TA_88803
cttcaatcccatattccccatgtagagtagcagctatatccattagccccccttcccctcatctctccctccaccagctcggtgtttgctctctcgcaacttcgctcaacttgcagtggcaatagcagaggcagcggcagcccgcgatcgatccttgccgggtccgcgggtgggatcgacgatgtcggatcagatggattctggcataaagctcttcgggcgggtgatcccgttggttcctgacgctgcgcccgggccgccggaagcggaggcgacggccggctccgancacccaccgccgccgccgccgcaggagtcagagggccgaggcagaggctgatantaataaggnaacaacacaatagaaacaaaagacaaaggcgatagtgaaatgaangtggncgcct

SEQ ID NO: 88804 - DNA, 370 bp, Triticum aestivum
  unsure (1)..(370): unsure at all n locations
  Clone ID: PAT_TA_88804
aatcgcagcagcggcagccggagaagaagagatcgagcgccagcagccatgtccggcatggaggaggaggagaacccccccgagctcaanatcngngaagagttnctgaaggccaagtgcctgatgaactgcgaggtggcgataatcctggagcacangtgggagcagctgnagcacatgtcnnncgggcgtgnnccgaccaangtctcgcaggtcttcgagaagtcncangcctacgtcaagcgcttcaagccgctanaanaancccnacncggtcccctcacggtccncgtgacncnctcccgctacagcctntgtctntttccagctccngnanccctccgggaaacctcctgntcccgatcacctg

SEQ ID NO: 88805 - DNA, 476 bp, Triticum aestivum
  unsure (1)..(476): unsure at all n locations
  Clone ID: PAT_TA_88805
acatatatgaaccatcaagtgaaaatcataggacaacaatgatacattttccccgcaaaaaaaagacagtgatacattttactttacttttagcacttgaaaatatgacgagacgactcatccaaaaataagtactagacagtgatttattttaggcagaccagacagtgatgcgctgcgtgtgcccgcaagttttttttaggccctaccacacaaacgaaaacgcgttgggcccggccgtcactaccccttgtagaatcgtagttgctgaacgaaattatcaatgcacgtctcgtggcatgcagtatccgcgacaatctgttggagcttcttggcattggccgcgaagacacgtctaccttcttcctccaccacgacggcccggaccgccgacgcgacgccttctcggtcaaaagacgattcaaccttgccgttcctagggnacggggaaatccaaccttcttccccgtccaatt

SEQ ID NO: 88806 - DNA, 382 bp, Triticum aestivum
  unsure (1)..(382): unsure at all n locations
  Clone ID: PAT_TA_88806
ggagggacttatgtcaccacaaacagaaactaaagcangtgttggntttaaagctggtgttaaagattataaattgacttactacaccccagagtatgaaactaaggatactgatatcttggcagcattccgagtaagtcctcagcctggggttccgcccgaanaagcaggggctgcagtagctgccgaatcttctagtggtacatggacaantgtttggactgatggacttaccaaatcttgattgntacaaagngacnatgctancacatccgagcctgttgctggggaagacanccaatggntctgttattgtagcttatccattacacctatttgnnnggagggtcccnttactaacatgtttacttccattggnagg

SEQ ID NO: 88807 - DNA, 492 bp, Triticum aestivum
  unsure (1)..(492): unsure at all n locations
  Clone ID: PAT_TA_88807
ttttttttaacctcaatagcatgccatatccaacagcaaataatacatcggtcgcgacttcagagtaggtgtagtacagcaatccgcgcacaccccgcaaataaatataaatacaactataatgaacacaaacagggaaaacagagcacanttgaatttactacaccagctgcacataaccactgcgtgctaaagttcattggcaatctttagtccccaacaagtacagattattcatcggtcttggatgaccangcaccaagactactcactgaaaaaaaaaaaacccgccatcactctataaacaggtacagttctggggctccagcatcaacttattgtttccaagggcgattgaatgattggatgagcatgggnaagaggggatcaaaagatgatgtcgtcgtccttctcccctccagcagccagcagatttgnccgcagnccccacggggatgccctcttgagcgcgagatctcgggcgagntgttn

SEQ ID NO: 88808 - DNA, 424 bp, Triticum aestivum
  unsure (1)..(424): unsure at all n locations
  Clone ID: PAT_TA_88808
gatacgctctcnctcttgttgtcaatggnaaatgttggngcatattcaaatgtgcttgccgttgatatggttggggggttaattgttggggctgtagctgaacgcttaagaggtacangatatgtttgtagcacaaatcttggntcagggnccagctccananacanaataagaatgtataatttggacantgagangancaacaagantttccangcaccacttaacgacctgtggcccntgaaaacatctggcgatgctcctggtancantnaacgtggatggnacctggngntgnaccaaaccaaagttttcaatcatccctgggaaaaccaactggtacagaantatcaaatgggaatgcgnantcaacggacaagcgcaaccaattgatattataangncccctgggcccggcaacggg

SEQ ID NO: 88809 - DNA, 426 bp, Triticum aestivum
  unsure (1)..(426): unsure at all n locations
  Clone ID: PAT_TA_88809
cagctagtgataaatccaggcatcacactatgtacatgaaggcgttggnatgtgtggtgcttggcgacagcaatgtcaagtgcttttatgttttcatggctgtgatgaaggaggtgtatgcgactctgcttccgctgagtgtcgataaagatggaatggagcttgcagacaaagagaaacagcagcaagattgtagcggaaacccaacatgaatcagtagaggcaaatgttgtgctgcataaagataccggtgatggtgaatcaagttgctcaggtgtaggtgtgaatgaggaagaagaggcagaggggaagtctgncaacaagcanagacaaggcgccttacgagcaacagcttacgacgtcgcagttttggncantccgcacaggngcaanggacaacgtgtannaacctgcccaccaacaacg

SEQ ID NO: 88810 - DNA, 413 bp, Triticum aestivum
  unsure (1)..(413): unsure at all n locations
  Clone ID: PAT_TA_88810
atgacccgcttttgcgcgggagaagacagttggcttgctcgtagcaacaatatgaccaagaaccctggtaattcggataccagggacagtaatggcaggtcgcgtcgcaataagcagaagcgccgcattaacggcgacaatgctgaggatacggcagttnatgccggattcagaggctataaatacggtcagcggaaaaagccattcanaagaaatcctaggggcccgtccagtttggncaaatactccaccgcttgtgccagatacatggcaccccccgaaaagctgggcaatcacaccaacagggattgttgggtgttcaagcacgcaaagcaantttantgttccaacactactggagcangggggtggcataccnaatnaacnacngcaangaggccccgggccgcccg

SEQ ID NO: 88811 - DNA, 485 bp, Triticum aestivum
  unsure (1)..(485): unsure at all n locations
  Clone ID: PAT_TA_88811
gggatatctgccttgactttcagtatgtatataagaaagagacaggttacatccaaaggatttctacaaggagggccgactgtgggcatgtcataactcctgccgcttttatatctccaaaaaattgtggngccaaaaaaaaaagagagagactcgagcctatctatacatgatgacgatacagcccaggatgaaaatgtttaccacttcaacaacacaaatcgacgtctagacaaaaggatgcaacctgatggattcctcaagtgcccaaccaagcacattactgaacaacctgagggagcagtaatttgcggacgacggcatgcaatgttacgaggatccctatctgcagaatcaccaatcacccttgaccaagccaagacatcttagcggaggatctgcattagagtaataagctccaccatgattggtaaangtccagtgatatcaagaaaagattaaacttcangagtttttcccannan

SEQ ID NO: 88812 - DNA, 273 bp, Triticum aestivum
  unsure (1)..(273): unsure at all n locations
  Clone ID: PAT_TA_88812
gacgacaaatatgaaaaaganntcgtcaccttcctgcggncgaatgtctgatgtgtntgnatggnaancctccaacatccccggtgttcccatggaggngattgaggcaccaccttgctgtcggtcctcatgcacggaacgtcaatcagaangttaggaagnaagctctcganaggcaggagntcatcannggagaaatcanaaagctagaggtggngggnttggtgagaggantactccatccgacnagggtggncantccngtactagtgc

SEQ ID NO: 88813 - DNA, 483 bp, Triticum aestivum
  unsure (1)..(483): unsure at all n locations
  Clone ID: PAT_TA_88813
gtgtcaagggcancatcttcttcacccangagggagatggnccgnccaccgtgacnggaantgtcactggactcaatgaagggntccacngnttccatgtgcacgcncttggngacaccaccaatggatgcatgtcaactggcccacacttcanccccgcnggncatgtgcatggggcaccngaagatnaaatccgccatgctggngatcttgnaaatgtgacanctggagcggctggtgttgctaacatcaatgttantgactgccatatcccccttactgnnnccaaattcaaattgntggccgtactgttgtcttccatggcnacgcttcatgatcttggcaagggtgcacatgagctgnncaagancactgaaaacgctggngcccgtgttgcttgcggcatcancggtgctccaggggctagatgtcatcttcancgaaccaacgtcgtacangatctggggaancttttcaanaagg

SEQ ID NO: 88814 - DNA, 387 bp, Triticum aestivum
  unsure (1)..(387): unsure at all n locations
  Clone ID: PAT_TA_88814
ccgactttgantacccccgaaaatttgncgtcttctcaanctcgctcccctcnttgcggncgggccccanatacgggnaccgcccggctggctccgaaactcgcaccccacgcccggcaggnncgtggacccggtggggcgagcnncggggcaagtacgangggaggaaggaaagggcgggcatggcggggcgccccccncacnaangggccccggggccgaccaccgaacnaanctttanncaaagcnttcctttctcaattggggggataagcgngtggnttgggcaaaagcagtntggcctnccntgtttggcgggttctcctggatgggttcccntcacctnaacaaaggcttttanttaaccaacaantttgggcantttga

SEQ ID NO: 88815 - DNA, 240 bp, Triticum aestivum
  unsure (1)..(240): unsure at all n locations
  Clone ID: PAT_TA_88815
gggctctcgagtctcctccaaccgtcaacctcctanctnctctactcgccaatcgccatggggaagattaagatcgggatcaacggcttcccgaaggatcgggangctcgtgggcaagggtcgccctccaacagcagaaggatgnngagctccgtcgncgtcaaagaccccttcatcaccacgaactanatgacctacatgttcaaagtacgaaaacgtccacggncactggtagcaaaa

SEQ ID NO: 88816 - DNA, 480 bp, Triticum aestivum
  unsure (1)..(480): unsure at all n locations
  Clone ID: PAT_TA_88816
ctcgagtttttttttttttttttcacnattaccattacaaagcanataccacaattatcaagaaagttttcgagacacttaacatctgatagntactgacaccaacattggagagtcgactgacaaccatacatagagcagagcaaaaatactgacgaccccaaagattttagcatactgtgccattagcacttgacctctttcagcccatgtgcaaagtacaggaaagttggatcagcagctccctccttgtagtacgcgaacaccacgccgccatcatcatgcatgctctcgcccaacaaagaactgaaggtccttgagcttgctaagaagatacttcgtggcaagactcaacattcttcttgaaaacatctaggtcatccccttcaagcttggcaagtgaggttcttgatgtancgcttcaatgtgagagataaactgcttcttgtcaaaagcaggttgctcctgaagacggaaggg

SEQ ID NO: 88817 - DNA, 495 bp, Triticum aestivum
  unsure (1)..(495): unsure at all n locations
  Clone ID: PAT_TA_88817
ggtcctgtcaagcacttgcatctaatcatccaccgcatagaggacatatggtattacgctcacgcagtccgaacctctctacatcgtgcatttgtatactggtgtgttagctctctattgcagtgatcttaggcctacactcctctctttctgattttcttcggtaccttgataacgtggtgttgcatcctgacgacaatacatgtattgggatgtcttcgtgtaaactctctaggttaagttgttggtggtttttttaactttctcaatgaaaccaattcagttcatatttaccagatattttgtagctttcatgcctgcctgccatcccatatgtgattcttttcttaagnttttttttgggtagaatcaatgcaacccatataactggnactttgcaagcttccgtttatcaagtttgncntttgggtatgttttcagctcttcgccttgcaagttcaagcattcanacgtggnaggaagactcaagcaaag

SEQ ID NO: 88818 - DNA, 494 bp, Triticum aestivum
  unsure (1)..(494): unsure at all n locations
  Clone ID: PAT_TA_88818
ctcatccctcccaagtcccaactccgctgctacgccttcttctacatcgcaatcacgcgcccgtccggctctcccccttctccctcgccctcacgcgctcacgccctcacctcagtcctcatcgctctcggncgcctgcttaaaccctccgctcgaaccggaacccaaccaagaacagatccaaaacgcaagccgcaccatgtctcgtgtcgcgggctcgcgcctcctccctaggatctctgcgctctccttctgcaccgcctccccggnaaccgccgccgcttcctcctcctcatccacagcggcggtggcaagcggcagccgccaccgcctccggaggcttcctccaacgccggaggaccatcctcccagccgncccaagactgnncggcaagncgtgggggnggggtcaagntcggccgnccntncgccggccgtngccaaccgcggnttgggcggnaacggggntacngtcaangctncgctntantcct

SEQ ID NO: 88819 - DNA, 452 bp, Triticum aestivum
  unsure (1)..(452): unsure at all n locations
  Clone ID: PAT_TA_88819
ngctggcgtgcccgccctgccctccaacttctcccgggngcaataaacaaatcnaggcgangcgaggcggcaacggcggcggcggcattgccgagatttccgtgattcttgcgcttgttagttgtgctgtgtataattgggccggccgggggtggntccgttcaattccttatctgttggagtagtcgtcngcggcgatgggtatcctcgcgctcatcaccggcaaagcgggggccancgggttcgggtncgcgtccacggcggagcangtcaccgacggcgctgangccanccgcctcaacgtcgctatcacangaggaagctaagtggcattggtctgggngacatcaaaagtcctcgcccctnagaggaggcccatgtgggcatcgctgctacaaacacaaaagggtgcatcangaagcaaagaaaagancatcatnggngaaagaaac

SEQ ID NO: 88820 - DNA, 480 bp, Triticum aestivum
  unsure (1)..(480): unsure at all n locations
  Clone ID: PAT_TA_88820
ccgcactctgccacaggtccacgcttccaccagcccactccccgtcgncgacctcacccccctcatggacggtggccgagccgcagccgtcggcggngacccctctcccatcgctgctccttccaatcccccggcgctgagcanccggcccgtcnatgtctcctcgttcacccataccccgtgctactgcgaanaaantgtttacatgttatgtaacgagcttattagaaccggagtggctgatcctgcgggcactgatctttatgttgttttcatatccancgangaaaaaaaggttcctctctggcatcagaaaacaggccattctgangatggatttatttgctgggattatcacgntgatatgnatccagtctnggcgaagcaaangaagntcttgattttgtttgggatcngggcctccgatcttcctttcccttccccanttgatccaaanaaggtttctgaagcgattcaaac

SEQ ID NO: 88821 - DNA, 477 bp, Triticum aestivum
  unsure (1)..(477): unsure at all n locations
  Clone ID: PAT_TA_88821
gagagaactagtctcgagggtttttttttttttttttttttttttttttttttttttttttttgtttggaaaaggntgtacttggaaggatctatccttttcctcacgcgctactgaaaaaaacttgngngctacttactaggcacagtcgaggtattgctggaattaaaaatatcttccctgaaaaatctcccagttccatgtaaccttccttaagcatcccatttaacttttaagaatgcnagctatattttcanggatgtcgtctttcgcattttcgncaaaggggncanctccgatatagagatcnaagagagacttgcacaagagcttgctctgaatgctccccacttcctcgccttcaatgcaaattttaaggacatggntaagattctctcgaaagctcaatcacagacccctttggnaatttgtattcaacccttgaaaacccgcaacaaaggctctgaagcaactctt

SEQ ID NO: 88822 - DNA, 476 bp, Triticum aestivum
  unsure (1)..(476): unsure at all n locations
  Clone ID: PAT_TA_88822
ccttttttttttttttttttttttcatgcaaaataaaatctgcatatatttcaagcctagtgctggggttcgttacaagagaagctctctcattccctatccccaccgcccacagtgagatgaaagtggatactaattcaccaaacgttacaaacttatgcaaatataatgcatcctccaacttagtttatttaaataggctagaaaggaggcatgaaccatgcaggacctgcggctgccgggatnaaactatgctgaggctggtattcttatcgccatcatctggaggagccatggcctatcgacgtctgggtcgataaaagtgtgcgcaagggaactgctctgcttcaacatccagcaactgtctacaccaatgtgacccggttcgatgggagggcgcctgggcctgancanctgtactcataaaagcaagcagttcgctccgntctcgggatttgtcccaanttgtgccaccc

SEQ ID NO: 88823 - DNA, 468 bp, Triticum aestivum
  Clone ID: PAT_TA_88823
atagacaaatgttcattctactgcatttgttgtgtgtgccaaattgagattattgtcattgatcctgaatcaaaagataagtcttcttccatataattgttaaataatctttgtgcttcttccgatttcccatccaatgagatgagaaagttagatatagatgtattaagaaatcttgcagcctccttgtcaaatgaaatctcatcagtttagtaagttcttgtatgtggctggttttcatgagtttagtaagttcttctaaggttttcctcctttaaaacatttgttcttgtagtgttccttgatttcttccatctatactgatcacttttgccaatattttcctctactggattgcctgcacatatatgaaataaataaagaatatacaatctttatcaaagggagtcaatattaatggaattaaaaaaataggaagtggttcataaccaatcaaagaaagttctt

SEQ ID NO: 88824 - DNA, 505 bp, Triticum aestivum
  unsure (1)..(505): unsure at all n locations
  Clone ID: PAT_TA_88824
gttcancgctcgcttaactctactgagctagtgtcancggggcacgcgcgaggggtgcctaactanctcggtcgctcgtgtccgacgagatgggagagcgccgngcgcggcgatcggtgcgcgcgcggnccgcgcctgcgacggctgcatgcggnggcggncgcggtggnactgcgccgcggacgaccgtacctgtgccaggcgtgngacgcctccgtccactcgggcaacccgctcgcgcggngccaccaccgggtgcgcctcccctcctccgtcctcgccggncgccacctcctcccttcagcaacgccgaaccccgacnagcccgcgtggctgcacgggctcaaggcgccgggccgcgcacnccgcgggtcgaagccccggngatggtgggcaaagcacggtggcgccccgccancgccnaaagggcgcggggttgcctccgggggttcccccgattctcnanggcgggnnggacntccgggttccnggnaatccgtgggtt

SEQ ID NO: 88825 - DNA, 455 bp, Triticum aestivum
  unsure (1)..(455): unsure at all n locations
  Clone ID: PAT_TA_88825
gtcagttnttgtcgnctcatccaagcagacccgagatacccaaaccctcgcaccttctcgggggnggaggcggcggcgtacnggacggcanaaatggccatggaggcggtgggcacggngagctccgncagtgggctccttgctatgctgcaggagnctgcnccggagctgaagctgcacacgctcgnccgcctcaactccgtcnnccacctcttctgggncgagatctccaccaagngttcccancattgagaagcttgtnncaagattaggagnttgagcagaggnagcttgcaccacttgttgtttctaaggtaatttactacctggggcgangctaaatgantcactgtcanatgcacttggngctggnnccctanttgntgtttccgacgaatcctgattatgnccatgctcttttggncaaaacaatnagggaatntngcaagtatcaa

SEQ ID NO: 88826 - DNA, 504 bp, Triticum aestivum
  unsure (1)..(504): unsure at all n locations
  Clone ID: PAT_TA_88826
tttttttttttttttttagaggcatcaagggatcantttattgagcaccaagttcagcaagcattgcactccgattatctttttattctttccttaccgaggtcaaaaccccagaagcaagctagaaagtcggggaagtcacgcacccaaacaggaaaccaaggcatacggttgctagctactgtcttacacacctcaacaggtacctcctatagctatccccagcatgtaacttgtgccaagaacacccaccaccaccaccaccaggtcaccacactaagcatcaacaaaacaaggcgtcgactgtctctttctcttccgagtcaccacaagctattcctaccctcctttgtgtttggctccggctactcaagaaagccaagtggcggcaagtggcangctgctgttgaagccccgattcgcatcctcctcttcctcaagcctctctgcgaatgataaaggggaagctccaggggactggggagggnattcaagccttgggng

SEQ ID NO: 88827 - DNA, 505 bp, Triticum aestivum
  unsure (1)..(505): unsure at all n locations
  Clone ID: PAT_TA_88827
ccggcggcaagcagcgcangcacaacaaccaaatggccaccatcagcgccgccgcggngaccaccgtcgtcgcccgtgccgccatcgccaggccgcaggccctaggtctgccccagctgaggacgaggagcgagagggtgaggtgcagctactccaaggacgccaaggaggcgacccctgccgccgccgtccgcggggctggcgcgtccctactcgccgcggcgggcgcggtgaccgccgtccgcgggggccggcgctggcgctggtcgacgaagcggatgtncacggnggggcaccggggctgagcctggggcttgagcaanaancntgctggggggtggatcctccctggggcgtcttcgggcctcatctgggtcgctctnaaaccgtntacacctccggggcttnaatanngaagaatgtgtcccgggcgggncntctccnctctnaagcgtacacatngangtttccctcggtcccttcccaatggtnatctcgntccnng

SEQ ID NO: 88828 - DNA, 478 bp, Triticum aestivum
  unsure (1)..(478): unsure at all n locations
  Clone ID: PAT_TA_88828
gtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccaagaaggagtcaaccctccacttggtgctgcgccttaggggaggcatgcagatctttgtcaagaccttgactggcaagacaatcacccttgaggtggagtcctcagacaccattgacantgtcaaggcaaaagatccagggacaaggaggggatcccacctgaccagcaacgtctcatcnttgccggcaagcanttggaggat

SEQ ID NO: 88829 - DNA, 484 bp, Triticum aestivum
  unsure (1)..(484): unsure at all n locations
  Clone ID: PAT_TA_88829
agctagtctcgagntttttttttttttttttatttcgnttcttttttanttaagaccttctcttctttancnttagttttatctactatcantagtatctaccggctcgaactcgaatttgntcgccttccatacttcacaagctgcggntagttcaggactccatttgnaagctgctcggataatttcattaccttcgcgagcaagatcgcgcccttcnttacgagcttgtacacaggcttctaaagccactcgattagctgctgcaccaaggtgcatttccccaagggntgtcctaaagttcctccaccaanattgnaagacannatcgnccccaaaagatttcgggtcangagctggcatatgccaaanatgaataccacctgnagntaccggtataacacctggcanggagaccccnagtcctgnggtgacaaaagataccggcgaggcacgattctttttcaaataaaaatcaaccgct

SEQ ID NO: 88830 - DNA, 477 bp, Triticum aestivum
  unsure (1)..(477): unsure at all n locations
  Clone ID: PAT_TA_88830
gggcgccactctcacacctaccaggaaaccaatcaaaacttaaaaccaatcgaaattagaccggcgacgaggattancgctcgccggcgatggattctgactacggcgtgcctcgcgagctctcggaggtgcagaagaagcgcacgctctaccaagcccgagctgcccccctgcctccagggcaccactgtcagggtggagtatggtgatgctgcaattgcagctgacccggcaggtgctcatgtgatcaagccatgcattccctcatacctatgggcagcctattgctcattttctcaggaagacagctgttgtccctgatgctaaggtcatatctgaacaccaagcggtcagggttggnattgtcttctgtggcagacaatccccacgagggcacaatgttgtttgggggctctatgaggctatcaagggcccacaaccaaaacaacaaactcaatggtttcctttggcggatna

SEQ ID NO: 88831 - DNA, 155 bp, Triticum aestivum
  unsure (1)..(155): unsure at all n locations
  Clone ID: PAT_TA_88831
cgcccactctccanttccctcccctcccccnccancctgtaatggccggtctcctccacntccantccangcttctcccatcngtttccgcgctccgccgccgtgcangngtnccggttcatcctcagtcccgccncacgntgccggattgatgg

SEQ ID NO: 88832 - DNA, 325 bp, Triticum aestivum
  unsure (1)..(325): unsure at all n locations
  Clone ID: PAT_TA_88832
tcgaatcgatctggttgcagnaacaatgggtgccattgncgccttctccctgatgttgctcctcgcttgttctcctcctgttcttggcttcacgangagcgacttcccnccngagttcgtcttcggggtcgncacctccgcataccaatatgaagggtgccgttgctgntngatggcaagagcccaagcctctgggacaccttcaccncacacacaggaaaatgtcggtgtcaaaacaacaagcanatgtcgcttgtcgnttggggtatnacaacgtacaagngacngaggntcaangctcaatggtcntnggactaaaactaaa

SEQ ID NO: 88833 - DNA, 311 bp, Triticum aestivum
  unsure (1)..(311): unsure at all n locations
  Clone ID: PAT_TA_88833
tgcagctgcaactgagccggcgcccaggaggccggccggcagaggcgagcacgaggatgaggaggagaagcaagcaccatcaccagttcaccaccacccagcgtatcagtttgatcaccagccgctgcatgcgcccgcgcgcgcgcgctaaaataaaataaaaccgtcgtgttccaccttaattaattctgtatgccctgcgtgtgttcgaccaagtgtccttcctcatgcctccacttccaatgaatatatggcgcctcaactttaaanaaaaacnaacaangnanaaaaaaannaaaanaaaggggggg

SEQ ID NO: 88834 - DNA, 241 bp, Triticum aestivum
  unsure (1)..(241): unsure at all n locations
  Clone ID: PAT_TA_88834
atttcagaaggaggtttgattaaggatggcattaacagggatatggacgtcatttgcttttctttaaagtcttcttaaggcatttgtattatttacctgtataagatatatttgcttccgctgtgagttgtatcttggtcgcaagacccttgtgttgtatccatatgttaaatttgactcttcagagttgttgcatatatatgttgttgtggatcaaaaaanaaaaaaaaaaaanaaaaaa

SEQ ID NO: 88835 - DNA, 479 bp, Triticum aestivum
  unsure (1)..(479): unsure at all n locations
  Clone ID: PAT_TA_88835
ggctagtgntccaaacaaagaacttccctttattcctccttggnaaggncatgccaacgtcgagcccaggaggnggaagtcaacgtaaccaagcgaacccatccatggcctccgctgctgccgtcgtctccctcaacgtcggnggggagatnttccagaccaccaccgccacactttcccgcgccggcgcctcctccccgcttgcctccctcggtccctcctccccgtctgntccgcacttcctcgacggggacccgcgcctctttgcccaactcctatccttcctccgccatggggcgcctccttgctccgtcctatccctcaagccacgctcctcgctgaaggggcgccacttcgcgctcgatgggagccctcctcgcttctctctcccggntgnaagncgcatcatctggaaggaaaaagaggaatggttgtataattgagtgctactggaattgggtgtttgtggcaacggnggg

SEQ ID NO: 88836 - DNA, 496 bp, Triticum aestivum
  unsure (1)..(496): unsure at all n locations
  Clone ID: PAT_TA_88836
gcaactcgcaaggcaagcaagagagcgaaggaggccaaggccatcgctctcctagcctcggagacttgcctttgcatacacatccccccggagggcggtgtgagggcatggctgcaaccgtgaggagggntgcttcctccgtcctctctcgcttcctcctcacaaagccttcgccttcgcctgcttctgccgccggcaataagtccgctctcctcggagcaggggctgctgctcttcacaaggttcaagcacccgcaccggcatccgcggncgcggccgcaagaggagccgattcaagcccgcggtggaggtgaagcacacccaagctcctcatcaaatggnaacttcgtcgacgctgcttctgggaagacgttccccgacgctggacccgcgcaccggcgaggtcatcgccgcgcggtcgccggagggcgacaagcgaagggacatcgaccgcgcccgttgggccgccgcccgcaagggtcttcgacgaagggcc

SEQ ID NO: 88837 - DNA, 471 bp, Triticum aestivum
  unsure (1)..(471): unsure at all n locations
  Clone ID: PAT_TA_88837
atagcccatgaccactgaatccccagctaccacccaccctttgttcttctccacaatctctcaaaatcttcccctccgatgtctcccagctgctggttcttggcctttctcctggtgtggngtctgccattgatgntcgtgatggacgaggagcagcagggtggagactgctcggccatgangtgcggcaacgtgaacatctccgatccgttctggntcacggncaaagttaccgggaaatcatgtggtcgtcctccctaccaggacttcgatgtcgcttgtattaaccacacttctccanctcnacggagctctatacccttcannatgggctataanatcctcaacatctccnatgagcancgcaacttctacgcggttgatctgggcaaggtcaacgtggttgcatgnccgcancaanctgccatganccgttctacancacctcaaccanagctcaancgntccgtt

SEQ ID NO: 88838 - DNA, 484 bp, Triticum aestivum
  unsure (1)..(484): unsure at all n locations
  Clone ID: PAT_TA_88838
ctgtgaaagaaaggaggtctttattctcttgatgtcagttcaagtttacaagtacaagaataccaccgttgatgttaaactggacacagaatcaaatatctctactacattgactgtgttggacgctttgccatccacaaagcttgtcacttctgtgaagctgcctgactacaattctggaaaggtggagctgcaatacttccatgagaatgcaacttttgctactgttgttggcacgaagccgactcctgtgattgatctttctgggacagtaggtgctcaaggagttgcatttggtgcagaagctgggtatgacactgctacaggaaaatttaccaagtacactgctgcaattggtgtaaccaagccagactaccatgctgcattcattctggcggacaaaggtgacaccattaaagtgtcaggtgtttatcaccntgatgaagaaacanaaggcctcagctgtggctgagctaacccgggg

SEQ ID NO: 88839 - DNA, 570 bp, Triticum aestivum
  unsure (1)..(570): unsure at all n locations
  Clone ID: PAT_TA_88839
tcggaacgaagggggtccaaagaaacgtctccaagccaaatttaaaacnnctnccccctttncccaaaacggccgnggngattncaanctgaanccgccccggggcgaagaancccaacaangcccggggcgccatggggnaacggggaaccgcatgaacaacttccttgangggngngcgcgaaaancgantaagggtaacgttcgcaaggncctctggggccccgtgggtcnctgggtggattgggatgngggcgggtggnccgccaatgtanngaagctccctcccntggtttggggcaacgaanaaaccntcantcngggggnaaatcaancncttntcccaggggggggagnttcaaactnacaaattcnaaggtttttcgaanggaaaanaancttggggggtaaantnggtcaaaccgaatttcccctgnttttggnaangaaaaaaaaacccccccttcaatatntaaagtttggggnacctgggngaanttccttggggnaanaaacctttntttgnggattccaaacngncccnccctcanaaaactaattgngtatttt

SEQ ID NO: 88840 - DNA, 469 bp, Triticum aestivum
  unsure (1)..(469): unsure at all n locations
  Clone ID: PAT_TA_88840
gcangcggcagtcggccancgcggcgccaaccttggctccccgtcactctcgcgcttccggtatggcttccgcctccccggccggtcccgcctcttctctgagggcgtggcggcggcgtcactccgcgtcggntctctgccccagccacggacccatggcagcggcggtttcgcgcacctcggggccatgggtggggaggcgccgaggctgccgcacgccctcaggagaatgcttatcgatcatcaggtgcgttcgattacgctttcgcttgctgcagtgagagttgaatcgatcgaaatgtgaaccaaatacttgaaatttcacgtgatgtggggtactgtggcaatgcataagcccacatggagcactgagtcttctaggtgacacacacacactgacattgcaactgaataccctgttgatgtnggctatggctacggtgtacatanagtcaatagattanatatc

SEQ ID NO: 88841 - DNA, 484 bp, Triticum aestivum
  unsure (1)..(484): unsure at all n locations
  Clone ID: PAT_TA_88841
tcgaggttttttttttttttttttttttttttgaaattattatccgaattatgtaaatgacagtggngacaaatccccttcatcaactacaaaagtaccgcctgcttcataacaacaaagaatttataaaaagaacctgctgctgaattaatccctcttccctctcaaaaagagctatatctatgggggagcctaggctggacccaatcatactttcttttcacttcagcagggaagtgaatgcacccccagggactcccatctacttggccttgtctttcccagccgcggggccagccgggttcagctcatcccaggcctccgatccaggtgaccatggngtcaccgagcttggnaaagtaggggtcgatcttgccaangcttctncttcacctgtccagagagggtagatgtaccacttctggncggtgtcgcaatccttggggaatggtcacgttctggaagaaggggatgatgtcctcnn

SEQ ID NO: 88842 - DNA, 226 bp, Triticum aestivum
  unsure (1)..(226): unsure at all n locations
  Clone ID: PAT_TA_88842
gnttgctagaagcttatgcctgaacctgccccaactgggacaaaattttcaccaccaaatgttggtgtcngtccatggatagcatgccaagtttcatgaatttcataccagttttatatttactanaatttaaaatccaggcacancaacatttgccagtaatcaacagtgnganggggggttgaanttcattcccatcacctgcangggnnctacaaattcacct

SEQ ID NO: 88843 - DNA, 459 bp, Triticum aestivum
  unsure (1)..(459): unsure at all n locations
  Clone ID: PAT_TA_88843
gtcgcctcctgcttatagttcttcanagcttaatacaaattgcgacgaaagcctcctgaagggaactacgtgcgcanttttgtactctggtcactactcagggtaatacataggtgacactcgatcgtcagtggngtcnaaataaggagaaggctactagtttgnttatgcataatttgactgtaatggctgacaaaataattatgaaagaattgnccgtcaagcttgctcatcntcatgtatatttgttctgcagcaggacangagcttctcaactctancaagagcaagctcngcagaaacaactgttgctaatgatctacagaaacacacaatgcaggacgtccctgntcatcatancctaancggaccaagntttttgtnggcagaaacaatcttcaccnncatttcttatttactcctaactcangttnaaaccancattggcngggggntcng

SEQ ID NO: 88844 - DNA, 461 bp, Triticum aestivum
  unsure (1)..(461): unsure at all n locations
  Clone ID: PAT_TA_88844
caccagcacagccgcgcatccaccgttgctagcaaggtcgaccaagcagcaccgatgatggctgctgccttctcctccaccgtcggtgccccggcttctacgccgaccaacttccttgggaagaagctcaanaagcaggtgacctcggncgtgaactaccatggcaagagctccaaggccaacaggttcacagtcatggnagcggnaaacctcgacgagaagaggaacacggacaantggaagggtcttgcgtacnatatctccgacgaccancangacatcaccangagggaagggcatcgtggactcgctcttccaggcgcccacgggcgacggganccacnaggccgtcctcagntcctaaaaagtacgtcaagcaagggactcaagaattactacttcgacancaccatggggaggcttctacatcgctcctgctttcatggggaangcttgtttgt

SEQ ID NO: 88845 - DNA, 160 bp, Triticum aestivum
  unsure (1)..(160): unsure at all n locations
  Clone ID: PAT_TA_88845
agccttatcccttcncctcccaccgctctgctctctngncgccgctcaccagncatagacgccgccccactgccgcatcncagttcagcgncgctgctcaatcncaggcacgtccggacgccgcatcntagatcagcggggccggncncatctcccgcgg

SEQ ID NO: 88846 - DNA, 378 bp, Triticum aestivum
  unsure (1)..(378): unsure at all n locations
  Clone ID: PAT_TA_88846
nggtacgaaggaaaccggcgcgaggagggcaaaggaagagaacaggagattaccgagcccatcgcgcgcacaagacagcangcgccgcnatctctgagcggagatggggctcacnttcaccaaagctgttcanncggctcttctncaanaaagagangaggatcctnatggtcggtctccangcggntggtnaggaccaccatcctcnacaagctcaagctcggggagatngtcatcaccatccccacaaacgggtttnnatgtcgaaactgtttgnagtaaaagaacantaatttcaccgtttgggatgtccgggggcanagacaaaatnatggccctgttgnggggacnacttccaaaaanacccaaggggcgccc

SEQ ID NO: 88847 - DNA, 163 bp, Triticum aestivum
  unsure (1)..(163): unsure at all n locations
  Clone ID: PAT_TA_88847
gaancagggnggcagccnggctgggaagggagaggaacannttcanctcagangattcattgggggttcaacgtggcatcttctctggggggcacgatgtggttccactgncccnggacatacctcagctngtcntccccagttccnnagtcggtctgtgcga

SEQ ID NO: 88848 - DNA, 461 bp, Triticum aestivum
  unsure (1)..(461): unsure at all n locations
  Clone ID: PAT_TA_88848
ctgagcatactagctaacaccaagtccattaccagcgatccgaaagaagacaagaaggctctgacctgccggcgatggagagggtgacaaagctgtcgtccgagaaagcggtggtgatcttcaccacgagcaactgcccgatgagccactcggtgacaagcctcttctcgagcctcggcgtgggcgccgcggtccacgagctggacaaggacccacgcggccgcgacatggagcgcgacctcgccagacgccttgggcgtacgccgcccgtcccggcagtcttcatcggcggnaagctcgtcggctccaccgacagggtcatgtccttgcatctcaagcgggaagctcgtggtcatgctcaaggccgcaggagccatgtgggctctgaccgtggggtgcaacatcaagttcatcccagctttggcaattttcgcacctccccatggnagcaangtatnccg

SEQ ID NO: 88849 - DNA, 498 bp, Triticum aestivum
  unsure (1)..(498): unsure at all n locations
  Clone ID: PAT_TA_88849
aagcggtgcttgcccagtagagagaganagagagagagatggcggcgtcngcggcgacggngaccgcgacngcggcngcggtangggcgggggaggtgatctccgtccacagactggaagcanatggaccatgcanatngaggagggcaacnccnccaacaagctggtggngattgacttcactgcaacatggtgnggaccatgncgcattatggntccaattttcgcngatctccccaaaaaagttcccangctgctgttttcctcaangtcnaccgttgatgaaatgaangcccatttgttgagcaantcaaccntggttgggcantgncanaccntccctnttnatgaaagggaaggngatnncaatggacagggggntntccggngcctattcaangggnggaactgcnnaccaaagggttggggcctnacacctccggncccaantaantcancctaaccgggcgttaataactccccccanaantaaaaant

SEQ ID NO: 88850 - DNA, 483 bp, Triticum aestivum
  unsure (1)..(483): unsure at all n locations
  Clone ID: PAT_TA_88850
tgatcaccaacacagccgcgcatccaccgttgctagcaaggtcgaccaagcagcaacgagatggntgctgccttctcctccaccgtcggtgccccggcttctacgccgaccaacttcctcgggaagaagctcaagaagcaggtgacctcggccgtgaactaccatggcaagagctccaaggncaacaggttcacagtcatggnagcggaaaacatcgacgagaagaggaacacagacaagtgggagggtcttgcctacgatatctccacgaccagcaggacatcaccaaagggaagggcatcgtgggnctccctcttccangcggcccacgggcgaagggaaccaacgagggcgtcctnagctcctacnaataagtcagncanggactcaaagaaagtacgacttcgncaaaaacatgggaaggnttcttacatcgctnctgctttcatggacaancttgtttgtccaatctctccaaagaan

SEQ ID NO: 88851 - DNA, 452 bp, Triticum aestivum
  unsure (1)..(452): unsure at all n locations
  Clone ID: PAT_TA_88851
gcgacgancagaggaaggagcggcgatgggttcctcgcagacggngataagataaataaagaagcccaggagcttttaaagcttacattgtgcaagacccgagtcaacctgatcgtgaataccattttaaccggatttttatggattctaatagatcagacccctttaatggtaaagtttgctcagtgaantacatttaggtctctatgtaggagcttttaatccatatggacttgaagtcgtacagctccatcaaaagtttggtcattagaatagnactcatgatgtggagtttttttgtgtacgtttaaccanttattaggtggaatggngatctgaatgtccttgctggataggtttacaggntctcattcggtttatgcttaaaaaaatatattttangcttccacaaaaaaataagttgccattgtatttttancttttaatttttg

SEQ ID NO: 88852 - DNA, 476 bp, Triticum aestivum
  unsure (1)..(476): unsure at all n locations
  Clone ID: PAT_TA_88852
ttagncgtcagacagtaatttagagcacccacaggccacaacatgaacagagaggnactttctccatttacacaatttctgcatcgtcaacggcacaaatctaagccatgcaggcaggcacaaggtctgcctcacaggctttctgctacattanncaagaaaccanaagaaacaacaaaaatagccaagcaccaactgcaaatatgcagatttatcccaccagtcactattcacantttcacaacatccagagccaatcttcgtttacccgcccccacctaaaatcctatgccttttatgtcacacangaggaagaaacctaggaacaacaccagccaagcccgnnacanataaatangagggggcaaagcggctaccgcccaaagctatccctggaggagagcctcngacccccggggcgtcgaaccagcgagaagcgccatgggccaagcatcatctgctccctcaanaggctg

SEQ ID NO: 88853 - DNA, 472 bp, Triticum aestivum
  unsure (1)..(472): unsure at all n locations
  Clone ID: PAT_TA_88853
ctcgtgccgccctcactctcgcctactccctccgcgcccgccggcgagcggatccgccgccgccgccgccgtctgaccatgaagcagctccaccggcagcccagcctcagcaagcagcaccgcccgcaccaccgcgcctccctctcccgctccctcgcctcctacctcctccgcgagcaccgcctcctcttcgtcctcctcggcttcctcctcgcctcctccttcttcctcctctaccccgccctcgccccgcaccccatctccctctcctcctccgcctacgccgccaccaccacttctggcatcaagaaacccccgcgtcttctccttctccaaacgccaacgcctcgncccgccgtctccncgtcggggtccgcaaanaagcccctggcgggtggtcgtcanccgggggggcgccngggcttcgttcggggaanncacctcgtccnacaagggtccctcgcccngcggg

SEQ ID NO: 88854 - DNA, 545 bp, Triticum aestivum
  unsure (1)..(545): unsure at all n locations
  Clone ID: PAT_TA_88854
ctcccgcactcaacccaatccccacctacccgcaccccatggcgccgaaggcggagaagaagccggcggcgaagaagcccgtggaggaggagcccgcggcggagaaggccgagaaggcgcccgccgggaagaagcccaaggccgagaagcgtcttcccgcggcgggcaagacctccgccaaggacggngacaagaaggccaagaagaagagcaagaagagcgtggagacgtacaagatctacatcttcaaggtgctcaagcaggtgcaccccgacatcggcatctcctccaaggncatgtccatcatgaactccttcatcaacgacatcttcnagaagctcgccgggcgaggccgccaaactcgcgngctacaacaaagaagcccaacatcacctccccgcgaagatnaagactccgtccgcctcgtcctccccgggggaggctcgncaaanaacgccgntctccgaggggnacaaaagncgntcaccaaagntnaactcctcccnagttnnccccgcccccccctncatggggganccgnnttg

SEQ ID NO: 88855 - DNA, 378 bp, Triticum aestivum
  unsure (1)..(378): unsure at all n locations
  Clone ID: PAT_TA_88855
atcagtntgaaaaangaagncttcaataagacgcaaaagtctcatgtgccaaacaagaangagctctctttgttagatcngtactgtggngtgtggngggatgtcaacnggactttgncntggggctcgtggtgggggngngaatcttgtgaccaaatgggctgttgataatgattaaantgcatgtnnaagcttcaaaangaatcaaccaaaaactccgggtccgcaangaaactaccgntggtttccntgnaatgcngcnaaaatggcaaaanttatgccaacactatgtgcngggaagtgaaagnagangggcaaatgcnnacgcctntaacanaatttgggnaatggggactccangattaatcngcccncccc

SEQ ID NO: 88856 - DNA, 533 bp, Triticum aestivum
  unsure (1)..(533): unsure at all n locations
  Clone ID: PAT_TA_88856
ggagggacttatgtcaccacaaacagaaactaaagcaggtgttggntttaaagctggtgttaaagattataaattgacttactacaccccagagtatgaaactaaggatactgatatcttggcaggcattccgagtaagtcctcagcctggggttccgcccgaagaagcaggggctgcagtagctgccgaatcttctactggtacatggacaactgtttggactgatggacttaccaagtcttgatcgttacaaaggacgatgctatcacatcgagcctgttgctggggaagacagccaatggatctgttatgtngcttatccattagacctatttgacggaggggtccgttacnaacatgtttacttccattgtaggtaacgtatttggtttcaaagccctacgtgctctacgtttgggaggatctacgaattccccctacttattcaaaaanctttccaaggcccgcctcatgggatcaaggttnaaangagaaaangtgancangtatnggncggccctttanctgggag

SEQ ID NO: 88857 - DNA, 288 bp, Triticum aestivum
  unsure (1)..(288): unsure at all n locations
  Clone ID: PAT_TA_88857
angagccagcttanacatggggcgncgccaactccancgtctccgggctcgccggggncgcgctcaaccgncgggcaggcttctctnccannttcactanatggtgcccgggtgtcgcgntaggaaaccgctgatgacgaggaacctgganaggaaagggaaggatcaactgcaatgacgttcccccnggactggnctgcggagggaactgaacgngatngggttcgggctgaatgggtgggtggcancgnccaggcaancccgctngttaatgggaaacaaaattgg

SEQ ID NO: 88858 - DNA, 533 bp, Triticum aestivum
  unsure (1)..(533): unsure at all n locations
  Clone ID: PAT_TA_88858
ggagaagtgcctgagggatgccaagatggncaagagcactatccatgatgttgtgcttgttggtggntccaccaaaatccccanagttcagcagctgctgcaggacttcttcaacgggaaggagntctgcaagagcatcaancctgatgaagctgttgcctacggtgctgccntccaggctgnaatcctcancggtgaggggaacgaaaaggngcaggaccttctcctccnggatgtcaccccactgtctcttggncttgagantgctggnggagtcangactgtgctcatcaccacggaaaccaccatccccnccncagaaagngcaggncttctccaccnantccgacaaccaaactggggtggtcancaaacnntttngggggggggggncaaggaccanggnnaacaacctcgntcccgcaanggttgaagtctcntggaaccccnccntggccccaagggnggttnccanaancaaatttcanggctccncaatttgaanccaaacggnttntntttttttncctttt

SEQ ID NO: 88859 - DNA, 558 bp, Triticum aestivum
  unsure (1)..(558): unsure at all n locations
  Clone ID: PAT_TA_88859
ctctttcccacttagctagctagcagccatgggcgccctctcctctgcagccgtgtccgtcccttccttcgccgccggcgccaaggtggccgctccccggagcagcaggatggtggtgcgcgcgtccctgggcaagaaggccgccagcgcggccgtggccatggccgcgagcgcgatgctgctgggcgggtcggcgatggcgcaggacgtgctcctgggcgccaacggcggcgtgctggtgttcgagcccaacgacttcagcgtcaaggccggngaagancatcaccttcaagaanaacgccgggtaccccgcacaaacgtgggcgttccgacgaaggacccggtggncctccgggtggtccgnggtctccaanattctccccaangggagggagtacctcaaacgtcccccgggggnagaacctttttccgtnnacgccntcaacggttccccggggaaccnaagnggcnttctanttgcgaagncccnaaccccngannccccgggaatgngtccggcaanggntcanccggtnaaacnaaaatgtnntcttaacc

SEQ ID NO: 88860 - DNA, 282 bp, Triticum aestivum
  unsure (1)..(282): unsure at all n locations
  Clone ID: PAT_TA_88860
cggctcggggagcanctgatnccgcaagacgaangggtgtttcacaagaccgtggcggagctgctcccnccgcgggtgatctgcntntggaanccgcgcaagtcaccggcgcccgggccgcggcgagccgctgtggngctccnggtacctgcgggacaantggatnganacggacctgccgggcgaccaaagtacgngagcaacctcaagttcctnggncaacaaaccacccgcnagggaacggccgtaccctgtancggggnggngaaaanaagngacgcc

SEQ ID NO: 88861 - DNA, 485 bp, Triticum aestivum
  unsure (1)..(485): unsure at all n locations
  Clone ID: PAT_TA_88861
gacncctccctcccancgcacagncatggncancacaaccttatccctccacgggctcccgtccccgaccgncaagaagctcacctcctccttcctcggggccccctcctccttcctccgcccggcggnactcgcggccgcggtcacgcccgcgcggagggtgttcgccgtcagggncatggtgncccccaagnccggggacaagccnaagaaagtggtgggcatcataaagntggngctggnagcggttaaagcnacgccnggcncgccccgtcgggcccgcgctcggcncaaagggtgtnaacatcatggccttntgcaaggactacaangncaagacggncgacntaacncggttacattantccncgtcggagatnaacgtnttcgatgaaaannagctttcacctttatctttgatgacaanccctgntttcagtntntgttncctccaangggtncaaagngtttnataaaaacgtctc

SEQ ID NO: 88862 - DNA, 159 bp, Triticum aestivum
  unsure (1)..(159): unsure at all n locations
  Clone ID: PAT_TA_88862
cacaaacaaaaactaaagcangngttgggtttaaagctggngttaaagattataaattgncttnctacaccccanagtatgaaactaangntactgntatcttgggancantccgngtaagtcctcaacctggggntccgcccnaagaaacaaggggtg

SEQ ID NO: 88863 - DNA, 434 bp, Triticum aestivum
  unsure (1)..(434): unsure at all n locations
  Clone ID: PAT_TA_88863
gatgccantgancacggcacttccagcttcccggttgctgctgttcacaggatcggcatattatacatcangattttcaacactgacaggcatggtggggaatgtcctggngaggaagcttgatggaggcaccggccgctttggttgccangacagagctgttcccaattgatcangggctgtgcttgccggacaacttggaggncccttatttccagtggntacactgggcgcaggcgncaattccnttctcccnggnagngctccnagnacataancaaacttgattcgatnaagggatgctgnnatgctgccgggagaantgcccangnnacaggaggnttgcctcccagtccctatcctgtgnncaatcttcctcaaaggaaaggtgcgcgncttccgggcctttgcttggnaagnggaaaagggggaag

SEQ ID NO: 88864 - DNA, 504 bp, Triticum aestivum
  unsure (1)..(504): unsure at all n locations
  Clone ID: PAT_TA_88864
gctgccagctgccacccgacacagaatcaaaagacatgagctcgtcaacccaagaaacccaaatgccaggccacgtgcacttagtcatggtcatgttaatcatgtaaaggttgaagaagctcgacgggacccaaaaattgtgatgggtaccctcctaagtgaactcagtcccagcttctgttctatttgattcgggagcatcacattctttcatttctgaagcatttgcacgcaagcaaagaattgtccttcgngaatatgtaccctccactagtgggtagctctccaggctctaggtgggntaccttgatgatagcccacaacaaatcgcattgaaattgggggggtcagtattcactgnttcacttatggncctcaanggttccaacataagatggcattctaggcatgnaattgggttgggtcctcaccaaaacccgcatcggaccggtgctggtggagattagtccaagctcaatcacctttctggggcangncggcaat

SEQ ID NO: 88865 - DNA, 549 bp, Triticum aestivum
  unsure (1)..(549): unsure at all n locations
  Clone ID: PAT_TA_88865
ccaacctcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggncactggaagcacagtgacatcaagctcaaggacgacaagactctgctctttggcgagaagccagttaccgtcttcggcgtcaggaaccctgaggagatcccgtggggtgaggctggtgccgattacgttgtgggagtccaaccggtgtcctcactgacaaggacaaggggcgctgctcactttgaagggtggnggcaaanaaggtgggcaaccnctgccccaaagcaaaagatgccccctatgtttgtgggttgggggtcaacgaaggacnaagtncnccctcnagaccgtttaacattgtcctccaaaatgntanctggccaccaacttaactgg

SEQ ID NO: 88866 - DNA, 252 bp, Triticum aestivum
  unsure (1)..(252): unsure at all n locations
  Clone ID: PAT_TA_88866
anncgggctgtcgcanggcgtgcgtctcccaagcccgaccggnaggngcgccaagcaggttcancgtgagggcgtcgtccgcgggggcggaggccgccggccgccgcgcggtccttggtctcatgggcaagnggngtcgtctcgaagcgcagttcgctcangtggtgcacgccggcaccgtcncggccatcaaagttggcccaaacncccgcncgctctcctgntggantccccgngtacnggtnaaaatcc

SEQ ID NO: 88867 - DNA, 544 bp, Triticum aestivum
  unsure (1)..(544): unsure at all n locations
  Clone ID: PAT_TA_88867
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtggggtgccttgcctcgagttcaagcaaggttgggttcatcttccgtgagcacaacgcatcccctgggtactacgatggccggnactggacaatgtggaagctgnctatgttcggntgcaccngacgccaccangtgatcaacnagggtggaggangnccangaaggggnaaccntgncncctatggtccgatcaatcgggattcgncaaacannggtcaggtgnantgccncatttcaatngtcctttaangcaacgggggttgngg

SEQ ID NO: 88868 - DNA, 524 bp, Triticum aestivum
  unsure (1)..(524): unsure at all n locations
  Clone ID: PAT_TA_88868
ctcccacccaacgncgtcctcctcanccatcgncgncgacctcgtccctccctcccctcaccanctctcnctaccctatgccccagatcaagtcnagnaggtcgggatcccatcgatccacagccagatncgccaccccgacccgctcctcgtnccacccaccccaatcggagggagtcatccctcgcggagcggnatggnctcggggatgctctcgctcacctgcacgggcctcggggacgcgaaggacgacgacnacggaggcgtcgtcagctacgtcaaggggaccaaccgccttgggacnggtnccaatctcctcgcctttccccgtcaagggctacgtcangggaaaccantatcncntgggcggcgcaanggccccgggcgggnganccgggccgaaagaagncgcgccgcctacgggnggtatgggngaatngaggaggcccctgggtnttcctttncgtcccngcccaagcaaagctgntccaaggtnnattnttgttgtaangnccggcaatggg

SEQ ID NO: 88869 - DNA, 543 bp, Triticum aestivum
  unsure (1)..(543): unsure at all n locations
  Clone ID: PAT_TA_88869
ttaccaaggctacttcagtatgattaatataaatggtttaaagaaaaacaagtgttgggtttcttttcctatacatgtcagtatactttgacagccaagagatgtggcccaagcattccgcgccttcacagcatcattcagagtcactgtaaatcataattaatcttcacttcttcaccatggnttctactggagcacccaaccgtaaaagatgtgatctcggngcaaagactccaccactatcagaattccagatactgcaattcaccagagcaagcaagatcatctgtaggaaatgnacagataggaccacatggtatttcagcatctgcagaaactgttcgaggtaaagcaaccccggtgaaaacatccacctgaaagacagncattttactaactactgaaatccaanagaaaaatctttggttacaaaggcacccttaatagattangggaattatcaaggtacgtcaccggctaattttcatcnacaagcctcaaggttntcaagnccaanntggntttggggcnagcagaaatgca

SEQ ID NO: 88870 - DNA, 424 bp, Triticum aestivum
  unsure (1)..(424): unsure at all n locations
  Clone ID: PAT_TA_88870
gtggaagcgaaatcagtatcttggnangagccataagtatttacagactccancaagttcacagcaagataatcgagttggcccccttaagcatatagtcaggctaactttgttaattgttctcaagcaagtaaagcacaacggcatgtacaagcccgttgcttgcctaancaccagctattcttttgtttantgtgttaactggcccgaggatacggtagtatggggaaactccgagncttcttgnangttatttggccatgaccnccactagatgtcaaggnanncttcggggtactaatgcncgtttganaantgncaagcttttgcaanattgntcacanaaatttcatgattgcacangggttcaagtgnttcncntttcccttagaaaaaacccaatccanaaaccttcaacggggaa

SEQ ID NO: 88871 - DNA, 217 bp, Triticum aestivum
  unsure (1)..(217): unsure at all n locations
  Clone ID: PAT_TA_88871
ananattcggacttcggcaancaagcaaaacaanatcctccttggnnaggaaattttgtccaaaaaggttgctggnttttggcnttncaaaacttgttaccaangggacaacaagttttgtgcaatccaaatgcnttacgtggggatggtgggntacaatancncccngagaangntanccccggagctttggtaacnaaaannaaggaaaggcccc

SEQ ID NO: 88872 - DNA, 684 bp, Triticum aestivum
  unsure (1)..(684): unsure at all n locations
  Clone ID: PAT_TA_88872
gcgggggggcgggcngctctagaaattagtgggattnccccgggcttgcaaggaatttcgggaacgaggccaatccccaaaaggaaatcccccatctcaaaaaacccttagcccggtccgattccgggnggagatggncaaaccccgaggggtgtttctttcgaacatgaaccgtccggngggcgcggccgggccggggcgcaatccgtggatgggagcttgttcaaagggacgccggtgcccgcgngacgggtggganaacttnccgcgcgctctggaaccgggggagaagggggggtcggcaanggagcgggnaaagccactgcactacaaggggcaagntccgttccaancgcgtggatcccccgactttnangtggccaggggncgggcgacttnaaccaaaggggcaaaggggaaccgggngggcggagtcccatctacngggggagaagttccgccgacgagaangtttcgtcccacaangcaacaaccaaaggccccggggatnctcctcccaatggggcaaacggcgggggcccccaaacancnaacggggttcccaagntctttcatcttgnaaccggtccccctggcaatttggggttcggacggnaaagcaaggtgggnctttcgggggagggtcctccnaggggnattggtccgtcngtccaangaacaatc

SEQ ID NO: 88873 - DNA, 386 bp, Triticum aestivum
  unsure (1)..(386): unsure at all n locations
  Clone ID: PAT_TA_88873
ggactaagtctggcgggcgcccctccccanattcccccgccgaatcgccgtctcgacctctccccaagattccccgncgaatcgccgtctcgagctctccccgggtcccccgccgcctgttgctgagctcctagnctcccgcggncccgctacgattcacataatangggattggggaacctcgcggatcgggagagaggaacngacggnggacaccgncggatcacnncnaggaggnaaacgnatccggggccgcccgcccgccncccgnctcctgtctgggttcancgatcagttctgngccanccgataactgnctntgntaaccaangngagggnagcatccttatnctccntcaattttcnggnggggtttcccanagggc

SEQ ID NO: 88874 - DNA, 390 bp, Triticum aestivum
  unsure (1)..(390): unsure at all n locations
  Clone ID: PAT_TA_88874
ggccggccgctccnagaactaagtgggattccccccgggcttgcaaggaaatcccggaacangggggggctcccttccccgaacgggtgntgctcccngaaagangtggccctttcaaacccggnccgccccccganggggggatgtctccccaacccctgaagaaantcccgttatggcaacctcaanaatnaagactatggttagggaagaaaangtccttngaagcttgtttcaanggggtnatgtttatcctnaccacatccgggntaagggaagaaactggggggngangggntggcacattttattttggggatgnacanggctaataggcatancctgattggcggtttgggcgggttgggnaaacttcnggtattgattgca

SEQ ID NO: 88875 - DNA, 528 bp, Triticum aestivum
  unsure (1)..(528): unsure at all n locations
  Clone ID: PAT_TA_88875
cccccaccgtgatgggctcgtcgggcaactccgtcgctcctttccaggggctcaagtccaccgccggnctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcaagcacggaggccctccttaagcaggtcgactacctgatccgctccaagtgggtgccttgcctcgagttcaacaaggttgggttcatcttccgtgagcacaacgcatcccctgggtactacgatggccggtactggacaatgtggggagctgcctatgttcggatgcaacgacgccacgcaggtgatcaaccgaggtgggaggaggtcaagaaaggagtaccctgacgcctatgtccgcatcatccggnttccaacaaacatgcgtcaaggtgggagtggcggtcagnttcatccnccntcaaagccaaccggggcttgngnaggagg

SEQ ID NO: 88876 - DNA, 508 bp, Triticum aestivum
  unsure (1)..(508): unsure at all n locations
  Clone ID: PAT_TA_88876
cgcaaancgggcctgcttcggcctctcgcgggccccgccgggcagctctgcgccccgcgccagcgtccgagctcttcgaagtccgctgttgtctgagctcgccggagtccgtcctgtgcaagctcgccggagtccactctgcaccgtcgtccgccccaagccgtcaagctcaccagctcctaatcgaagtcccactcgccgcctctctgcttcctggcaatggaggaggatgatattttgtaattaagnactcttctaattaagtactcttgtaattagatattttgtaagntagctgtattattgcttgggtggaggnggacgtgttgagatgtgacatcttgtctaatacttactatattttggtggtttggaccttgagaatgtaaccgcgtctgaacctgccctgtgcatgtgcatgggttggttcaatttattttattaaaaaaaaagaacttttgccggcctctcaaaaaaaaaaanggggggggncccggnaacccaattc

SEQ ID NO: 88877 - DNA, 207 bp, Triticum aestivum
  unsure (1)..(207): unsure at all n locations
  Clone ID: PAT_TA_88877
tacgccggttgcgggcggaccctgatctannatgccgcccccggnggggtctcccccgggccgaagatgcgctccgtcaanaantanctgttccttgtcccggtcggggaccgcacgttcttcnccatgtccgcctactcgcgcctggacgtcccccctgggggaccctggttcgaggttctgcaacaaaaaaatcctccccggcgg

SEQ ID NO: 88878 - DNA, 258 bp, Triticum aestivum
  unsure (1)..(258): unsure at all n locations
  Clone ID: PAT_TA_88878
gaacgaagcaagcctgcagaanagacaagatggnatgaaacctccacttccactgntgtgattgatccccnttcggaatttgataangagganattgaacgtgctatagcactttctctattanaagaggnacacagaaaancaaaggnaacanggaaggntctgnatttatattaggntgnacaantgggaagagctattcaaggaagttttgtatgttggatcacccccncncgctcaaaaaaaaaaccccccccc

SEQ ID NO: 88879 - DNA, 427 bp, Triticum aestivum
  unsure (1)..(427): unsure at all n locations
  Clone ID: PAT_TA_88879
ctctcctcctcctgccaccgnttccgaaccaaggangaacccggcgcgaggagggcaaaggaagagaaaaggagatnaccgngcccagcgcgcgcacaggacagcaggcgccgcgatntcgcacangagcggagatggggctcacgttcacaaagctgttcagccggntcttctccaagaaggagatgnggntcctcatggacngtctccatgcggntgggaagaccaccancctctataagctcaagctcggggagatcgtcaccaccanccccacaancnggggttaatgtccaaactgtntgngtancaaagaanaatagtttcacccnttttgggatgtccnggggtncagggaaaanaataaagccccctggtggggggaanttctttccnngaaaaacccaaagggtcctcaatttttttt

SEQ ID NO: 88880 - DNA, 607 bp, Triticum aestivum
  unsure (1)..(607): unsure at all n locations
  Clone ID: PAT_TA_88880
ctccgcccccaagatctccaacccggagaatctgccaagaaagccgtcgagggcctaacgcccgcaagccatgtcaggggagcaagcacgcccggtgggacgccctcggggcgagccgattcccaacgtcgtccggtgctgatgggcggcgtccaaagcacatcgcgggtgcggtgccgggccggagaaacgtgggcctttcctcaaacttgcaaaggaaagaagggaccccaaccccggagaaagtgcctccgaggaaggggccgccaaggtcacgcgcttgcggtcttcaaacctggttgaaaaagaacttcaaccaaaaagtgccccaagggagatgggnatggcgtattgctggggtgcatgttatttactaacaccgaaattgaantttggnctttctgccggcaangggagcaagggaangcttttccgaggggtggcgnggccctattttccggngtaggnccggtccctcttgaggagcgaaggttttacccccaagtggatttccttggagaaataagggaggaaaaagccgggnaaanccctcccaaggttgacgattctcccaatggttttattgttccccagnngaagttttgtt

SEQ ID NO: 88881 - DNA, 598 bp, Triticum aestivum
  unsure (1)..(598): unsure at all n locations
  Clone ID: PAT_TA_88881
ggggggggccgcctctaaaaactaatggattcccccggggctgcagggaatttcggcacgaagacgcctgggtttgcagctggggttgatgtgaagggaagagctcatgccttttaccaaggggagcatcccaagttatttgaggagacgaatgttttggattttagatcggttacgtaaggatatgggcaatttgagaatctgaatatgagcatgctgaccagtagtacaagccgacttagcactgaagttggtatggttaagtcatgtactaccgcaagtcagatattggtttgaggataaagcaataaccagccttaatttgttatcatgggttcacatcaacaattcttttaatcaacgaaagagntctggtaaatgtggacgctccgtggccttgaatatttttgtgggcaatatctgaaccaagatgctgtgnngatgaagcngtgacctggatgagaaatggatgctggttcttcaagtttgaggctaccgactatcctggctctgaagtgaacttccacangntggtncctaagtgtacccacataanctggatctgaatgtataacacatgaaatcaacatggttcttg

SEQ ID NO: 88882 - DNA, 249 bp, Triticum aestivum
  unsure (1)..(249): unsure at all n locations
  Clone ID: PAT_TA_88882
agaggaagnagttcaaagggactatttgacaangaaagccaaggcnaagatatctgaacttggggtggngtccaaaaaagggtgggggacacggcanggtctggncgngggcaagtgcacaaagtangggaatagagntgggatgcggggaaggtcnaatccttcccttcnggaagagtacaagatcaatgtcatttgttttgnanagaaggncaagggacntttattnggncgcaacctgngccttcc

SEQ ID NO: 88883 - DNA, 182 bp, Triticum aestivum
  unsure (1)..(182): unsure at all n locations
  Clone ID: PAT_TA_88883
caaaaatttctctcgccttnctncccccccgagncctccaaaacctanggggcgncntccaagaancccatttatcaaccatgtttgggngcatggcaagggagaccaacaacaacaacaaagtncnaagaagngnttgggggtttcaanacaacaacccccngatgagntgtngaaaggtt

SEQ ID NO: 88884 - DNA, 443 bp, Triticum aestivum
  unsure (1)..(443): unsure at all n locations
  Clone ID: PAT_TA_88884
agcttaattcaagagttatagggagggacctatgtcaccacaaacaagaaactaaaagcaggtgttggnnttttanagctggngttaaaggattataaantttgacttactacaccccantagtatggaaactaaggatactgatatcttggnagcattccgagtaacgtccccaagacctggggttccgcccgaaagaagcagggggctgcagtancctgcccgaatcttctaactgggtacatggacaactgtttgggactgaatggaactttaccaantcttgntcnttacaaaagggactgatgcttatcacaatcgtagccctgttgcctgnggagaaagacagccaaatgggatcctgtttatgtaagcnttaacccaattaatnccctatttnaaagagggnttccgttacccaacaatgtnttacttccaatttg

SEQ ID NO: 88885 - DNA, 296 bp, Triticum aestivum
  unsure (1)..(296): unsure at all n locations
  Clone ID: PAT_TA_88885
aangctccaactccgnctccccatgggcgccgccgccgcgggggcgacgccantgaacgggtgcggaagggcctcgcgtccaanaaatccgtcctcctctcctcttnanccgcgctccgccgccgnagcttgtcctgctccgccgnatcaaaaanngaccgcccccgcncatcgcngcancaaacgccggacctggctcccggtggggtnnaacggcgangggaggtttngtgnaancgngctctcctnngtngggcgattaacccnagtacggtctccgggtgtccncccaaagg

SEQ ID NO: 88886 - DNA, 673 bp, Triticum aestivum
  unsure (1)..(673): unsure at all n locations
  Clone ID: PAT_TA_88886
ggccgctcctanaaactatgggattcccccggggcttgcagggaaattcggnaacgaagcttcatcaggggcaaatctggnggctngcgccaacccggctngctttctttggggattaatctaaagctgaaaaccgaatgccatcggggtcaanncctcttgagggaaagtcaaggcctcaaaccctaacggatnccgggcttacgcggtccaacaaagtaatcccgaaagaaaggggcaagcaagcacaaagtcaaatggcaccaaacgaagaaagcgggctatcccttcctaagcaaacgggnactggccgggtggcgggagcaaagaaaagggccaaggccaaacaggcaagcgagaaagctcgggccccgtcgggttccaaaganacaaaggcggaaagggagcgtccaaagtctggaaccggaagcaagcggtcgggagcccctgggnaagcgcaaaccgccgaaagcggggcccaaggcacaagggntggaccaaatcaatccaactcccctcccattttnatccaagaaaacttaggtccgtcatgggnaaatggncccatcttgtcancgtaccattaaaanaccaaggaaaattaaacaaaccctggcatcttngattgccgccaaagctccctgnatttcctcaangcnttccgttaaggctt

SEQ ID NO: 88887 - DNA, 222 bp, Triticum aestivum
  unsure (1)..(222): unsure at all n locations
  Clone ID: PAT_TA_88887
actacggctccatgngtcctggcncgatggtgcggtgnacgcagtgcagctcgagcatnacngtgatgcccggcgnccncnccgtgcagtgcatncantgcacctgcgtnncacgcgtcngcggccgtggtcggcaacagnacagatacgggcagggttacngcgggaaaggcggggggatgctnntgccgccgatgcntcncaccccggccttcggcgggg

SEQ ID NO: 88888 - DNA, 245 bp, Triticum aestivum
  unsure (1)..(245): unsure at all n locations
  Clone ID: PAT_TA_88888
gggggggggggcgctcctaaaaactnagggggttcccccggggctgnaagggaattncgcaacgaattngagatgggggcaaaacaatnggcgtncaanaancggggctgtcccaaggcgggggtctcccaangcccgggccgggaaggggcggcaancaggttcaaccgttgagggngtcctccgcggagggcgagggccgccnggccgccccncgggtccttngtttcaanggcaagngggag

SEQ ID NO: 88889 - DNA, 512 bp, Triticum aestivum
  unsure (1)..(512): unsure at all n locations
  Clone ID: PAT_TA_88889
ggtctatcttccttcctttgtccgataacagtgcgacctatgacaatttgtcgcatacagattttttcctgaaatctcaggacaactttacacataaaggncacagtatcctactgttattaccacaaatcagttaaccattagctgaacaagataccgatgtaagttaatcatattttcttttttttaggtgaatgantcgtttttttgagttaggttgcttgccccacaggtattagntgaacaccaagttcgatgttaatagacacaagaatgagaacactgcttggnttacccttgatttcttcttcgnctgtgctttttatatatgagntggnaccnatagggaaagttgccatctacaggcttatctcangntggtgtggtaggctactacagggngttagcaaatggaaagcntaaagnggtgnttatggtgtcacccctggtgggnttaacaanattttagggaacaagnaggcttaccnggaattggcaacccaaggccnggg

SEQ ID NO: 88890 - DNA, 462 bp, Triticum aestivum
  unsure (1)..(462): unsure at all n locations
  Clone ID: PAT_TA_88890
ggttggttcgcccantcagtgtcgcctttgaggtgntcgacggnttcaggcagtacaaagancggngtttacaccaantgnccattgtggnacnacacctgangatgtgaaccacgcccgtcttgggggttggctatggtgtggngaacggcgtcccaaattggctcancaaagaactcctggggcgctgactgngggtgacaatgggntacttcaanatgggaaatgggcaaganacatgtggtgcntggtntgctaactgcggcgtccctacacccatacntggggggggatnnaaagcgccaaaatccacgantccaaagtctccgaattcgcccanaacaangaaataancanngtttttcagacccancaagtacantnaagantgggggggagaanacaaaaactggaaaactcctgntgtgggnctatntaannccccaaaggancttcnanttg

SEQ ID NO: 88891 - DNA, 408 bp, Triticum aestivum
  unsure (1)..(408): unsure at all n locations
  Clone ID: PAT_TA_88891
cttctccgggctctccctcggggantccatctggtcccccgccgangccgcnccccgcgcccgcaangccgacctcttctccccctccccggtgcccganaacaacaacgccgccaagatgaacggnaacgggctcaangggcccggcctcatcgggtccggcaagctcgccttcggggccaccaacaccannaaggncgaccgctacaacaangtcagnctccccgccgccgccgacgccaacgccaagccctacgggaacgccaacgggctatacggtgccaagcccaaaaacgccaccaacaacgggnttcgggctcaacaagatggctgccggnggcgggggctacggnaacttcancggggggnaacgacgggggnggangagctatttcannaaagtccatc

SEQ ID NO: 88892 - DNA, 636 bp, Triticum aestivum
  unsure (1)..(636): unsure at all n locations
  Clone ID: PAT_TA_88892
aacaagggnaaaatgaaaacaatgcnttttctcaaaatagacatttcatgttcaagatggggcgctattttgtaaacatctttgattagtgtcaacaatcaaacggatnaagatattaatcatacatccaagaggcacacatattactcctgaagaaagtccgattcctcaatgtgntttactttgccggggcaacaaaagttgggtgggcgaaagggcccaacgccgtttgtttgtttgacggggggtccggcgaagggtgggtcaagcggaagggttctcaaagcggggccccttaccgggtgaacgatgggcctggcaacaaaagntatcccaaaacaatgggagaaacaattggcaaaggnggggcggttcctggatctnccttcaacctttgaggctccggnaaaaccgcctcctgggtncgtcnagcctaagggcaaagggggggtcgaangctggccaaccggggggtaagaggtggggtccgacgnatctcccccgagcggggcccaaccangnaacggncggtaacccctccgacaagcggcccattgaggcaacnaacctngggaaagccccaagatggggcaaanggaatgctnccngagccngtngggaccnaancctaggggg

SEQ ID NO: 88893 - DNA, 620 bp, Triticum aestivum
  unsure (1)..(620): unsure at all n locations
  Clone ID: PAT_TA_88893
ggagccnaagaggncctcaagacaagcccctccgtctttcccctacaaggatgtttanaagattgggnggcaattggaactgtgccctgttgggccgtgttngagactnggggtcaatcaaagcctgggtaatggttgttaccttttggggcccaactgggtctgacaaactgagggncaaagtccgtttgagatggcaaccaatggagtnctctccctgggagggcggcttcctggggggacaaacgttgggttcaaaccgtcaaaggaacgttggcccgtgaaagggatctggaaagcngtggggttttgtttgcatccaaactcccaaagggatggaccccttgccaaagggagggcaagncaaacttcaacctccccaaggtcatcaatcaatgaaaccaacccctgggtcaaganttgggaaacgggctacgcccccaatggctggggactggccaanaccctcaanacaattgctggtcaaangtttggcntgaagctggnggacccaananatncgacaagggcggggtcctgggtaagggangcntggagggcccttgcccaaanntcctcaaagaangggngntgctgggaatancggaanangntttccc

SEQ ID NO: 88894 - DNA, 348 bp, Triticum aestivum
  unsure (1)..(348): unsure at all n locations
  Clone ID: PAT_TA_88894
gcatccaccgctgctaagcaaggncgagcaagcagcacaaganatgggtgntgccttctcctccaccgtcggtgncccggcttctacgccgaccaacttcctcgggaagaagctcaagaagcaggtgacctcggccgtgnactaccatgggaagngctccaaggncaacaggttcacggtcatggnagcggnaaacatccacnagaagaggaanaaccgccaagtgggagggncttgcgtacgatatctccgacgaccagcaggacatcaccanagggaaggggatcntggnctccctcttncaagggnccantggggggcggcaccacnangggcgttctnagctca

SEQ ID NO: 88895 - DNA, 325 bp, Triticum aestivum
  unsure (1)..(325): unsure at all n locations
  Clone ID: PAT_TA_88895
ncccgcgggtgggccgggccgctcctaaaaaacttagtnggattcccccggggcttgcaaaggaaattnccgcaacgaagaaagaanttncgnggaacctngnctttaccctgggcaaacgggtcaancaacgggngggcctccctcaaagcaagggtgggactaccctggattccgctccaaagtggggtggcttgcctttgagttcaagcaaagggcggggttcaatcttccgttgagcaaaatgcgtctcccgggtactacnacggccgctactgggacaatgtggaagctggcctatgttcgggtggaccgaccccacaca

SEQ ID NO: 88896 - DNA, 511 bp, Triticum aestivum
  unsure (1)..(511): unsure at all n locations
  Clone ID: PAT_TA_88896
ggagcaacancccccgnccaaccgccgccgccgcagncatgctccccangaagccccagctatcttcctctctgctcgcatcnacgccgctctttaaccccgcatccaatctcaatnacgccaagccaatcgccgcctccccctccccccgccgccgcctccgnatctccgccggatccacggnggtttcgccgggggngacggngctcaaccgcgtcgacntgctctcggaggcgctccccttcatccancgnttcaagggnaagacggtggtggtcaagtacggnggcgccgcgatgaaatcccccgaggctgcaatcctccgttgattcggcgacctcgtcctcctctcctgcgtcgggctccggccccatcctctttcacggngggggggcaaaagattaaatcctggntggtccgcgtcagggtcgagncncaanttccgtnaacgnctnccgccgtcaacnntgggctcaacaaagggggtcntcnaaaatgggggntcngttgg

SEQ ID NO: 88897 - DNA, 609 bp, Triticum aestivum
  unsure (1)..(609): unsure at all n locations
  Clone ID: PAT_TA_88897
gcaacaataacggcgggaacgggaaccatcacaaacaatcaccaccaacacatgctcctccgctgccaatgggaagcactaacactaccaacactaccgccgggcgacggnaccaccaccaagaaccgccacaacaatcaccaccaccaagatgctcctccgccggccgcccggatggnaaccaagtaccacaaccaccacaaccaccaccaacgancacaacaaggaancaccacaaggcacctccaaacgccacaancatttcatccccactgtggatgagggaattttgaaatttgatgggctgtgcccatctggtatgatatgcctttgacctcccttcttttggttgggtggatgatgggggaagcacaagggcatgaaagttgaagcttctcaaccgaaagcctgcaagtttgttttgtcatattganggaaaatttgaattgggaaattttgtggggtacgaagctaaacangttatcgggtttactggtttttgttggatgcaaaaataattatctaagaaaaccttggtatccntaaggtaaattgttattggcaatannaaaaccnttaagatggctttctccctggcaaactaaatgg

SEQ ID NO: 88898 - DNA, 611 bp, Triticum aestivum
  unsure (1)..(611): unsure at all n locations
  Clone ID: PAT_TA_88898
ggaacgaagcaaagccgcccgttccaaatccccaacaagaaaaacnccccaaccccctccgccantaaangctcctgcttccgcgttggcacgggaanatcnggctccntgcttctaanggngggagggnccaaagtgaaaatggggntaaagaatccacantcctgttggnttggngggagcntttggattnaacaangcncctgcctttcaatggttgaananaaagctaancgccccntngaaaccccctgtgatgtatgggggnggaaagaatgcctaantggntggggcaccaaaaagctcacaactggaaggaatttgatatgatgtttgcaaaacgaattcttttttttngacaaggngaaccaangaaaagaggcnacccancancgagggncaagcaanaaaaaacaatcaacatttttctggtntgaatttaaaactcccctggggttctaatgcgtgnaangacancatggnccttttactaattaatgaanttaaggacaataatgaanttagntttaaagntaatggcctaacaatttacattgggggccaccctttgttggtaacttccntgnatgggggcgaaaaaaaanaaaacn

SEQ ID NO: 88899 - DNA, 559 bp, Triticum aestivum
  unsure (1)..(559): unsure at all n locations
  Clone ID: PAT_TA_88899
acgaagctcccccgnccccccttccgcatccacgcgagcgaagccgcgccggcgacgagcangcgaaccttctacagncctccgnctcngagcccccttccgcggcccgcagccatggcgaccgtcatgcanaagatcaaggacatcgaggacgaagatgtcnaatgacgcagaaaaacaaagncactgcacaccatccttggtcttctgaangctaaacttgcaaaattacggcgaagagttgctcactcctacaancaaangtgggtggtggtgctggtgangggtttgacgttgacgaaaaagtggacatgcncgtgttggtttggtgggctttccttcggttgngaaatcaacatttgttngacaaagctgangggaaatttttcaanacgnncgcgtcctaatgaagttttacaaacttttaacaatgtantcctgggagttaattaatggtacnaaagggagctaaanntacaancttccaagattttcccggggaatcaattggaagggggctnaangattggnaaagggtaacnagggaaggcaangncnt

SEQ ID NO: 88900 - DNA, 450 bp, Triticum aestivum
  unsure (1)..(450): unsure at all n locations
  Clone ID: PAT_TA_88900
atgttggnacaaaangggccacaatgtccaanggggntgnaaagttatggnaaagaaaccaagggaattcaantgcagcnaatgcnttaaagaaggcaatggttgctggtttgggagganncaatcnttttggggncataantccgggaaacttactgaaagcaaatgacaatgacacctggngggcttatctcanttgctgngcaggtaattcccttgcctcananaaaangccggggncccntttttgcaataccaataatttaaatgggtgccgggacgcaagaccaacantgacattgcaanggaggnacaaggntntgncaaagaaaagagnccaacgaaattttgtnnccagnacctttctcccannaagaaaagntggcncaatgcaacgccgacatgggcctcnnttgggaaggggggnttttcacccaaggggaagatttg

SEQ ID NO: 88901 - DNA, 428 bp, Triticum aestivum
  unsure (1)..(428): unsure at all n locations
  Clone ID: PAT_TA_88901
caaaacnggccgagattanagggggggtgggcgtccngngctctatcaaattcancaaccaacaacatgcgcttggtcaacgaatgctgtgcggnggggctcgtttntcatggcggngggtaacacgtcgctgcactaaccatggnggagaatgggggagttcctgctctacatcttnanctccnagacgcgagcctgngncatcaaaaaancaatnttntcaatgggaganggagncactgaccttggngactaaatgccnggcaangggattcgctgtccgtgatggcggngtcatggcgttcgtcancttgtgggntgggaatctcttctgcaacgtcctttatcagtgggngaacaacgcngagctgtgntatctacatctnccaactgcannagctctgncgggncaaacatgaantaccggg

SEQ ID NO: 88902 - DNA, 167 bp, Triticum aestivum
  unsure (1)..(167): unsure at all n locations
  Clone ID: PAT_TA_88902
cgcgccgancgtctcctcctcctcaaagncgccctccctccgcttccgcttcggcttcccccnccgtgggtgcgccgccgaccggagccggagggngaagacgatggccgcngtggtctccccgggggatggggggctggtccanaaactcntgtcctcnggcgnca

SEQ ID NO: 88903 - DNA, 487 bp, Triticum aestivum
  unsure (1)..(487): unsure at all n locations
  Clone ID: PAT_TA_88903
cattaaatanattanaaggntggggctgaagctgcccaacaaattattataaannccccnactancntacataaaggngggtatganacaagggngggggagnangncaccaacnccnnggaaaaaaaggggggggggaanttgactcccaactgggaagctcancccacntcnccggggaggnncggctcaaattaattctggggggtggggggacgcgggtaanacaagtggacaaaacaagattcncaccgcgactgantggggantccccccnagcggagnaagacacgctntccnaactcttcactccnagaaattagccttcnatnaaaaaannagtttggntggaaaccngagcgttaaaatggactgaagntttggaaggncccgtcacctcccccccggcaggtgnaaaggaagtttgggtagggngaaataaacaagaacaaacccacccaggcgnnagtatcntgggcgggcaagg

SEQ ID NO: 88904 - DNA, 530 bp, Triticum aestivum
  unsure (1)..(530): unsure at all n locations
  Clone ID: PAT_TA_88904
gntatatacctacatantacagccatggnccccaccgtgatgggctcgtcgggcacctccgtcgctcctttccangggctcaagtccaccgccgggctccccgtcagccgccgctccaacggngctagcctcggcagcgtcagcaacggtggnaggatcaggtgcatgcangtgtggnccattgagggcatcaagaagttcgagaccctgtcctacttgccaccgctcancacggaggnnctcctcaagcaagtcgactacctgatccgctccaaatgggtgccttgcctcgagttcancaaagntgggttcatcttccgtgagcacaacgcatcccctgnggtactatgatgggcgggtactggacaaatgtggnaagnttgctatgttccgggtgcaccgacccccacacaagtgattaacnangggtggggggggggtcaaaaaangagtaacctggacncgtatgttcggcatcattcggnatttcgacaacaatncgccaaggtgcaattgnggtaagctttcat

SEQ ID NO: 88905 - DNA, 659 bp, Triticum aestivum
  unsure (1)..(659): unsure at all n locations
  Clone ID: PAT_TA_88905
cgggcgggnggggcggctcnaaaaanaatgggatcccgggggtggcaagggaagtttttttttttttttttaattccgttcctttttaattaaaccctcccctccttaacccttaaggtttaaccaactatcaataagtaaccaaccgggntcgaactccaatttgattgccttccaaacttcacaaagctggcgggtaagttcaaggactccatttgcaaagctggctcgggataaattcaataacttcgccgaagcaaaatcgcgnccttcgttacgaagcttgtacacaagggcntcctaaaagccactcgattagctgctgcaccaagtggaatttccccaaaggatgtcctaaaagntcctccaacaaattggtnatacaagaatccgtccccaaaagatttcgggtcaagagctgggnaaaatgccaaaacaatgaataaccaacctggaagctaaccgggtatnaacaacctggggaatgggggtacccantcctngagtggnaaaaaagaaaaccggcggagnaacgnattcnttttcaaataaaaaatcaatccgcgncaataaatcanacaaaaaacctaaaagncaatttcccggttcccccttctaaccttaacctaacaacnggtaccgggnggtggggtatgatc

SEQ ID NO: 88906 - DNA, 247 bp, Triticum aestivum
  unsure (1)..(247): unsure at all n locations
  Clone ID: PAT_TA_88906
tccccccgcctggcccgtntcctccgacgccgacgtngggaaanangcgggcgccgccgctcanccccaaagtccgngacgccttccctccctggtcctctgaggnagcaacccctgngcccancgantccccctcctcccggttgtctcccctatcccatctantccgacgccgatgtcgggaagtaagccgtcngggccgtccanctctgattccgngacccctctcttancttattctctgatg

SEQ ID NO: 88907 - DNA, 556 bp, Triticum aestivum
  unsure (1)..(556): unsure at all n locations
  Clone ID: PAT_TA_88907
ctcctccttccactcctacttcgccgtttccgggagantcttggattggnttttcggcaaaaanggnttcgcccgtcntgatcgcntcggcggggctcgggatgctggngggcgtggcgatggcnanccggggatngggnnacgggctgccgggggggtccaantgnggangcgaggccccgttgctncacntgaantggaaccggacgggaagagngnctctgcacccgttgggccgancggaaagtcaggtgcgggacgtgatctgggtccggnccgcaaaccactgcncgcaantgacggnagggtctggggancgggaccggggcgntccccgggcccgactcaanctttcaaaggaaaaanaaaaataaccgtaacggggcccaagggngagggcgggggaacaanaaaatgaatatttcaaacccggtttccccncccggnaanncccaacgttgnnatttaagccaaaacaataatcacaaccaaatttaanggcaacgggggccaaatccncgtgntangggtaaaaagncgggggtcctgncaccgt

SEQ ID NO: 88908 - DNA, 558 bp, Triticum aestivum
  unsure (1)..(558): unsure at all n locations
  Clone ID: PAT_TA_88908
ctcctaacaaagctatatacctacatagtacaaccatggnccccaacgtgatgggctcgtcgggcacctccgtcgctcctttccangggctcaagtccancgccggcctccccgtcanccgccgctccaacggngctaacctcggnagcgtcaagcaacggtggnaggatcaggtgcatgcaagtgtgggccatcnagggcatcangaaattcgagaccctgtcttacctgccaacgctcaacacggaggccctcctcaagcaagtcgactacctgatccgctccaagtgggtgccttgcctccgaattcaacaaggntgggttcatcttccgtgagcacaaacgcatctcctgggtactacgatgggccggtattggacaatgtnggaaactgcctatgttccggggtgcactgacccacacaaggtgatnaaaccaagtgggnggaggtcaaaaaaggagtnaccctgacncgttttttccgcatcatccggntttcgacaacaatgcgtcaaggtcanttgcgtcancttcaaccgccnttaaagcaaccggggg

SEQ ID NO: 88909 - DNA, 561 bp, Triticum aestivum
  unsure (1)..(561): unsure at all n locations
  Clone ID: PAT_TA_88909
cttgaaaaaacgcaagccaagatggnaacctccatgattaactcnccgattgtggngcccgacnagcgtggcgtccctctcccgccggggntcctccttcgccgtcgtctgcagcggtggnaaaaaaattaaggtcgataagcccctcggactcggaggnggnttgacaatcgacatcgacgccaacgggaagaaggtcggnaaaaaaggcgtgtaacaatttgttgacaaatacggtggcaacgtcgacgggtacaagccaatctacacgccaaaaggaatggtctgaagtcctggtgaaccgctacgccggngggacgaancggggcttcttatctgggggcgttaaccctcgccggggctcctcgggggggggggggtcctcctccgtctaaaaaaacaanggctctcgccgggntaagaanaacaatctacgtgttaaaacaagggccgggtctctgctttgcaatcaacgtctctggttaatcctggcgtaanctacctcctgtggaatgttancaatccaaacgattcaaaagttaanttgnttcggaacaanat

SEQ ID NO: 88910 - DNA, 620 bp, Triticum aestivum
  unsure (1)..(620): unsure at all n locations
  Clone ID: PAT_TA_88910
acgaaggccgccgcctcctcctccggattgccgcttgctgggagaacaaaaagancgcgggttcccgagcaaaacctaanctcccacgaatgggtggctngcaagaaacgaaatcgacctggctgaaacccccggcgggagctccgaanaantcaaagcacaaanaaaaaagcggcctccgtccaatccccccaaattcctttcntcatgggacgtcaaagttgncaagggctggcttcaaacaatcaactactngtgttcaagccaactcacaanactggttgtggtgtgcccaaggctgccaaaacaagtgctctgccaagccaaacgggtggtaaagggcaangctcaaccgaaggggttgctccnttccgcccgcaaagggcgactaaaaccgaaggntatcttaaaaaagcnaagcctgtttgttgaaactcngtttagttttttcaaangggnggttgggcctgaaaaaanttttgcnaatgtccgggnaaaanttgaatccaaccctttgggtaaatttgggaatctaacctccgagcaaataattaactaatgaacaacngtcctaatgnttctgntttggcctgtgaaaattaaaactaaatnantttcct

SEQ ID NO: 88911 - DNA, 497 bp, Triticum aestivum
  unsure (1)..(497): unsure at all n locations
  Clone ID: PAT_TA_88911
agcaaagaaaaggggccangggaggaggacaancaaccanaggtaaacaaccatcctaatgcccaacaaggttttggtcntggcncaagaagaggggacagggacgaggacaacaagccancaaggaataaccatggccancaaggtttcggtcntggtggaagaaaangggacagggacgaggacaacangccagaagggaataaccatggccancaaggtttcggtcgtggtggaagaaagaggggacagggacgagggacaacaagccccgaanggaataaccaatggccaacnaggtttcggtcngtgggtggnaagaaaanggggacaagggatnanngacaacanggccagcaaagtnanattaaaccatncgcccacccaacggtttttggtncntggttgccaagaaaaaagggggacaaggaacccatgacccattccaattgggnggacaaatganagatcnttantgcancaacaanggtttccct

SEQ ID NO: 88912 - DNA, 542 bp, Triticum aestivum
  unsure (1)..(542): unsure at all n locations
  Clone ID: PAT_TA_88912
ggaaaatctcctccgacanatcgaanngaaaggcatctcgtcctcctcctcaagatgnaaatctttgngaagaccctcactggnaanaccatcacccttgaggttgagtcctcggacactatcnacaacgtcaaggntaagatccangacaatgagggnatccctccagaccaagcannngtctcatcttcgctggnaagcanctcnaggatgggcgcaccctggctgactacaacattcagaaggagnccaccctccaccttgtgctaaggnntcggggtggnatgcaaatcttccgtggagaacctcaccggnangaccatcanccttgaggtngagncanctgacaccattganaaagtnaaggngnaagattcaanacaanggangggatcccccccnggancaagcancgcctcntcttcttctgggaaaggaactttgaggggtgggcgcacgccnccccnactataaataatcnaaaaaggnggtgcacccctccaaccttgggggtttaaggttcccgtgggggggatggaaaa

SEQ ID NO: 88913 - DNA, 501 bp, Triticum aestivum
  unsure (1)..(501): unsure at all n locations
  Clone ID: PAT_TA_88913
gtcnattacctccaccgccgccgccgccgccggcaagcccggtctacacgccgctcgtctccaggggcgggcggcgcancangtgcgccgtccgaacccaancggccggaganggggcagccgccgccgacggggcggngtcagagcacaagtcgctgganataatgcgcaagttctccggagcantacgccccgccgctccagcaaccttcntctgctccgacaagtncgtcaccgccgtcgtcatcaaggggcttgctgaccacaaangatcaactcgggagcaacctctctggccctgcanggnaattaccaccnacaangggcgcccgagggcggcacaaaggggttctggaacttgcccgttccgtccccaatgcgaaaaaaatggaaaggaggtgccnatntncatgccnttttcctntacnccccgacaaaccatttttgncgggtgaaggacccaggcnatcaanctttgngngaagatcaaagganggggac

SEQ ID NO: 88914 - DNA, 416 bp, Triticum aestivum
  unsure (1)..(416): unsure at all n locations
  Clone ID: PAT_TA_88914
agaggaagagtagcatccatggcgtgcatcaataccttgcaaagctgctccatgttcaaaggggccaaggntgaggncaaaaggggcaaagccactggcgcaaggagcttcgggtgccgggcgtccacgttcatggacgggagcgggctccggctcgggctcgacnaaaaacccgacnccatcatctccggngaagtggnccgagaacttctccctcctcaactacgacgaactccgcgcctacctccaatcccaacaacaacagcaacaanaaccaccttcccacgctggcgattaacaacggggggcgctcctgcgcgaagncatgtcgacgcccgtgctgatgggcacaacggancaagcgcnggtggagggttgaanggcantttcaactcgtgtcaaggctcccgggtttt

SEQ ID NO: 88915 - DNA, 487 bp, Triticum aestivum
  unsure (1)..(487): unsure at all n locations
  Clone ID: PAT_TA_88915
agatncaatccancccccctccgatntcgccgagaagtctccgattgaagcgaagcgaagccaaggntctctcctcctcctcctaanatgnagatnttcntgaagacccttancggcaagancatcacccttgaggtcgagtcctctgaaaacatcgacaacgtcaaggnaaagatncaggacaaggngggnatcnccccggancancaaggtctcatctttgctggcaancanctcnaggatnggcgcncccttncggactacaacatccanaaggagtccaaccnccacctnggttctcangctccctggtggnatgcangatatttntcaangaacctcactggggaaaaccatcancccccaagntgngntcctcanacaccatttataangtgggagggnccaaattnaaggncaagggaggggtgttncaccgggncaagaancggtctcaatcttttggtggngaaanaacncnagagga

SEQ ID NO: 88916 - DNA, 524 bp, Triticum aestivum
  unsure (1)..(524): unsure at all n locations
  Clone ID: PAT_TA_88916
tacaaagcagatcccacaattatcagaaagttttcaagacactcaacatctgatagttaccgacacaacattggagagtcgactgacaaccatagagcagagcacaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcaagactcaacattcttcttgaaaacatctaggtcatcccccttcaagcttggcaagagaggttcttgatgtancgcttcatgtgagagataaactgcttcntgtcaaaaagcaagttgctccctgaagacggaaggtgtcaacaatgtcaaccaccttcacgggcctggtcaatcgacaccctcatnatcancaaccaaccctcaagcangaggggattng

SEQ ID NO: 88917 - DNA, 557 bp, Triticum aestivum
  unsure (1)..(557): unsure at all n locations
  Clone ID: PAT_TA_88917
aagaacaaaatcccaantggggattggatttcccaaagataancctttgnaagcttccttggcaacaagcanatggggntaactccttttgntccaagacttctaccggggntcctgaatgtgtagtcccacctaaatttcccantactgnaaaagncaaccttggacctgcgctggnttttcccaatccaanacacccaagaanccnttgntggntctgggggngncctaatacaaatgggtaacaattgggctgatgttgattaaaacctcctgagggatanaagntgagcaagggggacaaaatcctgncttcctcaaagtgagttgnttccctganttgaantcnaatcanttttgccnccaatgggttcaactcaatcaaaggcactcccggtaggnaatggagtcactttgcnggggtcccaatggctgnaggccaaaaaacaaaaaagnaacggattctgnttncccccancctgagctggggtacnaaaagattgatagagggagggggaaacctccttgangaaaaagctaaaggnnccaanccgngg

SEQ ID NO: 88918 - DNA, 372 bp, Triticum aestivum
  unsure (1)..(372): unsure at all n locations
  Clone ID: PAT_TA_88918
acgaagtttaattccccgttagaaacgaaggaactccccgcaaaggcgcctccttctcgtttncatccatcangccgaatgaacctccatcggacgcctccccgtgntggtcgctcgctcctctcctctccanaaatatggtgggtgggaaccccgcctcntctctctatttactggacggccccgcccacgacccccaatgataagntccntcttttatccncaatcnaaaatgtcgtaggcgtnatgtanaatatcatcatacctgatntgncctaccatgaggnatcnccggtctgattgcntgtntgggccgcacnctctaantctattgggggtgngggaccaancagggaggaaaangaaaaccaa

SEQ ID NO: 88919 - DNA, 282 bp, Triticum aestivum
  unsure (1)..(282): unsure at all n locations
  Clone ID: PAT_TA_88919
aacaagcaacaatgggcccccaatggtgatgggtttctcngggcaacttcgtncgcaaccttncaagggnctcaaattnaacggcggggctggncaataanccnccggtccaacaaaggccgggctcaaaaaanggtaaacaaanggggggaanggttaaagnggaaaggaaggtgtggggccctttnngggggaancaaanaaaattttagaaccctgtgttttctgtnanaccctctccacangnggggccnccttaaaacaagggcgacnaantttttt

SEQ ID NO: 88920 - DNA, 322 bp, Triticum aestivum
  unsure (1)..(322): unsure at all n locations
  Clone ID: PAT_TA_88920
ntttttttcanggcaaatttaantnacatgaatttcnccnnggcaagttttgatancaatttgccacgacacgtttcttgtncacaggtgnantccaangccttttgtgtttttcaacacacattaaattcatcacacaaaacacggcaactctttgagaccaatctgccanggcaaatctcngttgntcacacttgagtttcaacaatttgtgtttnttctcacacacggcaaaantctccttccaaanatngcanttttgngtaaactttcatggcatttttanctaaaaacgcnattgcatttttagcttttaantgcc

SEQ ID NO: 88921 - DNA, 364 bp, Triticum aestivum
  unsure (1)..(364): unsure at all n locations
  Clone ID: PAT_TA_88921
ctcaatccgaaccggagctgtggnagcgaaaacttggngagtacaaaangnaaaggnacaaatggtgggnttnctccgggncttcancgccgcatccgccgtgncaagaacaaccgtcgccgcggtnggcctctcctcctcctccccctctcgctccccctnttncaagntccgcttncccctggctccctccctctccgcgttcggcgcctcctcgggctcctcttnccccgtgngcgcgccgaacggcggccctccgatgggcgcccgccgccaatggcgatttctctgntcccganaaagggancncggttncggngctcancaaccnattcatggggggncattaaatgtgaaggggtgt

SEQ ID NO: 88922 - DNA, 581 bp, Triticum aestivum
  unsure (1)..(581): unsure at all n locations
  Clone ID: PAT_TA_88922
nttttttttttttttttttaaaaaaaaacancanttcttcccgtggctggatagataaatatctttccctcntttcaacaaaatatagntacctcaaccatgttagggnacccaagttcatcacaccgtaatcangaggcgttctctaacgcctcnatgcacccgagcacgggggncttctgcgacatggggnggcaccaaancgtcntgcnccgccttgttgttcttcaaaaaccgaggngggaatcaagcaacgcccanctcntaagggtctgctgctgtggcttttgcccaacggcgggttaaatcctgttcaagaacctcctgaaagggtgaaagaagtcncgntgattgggccnacnaactttgtcgttntccaanaaccntcaacaaccaatccggggcangggggatcaacaagggaaagcngtccancttcccttttggggcaaagtggaaccgccngtacaaacaacctcctggttcctggggcnatcaaccaagggntaacaaggcncccttcccngatgggtccaaaaggaanatccccaaagataaggtanggcnggccaaataaaggn

SEQ ID NO: 88923 - DNA, 547 bp, Triticum aestivum
  unsure (1)..(547): unsure at all n locations
  Clone ID: PAT_TA_88923
actttggnccaaaggnttgggacangttccttccccnaanggccaatcntgccgtccggggaattttctttggatttctttggtgaaaccctccgtggatggncncttgggagccaagcanttgatttgatcttaaagtgggccagtttcaagccaatggaggagctgctggctgntgctgttcctggggcggggattttcttgaggngcaagtgaanctgtcctgctgtcntatgttttaaaaaacaaagcaaattgcctggccttggnttaantccantttcctataaagatcggcatctggcntaagtcaaaacaactgtatttctggcaaagnacaacnaactannttcaaatgcaatggtcanttgaagggggggcanccnggttggnntcaaaancaaacnttgnaacannataatcacccccttactnngtaagaccnacaagggaaactaactgcnccacctcnaaaattnaaattgganaannccaaaggggaagagggntgggttnaacctcaaaccncccccncccggnggnnaaa

SEQ ID NO: 88924 - DNA, 510 bp, Triticum aestivum
  unsure (1)..(510): unsure at all n locations
  Clone ID: PAT_TA_88924
atcagtancagcggcagccgcacatcagcagcttgctctgttccatccggcagcaatggcggccaccaccaacatggngctctcctcccccgcgatcaagctcgccggagcctcctacgccctcggcggcggcgggcgcatcaccatgcgcaaggccgcgcccaaggcctccgcctccaacagcccgtggtacggccccgaccgcgtgctctacctcgggccgctctccggcggagcccccgagctacctcagcggcgagttccgggncgactacngggtgggacaccgcgggcctctcccgccgacccgggngaccttcgccaaagaaccgcgaggctcgaaggtaatccaactgncgctgggccatgcctcgggngcgctcggntggcgttcttccccgaagctgctcgctcgcaacgggttccaanttccggcgaangcantcctggttcaaagggcggggctcccnagatnttcaagcnaagggggggcttgnactacctcgggaa

SEQ ID NO: 88925 - DNA, 535 bp, Triticum aestivum
  unsure (1)..(535): unsure at all n locations
  Clone ID: PAT_TA_88925
ccatcttctcttctcttctcctcttgttgctgcagtagatgagcatgtcggcgacagccgccacggncacggcctggccctccacctcctcctccgtcctcgcccctcgcacccgccaccacgccgctcccagcccccgcgccctccgctccggcttcctcggccgcgccctcacgctggncgccgccaccgaccgcccctcctccgcccncgccgccgtctccgtctcggtgagcgcggnctgggacgggncgctctcctcggngcgcctcatcatgcaggggacgnaangtcaagctgacgngagaagctcaaggagcacatcgaangacangggtggggcgggcgggtgcacanccacgcgcacctgngtggggggaaggtgggacgtgngacctctccgcccgtgggngggganctcaagcangggnccccaaagctctcccgtcttgagnanggtnaacgctcttnaanaaagccgaccaccgnagtccttccngcgcccaaagggaaggaggacggagtcatccctcnt

SEQ ID NO: 88926 - DNA, 520 bp, Triticum aestivum
  unsure (1)..(520): unsure at all n locations
  Clone ID: PAT_TA_88926
cgnctaactcaacctcgaggncaacaacttctccgggnccatcccggagtccttcggcaccttcaaaaanctccagtcgctctcgctcgtcaacaanctgctcgggggnaaggtcccggngttcctcggncgcgtctccacgctccgggagntcaacatgtcctacaacccgttcgctccgggcccantgncgggcgagctcggggacctccccgcgctgngcgtgctctggntcgccggctgcaaactcgtcgggtccatcccggggtctctcgggcgggtcgccaaacctcaancggaactcgaactgtcgctgaangcgctcancggccccgataccancgcaaattggccgttctganaagcgccgttcaaattgaggctgtagaanaantcgctctccgggggccaatcccgaaagggattngggaanntcncgggagctcaagagnatanacatctccatgangccgcctccggngggngccattcccgggtgatcttgtttaaggggnccaag

SEQ ID NO: 88927 - DNA, 518 bp, Triticum aestivum
  unsure (1)..(518): unsure at all n locations
  Clone ID: PAT_TA_88927
gttagctccggcgtcaagtttaagcccaccagcggcgacctgtccactgcgtcaactatcgccttcgaccgcaagacagcgacgctccgcctccccgtggtgaccctcgacggcaacacggaggtggtgctccggaacctggtcgcctacgagtcatccgccgcgtcaggcccactggtgctcacccggtacacggagctcatgaacggcatcatcgacaccgacgacgacgttgcgctgctccgcaagcggggcgtggtgctcaaccacatgaagaagagggacggcgaggcggccaagctgtggaacggcatgagccggtcggttgcancactccanggtgccgggcttgggacaagggtgatngaggaggtgaaaccgcttactacgaaggtcggttggagccgttaaagaccaaancgggtcatgcgcaagttcgtgctcaactcatgggaaaatgctcaactttctcnccaacatnaaggaatgctgctnntcancaacgggtgcaaggccnt

SEQ ID NO: 88928 - DNA, 533 bp, Triticum aestivum
  unsure (1)..(533): unsure at all n locations
  Clone ID: PAT_TA_88928
tgcttaacctcgtacacacatcacaaattcatccttgcactacattcacgagaggtggtcctcctctccattagccgcgacgatcttggagggatggatgacgtgctgtcgcagattagcgaggcgttccggctcgccggcgagctcatgggtgagctccaggccacccagaacggnccggcctacatcgccgcacgctgccacggcattgtccatgcctacaacagagccatccgcatgctgcagcagtacggcgtgggcgacgtggcccgcaagccgcgccacgtgagctcgaggccggggtcgatggacatcctgcgcctgggcaagcacggggcgaaggcggcgctagccagtttctcggagagactcccggcgcattttggnccaccgggaaaggagccaattccacaatgccgggccnggcgttgttcgggtgcgcgaagttggcgccacaagcaatacgaatgtncngcgggggggcggggcgtcncccggnaacgtcccggtgggcccgattgaaggaggcttnc

SEQ ID NO: 88929 - DNA, 512 bp, Triticum aestivum
  unsure (1)..(512): unsure at all n locations
  Clone ID: PAT_TA_88929
cagaatgaagcatgaccagctgctacggtaattagtatcagtactgttcgtccagccatggctatcacgggcgtagcaacgagctcacacaaaaaattatgtaaaaccatcaatcactaagaggaagttaggttttaccaactggagcaacaagggtgccatcggcagctccgagttggagcgggagccaccggtctgccgtgccgtcagcagcaagagccgccgggccgggctgccagctgcagcgggaagccgccacgccgggccgccgaagctttggagggtaccgccacgccaccaccagcagcgggagccgccgctgattggggccctaggtccggtcgtcggcctttgtcttctcctccaagtggnttctctcttcanaacaaacgtgttgtttcaacacacattgtanataccngctttcctaatttaaatttaantaatttttgcggggataactgctttcttaattttggctaactnacctataataagaaagaagtcatgtt

SEQ ID NO: 88930 - DNA, 525 bp, Triticum aestivum
  unsure (1)..(525): unsure at all n locations
  Clone ID: PAT_TA_88930
acctcgcggagcccgtcaggctgcccggctgcgtgcccataccggggccggacatcctctcgccgctccaggacaagtccaacccctgctaccgctggatggtgcaccacggccagcgctaccgcgacgccgaggctatcctcgtcaactccttcgacgccgtcgagccggacgccgcgcgggccctccgcgccccggagcccggncgccctccggtgtacaccatcggcccgctcataaagaccgacgccacgggatgacaaagagccgcgcgcggcgtgnctcgactgggctggaccggcagccgcccaaagtcggtcatcttcgtctccttcggctccggcggntcgcttccggcggagcaagatgccgggagctcccncctgggggctggagcttaaacggacaaccggttcctgtggggtgggngcgggagncccgaacnaactaagggcgncggtnaacngccaacntactaacnaacncggagaagcaanaggggacccgccttgcccctaacttccn

SEQ ID NO: 88931 - DNA, 427 bp, Triticum aestivum
  unsure (1)..(427): unsure at all n locations
  Clone ID: PAT_TA_88931
tatagggagggacttatgtcaccacaaacagaaactaaagcaggtgttggctttaaacgctggtgttaaagattataaattgacntactacaccccaagantattgaaactaaggatacngatatcttgngcancattccgaagtaagtcctcangccngggggttccgcccgaacgaaagcagggggctgcangtaanctgccgtaatcttctactggntacatggncaactgtttgggactgatgggacttaccaantccttgaatcggttacaaaagggacgnattgctatcnacatncggngccntgtttgcctggngggaagaacaancccaaatgggatctggttatgttagcctctatccacttangaccttattttgaangaaggggnttccggttaactnaancatgtttaactttcc

SEQ ID NO: 88932 - DNA, 521 bp, Triticum aestivum
  unsure (1)..(521): unsure at all n locations
  Clone ID: PAT_TA_88932
ctctgccgagacaaatcaactcctctgacctgtcgctccctccctcccgcctcccaccaancaatcgccggcgacctcggnccctcgccattgccgcgctccgtcgaggcgggcgcttcccccgctactctccccgccaatgctcccgacgcccgccgcgtttcccttctgatttctccgctcgcttcagggtggcgtagggttcctcctgcctctgcgggggggggcgcacgacgtacgtcttggctccggcggntgttccantccaagtctgaggtgncgaggacatcaagaatgatgcttctgtatatgcttagatgacatcaatcaagccggacaggtcgggattcctccaagttcacatctgangggaatttgtgctttgatcgagccagagggggggcggtgntcggattcctccaagttcataatntganggaatttgtgcnttgantcganctaacaagggcggngctncggnttnctgtttnccacttanagggggaaacttttngccccng

SEQ ID NO: 88933 - DNA, 475 bp, Triticum aestivum
  unsure (1)..(475): unsure at all n locations
  Clone ID: PAT_TA_88933
gntttttttttttttttttcttcaantccanaaaatttcncttttttatacataggncgtcgattcggnattggttaanaanagggcagggtgccccctttttttttctannaaanaattcanancattttanccgatatgaagtgttctatntcacgataaattttacattagctatttcccgnttaaattcggtaccantactaataaagntggngaaagngnacctctttnngcctggacttcaagcagnttancnattaancgggggaagggnctcacagtcttggtttatcgnnaatcaangttgatttaccaatgagtcgcaaaatgctatggttcttccanaagatntccaaatttanncaagaagtaattcgtcgngatggtgcnancttttcttatttatccgaanaaatactangnagaatagtattaaagtgcacccgggataggatccangctattcttgaaa

SEQ ID NO: 88934 - DNA, 515 bp, Triticum aestivum
  unsure (1)..(515): unsure at all n locations
  Clone ID: PAT_TA_88934
gtttttttggagaaggnaaaaccanagcaatgtcaagagttgacaaaactgcaatggcactttatatatggcctgtccgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcaaccgaacataggcaagcttccacattgtccaataccgggcatcgtagtacccangagatgcgttgtgctcacggnaagatgaacccaancttgctgaactcgaggnaanggcacccacttggggcggntcagggtagtcgacctgcttgnggaggggcctccgtgctgagcggtnggtaggtnanacaaggtctcnaacttccttgatgccctccntngggccaacacntgcatgcacctgatccntccaccggttgcngac

SEQ ID NO: 88935 - DNA, 449 bp, Triticum aestivum
  unsure (1)..(449): unsure at all n locations
  Clone ID: PAT_TA_88935
atcgagatggncacagcatatgctcctccgatggcnntgcangtgatgnanagcggtttggngtgctccaagccgcggggcatgtccggcgcttcgctcancaggaggaccgcctcgtcgtcaaggccgtcangtctgaaaagccgacgtaccaaggtggtccaagnccatcaangggganncattcatcgggagnctggagacgnccgtcacctccaagacccctcgtcgcctggtanctctccaannctccccgcctaccgcaaccgccgtcaggccgctcctccgcggnatcgaagtcgggctcgcccacggataactcctcgncggggccttcggcgctcanngggccgctccggaaacacgccaattcacgggccaaggnaggcactctcggcggcnattcnggctcgtcttccaatcctttagggtcctggcctcaacaatgg

SEQ ID NO: 88936 - DNA, 233 bp, Triticum aestivum
  unsure (1)..(233): unsure at all n locations
  Clone ID: PAT_TA_88936
ctacctgggcctccgaagnccggcaaggangtccggccccgaccaatggatggatgggggatgaaaacctagcctaacacccacccatggatggatggggatgggggcggcgancngcggcgggnggcggncttctctcgggtgcttgctgatgtgggtgggcatccnacgtcggtgacgggtttcaagcacgtanacatcaaacgctgcgggtgtgacngaggagcaccatg

SEQ ID NO: 88937 - DNA, 504 bp, Triticum aestivum
  unsure (1)..(504): unsure at all n locations
  Clone ID: PAT_TA_88937
ataaacttcctcaaagtcaatgtcgacaatcacaaggnaataacgtccaagtncgctgtnacggggatgccgaccttcctcgttttccaacggggggaggncattgaacgcgtccagggtgccgacatgcgtaaagtgcaggctattgtncagaaactcttgccangcactaaagacgctctggctgatgcgacaacgggggaaaatggcacaagtcattcctcctggggattgngcgagnatcctcccggctactatgatgtaaccgatcaggtcnatttanatgggctanatntgtccaatgctgatctcaanttcggncngggctcgggtccctatttgntgatagtaaacccactgntctccaaaatggggaaacaaacaanaggacaacgactaangnttgggntggggaggcgactcaanctgancaacctgnnggntgtttattcccttccagtccccgcaacaaagaatnaantcccnttttaataaacttnaact

SEQ ID NO: 88938 - DNA, 530 bp, Triticum aestivum
  unsure (1)..(530): unsure at all n locations
  Clone ID: PAT_TA_88938
aatatgccttcgtgcataagtactggagcttttgcttgaaaaattttaattcatatttcctgcaatcagaaaaatttgaacttcggtagcggttataccgtcagccggattatgatcttgacatgtgtatcaagtaatacaacaaatagatgatacataaatacctgccatgtttgatcataaagctggctttagccaagcctgaagcggtggttttctaaaccattaccgtcaaaaggggagaaagtagcgcccgtaccgactgtactgacttaatacgaagccccctggttactccatgatgttaacagggaaaaggtaaaccaggcagactcctccgggnttaaaagggggatcaaaaatcattggctgaaccggaaaaaatatgcttgttgacacaaangaaatcgaacaaaagcaaaagaacgaacaaaccatgaaaacaacaatgggagcaaaagtaatgntaaaaaccatttgcaaaaatatgctatactgagctgttcanatgggaatancaagggncggnc

SEQ ID NO: 88939 - DNA, 296 bp, Triticum aestivum
  unsure (1)..(296): unsure at all n locations
  Clone ID: PAT_TA_88939
ggtcgctgtcgccgctcgccactgtagtcttctgctccgcatccaaatctcagatcgaacaacgctatcgccgatgggcgcctccgcctccgccgggagccgncgcttcaagatcttcgcggncgccgacggnttcggcgagccgctcaaggacgccgtcgtcgcgcacctccgcgcccactcctccgtcgccgangtcgtcgaantcggggtcggacaagtactantcccgccgccgcggggcgctctcccnacngagatctcctcctcggngnnacggaancaancgcaatgga

SEQ ID NO: 88940 - DNA, 296 bp, Triticum aestivum
  unsure (1)..(296): unsure at all n locations
  Clone ID: PAT_TA_88940
gangtgntaaccnaanntggggccaatccccgctcttancnccaagccngaggtcctanacctttcnccaatcanattcgggggcgcaaatctcattctctttggtgcgcacnaaaatttagcgggtgccgtctcgncncctccanattatcngcgnttgantaatctgcnatgcncacnntcaccaangcgacanggaaatcncgctggtctggccngccattacactataaattcccacctgctcccctgttttcttggggtcccttcttctccacatcaccccccnacaacca

SEQ ID NO: 88941 - DNA, 247 bp, Triticum aestivum
  unsure (1)..(247): unsure at all n locations
  Clone ID: PAT_TA_88941
ttcaagtaagggatcctnctcccctcctccgcgctcggcggcatcctcccctaccccgcggtgntcttgatntgcctggcancagggtggaagcatctgntggntcaacacggactgnttcgtggnctgcatacncnagattctccgcagtcaagcngcccctggggctctccctctccanaagcttcagcgggntcaaaggntgccttntacaccctcttcgncanaggtctctccccttactcac

SEQ ID NO: 88942 - DNA, 536 bp, Triticum aestivum
  unsure (1)..(536): unsure at all n locations
  Clone ID: PAT_TA_88942
ggaaagccgccggctgtgaacgancggngagcaaacgacaaaacgaggccaacgnaacaaaaacaaatcctcctcctcttgcgcgggtgnagctggcggncatgtcggtggagacggagcggagctccacngagtcctccggcgcctcggggctccacttncgaggaaaacggcctcaacctccgnctcccgggtccgagcccgaacgcaagcgnggctccanctccgaccccgnntggccctccccgaacgncggcgcctccgactctnccccttcccccaaggngcaagtggtggggtgggcaacggtggcggtcgttccgggaagaaagncctcgcggggcgcgggctcgtccaaagacaaagntcgncaagggtgggncgtcgacgggggcgncctaactgngnaagggtcganctcaaaggnttangcctggntacanaaagctctgncttcctatgaacaagntcctcgccacgctccnaggacaaggtnaattcccancttcanccgtccgaaangnttggggaacgng

SEQ ID NO: 88943 - DNA, 412 bp, Triticum aestivum
  unsure (1)..(412): unsure at all n locations
  Clone ID: PAT_TA_88943
actcgtacacgtgctcgtctatgtgaagacatcaaagttccaggaaaaagcagcttgcctagtttgaagacattacttctactgaggntatggnctcttatattcccctgctccgacttccggcatgntgtcgcaactccaatgcttctgcttatgtncgaatatctgatgcgatgccctatacaatctgggcgagatgcanctgttggntctttcttgtgctccatggagnttgcggngtactaaagaatcgaaaaagttctgccctgaagntaacaanttttctgcaaactcntttggtaagcatcacttaaatggagaaggngagnantcaanatcaatgaccaagtttatggnaggncaacgacattgaaaccanggnttcatntcaaatnaagnaaangtgcaatgg

SEQ ID NO: 88944 - DNA, 318 bp, Triticum aestivum
  unsure (1)..(318): unsure at all n locations
  Clone ID: PAT_TA_88944
ggggacccggcgcgcggcagagcctgatctccgtcgggacgtcgngcggnggaggggatgagtggagcaacgacttcgngctgacgctccggcagctgaggctggacgacctgatcgaggacgggnagggacgacgccgacgncctggtgcaccttctggtccatcagcacacccagttcggaatgtcgatcacagggcgagtggtcanatcgctcaccanaaatatgcgatttcctgctccgcccccatactgnacaangatatgatgagcaaattcngacatcacgggtngctgtcttcctccannnaaggatcag

SEQ ID NO: 88945 - DNA, 297 bp, Triticum aestivum
  unsure (1)..(297): unsure at all n locations
  Clone ID: PAT_TA_88945
gcagcangtgatggcggtggactttgccccgctctgtcgaggtggtctanatgcagccacgcatggctcatgcatgagtcatgcaagctttaatattcgtacaacctttctggagggtatgcagggctctanattcccgcatgcgggggtatgcgatgcctttgttctgttatatcaacgcgttganantatgaggcanaaancatgttntcngcagtgtatagcgcatgtgccagtattgttgcccatctgaagtttcctgnagaaatttnttttgtaaacctacaggagaancaa

SEQ ID NO: 88946 - DNA, 411 bp, Triticum aestivum
  unsure (1)..(411): unsure at all n locations
  Clone ID: PAT_TA_88946
ctacaacaatcnccaactccttgggcaagataggncatgtgaatcaaagaacctacattcatttccaacactggtgagaagatggnctggtnctaaagtatattcaaaaattgaacaagngcaacgaaattcggcattggtgtagaacatattccatggatgcatgncctanaatcaagagcatccacatnccaacgtccgnagttacgggccacangaagggataacaataatctggtngaggtgntgnggttcctaactggctaaaagggaatcgggngggaaaacaagtaacaaaggccttccttgnctgggaatttcccccanaactggaatatatgcgnattaggntncaaaaatttcaaaaatcccggggggattcaatggtttatcaanccaaaacaantgggg

SEQ ID NO: 88947 - DNA, 389 bp, Triticum aestivum
  unsure (1)..(389): unsure at all n locations
  Clone ID: PAT_TA_88947
ctcntgccgcttgatcttatcggtggcagtactacangcgagtgacacaagttcttgcancgatcagattcancttctgcgcaagatgctggacaagctgtgggaccacgtggtggccgggcctcgcccggagacgggnctcgacaagctccgccgcgncgccgccanccaaaccctcgccatcaacacaggtgcaggggaggngattaacncagtcgccgtcgatgccgacgaaccccgaccacgccggtgacnccgtcgtcgncnacgccggctccatggngggaacgtgtggntgcgcgttttccacccccgggancaagntggccaccaanaggctcgggggncaangctcttcganncgacccgnaagcccaantcccccaccg

SEQ ID NO: 88948 - DNA, 473 bp, Triticum aestivum
  unsure (1)..(473): unsure at all n locations
  Clone ID: PAT_TA_88948
aatgggattccccccgggcttgcaagggaaattcnggaacgaaggggaacgaggttangaangcaancaancccgcaagcggcgaanccccgccgaggaaaacctaaccgccgcccgcccgcaaaaagcangcaatggggttatccaacctccgnttgccgggcggggagggaacaaagaagggaccaaagcggcgtccgcggccccaaagtcccgacnnatgtctaacctcaaagctcctcngtcaaagcttctaaccggtttccctggtggagggagggaccaangangcaagtttcaaaccgccgttcatcctcaangaagggctccntcaatggagcaaaganccaaaaccgccccgcccggctctcccattgtgccggccctctccaaacttcnatgnaggggaaaatnggagggnganagaacaatttgctggtgggttgtttgggacaaatcaaaagaatgacatt

SEQ ID NO: 88949 - DNA, 433 bp, Triticum aestivum
  unsure (1)..(433): unsure at all n locations
  Clone ID: PAT_TA_88949
tgatcacccatagctagctagctagcagcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgntgctccggcgtgcaggggctgaacggcatggcccgcagcagctcggaccgcaagatagcgtgcaggtgcctcaagagcctcgccaccagcatcaagtccatcaacaatgggcnaaggtctccggcgttgcnccgggcaaagtgcngggtcaagtgtgccctttccccaatcagcaattncaaccaaacttgccgncaactg

SEQ ID NO: 88950 - DNA, 175 bp, Triticum aestivum
  unsure (1)..(175): unsure at all n locations
  Clone ID: PAT_TA_88950
ggtccaaaaatangggntccccgggctngaagaattccgnacgancaaaaacatgtctgnctctgtcaaggggtccaagggtctgacgaagccanctccctccccaatggtaaaaagaagcgaaactccnaggnttgggaccanccggggangncatcgctgctcaaantaacca

SEQ ID NO: 88951 - DNA, 574 bp, Triticum aestivum
  unsure (1)..(574): unsure at all n locations
  Clone ID: PAT_TA_88951
gggagtctaaatanggatccccgggctgaggaattcggacgaggttcaacaaccttcggtagggttccggcgactccggatgggcggccgcaacgtaaccgctgcttcttccttctcccgcggcncggtgccggaaacaaccgcaacctcctccgncccatcaacctcatctcccgccttaccanctcgacgaattccgcgaggcgccgcgcctccccccgcancacctcgatgacttccgagacccggctcgcctggcaccaggccacccgacagcctccgcgagcatcctccgccgccgcgccaacacttggtggggcanggcggagggaccctgccccagcatcgcacatgggcgcggngctggnggagcgtatcggcgcggagattgagggaggngcacgcgctgctccggacaagaacagcgaatctctgcgaacgcaacgtggngctcgtgcaaggaggtctcccgcccgtgcggnaacgggcttggncanancggctcgagncatngggnggcgnccaagnaagaagggagattcccgttttccgcgagggtctnatgannaggttt

SEQ ID NO: 88952 - DNA, 526 bp, Triticum aestivum
  unsure (1)..(526): unsure at all n locations
  Clone ID: PAT_TA_88952
catgttcactcttttattaagcaactgcacgtctcttgtaactgtgcaagcaatgtgggattgccacgaaaatggtccatccaacatattttctcatgtctgaccaattaacatccagtaggcaggctagtgtgacgagtccaaaataaagtgcaagggatttatcccttgtgtcataagaaaacagtaggaaaaatattaccaaatatctcagttctctggaaaccagcaaaaacctactggttcataaacttctcaaacaactagacctaacaatggagtagaaaatgaatccaagagcaaggtttaacaatacattacctgttttggcaaagtcataggactttcagatcaacaagactgatgtgatgagatatgtaattattacttatacaaatgaaatggccntctgatcatgcggtcgcaaggatgttttgttgtataacctcatagtgtaccaaagtggggatagaanccgtttcggtacattgcctccatccaactttcagcctcacttctgctgcca

SEQ ID NO: 88953 - DNA, 517 bp, Triticum aestivum
  unsure (1)..(517): unsure at all n locations
  Clone ID: PAT_TA_88953
caaaacggnccctgngggtggtgggaaaaacgccctatgnncggggcntgcacgggtaccancggaggncaggccctgctcaacaatgggcagtaagcaacggcaaagttcnacaatntgcgtggtgcctgagccctaccacacnatcngcnccatgacgcacagcttcatccgagcngtggagtgncncncgcggcaccaactangggccgnctggntcacctccatgagggccatcaatgcgcgacagcngtggcaactgttnaccttgcaaggncccatcctgnggntccatccgnantggtcgcaancttcatnggcgtgggtgagcctcaggtggtccctctgccctaaaaagtttggcatcgagcggnngagcccttctgcatgtaanaatctgaccccntttcgcgggcttcgtccgtcncttggaccngnaggcntactgnaagtncgacccnttattaccaaacgaancattncatcgaccggttctgaantaatgggncgggttaaa

SEQ ID NO: 88954 - DNA, 332 bp, Triticum aestivum
  unsure (1)..(332): unsure at all n locations
  Clone ID: PAT_TA_88954
cgggctgcanggaattccggcacgagcanaaccgcgggncaaccccgntgttactgatgggaaactgctttttaatgtgagctgctgctggatctcctttacctgtgggaggtatttttaggtttgctacaagaagattcttacaacaatgangttaagnaatgcaccgctaatggttgacctactatggcattttacaattgttaagattacaaagcgggaaaaaagagttaaagaattgtgacgtatgtttaacatgcanctatttttttaattcnttatcaanttggggaaaagtggtgctcttttcccgaacgaagggtctctnataa

SEQ ID NO: 88955 - DNA, 319 bp, Triticum aestivum
  unsure (1)..(319): unsure at all n locations
  Clone ID: PAT_TA_88955
nagcaacaaggtggnnggacgtgcgttcnctcggacgntggntccgccgcgtccaagngggtcaacgggntcgtgccccacgtcnaacgacntctgngtcaagatcgaccgcgtcgtgggcggtcgacggcgacggcgaggacgncctcaanctgacctcgcccaagnccngggacatcctctcccacttcctcaagctgatnntcttcacgatcatcangcccttccacaaaagcncgcggggcccaacagngccgggcggccgntcttcccggcagctcgttcaccactcnccggcggaggngctccngagcttcac

SEQ ID NO: 88956 - DNA, 540 bp, Triticum aestivum
  unsure (1)..(540): unsure at all n locations
  Clone ID: PAT_TA_88956
tgatcacccatagctagctagctagcagcttaaggaactaagcttgcagataccgatcgatggntcgtctcaacancaaggntgtggtggncgccgtggtcctggcggcggtggtgctgatgatggccggcagggaggcctcggcggcgctgtcgtgcgggcaggtggactccaagctcgcgccgtgngtggcgtacntgacgggganggcgtcctctatcagcanggagtgctgctccggcgtgcaggggctgancggcatggnccgcatcagctcgggccgcanggatagcntgcaaggtgcctcaangagcctcgccaccacgcatcaaagtccatcancatgggcaangtcctcggcgngccccggcaaagtgcnggngtcaatgtncccttccccatcancaagtccaccaacntgngaaactgtcanctangntcaatnatataancccttcctacnttncatgtatnggtctcgcnttgtngtngnggcttnatgnctatnctttacnggggtggcncataccctnnctgatg

SEQ ID NO: 88957 - DNA, 467 bp, Triticum aestivum
  unsure (1)..(467): unsure at all n locations
  Clone ID: PAT_TA_88957
agattgtaaaatgcctaaaagtccaacctcgaccaagttatatcaatatagaagagcaatgcttcaancactttggtattcttttttagcacaantaggcnattcattcatttaataaatttgtgatcaagtacatgcatttancaaaccaagttcaaatgaggcaaanattttggggggggggcccggtaaccaattccgccctataggtgagtcgtattaacgccgcgctcaactgggccgtcgttttacaaccgtcngtgaactggggaaaaaccctggngtttaccccaaacttaaatcngccctttgcaagnaacatcccccccttttccgccaaggctgggcnggtaataagcgaanggagggccccggcaaccgaattcgcccctttcccaaccangtttgcggcangcctggaactggcngantggggaacgccgccccttgtattcgggcgtcattta

SEQ ID NO: 88958 - DNA, 522 bp, Triticum aestivum
  unsure (1)..(522): unsure at all n locations
  Clone ID: PAT_TA_88958
nacttgtgtttgtttaaataacagtagtggcctcctggcttgtanttgggtaatgcaanagagaggtttggagttgaaggttctgaacgggaagcttgaacaaatagntcactttttctcatgtctttgattaagntcatcctatctatgtcngtttcttgtgtgcaagcattccattgtgtctgtgtgattgtgtgtgactgactgtttgtgtgtgtgactgattgtgtgtgtttctttgtctgtttcntgngtgcaagcgccccattgtgtgtgtgcgtgtgtgttgactgtgaactgtgtgtcattttatgactgtgactgtgcattgaatgtgactgtgtgtgtgtgtgtgtgtgcgngttgactggtgactgtgtgtcattttgcagggcgctcccataantacccatttgggcacctgatnatgcatggaaattttctaatangggcatggggcatgtaattttatgacctacananctccgtannngggaagaaacattgccctttggacaaccc

SEQ ID NO: 88959 - DNA, 163 bp, Triticum aestivum
  unsure (1)..(163): unsure at all n locations
  Clone ID: PAT_TA_88959
canagaataanaaatgtgactttcttaacnacacanaaagantgttgcttgtcaagcatcaaagatgttcaaaaaccgttcaccngtcctgggagcaatgtgttnntacaagaagaacggcaagngtttacacacanaggnaaactacacacttggnagggat

SEQ ID NO: 88960 - DNA, 530 bp, Triticum aestivum
  unsure (1)..(530): unsure at all n locations
  Clone ID: PAT_TA_88960
ggaaactgggcatctacgacgcgttcctgggcgcacgactggcgggaggcgctggagaanacgctggcctggctgggccccatggcgcacaacatgatgcggtggcangccgaccggagcttcgagcancagcaccanatggaggtgcagctcangggcggcaatggcaatggcaacgtgctgctgctgcagaccttgtacttcgccgaccgggacaagacggaggcggtgctctgcgagctgctcgtggggctcaactacatctgccgctacgangcancaagcagagcgcgctgctcgactgctccagcaagngtcgacttcgacgactgcaccgtggatnagtggcacgcctccatgcntcagtagcaagcaactacntagcaanggttttctttctcccctgagggaattccttcccttttggttggaaggtngtgtgaggaaaacaagcaagcanacaaaggggnagtggccangtantggggttacctgtggnttttgggttggggtttccccggcccntcaan

SEQ ID NO: 88961 - DNA, 541 bp, Triticum aestivum
  unsure (1)..(541): unsure at all n locations
  Clone ID: PAT_TA_88961
ggttcctttttatttaaaacttcncttcnttancctttagntttatctacntaacaataagtatctaccggntcgaactcgaatttgatcgccttccatacttcacaagctgcggctagttcagggactccatttgcaaagctgccggataatttcattaccttcgcgagcaagatcgcgcccttcgttncgaagcttgtacacaggcttctaaagccactcgattagctgctgcaccagggtgcatttccccaagggatgtcctaaagttcctccaacaaattgtaatacaagaatcgtccccaaaggatttcggtcaagagctggnaatatgccaaaacatgaataacaactgaagctaccgggtataacacctggcatggatacccagtccctggagtggaaaaagataccgcgagcacgattcntttttcaataaaaatcatcgcggcaaataaaatcaacaagaacctnaaagtcatttcggcggttcccccttctaaacttaccttactaactggtaccggggggtgggatattn

SEQ ID NO: 88962 - DNA, 350 bp, Triticum aestivum
  unsure (1)..(350): unsure at all n locations
  Clone ID: PAT_TA_88962
gtacgccggnttctctgcgtccaatggggaagggggcgcgcttcacgtcctcnagagntggagctttcncaccttcggnttccccaacaantcncacgcctcggnttccccaattccttcgccaccgnccaangaacaagcntcgctcaagaaaccactgacgnttccanaaaatcaccancancaccaaaacctattctnnacngtgctgggcggggctctccntggggtgggcctgctggntcttgtgggcancaactccattctattgattcgccattcaaagcgccncacaaatgaaaaaactgctgtgttgttcgnccaaaaaaanttccctnggatgcngtcca

SEQ ID NO: 88963 - DNA, 390 bp, Triticum aestivum
  unsure (1)..(390): unsure at all n locations
  Clone ID: PAT_TA_88963
ttcaaaagatatacggagggacttatgtcaccacaaacagaaaccaangcaggtgttggatttaaagctggtgttnacgnttataaattgacttactacaccccagaggnatganactaactgntactgatatcttggnaagcattcccnaagtaagtcctcatcctgggggttccgcctcganagaaacaaggggctgcaagtanctgccngaantcttcctactgggtacattggncaaactgtttgtgactgatgggacntaccaagtcttgatccgttacaaanggacggatgccnatcacatccgnanccttgttgccttggggaaaagaacaagcccaaatgggctcnggntatngtancnttaatccatttaaatcctatttt

SEQ ID NO: 88964 - DNA, 527 bp, Triticum aestivum
  unsure (1)..(527): unsure at all n locations
  Clone ID: PAT_TA_88964
gtctgcatggcccttgggaataagtgagtttttagggcgagtgtggagggccttgatattcactgcctttataaagagataaggattcaaccctttcanccatgccttctctctctgcctcccccactctcgagctctagcanccaagttctcatcttttccgccccaagaaatcactccaaccttgtccgggatccggagcgtagggcaagtgggatggtctcctccgtcaaggagaaggacattacgaagctctggaaggcggggtatttgggcaaagaaatcaaccaacggctcccggncgaggggcaaatnatccccactccggagccccatgagagggtgggtgttcatcccccactttgtttgcggggctgggatttcctctccaaccattcgtccgcggactcatgttctaactaagggctagatttccaatgntcctaaccccaanattctttcctcaacaatctcagcattcaattgttcgtgtgcgangntttcctcccgcaatccaacccantttt

SEQ ID NO: 88965 - DNA, 507 bp, Triticum aestivum
  unsure (1)..(507): unsure at all n locations
  Clone ID: PAT_TA_88965
tttatcaaatttctcanccaaagcaaantgtggaggaggggccgtccaaatccctggcgtggtccggccggtccctcgccgngncggngaagaaattaangcgncgctccttcaagtcccctccgangccgccangaaactctcaggtcctccctcctcangangtcaccgnggcgnccaagctcgancctcctgtcgangncgccgngntcaactcctccccccaagggcangaatcntcatggacctcnngatgaccatgcctcctgggcgncggatcctctccgggancgngcttcaaagcagattggggaactttgttgggcacggngacatgttnancctaactgaacatacaagtnggcgnangaatacaatcccatactccgggcaagggntanggaagggttgcctgcaagccgtgcaaataacaaaggcagcttgtccttgaggntcaacaagaagcttttgtgganctcaatcagtactaagganttcangggaagg

SEQ ID NO: 88966 - DNA, 199 bp, Triticum aestivum
  unsure (1)..(199): unsure at all n locations
  Clone ID: PAT_TA_88966
ccaccgcgggtgggcggggcncggctcctagaaactaagtnggatncccccggggctggcaaggaaattcggnacgagnccgggagttttttnttttttttttttaattccgctncccntattaaagtagngccgtcnncttcctttatcttnangctttnaccgagctagcaaagagtnatccanccggggtcgggac

SEQ ID NO: 88967 - DNA, 630 bp, Triticum aestivum
  unsure (1)..(630): unsure at all n locations
  Clone ID: PAT_TA_88967
attcccccggggctggcaaggaaattcnggcaacgaagtttttgttgttgggttgaagctngattnaaatgctttcaacgtggtttcaagggatcaagattctnatgatatcctcccaagctttcttccatcaaaagaattcanggntgggggtgttcctcaagcaaaccatgcctccctgagggccctttgaagattaaccccgcaaggttcatgaacaaagcctgtgaaggattcttgtcaaaggagaagatgaggcntacccttgaggggtatcaaaacaanttctatgtcaatgtggagaaanggaagagtgganggcttgggatacactctgtggaccctgttacgaagaaccctgngnatttacccangaggtggtcatcttttgtgaaacaacccgcccgcaaaggtggactgggctcaccgacaaagattgagggggacgggaaccaacactggtctctgccacggcacggnngatattgggccaagaacnactaggggacatcaancaatgaggggagtttcaagattctgggttctttctcgtggtgctcaaccaccaaccggaccttgctgggcccgtggtaattgatngtgcaagcaaagtccccccttgtcaatcaa

SEQ ID NO: 88968 - DNA, 361 bp, Triticum aestivum
  unsure (1)..(361): unsure at all n locations
  Clone ID: PAT_TA_88968
ttcgtcctcctccccccttccgctcctaactagggttttgcctgcccgccggcctgccgtcagcgangcccggcgcagccanccaagcgcgatggagcccanctcntcgtcngcggtggcgaggcaaacgtggganctggagaanaacatcccggcgggcgcctccgacccggacgccatggncgcgatctancantacgangaggcgggcaacgcncgggcccaccaagagaanccctggggcaccganccgcaacanttccgccgcgccangatntccgccctcgcgctccncaagatngtcgtccacncccgcgccgggggggancatcnagatnatnggnctcatgcaagggaagtt

SEQ ID NO: 88969 - DNA, 592 bp, Triticum aestivum
  unsure (1)..(592): unsure at all n locations
  Clone ID: PAT_TA_88969
accaaaggacttgaccnggcaancgcctctccgncgattcaanatcctcccggggaaaggttcttgggnatgatttcttcctcctcgaacgggntcccaagttcttgggggtaacttttgncnctctcaccaaggagatttcatgtctgatctttgacgttcaaattncaactgcctttgncccctttgccngaagcgaangctggggaagctggtgcanctgccggntcaaanagactacgttcatgtngcgcatccagcagcgtaatggtccgcaangngcctgaccactgtcccagggcctgganggaaagagttcaactacaagcaagatncctcaaagacctcaanaaaagagntttgctggaaatgggtancaatntgttccaaagaacaacangaacttgggncanggncaattcaaactnccangggtgatnaagaagggaaagaacggtctcaanaccttcccttggtccaaggcccgggaatttgttgnaagcaaagggaacnacattcnaagagttcaatgnggttttcttggaacnaaactgccaagnctccaatatnaaagagncctaacnatnncatg

SEQ ID NO: 88970 - DNA, 223 bp, Triticum aestivum
  unsure (1)..(223): unsure at all n locations
  Clone ID: PAT_TA_88970
gtgaggnggnccgcagaagacattaacaacatttcccttattgtnanttccatcaagctcnttacaataagganggnggggtgnccaaacaaancanatcacangntttaggnacatcggggaaaaaccgggcaattgtannaggggntcccgtttgttangggngcaagattcttctcacttcngactaanaaccaactgatgttgtaacaaacaantcctg

SEQ ID NO: 88971 - DNA, 403 bp, Triticum aestivum
  unsure (1)..(403): unsure at all n locations
  Clone ID: PAT_TA_88971
ttnccccggggtggganggattccggnacgaggcaaccangcccaaaaccaaaccctnatgcggcggnttgcggcggcggtaattgcgggggggaacctgaggaaaggggaancccagggttgcccccggntggnnaaccgggcgntnttcgtgcggggaacctgccgttcaacatctcngagcgagggagntgtntcgacatcttccggcaagttncgggggcgnttcgggagnttccggntnggcaacnccaaaggacaccccgggganggcgtacgtggggtttganggacatctaacacgncaagaanngccgtttgnccanctctcngggcttnaangtcgccaaccgggntacctcatnngtgntcctagtncncagggtcaaaaanggatntccaa

SEQ ID NO: 88972 - DNA, 522 bp, Triticum aestivum
  unsure (1)..(522): unsure at all n locations
  Clone ID: PAT_TA_88972
ccgtgccgatcgtgtctcaggcctactataactgaatttctccctctcttttatcttccgcacgaactcctattaagttcaagtatttttcttaagtcccatctaaaaatgcatatgaccagaacaagttagaactangccataccttgacgagaacatgtgaatgtccgttgttgtattgtactagaatttttttactttatgttgattgcctcttcggatgctaaaacccatgggaataagcatacttgttatagaaggaataagcttcttcttcagataaaaaccgcatgccaagctttggcacccctttttcaatttgctctgttgcattgctagctgtagtttcttcgaatcctgtttaaattagtagtcacnttagcaattgggtcaaaatacaaggaaaagggagaagaaacctatcctgtgttgtaaatcaacaaataaaccttgctatgtctanttattttgatttcacgatgggaatgaaaagggagtaggcattnccaacctaatcanggg

SEQ ID NO: 88973 - DNA, 699 bp, Triticum aestivum
  unsure (1)..(699): unsure at all n locations
  Clone ID: PAT_TA_88973
ggggggccgctcctaanaactaagtgggattcccccggggctggcagggttttacaatcagcaattaagattcaactcccggtatgaaatgaatccaaagggtctgggncccgtgccntcctacngggaacctgtccaaagggcgagcaattcaactancaaggctttatcaaagtggccaacaacatgttttaacaaacccgtgcaatcaatacgcaatcccgcaacaatgaaagagggttctaacgaagttcaagagggatcatccgacaatcccttgagtaaattttttttcctaccggcaagttcaagacatcaagatataatttactaagcaaagggaagggtttcacgtcaagcatccaagaacacccctttgggcctaagtagccctggcttcaatccctttccctccgaatcggggtccttcctcaatcctcaaaaaagcttgcttcaanggttcctcaaagctcccttgtcctaagatnaattggatttgcctgggggtaataatgccctggagtttggggggaaggganttgggctttgcaagtatgggattncctaaacaaatggaattctttgtacnggaaaagggggggtgaggggaagccttatagccaagcaaaaggtgaaacaatttgggggtcccctgtgcaancctgcaatgccgggaggggatgtttccccgatgggngg

SEQ ID NO: 88974 - DNA, 527 bp, Triticum aestivum
  unsure (1)..(527): unsure at all n locations
  Clone ID: PAT_TA_88974
ctcctagaactagtgggatccccggggctngcanggaattccggcacnagggggcnctgactatnttttgcttagggggtgttccanctgacagcgtgggntggttgactttgggtggaacaagattgcngangtgtctcaaatttgaacttccccgggtgaggggancataccattttcannctccgtnctgttttcaaaagntcgncccaggnttagtgcaaataanactggggttgtctacaaaggntgaaaatgcgccttgcaaaagcttgagcccagtaacttggtcatcattgggttatactgggnaaaccaanggctcctcataaganaaatgtnccaagctgaatcanccccaagagggcatcttatccatcatcaaaatcccananacggactggggntaaagcttgaaagcttganggtgaaaaaaacagggagaanggattcaaaaactttgctgggcgaangctgcatttaaacaaaatttttcccggttgaaatttacangtgggttgctgatt

SEQ ID NO: 88975 - DNA, 534 bp, Triticum aestivum
  unsure (1)..(534): unsure at all n locations
  Clone ID: PAT_TA_88975
gggaggtggncatgcatcgactgcggngacgtttacagttttgggattgtaattctggagatgctgactggcaaaagggcaacagatgattcattttgagaacggacttaacattgtcagcttcgtacaaagtgagttttccagaccagatactgaaagtcactgatgctgctcttcaggaggagtgcgagccctctacacaatccaatacaagtaacccgagagcgaagttcatccggtgcttgtgcagtctgctggagggtgggactttcttgcacgcgccaacacccaaagtgagcggntaaacatgangnaagcaacgggcanagtgcgtgcaatccaagaagtcatatgtcaaaagggacaagccatccggtttttctcccaagtgaaaagnacatccaaaaggaacatgtgcatctatccttctcctccctaacaaagatcgacaagaacgttcctcaatggaaaaaaaatatccacattcatgtttacttanccaacaatattaacattcnnaaanttacgtgggtt

SEQ ID NO: 88976 - DNA, 380 bp, Triticum aestivum
  unsure (1)..(380): unsure at all n locations
  Clone ID: PAT_TA_88976
acaagggaanagcaacancccatcncctccgtttccgaaaggtcanaaatggcggnccgtgctaaacanccntctgtcatgcaaaaatttggtggananttccaccttgcctccaagcntctctgagggtgttcgtgctcgcaanatctggccttctgtgtcatcctatgggaggggcttcaccacaagcaagctacatgnctcanaaccttgggatcagtgtcccaatgatgtcatcttctccattgnttgncaatgcaccccctgagaagaaaggngtcaaaaactttgcgattgacttcctcaangggaggagtgtcagctgcagtttccaagactgctgcaagctcctattgagngggtttagctgcttatccaga

SEQ ID NO: 88977 - DNA, 533 bp, Triticum aestivum
  unsure (1)..(533): unsure at all n locations
  Clone ID: PAT_TA_88977
tagaaagaaatgtcttaattgccatttgagctaataatcctaaagaaggagagagagccgaactaaagatatagagaaaattgatgcccattgctgatacagagaccagctcatggaagagaaaaccggggcccaggggctttcaccggaggcagcttcggcactcccacatccgtggtcaccggcagacgaacaccaccaccaagaccgccccccgcgcgtgctggccagccgccagatctggcgcaaccgagccactgcacacctgccccgcaacctcggttgcccccagccaccctctgggaggaggggctccatcaccactgcaaggnaagggggctccgccccgggcccgagtgcgccggntnagcaggcaacaaacgccccaaccngtagccagnatagcacgccgacgctgtcagctgggatgtggctcanggccaagccaccgggggggggcccggtacccaaattcgcccctattagtgaggtcgnnttacnccgcggctcaatgggccggtcgntttataant

SEQ ID NO: 88978 - DNA, 519 bp, Triticum aestivum
  unsure (1)..(519): unsure at all n locations
  Clone ID: PAT_TA_88978
ccccaacgtgatggctcgtcggcaactccgtcgctcctttccangggctcaagtccaacgccgggctccccgtcaagccgccgctccaacggngctagcctcggcagcgtcaagcaacggtggaaggatcaggtgcaatgcaagtgtggccatcgagggcatcaagaagttcgagaacctgtcctaactgccaacgctcaacacggaggccctcctcaagcaggtcgactanctgatccgctccaaatgggtgccttgcctcgaagttcaacaangnttgggttcatcttccgttgaagcacaacgcatccccctggggtactacgatggccggtactggacaaatgtgggaagctgcctatgttcgggttgcaccgacgccacacaagtgatcaacgagggtgggaagaaggtcaagaaaggagtacccttgacgcgttacgttccgcatcatcgggattcgacaacattcgccaaggtgcaagtgcgtcaagctttcatcgncttcaaagccaacng

SEQ ID NO: 88979 - DNA, 518 bp, Triticum aestivum
  unsure (1)..(518): unsure at all n locations
  Clone ID: PAT_TA_88979
tatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccaagtcttgatcgttacaaaggacgatgctatcacatcgagcctgttgctggggaagacagccaatggatctgttatgtagcttatccattagacctatttgaagagggttccgttactaacatgtttacntccattgtaggtaacgtatttggtttcaaaagccctacgtgcctctacgtttggngggatctacgaattcccccctacttattcaaaaactttccaagggccgcctcaagggtaaccaaagttgaaagagataagttgaacaangttt

SEQ ID NO: 88980 - DNA, 360 bp, Triticum aestivum
  unsure (1)..(360): unsure at all n locations
  Clone ID: PAT_TA_88980
ctgatcaaccaataagcttagctancctagcaagctttaagggaactannctttgcaagctaaccggattngaatgggctccgtcctcaaacaagcaaagggcttggtggtgngnccgccngttggtcctgggcgggcgggtgggtgcttgatgattggcccggcaagggaaggcctccngcgggcgctttcngtgcggggcaaggtgggactccaaagctccgccgcccgtggccgtnngcgttacgttgacggggggaaggggcgttcctcnaatnaagcaaagggaagttgcntgctccggcgttcaagggggcttgaacggcaatggtncncncaagcaagctccgganccggcaa

SEQ ID NO: 88981 - DNA, 151 bp, Triticum aestivum
  unsure (1)..(151): unsure at all n locations
  Clone ID: PAT_TA_88981
tctccgtcttccccganggtgtggngtanggtgcaagcantggnccgggtgtgtncgaaatccantcccccaagatcccntccaaagaggagattgccgancgtntcaanaaaatgntcgcggnggtcganaccaaaancctgtgggtgaa

SEQ ID NO: 88982 - DNA, 518 bp, Triticum aestivum
  unsure (1)..(518): unsure at all n locations
  Clone ID: PAT_TA_88982
ggttaaacacactcatctgatnanccactagctagccaagctagcagcttaaggaactagcttgcagctagcgatccatggctcgtctcaacancaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcancaaggagtgctgctccggcgtgcaggggctgaacggnctggcccgcaacagcccnggccgcaagatagcgtgcaagtgcctcaagagcctcgccaccagcatcaagtccatcaacatgggcaaggtctccggcgtgcccggcaagtgcggngtcaagcgtgcccttccccatcaagcatgtccaacaactgcaacaaatgtcaactaagttcaatatataatccntccctacgtgcatcatggncccgcntgncgtggaggtttantttctacnttt

SEQ ID NO: 88983 - DNA, 308 bp, Triticum aestivum
  unsure (1)..(308): unsure at all n locations
  Clone ID: PAT_TA_88983
ccccgtccgtccccacacacacacgcacgcgtttgncattttccgcccaccaacgccggngggagctccagccatggncgccaagtgctacccnacggtcagngacaagtacctggccgccgtcgccaaggccaagcgcaagctccgcggcttcatcgccgngaagaactgcgcgncccttatgctccgcctcgcgtggnantcggncgggancttcgacgtgggcaccaagaccggnggggccttcggnaccatgaagtgncccgcggagctcgcgcanggtgccaacgccgggctcgacatcgcgt

SEQ ID NO: 88984 - DNA, 220 bp, Triticum aestivum
  unsure (1)..(220): unsure at all n locations
  Clone ID: PAT_TA_88984
cccggggctggaaggaattcgggaacgagccaaccgtctccaaccaagataattcgcgagagatatttcgtcccggacgcgtccgccccgacgaccgaccgacgaacagcgcaaaagtaggagggagaggatgagcaccatggntatgtctgggctngaaccctggccgcgcccatgttcatnccggcggtggncaagtaaggnggaggactactcgctc

SEQ ID NO: 88985 - DNA, 233 bp, Triticum aestivum
  unsure (1)..(233): unsure at all n locations
  Clone ID: PAT_TA_88985
aaccgcgnaaccgctgcagatcccccctcccgccaaaaaagacgcctccatgggntccctcgccggnggntccgnctccaaggggctcctcttcccgtcctccatctcctcctccaatgcccgtctcncgntctccacatcctactggttctccgcgcccgctgcggtcacttcccantgaggtcgcagaggtggggangtccnngcaggccggccagggctggtcgtntatg

SEQ ID NO: 88986 - DNA, 463 bp, Triticum aestivum
  unsure (1)..(463): unsure at all n locations
  Clone ID: PAT_TA_88986
gatatatacctcgccccgcgccacactccaatggcgtccgccgcatccacctccgcctccgccgccgtcgccgtcgcctcccgcctgctcctgcgccgcgcgccgcacctgctgcgccgcctcccccgcgcgcgccccgcggtctcgtcgtctcatccgtcgtcgtcgtcgttcggcgccgccgccgctctccgacgcccgctcgggcaccgcgccaggatgggccacaccctccgccgcggggtcaagctgtcncccgcgctcgggctcaancaaggccaacgccgtcgatgctcccccanggtttgctttcaccggcaaggacattgaattctctgnctgggaagggcgacatccctctccgtcgccggtcacggngaaaagatntgttacaaaagtnnaanactcccaaattttnangaaatgnctggtgctgaaanaaancntcgaccccccnagctnn

SEQ ID NO: 88987 - DNA, 458 bp, Triticum aestivum
  unsure (1)..(458): unsure at all n locations
  Clone ID: PAT_TA_88987
cgcaaaggctcgacaaaccctaaccctagtccatanctagcttagcttccttcctctcnatctatctagagccatggcgccgaccaagggcgagggggcggccatcngcatcaacctcggcaccacctactcntgcgtcggcgtgtggcaagcacnaccgcntcgagatnatcnccaacgaccaggggaaccgcaccacgccctcgtacgtcgccttcaccnactcggagngnctcatcngcgatgccgccaagaaacangtcgccatgaancccatcaacaccgtcttctttncnaaagngtcttattggganaaaggttgntgatgcccctgtncacnantgatattaaagatgttggncgtncaaaggttnttccctggtcccncccgacaaagcccaatnaattgttgtgcagttacaaangggtgngggananagcaatttctcntctntant

SEQ ID NO: 88988 - DNA, 449 bp, Triticum aestivum
  unsure (1)..(449): unsure at all n locations
  Clone ID: PAT_TA_88988
ctcgcctccatcgaccatgccgccgccgccgacgacgatgacatcggcgacggcaccgtctctgccgtacgagctcctcgaggaggtcttcctccgcctcccgccggaggagcccgcgctcctcgcgcgcgcctccttcgccagcaagttctggctcggnctcctctccggncctcgcttccgccgtcgctacggcgagttccatggagcgccccccgtgctggggttcctttgttgccggccttgttccatcttcccggacgaagcaggaggaacccgtggnaagcttcgtctccaccacgaaattcgccgagcgcgctcccgacgacgaagaacgtggggtanacnccgtgggaatgccgccatggnccgcgntctcctgggggaatccgttataaacatgataatnggggctcantcgttttgggaaccnaattancangggcggg

SEQ ID NO: 88989 - DNA, 441 bp, Triticum aestivum
  unsure (1)..(441): unsure at all n locations
  Clone ID: PAT_TA_88989
ggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccaagtcttgatcgttacaaaggacgatgctatcacatcnancctgttgctggggaagacagccaatggatctgttatgtagcttatccattagacctatttgnagagggttccgttactaacatgtttacttccantgtaggtaacgtatttggtttcaaaaccctacgtgctctacgtttgggggatntacgaattccccccnnccctat

SEQ ID NO: 88990 - DNA, 402 bp, Triticum aestivum
  unsure (1)..(402): unsure at all n locations
  Clone ID: PAT_TA_88990
gatanatcctccganaccagcgcctccgatccatgtccgcctctaccgcttcctcccccgccgcagccctgcacctgtcaggatgcctgcttctcctgccgaccaatcccgcaantcgcagctaaaaaatggcncganctgaggaaaangcgaaattccctatntgtgatgcctantttgacactatccaagtccaagaagaagctcccgctaactttgcatnagnctcngancgctgnctttgntcacatcccaatcncntcntttcctgatntnccnattggnnggggtangntgtatncanntctgcaaaagaaatcactcaatctgcncannctttctgccntataatttttttgtcacagatanntttcngtggtttgtaaaagaatgangttctgt

SEQ ID NO: 88991 - DNA, 248 bp, Triticum aestivum
  unsure (1)..(248): unsure at all n locations
  Clone ID: PAT_TA_88991
gaaaaaccattcgaatacaagcagtaaaaccattccnaaagttttttncttatggggggaaaacacaantaaaaaantctccgtccatctcttccaancaaaaagatgggcctcgacctgttncaaacgaacnaacaacactgggnggggtaanggnggccctcaaanctgctcaaanggggcggatnaanaaaccncccncccaaaagggnggattaattanatnagaataacctcccccccaccgg

SEQ ID NO: 88992 - DNA, 438 bp, Triticum aestivum
  unsure (1)..(438): unsure at all n locations
  Clone ID: PAT_TA_88992
ggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccaantcttgatcgttacaaaggacgatgctatcacatcnagcctgttgctggggaagacanccaatggatctgttatgtagcttaaccattaaacctatttgnagagggttccgttactaacangtttacttccattgtagggaacgtatttggtttcaaaaccctacntgctcnacgtttggngggtntacnaaatccccccacttn

SEQ ID NO: 88993 - DNA, 459 bp, Triticum aestivum
  unsure (1)..(459): unsure at all n locations
  Clone ID: PAT_TA_88993
caccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaggccgccggcgccaccctcctcgtcgccgccaccgccacccanaaagcgaagctccggcgggatggagatngcggcggaggatgggggctgcggctgcacccaatgcaagttcgggaccaactgcggntgctcctgctgcagctgctaaattattgatnaacgatnaatgcaatgcaaccgcncgcaatgcnatcaatatnctaatgatngattcaatccaacccaatcctantaacaatgtnaanctaccctngattccaaggggcctttgtttgtntttnaagcaactggncaancnaagaancaaaanaaggtggannccccatcc

SEQ ID NO: 88994 - DNA, 272 bp, Triticum aestivum
  unsure (1)..(272): unsure at all n locations
  Clone ID: PAT_TA_88994
tcaacgtctacgtgcacgcagacccggcggtgaggntgngggacccccctacgccttccttccggggccgcttcgtcgcnggcaagccgacgcggcgcggggagccgagcctcatcactgctgcgcggcggctgcttgtngccgcnctactggangacccggccaacacctacttcnnactgctctcccaagcantncgtcncgctccactncttcntncggctctacnnggcgntcttcttncccaaaggcgcgnancaacaccncctccc

SEQ ID NO: 88995 - DNA, 221 bp, Triticum aestivum
  unsure (1)..(221): unsure at all n locations
  Clone ID: PAT_TA_88995
ccanctgctgcgcatactacanaggtggtacgcngaccggcggtggnggtggntgcttccgggcatccggcaaaaaggtggaattgctgtgggattttggtagtctttggtggntcaaaaagatanatggaggtacatgaattggtaggaccctgntaganattcaagcgtccatgaactcntcattgacgccagtttcttctggaattaaccganctgcg

SEQ ID NO: 88996 - DNA, 330 bp, Triticum aestivum
  unsure (1)..(330): unsure at all n locations
  Clone ID: PAT_TA_88996
agctgattggcctcatgatctgatcgatcgaaaccgtatccgacgcctcacttggttgaagcgaagccaaagctgactctgactcttacaaacctgacatggatatctcngcaacactttgtttgagaagangaaggtgccttganctactnaacttctttgcaggccgaggtanannacgatgcncnccgtggtgggnatgaatttntnctgctgctgctgccgccccacnggaagangaaggaggtggcnggggatanactacgtagaanaggagtttttnntttgctgntggtagtangcagnagtttttattatgctgttncncct

SEQ ID NO: 88997 - DNA, 353 bp, Triticum aestivum
  unsure (1)..(353): unsure at all n locations
  Clone ID: PAT_TA_88997
ctcatcgagttcctccgcgccttcgagcaccgccgccgcgcctcgccctcgccgtgcgcccgcccccgccgcgcggcctcctcctcctcgtcgccatcgtcgcggggaaggctcttcacctcgctctgcgataacccgcccccgaccgccgcgctcgacgcgctcgccctgctcgccgtgctcggcgcnctcgccttccntggtcgcgccctacgccangctgctggcgcgcgaggccgccntacctggtgcggcangtanccggaggagcnctantcgtacgtcgtccttccnggcgggngcccngcgcnagcantgngcggncagtntgtcgngcactncctctcgtggga

SEQ ID NO: 88998 - DNA, 440 bp, Triticum aestivum
  unsure (1)..(440): unsure at all n locations
  Clone ID: PAT_TA_88998
cttcgtactcgcctctctccgcgcaaccgagccttccgcccacctcctccccatttcgccagcggggcacccaccaaccacccccacccgccgccatgagggagtgnatctcgatncacatcggccaggccggcatccaagtcnggaacgcgtgctgggagctctactgcctcnagcatggnattcancctgatggccagatgcccggtgacaanaccgttgggggaggngntgatgctttcaacaccttcttnancgagactggggntgggaagcangtcccccctgctgtcttcgtagatttcgancccactgtgattnnttaagtgaggactggggcttaacgccanntcttncaccctgagcagcttatnaattgtaagggnggggtgggtgncaacaaattcccccntgggncntttcaccaatgggaaggngat

SEQ ID NO: 88999 - DNA, 185 bp, Triticum aestivum
  unsure (1)..(185): unsure at all n locations
  Clone ID: PAT_TA_88999
gcatcttgaagtgggtccgtccgtcttgaattggcaaaagagggcggtggtcgcccgttggtgangcantncccttccccngcctgccnataaaaagagggggggnggaaggcaaaatcatccacccntgtngtctccttctccttctcctgctccccgcttcccgccggtgatgctaaaaaaaa

SEQ ID NO: 89000 - DNA, 452 bp, Triticum aestivum
  unsure (1)..(452): unsure at all n locations
  Clone ID: PAT_TA_89000
catggccggcctcctcctcctcaagctcctccctccctccatcctctccggcggngccacctccacctccacacctcgccgtcggccagcaccgatccaccacaccaccaccagaatcacaagcagcagcatcaacgcaacacagtcttcctcctcctccaccacacccgcgacaacctcggcgtcgtctccggcggcggtgaagctcacctacctccagttcaacggctggctgtgggagctgcccggcggggttccgcgtcctcgtcgaccccatcctcgtcgggaacctcgacttcgggatcccctggntcttcgacgccgccaaagaaagaaactccccaaactcccaacccanaaacgggacgcccgggctcctcgccgaacctgcgtgggtcatcaaccaanaagcctcgacgaaccaatgggaactccgcaccctcaaccaagtn

SEQ ID NO: 89001 - DNA, 438 bp, Triticum aestivum
  unsure (1)..(438): unsure at all n locations
  Clone ID: PAT_TA_89001
gggattcgaagggcgccggcatgggcatcacgaccgacgacgtgatcggggagtgcaagctgttctacttcgccggtgcgganaccacgtcggtgctgctcacatggacgatgatcctgctctgcatgcacccggagtggcaggaccgcgccagggaggaggtcctgcgcgtcctcggcgccgccggcacgccggattangacgggctaagccgcctgagggtggtgaccatggtgctgcacgaggtgttgcggctgtacacaccggtgacggcgatccaccgcgagacgtacaatcccatggagctcggcggcgtcaggtacccggcgggcgtggtgctcatgctgccgcttctctgcgtccaacacgacaatggaggtgtggggcgccgacgcccaccaanttcaagccgganaggttcnccnaggggatctncaa

SEQ ID NO: 89002 - DNA, 435 bp, Triticum aestivum
  unsure (1)..(435): unsure at all n locations
  Clone ID: PAT_TA_89002
aaatccctctccacgagatttggcaccggccgctgctactgggagccagccatggccgctcagtcaaccccctcgcccctcccatccatgctgtctttgctgcaaaagagagccagaggagtcttcatggtggatgtgccgcatcgacgatgggctgcatgcctgcatcgacggtgaatcgatggcgactgcgtcgtgcagctccgcggtgctacagcccgcggttacaaacgctggaaccgtggcttccagatgctggaaccacgacggcatatgctggaagcccgcanctgttcgtggtgactggtgaccacaccggagcancctgaagctggaaccggcatcggtaattgttggnaccatgaancccctttgntgcaaccgggggagncccaanctggnaacgggnatccgtaattgctgctgccaagcgaa

SEQ ID NO: 89003 - DNA, 445 bp, Triticum aestivum
  unsure (1)..(445): unsure at all n locations
  Clone ID: PAT_TA_89003
cgtggcttggccgtcgtcgagagctacaaatcgttgaaagcaggatctgaaccgagcgaggaggaggagttccttgcttgcgttcttggctggggcattgaatggcttcaggcttatttcctcatccttgatgatattatggataattctcaaactaggcgaggaaaaccatgttggtataggcttccgaaggttggcctcattgctataaatgatggacttctccttcgcagccaaatatcacggatcttcaagcgttatttttacgggaaaccttactaagttgatctcctagacttattcaatgaggtcgaagtttaaagacgacttctggggaagttgttaanaccaaattacaacaaagtgaagggcanaaaaatttgagcaaataataccgtagatgtttacanngcgcaattgtttgaatacnaaacancttacttat

SEQ ID NO: 89004 - DNA, 193 bp, Triticum aestivum
  unsure (1)..(193): unsure at all n locations
  Clone ID: PAT_TA_89004
caaaatcccatccggaatcaacttctctccctccgatnctcttcctcccccttccctgccgcctccgccggggagaatcnctgtcgcgcccgtcgncacgacctaagagncctccttcatngggggngntcttcccngagncaccaganggngggganggggggncaatntnctccanaancggtatncaaaa

SEQ ID NO: 89005 - DNA, 474 bp, Triticum aestivum
  unsure (1)..(474): unsure at all n locations
  Clone ID: PAT_TA_89005
gaaccacatcactgcctgtcgtaattgagacatccaaggatcaaagttaatccagatgcctttgtcattctcaccttcttttggctgcaggctgtatcgttgacaatcaggggagtttgctcctgaactcctagggctcgccgtgtagacacagttttccatatcaaacagagcctctctgccatcaaggtccttgccaacggtgatctcctggttaatcggataattgagtccgagaaacaaagagtgtgaaccaaggntgtttaccccgcctccaactaaaaaatcctaaaggncccaacaagctagtatcctgctcaaaagacgtaacagccattgtccggntactcacncattgcacggggcttgtatacaagngggttttttgcaatataacttttccggctcatgtgtccaaatgatcatcaatcttttgccgtcntctgatcgagcgaggaaacaattgtngttccc

SEQ ID NO: 89006 - DNA, 195 bp, Triticum aestivum
  unsure (1)..(195): unsure at all n locations
  Clone ID: PAT_TA_89006
ctcaaccacacanaaaaanagcgtccaaggctccangctanctagccaccaatggccgccgcactgtagcctccgggcgcccttctccgtgcgcgccgtggtggcaccngggccncacgtggncctggggcccgcggacctcanaactccacgccgccaancaagtgnttgggaaggcatgttccgcgctgcaag

SEQ ID NO: 89007 - DNA, 428 bp, Triticum aestivum
  unsure (1)..(428): unsure at all n locations
  Clone ID: PAT_TA_89007
gttcatctcactgagctcgcaggcagccccagccaccaagcgaaatggncgcgtcngcgctgcaccanacgancagcttcctcggcaccgccccgcggcgtgatgacctcgtccgcagcgtcggcgacttcggcgggcgcatcancatgcgccggaccgtcaagagcgcgccccanancatctggtacgggcctgaccgtcccaagtacctgggnccgttctccgagcagaccccgtcgtacctgaccggcgagttccccggcgactacgggtgggacaccgccggattgtcggctgacccaaaaaccttcnccaagaaacgggagctggaggtgatccactcaccgggggngatgctcggcgccctggggtgcgtgttcccggngatnctgtccaanaacnggatcaattctgcnaaggccgtgttg

SEQ ID NO: 89008 - DNA, 492 bp, Triticum aestivum
  unsure (1)..(492): unsure at all n locations
  Clone ID: PAT_TA_89008
agaaaaatcgccagcggnaatgcctactcatatcacctcactgttggncaccttcggtttccttgcagaaatcctgctactaagtgcattgctcacacgccctttcagcaaacagcagtgcctcgcagcangtccctgcacgctgccgtagggaccaagcggncgcgcttctcancgtgaagcgttccttctccttcaccgacaaagacgactacttcatgccaagccaccaccacgacattgtcttcgtggacaaagggnacanactgctgccgctgggagggngttggntgcgaaaaatgttaccgggagggtaaacgcactcgacctcccgggggcgggaactgtntntcancggggcttcanccttttctctcttcagggnttaactctctccaaataacctcaaacctttgcctttcaaanaaagntttacaagctcccaancttcanggtttctgggnttccaagagcttgacacaaacngaccnn

SEQ ID NO: 89009 - DNA, 482 bp, Triticum aestivum
  unsure (1)..(482): unsure at all n locations
  Clone ID: PAT_TA_89009
cgcacgacctacgtagccttcgcgtagcctgcgccttcccttccattaattttgctttgcctgctccggcacggcacttanatagctccttcgtccaaacgaaacgactggtacggtgcttgtgcgtgtgtctcgttgatcgatcgaggtggtcgtttgctcggcacctaaaaagangttgagcggcgggtcatggcggggccggcgggagggcgggaactgccggacaccccgacgtgggcggtggggctcgtctgcgccgttatgatactcgtctccntcgccatggggcacgccctccacaacctcgggcactggttccacaagcggcacaanaanggcatngcggnggcgctggagaaaattaaggnggggctcangcttggtggggcttcatanccctgntcctcanccgtggggcaggaacccatntccaagatatgcaatctccntggaggggcngcancaaagaatgntccccn

SEQ ID NO: 89010 - DNA, 272 bp, Triticum aestivum
  unsure (1)..(272): unsure at all n locations
  Clone ID: PAT_TA_89010
cttcctcaagtatgtcnatttgtngtacgggcanttcantccaatccactgacttnatgcacggggaatcgancaacaatcctttnttgtgaaganctgtgactgggnggtctgnaacctccttaaaaagangggnggnggggnaagggaattnaaatnactaaccaatnttnagattnagnataagcaaaataaactgntgcatccgaagacggggaatcnaaaanaaaagncnggtggggaagnaaaaaatgcaaaaaancctttttccc

SEQ ID NO: 89011 - DNA, 471 bp, Triticum aestivum
  unsure (1)..(471): unsure at all n locations
  Clone ID: PAT_TA_89011
gcgcgccctctccatgagcatgaacccctcctccaaacccctcctctanataaaaanacgctgctccccntccggacgannancctggctggtggatgattggccggacatggaagcgctcctcctcctcttcctgctcaaaatggagggtttccacatacaattcttcccaaacccctgaatcttnanaaacnaactaagttggtagattgctgcngggggataggtacgtccgttttgtntgcattangcggcaacangcaagtgctgtgttgttgtccntggnacaaatnanaatggtggtgggntggggctcaaggccgggatgctccctgggcgtcgaagttctccaaggagagggaaaggntcccggccgggcgggngggngggccccnttngccccgcgcnccngaggggcgtccntnccctccngcatngttntggggacgaacaanacggcacctcngtttn

SEQ ID NO: 89012 - DNA, 482 bp, Triticum aestivum
  unsure (1)..(482): unsure at all n locations
  Clone ID: PAT_TA_89012
ccgtaatatctctcctccctctcccatcccctctctctcctccanccgacgtcgccgtcgccgtccaatctccggcgagatnccctcccccgccggcagccatggnctccaccttcagcggngacgagaccgcccccttcttcggcttccttggngccgccgcgggcctcgtcttctcctgcatgggggcggcgtacgggacggcgaanagcggggtgggggtggcgtcnatgggggtgatgcggccggagctggtgatgaantccatcngtgcccgtggtcatggggggggtgctcgggatntangggctcatcatcgccgtcatcatctccaccggggatnaaacccaaaggcaaagcctacttcctcntcgacgggtaanggcgcaactctcctccgggctcgcctgcgggctcccggggctcgccggccgggcatgggcaaccggcaatcgtcggggnagccgggngtcaagggncaa

SEQ ID NO: 89013 - DNA, 496 bp, Triticum aestivum
  unsure (1)..(496): unsure at all n locations
  Clone ID: PAT_TA_89013
cggaggtgcttcctaatttccacgatgaagctgatcgcagcctaccttctcgccnatctgggcgggaactcttccccaagtgccgctgacgtcaagaacatccttgactcanttggtgctgaggctgatgaagaaaancttgagttccttcttgctgaactcaaaggnaaggacatcacacaagtgattgcatctggaagggagaagtttgccgctgtgccttcaggngggggtgccattgctgtgggagctccatctgctgcatctggtggtgccgcagcaactgctgctgagtcaaaaaaagagggagaangttgnttganaaagaaagaatctgactgaagacatggngtttcantctgttcggaccaaagcaacgtcagttcctccccccnanccaccgtttaacctgntaatcngtcccgngtgtgggcntgncacaaaaaacgcctgcataaatactaancagacctgcaggttngttcctnattttttg

SEQ ID NO: 89014 - DNA, 436 bp, Triticum aestivum
  unsure (1)..(436): unsure at all n locations
  Clone ID: PAT_TA_89014
caacaagagcgccaggccaaggncaggccagnagaccatcctccctcccctccctcccccattgnggncctcctccccctctccccgcccgcggaanctcgagcgcgggacacntacgcgcaggaaaangcgcgtgcatttntgntgtcggcggggaggcttgttcnccggcggggggcgtttcttggtggncgggccggtcgttcngcgtgatgaacancggtgacgccgccgggtccanctccggcggatnggggaancgggcgctcccacgaggggctccaagaagcccaagtattccaagtttattcagcaggnagctcccggcttgcaagccaattcttactccaaaatgggtcatttcggtgnttcttcttgttggnggcanttttgtccccaccaagtngtngcttcgtttgctagcttcaaaaaaaga

SEQ ID NO: 89015 - DNA, 487 bp, Triticum aestivum
  unsure (1)..(487): unsure at all n locations
  Clone ID: PAT_TA_89015
cacacaagaagctcatagccattcaaagcctcttcatctccgaagctccaacccaaccgaggatgtcttgctgcggaggaaactgcggctgcggcaccgcctgcaagtgcggcaacggctgcggcggctgcaacatgtacccacaggccgagggcgccgggggcaacctcctcgtctccgccaccgncanccanaangggaagctccggcggnatggagatngcggcggagaacngcggctgcggctgnacccanntgcaaagtgnggcaccaanntgcggntgctcctgctgcagctgctagatngattatcgaccatatgcatgcaccgtgcccgtgcgtgcatcatcgatcatatcgatttactactaccaaaccatgtnnccgcaacctgntcgaggggcttttatttattcacctgnnccttgcatcaaaaanncnagggggcnatgcccaatgntttttaaacaangnccccccccnaatn

SEQ ID NO: 89016 - DNA, 476 bp, Triticum aestivum
  unsure (1)..(476): unsure at all n locations
  Clone ID: PAT_TA_89016
ggcgcatcttcctttgtctcactgtcgcctccctactcggcaggctcgcccgtgaccgctcgcaaaattgatgttgtaattgtatgcttggtcatagagggggattcgccatccacgggttcggcggcgacggtctcctccctacctgcatccgcgagagaggccacgacagctcgccgacggcgggcctcgaggtggccgagcgaaaagcggcggtgctcggggtcttgggagctcctcaccaccacggccatggtagcggcaacaacagccaagaccatggtcacgccaagcagtagcagccgttcangttcgtcccggggtgctttactccctgcaatttttgacgcagtttttgctccagctcatgacaaactacgtgttgtgatgctaatcgattacatttgtatgtccatttttatctgtacacccactgcaaaaactatgcgatgtaatgctaatcttgaccagatttt

SEQ ID NO: 89017 - DNA, 475 bp, Triticum aestivum
  unsure (1)..(475): unsure at all n locations
  Clone ID: PAT_TA_89017
cctccctcgctggtcgccgtcttcgccttcgccttgctctctcccccaaccccaacccctancctccgtccgccgccccgcccctccttccancgccggncggaggaanctangctgcttgctgcctcgtccggagaagccctttttgcgcccggatntcctcgccccccgcgcgcaaaccaanccgccggnccgctcgcttcgatttgtttcgtttattcgattcttgcttcccgttctgtanatatntgctcggtcggngcccggatttctcggcggcgtgtntggatctgggctgtcngangaaancccggntcgattcgctcccgggcgccgccgcggngggtttggatctcncgnggggtacnaaaagggggggaagagaaantcgttgatttcnttcggaaggcangcaancngtnaaccnganatggatnaaatngntcggcggggaaagtttaaagctccgggnaaa

SEQ ID NO: 89018 - DNA, 214 bp, Triticum aestivum
  unsure (1)..(214): unsure at all n locations
  Clone ID: PAT_TA_89018
ccctcctctgcctgcatctgtcgccgncggtgcgcnacctccacacgccacncgccgcgatggccgccgccccctcngcnacaagacgctcnccggcgnggntctctcgctccccnttctccggnncgacctcaaccctgcncggttctccgcggggtgttntcnnccggacggnnccctccatctcgcnagaccatgtcggtntccggnancc

SEQ ID NO: 89019 - DNA, 477 bp, Triticum aestivum
  unsure (1)..(477): unsure at all n locations
  Clone ID: PAT_TA_89019
ccgtcccctgctcctacccttcgccatggccgccctgagctccagccatggacagccgctgccggagctcgtcttccccgccgtcggctagagccctaggccagtgacccaagcctcttccttccttcccttttccctcacgcactctcttcctcctccatgacctctctatcttccttgacgccatggaaaggagcactcaaccgtggtacagtcgactccggtccgtccagcgacctccgtgcctcgtcgccgatcagattcgtgcctcctccgtcgtttcccacgccggaccccgctactgcctcccctgcttctgctgcgcgaggacgacgacgcatccagcaaagcgcccgctcatcccaagccacgttgaccgcctccctccgaactcaccggngtcaccacggagcttccccgacctctccttcactctgacccaagtctctggtgggcttgtcgtcgtcgtcacctaag

SEQ ID NO: 89020 - DNA, 152 bp, Triticum aestivum
  unsure (1)..(152): unsure at all n locations
  Clone ID: PAT_TA_89020
aatccatcaacntcttcttccntcacncaccgtcnggganactatgcaatcnccatcgctctcnncggttttacggcggcggattgnncctacnctctctgtctctcgcggttgtactccgcnncgggcccggtccaaagattcnggcgagt

SEQ ID NO: 89021 - DNA, 347 bp, Triticum aestivum
  unsure (1)..(347): unsure at all n locations
  Clone ID: PAT_TA_89021
acatgttctagtttagactcnangntgcaccanatcgaaacatgcatanaanccgctagntccctcaangcatccctcctanctggnctattaagggcacgtagattccagcaaactaactccaccggggagtacganatggggagggaagggtccaatgtcngtancaagccgtctangcggncgaaaccatgagcttctccanatctccctcaagggtcaacgggantactttgtcaaaaatcgcagcgatngcccntanttgtggntcntggggtggggagncaaacatatnaccaagttgtccaagagctccctccgncatgggcanattatcaaggggaatg

SEQ ID NO: 89022 - DNA, 189 bp, Triticum aestivum
  unsure (1)..(189): unsure at all n locations
  Clone ID: PAT_TA_89022
cactccttgcgttccgagtgacaaaggncatggggctcgccacctcccancgccanctcgttcgccccgccgccgcgggccctcncntgncgctgngtnccctccgcttcgccgncccccgatntctcccgaggatttgntnccaatctatcaactcaactaaagtgttgggagnttcctcaatgacag

SEQ ID NO: 89023 - DNA, 485 bp, Triticum aestivum
  unsure (1)..(485): unsure at all n locations
  Clone ID: PAT_TA_89023
ctctccagcaccagcaggccggcggcaagcagcgcaagcacaacaaccanatggccaccatcagcgccgccgcggcgaccaccgtcgtcncccgtgccgccatcgccaggccgcaggccctaggtctgccccagctgaggacgangagcgagagggtgnggtgcagctactccaaggacgccaaggaggcgacccctgccgccgccgtccgcggggctggcgcgtccctactcnccgcggngggcgcggtgaccgcgtccgcggggccggcgctggcgctggtcgacgagcggatgtctacgggngggcaccgggctnnncctggggctgaagcaanaacctgctggggtgggatntccctgggcgtcttcggcctcatctgggtcgctctncaaacgtctncaactccgggcctcgaannagggacgaggantccnggcgggctctcgctcctaagcttngacatnagttttcctccgnccgnt

SEQ ID NO: 89024 - DNA, 155 bp, Triticum aestivum
  unsure (1)..(155): unsure at all n locations
  Clone ID: PAT_TA_89024
ctcgagttttttttttttttttttgaaaacannattccacttgatgangacaanattacagcganganangttcacantcgagncacttgnncantttggacatctacggtacacgcggttcgctgacatnanatcagcactcgcnatattgcct

SEQ ID NO: 89025 - DNA, 204 bp, Triticum aestivum
  unsure (1)..(204): unsure at all n locations
  Clone ID: PAT_TA_89025
tttttttttttttttttagggatgacatgctacaactattcaagacagatgttacaaccggtaggaataaatgttgcnaacgatggcataaaatgttgcatggncgactgacacttggntaaatctcantcaactgaattttagnaggancgcaggaacattcnacatgtncacagcacantannaccttgnaangntctgcta

SEQ ID NO: 89026 - DNA, 567 bp, Triticum aestivum
  unsure (1)..(567): unsure at all n locations
  Clone ID: PAT_TA_89026
gctagaacctgaagatgaaagttcagactctgatgacctgaattttatcacccgttctggaaattcagaacctttgaaaaatagagagaaagttgatgaccttggattaccttctgcatactctgaggatgatgactatgattctgacgaagttattgaaatgatgcaatcaagttcagatgaatcaaatttcaccacctcttctgacaatccagaagatgtgaaggagaaagttgatggccttggattaccttccgaggactctgaggacgatgattatgatccagcaggtcctggttctgatgaagatattggaaagaagcagtcaagttcagagaagtcacactcttctgacaaatcagaaaataggaagacgaaaaggaaattgatgacctcggattaccttctgaggaccagaggatgatgactatgatcagcaatcctgatcagtaaagatatcaagagaacaagatgatcagctccaccgacccgatgattcgtgttgaatgcaaacttgtctggcaagaggantcacaggactaagtggtggaactacgtactgganga

SEQ ID NO: 89027 - DNA, 394 bp, Triticum aestivum
  unsure (1)..(394): unsure at all n locations
  Clone ID: PAT_TA_89027
gaaaaccctaaaccctcttcgccgccgccgccagccatggncctctttgccgccgcccgccgcgcggtctcctcctcccttcccctcctccgcgcctccgcctcccgcggcgcggcctcncgtggcgnggaccttctccacccccttgccgcagncgctgnncggccnatgcacttctcctcggnnacngagctgaanccganctccgacgacgagctcctccgcatcatcaatgcnganatnaagttcgccgatgantgcnacgacnacgaccggnttgaggagatccaaatancttccntttcaggatcaccgacanaanggcttaatgacatcactcttacaataattancanggtgagaaatcgaggtctggttcaagcccaacctagta

SEQ ID NO: 89028 - DNA, 546 bp, Triticum aestivum
  unsure (1)..(546): unsure at all n locations
  Clone ID: PAT_TA_89028
atttggattaacttgctgctgcagccgtattgagtcctatgcactttacatattgcacgccgggactgatcccgtatgctgctcgcactgtgagcaccttgcaaatctactccgtgaagattgttggaacagatggaaagttgaagttgccactccatgtttatgggattgtcgctgcccgagatgccgtggactacaaccgcaacattctcttctcttggcgaagggaaaactgccaaaaactcactccagaggcatgtaccatattacatagtatttctcgtaatttcccccttttcttcctgcatgtgcattcgttcattcgattcaactataatgatgattatgatgcctgcangatccttttttgcgcttgactggcctgtcccgtcaantgtggctgttacatgttgattttgaagtcaaagaacatcaagctacaacctgagtgccctgttgttaangggccctggcctttnataggcgacgatattctctcgcacacaggaatnnggccccancaagaattgntggtgtccanncctn

SEQ ID NO: 89029 - DNA, 380 bp, Triticum aestivum
  Clone ID: PAT_TA_89029
cggagaaggacctcatccgcgacaccaacctcgagtactgcgaagcactgcgcgccgccggcaaggaggtggaggtgctcatcaaccgcggcatgagccactccttctacctcaacaagttcgccgtcgacatggaccctaccaccggggagcgagcccaggagctcatcgatgccatcaagagcttcgttgcccgccactaaaaaagcatattgtatcacacacgtgcatatggtatcccacaggtgtgtctgccattgtcgatcgaccatatatacgtgatggcttctgggattgtatccggcgcctcgtctgttatcagtgtatgcgtccaaatctttgggttatcacgccatctgcagcagcatcgtgatcaaaaa

SEQ ID NO: 89030 - DNA, 571 bp, Triticum aestivum
  unsure (1)..(571): unsure at all n locations
  Clone ID: PAT_TA_89030
gcnanccccagaaagtttccgatctaatcgtagcaaangctttctcgtccgcctccaanatgcanatctttgtgaagaccctcaccggcaanaccatcacccttgangtcgagtcctctgacacnattgacaatgtcaaggcgangatccangacaaggagggcatccctccggnccagcagcgcctcatcttcgctggnaannagcttgaggacggtcncaccctcgctgactacaacatccagaaggantccaccctccacctggtgctccgcctcaggggtggtatgcacatcnttgncaanacnctcancggcaagacatcaccttggaggttgagtcatccgacaccattgacaacgttcagcaangatcaggacantgagggatcgtccggacaacagngctcatcttcgctggaacagcttgaagatggcganctcgntgactacnnatcagnaggatcanctcaccngngctccgctcgtgtggatcanatctcgcagacctcactggaaacataccntgggcatctctgccatgngactcagcangttaagacagnggancc

SEQ ID NO: 89031 - DNA, 577 bp, Triticum aestivum
  unsure (1)..(577): unsure at all n locations
  Clone ID: PAT_TA_89031
cctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacagtgatcaacgagtggaggagtcaagaaggatacctgacgcgtattcgcatcatcggatcgacaaatgntaagtgagtgctagctcatcgctccagcaccgggctcaagatcggcaggctaacantactacacngcatatataatgcattnanttgtaaccng

SEQ ID NO: 89032 - DNA, 298 bp, Triticum aestivum
  unsure (1)..(298): unsure at all n locations
  Clone ID: PAT_TA_89032
agaaaatgcgccgccgttgttcgccgttgtgaccccgccgccggcgaggcctcccccgcgtccatggatctttccgccgcaagcgccctcgccgtcctcagcaagctgcagctcctcggcttctgcgtcggcctccagatccccgacgacgccgccgaccccnccggaggtgttcgacaccatcctcgccgcgttcctgggcgaggtctacnccggcgancgcgatgcgcgcccgctcncggcngccctcggcgactggngccgcgtgganctcntccgcntcttcancgnngtccgc

SEQ ID NO: 89033 - DNA, 564 bp, Triticum aestivum
  unsure (1)..(564): unsure at all n locations
  Clone ID: PAT_TA_89033
ctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatttcgggtgcaccgacgccacacagtgataacgagtggaggagtcaagaaggatacctgaccgtactccgcatcatcggatcgacaacatgcccaggtcagnctcagctcantgccttaagcaccggctcaagatcngaaggctaaacagtantcacacggcacattaatgc

SEQ ID NO: 89034 - DNA, 555 bp, Triticum aestivum
  unsure (1)..(555): unsure at all n locations
  Clone ID: PAT_TA_89034
cgataatacaataccatggcccccgccgtgatggcttcgtcggctaccaccgtcgcacccttccaggggctcaagtccacagccggtctccccgtcagccgccgctccagcggcagcctcggccgcgtcagcaatggcggaaggatcaggtgcatgcaggtgtggccgattgagggcatcaagaagttcgagaccctgtcttacttgccacccctctccacggaggccctcctgaagcaggtcgactacctgatccgctccaagtgggtgccctgcctcgagttcagcaaggttggcttcgtcttccgtgagcacaacagctcctccgggtactacgacgtcgatactggacaatgtggaagctgcctatgttcgggtgcaccgacgccaccangtgctcaacaggtggaggagncaagaagatacctgacgctattcgcgtctcgcttcgaaactgccaagtgagtctcactcatcgattaggcacgggttcaagatctgnaaggctaacacattaacatggctagtagattgcttgtactacttgtcagaccg

SEQ ID NO: 89035 - DNA, 552 bp, Triticum aestivum
  unsure (1)..(552): unsure at all n locations
  Clone ID: PAT_TA_89035
aagaattcctcccacccccaccgtctcgccgccgccaccaccgccgcagctagataagaagaaaaaaagagagagaagaactcgtcgggagggctcgagatctgtgtcgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtagttccctgatgtacgaagcacccctcggctacagcattgaagacttcgacctgctggaggcccaagaattctctgctgatacncaattgcgcnaanaaccanccnganacgtttttgggatcccttcccgnanttaaggttttangcattttatccgaccttttcnccaanatctctngggttgtgcttcacataatcgacagttctcantcttctcctcgtcctctcgctcngtctcgaccnaatgcaacaaggtgcccgactcncatnggttgaggcacaaaanncctcagatactcncgagca

SEQ ID NO: 89036 - DNA, 557 bp, Triticum aestivum
  unsure (1)..(557): unsure at all n locations
  Clone ID: PAT_TA_89036
gtgaagaccctcaccggcaagaccatcactcttgaggtggagtcatctgacaccatcgacaacgtcaaggccaagatccaggacaaggagggcattcccccggaccagcagcgccatctttgctggcaagcagctggaggatggccgcacccttgcggattacaacatccagaaggagtccacccttcatcttgtcctgcgtctccgtggtggcatgcaaatcttcgtgaagaccctgacggggaagaccatcactctggaggttgagagctctgacaccatcgacaatgtcaaggccaagatccaggacanggagggcatccccccggacnagcagcgtctgatcttcgcaggcaagcactggaggatggcgcaccttgcgggactacaaattcagaggnntccacctcaacttggctcgcctccgtggtggtcantattncctccgttggcctgcnggaacttgttgncgtggttcgtnattnaantgtcccccttccttagtgccnnngtggttaangactatccnttccggttattttggttaanattgcggt

SEQ ID NO: 89037 - DNA, 285 bp, Triticum aestivum
  unsure (1)..(285): unsure at all n locations
  Clone ID: PAT_TA_89037
tgttcgagagcagtaacgaataagagtgcgtacaagcccgttgcttgcctaagtgccaacaattcacatgtttatgtctgggtgtctggttacgagtgtatggttgaagatcttgaaccctattgtggatacatggcagagattccatttggtaacgagtattcttctgatcatcgacagctacagaatgcangttatgcagatatcacaaaattcataagtangggtgcccaatttcgtcngnacacnagggggctttctgtctctgagattttaanagggaac

SEQ ID NO: 89038 - DNA, 346 bp, Triticum aestivum
  unsure (1)..(346): unsure at all n locations
  Clone ID: PAT_TA_89038
gggaanggaagggtagggaagagcancgagccgccgcgccncaccgctgnctcntcctcntcctcccgctgctccccctccncgatccgatngccgccggctcggcaatatttgnanccntcggtgncgatcnacccattgccgtntcactgagacaccgatcccgccntccatccgtcatcgtcatcagcgcctgaccgcctccgcgtttattcatcnacccgtggaaccggcaccncccgatcagacagaggangtgtngtngatggcttccnttgccnccgacccncacgntgcnctccctngcncggggacnccgccccacagtancccntcacggggaaga

SEQ ID NO: 89039 - DNA, 469 bp, Triticum aestivum
  unsure (1)..(469): unsure at all n locations
  Clone ID: PAT_TA_89039
ctgtctcgatctcccccaatccaatccgccgctcaacaagcnatcgacaggcnctcgctcgcnaggatgatctacggcaantggtcccatgctctcctccacggtcgtcanctggggcaacgtcngcgccgccggcctcgccgggatcttcctcttcggcggcaaggngaaattccatnggctatctttctcncnanggcgagaggctaaggnancacgacagangcatgatgggcaagaantagtgcagagcacggntcactttcgacgtgtcaacatgtnaacnacacatgngacgacgttcnctgtggtttagaacagaantttctcttcctgccantggcaccttttgcntctggcccccangattaatcttgaggcgnatgttaatcngttcccccgtgnatantctccangccggtgtttgctcggtnncgttggaacccncgtttgtcncttgttctggggc

SEQ ID NO: 89040 - DNA, 215 bp, Triticum aestivum
  unsure (1)..(215): unsure at all n locations
  Clone ID: PAT_TA_89040
gttaancaggccctacntaagaaaggcatttttcatgagctcntcggtctgttctgcagtcccatgcaccgtctgtgaattacagctanagtcacctctttgtattttccgcgtttcgttgttttcaggtcatgtntcngttctggactcgaacttttaccaccatgtagatatttattgagtatattatcccnctttatcaaaggngnaaataa

SEQ ID NO: 89041 - DNA, 511 bp, Triticum aestivum
  unsure (1)..(511): unsure at all n locations
  Clone ID: PAT_TA_89041
cgagtttttttttttttttttttagtcnacagattgtataatatattatgtgcatgtgcatatacatagccaccgattgcattcacatacgagcacgctttctcgagccatgttgttacatgaacatggacatacacatattcttaggaacaagtaagaaagacanatggagaaggaaaacccanagcaatgtcagagttgacaaaactgcaatggcactttatatgtggnccgtggtgagtgagctgtttaggccttgccggactcctcgcagcccggtggcttgaangcantgaagctgacgcactgcacctggcgcatgttgtcgaatccgatgatgcggacgtaccngtagggtactcttcttgactcctcaactcgttgatcacctgngtgctcggtgacccaacataggaagttcacatgtcantannggcgtcgtagtaccgggagacgcattgnnccacggaaatgaacccncttgtgaaccaaggaggaccaattgancggt

SEQ ID NO: 89042 - DNA, 581 bp, Triticum aestivum
  unsure (1)..(581): unsure at all n locations
  Clone ID: PAT_TA_89042
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacaagtggaggagtcaagaaggagtaccctgacgctatgtccgcatcatcggatcgacacatcgcaagtgagtgctaactcatcgcctcagcacgggtgcaagatccggaaggctaaacantactcacacagcatatataatgcattgatttgtnacncgaattctt

SEQ ID NO: 89043 - DNA, 551 bp, Triticum aestivum
  unsure (1)..(551): unsure at all n locations
  Clone ID: PAT_TA_89043
aggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccagggcggcgacttcaccaagggcaacggcaccggcggcgagtccatctacggcgagaagttcgccgacgagaattcgtcacaagcacaccaagcccggatctctccatggcaacgcgggcccaacaccancgctcccagttctcatctgcaccgtccctgcattggtcacggcaagcactggncttcggnaagtctcagggntggacgnntcaagaacacgagaagnggcnccgaanggnctgtcaagcangtntcatcccgatggggcag

SEQ ID NO: 89044 - DNA, 179 bp, Triticum aestivum
  unsure (1)..(179): unsure at all n locations
  Clone ID: PAT_TA_89044
cccttccggttcgggttctggttcggttcgggttcggattcaagaganaggccgagtanctagcctacgtctagtggtttcggtanagaggaaggtgngatcnatggcgaagacggcgtagcgtcgnntcncgggcggatctcctgcgccaccgnctacnacnacntccaataggcctt

SEQ ID NO: 89045 - DNA, 237 bp, Triticum aestivum
  unsure (1)..(237): unsure at all n locations
  Clone ID: PAT_TA_89045
attcaagagttatagggagggacntatgtcaccacacggcatggaactaaagcangtgttggatttaaagctggtgttaaagattataaattgacttactacaccccagagtatnaaactaaggatactgatntcttggcagcattccgngtnagtcctcaagcctggggttccgcccgangaacangggctgcagtagctgccatttcnctactggntacatcgaccanggtttgg

SEQ ID NO: 89046 - DNA, 561 bp, Triticum aestivum
  unsure (1)..(561): unsure at all n locations
  Clone ID: PAT_TA_89046
ccccgttccacctccgcctccagcaacagcccttcctccgcctccccgccctccccttccaccgctccctcccgctccacctcccctccctccgcctcacccggcccctcctccctcccctcccgctcgcctcctcgggcggcggcagcaacatcgggtccggctccggctccggcggcggtggcgatgacgacgacctcttcctcgccaaggtcgccatggagtgcggcgtcggcatcttcaccaagactgcggcagaatatgagcgaacganggagaactttgtcaaggagcttgactttgtgantgccgatgtgtcatggcaatagttgcanactcatgcntgtttggctctgctcaaactgtgtctctgcaacagcactatcaatgaatgctgggggcaatgctaaatcttcacaatgccngatatgcattcaagttgctttggctggnaattataacatttgagaatttggngcnttataggaangggcaaacttttgatagaanagtgcacttgattggacggttnaccacgatttagggaagaaantttacaag

SEQ ID NO: 89047 - DNA, 186 bp, Triticum aestivum
  unsure (1)..(186): unsure at all n locations
  Clone ID: PAT_TA_89047
tgancncagtggccatgaaaatggntcaaaagatgatcatcctgtgctccgtcnatcggatctctcggggtgctcagtgccgtcctgnggttcncagccgatggcacgaagctcaccgtttnngacttgnangtggntgnagggctgtgcctgtncccgcagaacccgcgctcggncttggggtgt

SEQ ID NO: 89048 - DNA, 542 bp, Triticum aestivum
  unsure (1)..(542): unsure at all n locations
  Clone ID: PAT_TA_89048
cggcgcggagcccacactcggcccgcgccctcctcctcctcctcccccgcccgccgcgcctccatcgcagccgcaggtctccgaggcggcggcgaggcgcctgcgggaggcggaggagcggctgcgcgaggccatccaggagctccaccagagccacggccgggatgaggaggccgnaaaggggggcgggtgggggtgctgcgtgcatcagggggagtcgtgcgcggcgcacgcggcggggaacctgtgccagaccttcctgctctcctacggcgtccgtgtcggcatcgggatctcctccgcgccttcaagctcgcgcgccgcagttctacgcctcgctcctcgatctcaagcaactggtttcggagaaagtctaatagnagggangaacttccggtagggttacttttggagatcactggatatatatgcactggattttcctaggaattccaaaaaggaacacattaatgatatataagtcgtgganntggcgatatagacnnatatcatagagccaccttccnaatctcagaagntgg

SEQ ID NO: 89049 - DNA, 349 bp, Triticum aestivum
  unsure (1)..(349): unsure at all n locations
  Clone ID: PAT_TA_89049
gtccgagagtanctagcctagtctagggtttccgtagagaggaggangagaggaagagagagatccatggcggagacggagtaccgctgcttcgtgggcggcctcgcctgggccaccgacgacaacaacctccagcangccttcagccagtacggcgagatcctcgacgccaagatcatcancgaccgcgagacggngaggtcccgcgggttcggcttcgtcacgttcggnagcgaggantcgatgctccaggnatctangagatgancngcaanganctcgangggcgnaanatcaccgtcaacgaggcccagtccgccgntcggncngatggggcgngttnccgcgg

SEQ ID NO: 89050 - DNA, 585 bp, Triticum aestivum
  unsure (1)..(585): unsure at all n locations
  Clone ID: PAT_TA_89050
cgcagacagacagagcttgagagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtcgacatcgacgccaacggcaggaaggtcggcaagaagggcgggtaccagtttgttgacaagtacggcgccaacgtcgacggctacagcccaatctacacgccggaggaatggtctgaatctggtgaccgctacgccggcggaacgaccgggcttcttatctgggccgtcaccctcgccggcctcctcggcggcggctctcctcgtctacaacaccagcgctctcgccggtaaganacatctactgtacacagggccgggtctctgcttgcatgcacgtctcntaactactagctactctgtgaatgtagtcatcaanatcaaattatgattcnananatggttagtagtactaccattcatatccctantccacttggaacgtaaaggnggntctgaccct

SEQ ID NO: 89051 - DNA, 556 bp, Triticum aestivum
  unsure (1)..(556): unsure at all n locations
  Clone ID: PAT_TA_89051
agagcaaagagctcaagacgcctgcatattgagccgaacatatcaaggaacacggggtgaatagtgaaagcggcaatggtgagcaaagtcccagccaaactggcaggcctactcaagacggctataaaaaatggtgcaataactattgttggagaacgtattgtgagcgtttctattgatcagttagaagctcccttgaaagaattcttcaacaatcttccaggagctgtagaattaatttctgacggtgtggcggacatagctgaagatggttatcgcaccgttcagagcatagctcaagaagttattaatgaagctgaaaacatcggtaaaactattggccatgaatttgaacacgcaggaaaattgttgttcaagaaattgaagagtgggaaangacattgaagaaacgggcaaaaagattggatctttccaangggatgttggncaaacntnaaaggagggataatatacnntatatccnactcancgggcgcttacnatattgacactaccaaaaaagtcacttccngttgtaaccaattgttatgataag

SEQ ID NO: 89052 - DNA, 494 bp, Triticum aestivum
  unsure (1)..(494): unsure at all n locations
  Clone ID: PAT_TA_89052
ccgcagttgggtacatcgcctgcttgcgcgtcgccccaaaacggatctgaattgctagcatccacaacttcggatctggacgagaagggggtcgcttttgttcaatatatccgattaataaatcggataaatcaacgatactttcaatggattacgccaccgctaacctggagatcggctccaaatctgggattggcggcgattgttgccagtatatcaataccacagggagactgtagctctgttatgccttccgtctgcgggtcatggcgctgggattanctcggcgaagcgtcctaccatatcatccccgccatgatggaggaactccattgggacctangctgtggtgcntggatcggattgatcatagcaaggcggaaggantgtggggaacagtatgttgacgacccgagctcaaaggcgacaatccctttccggaggacncacntgccgttgggccactacatgtgggcaagttccaaaaggccaat

SEQ ID NO: 89053 - DNA, 559 bp, Triticum aestivum
  unsure (1)..(559): unsure at all n locations
  Clone ID: PAT_TA_89053
cagaaatccccatctcaaaaccctagccctcatccccgatcccggcgaagcgagatggccaacccgaagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgtactacaagggcagcgccttccaccgcgtgatccccgacttcatgtgccagggcggcgacttcaccaggggcaacggcaccggaggcgagtccatctaacggcgagaattcgccgacgagaattcgtccacaagcacaccaagcccgggttctccnccagggaaaangngggnaaananaaagggtcnaattttnatcggaacgtcccctgcaattgntcaacggaaacactggccttcggcaagtcttcaaggcatgncntctcaanaaatcaanaagggggncccgnangggactgntcaanaagtcgtatcccgatgnggnacccaaatcgccgccgcgggc

SEQ ID NO: 89054 - DNA, 591 bp, Triticum aestivum
  unsure (1)..(591): unsure at all n locations
  Clone ID: PAT_TA_89054
cccacaccggcgcctagatcccgatccgcccaaattccattcccgatacctcgacctcgcccccgcctccgccatggcggactgccgcagcctcatcgagttcctccgcgccttcgagcaccgccgccgcgcctccgcggcggccggcggctccccctcgccgtgtgcccgcccccgccgcgcggcctcctcctcctcctcatcgccatcgtcgcggggaaagctattcacctcgctctgcgacaacccgcccccgaccgccgccctcgacgcgctcgccctcctggccgtgctcggcgcgctggcttcntggccgcgccctacgccaggctgctggcccgcgaagccgcggacctggtgcggcagtaccggaggagcttactcgtacgtggcctcgcngccggcgccggcgccgcgtcgccgccgtggnggggctgtcgcntggaagcggcggcacacgcgccaatngcgaagcccntgccgcggctcncaaggcntcaattcaaaccactcaaacgangaatctncccgaanggaagtgtgcncccgnggcaagcaanagttctnnggcgcgntcgcnggcgctctcna

SEQ ID NO: 89055 - DNA, 209 bp, Triticum aestivum
  unsure (1)..(209): unsure at all n locations
  Clone ID: PAT_TA_89055
gtgccttcaccgtcccgcctaccttccccgtccccgcgcccacccactccctccctctctccgccccgccgccgcccgctcgtgccttcaccgtcccactcacgccaccaccgacgccatgtggggcatgacctacgatgccgagtgggaggcnatgccnaaggccaattggaanagggaaaagcgnaatntcgancaaaagaagcaat

SEQ ID NO: 89056 - DNA, 334 bp, Triticum aestivum
  unsure (1)..(334): unsure at all n locations
  Clone ID: PAT_TA_89056
ggccggtctacaaaggcgttctgcgggacgggcaggagatcgcggtgaagaggctgtccaagacctcccancaagggctcgtggagatgaggaacgaggttgtgctggtggccaagctccagcacaagaatctggtgcgcttgctcggctgctgcatccaggaggagggagatgctcctcgtcnacnanttcctccccaacagaagcctcaacangnttctattccgattccngcgagggcgcaaagagcttacntggggggnaacagnttcaggttncccncggggggnttgggngaagnnttttttccccccaaaaancccgggggggaaaa

SEQ ID NO: 89057 - DNA, 249 bp, Triticum aestivum
  unsure (1)..(249): unsure at all n locations
  Clone ID: PAT_TA_89057
ctctcttctcccccaccacttcttccacctcaggccgctgccacggccaaggcggcgtggtggtgcgcctccgcagcccagccaccaccatctccatccatctctgctgtgccaccatccacatcagcgccgctgcgccatccattcaacagcaccaccatcgcctcctgccacnactccatccacaccgccgccacnagcacaacagcgnttccccgaacctcgcgcccctgngggctcttcttcttc

SEQ ID NO: 89058 - DNA, 508 bp, Triticum aestivum
  unsure (1)..(508): unsure at all n locations
  Clone ID: PAT_TA_89058
ctcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggaaggcgtcctcgatnagcaaggagtgctgctccggcgtncaagggctgaacggcctggcccgcaacancccgggaccgcaagataccgtgcaagtgcctcaaagagcctcgcaacaagcatcaagttccancaaanaggggnaagggncnccggntttcccagnaaattcggggtnngggtncccttccccaaaaggatttcnncaaatggnaaaatgttncactanttnaanatacaanccctccnaagtgaatgcatggacnccctgcgtggagctaanttcaacgttggnngg

SEQ ID NO: 89059 - DNA, 515 bp, Triticum aestivum
  unsure (1)..(515): unsure at all n locations
  Clone ID: PAT_TA_89059
agcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcnagggcatcaagaagttcgagaccctgtcctacctgccaccgctcaagcacggaggccctcctcaagcaggtcgactacctgatccgctccaaatgggtgccttgcctcgagttaacanggttgggttatcttccgtngagcanaacgcatcccctggttanacaaagggccggtaatgggacaatgtggaagctgcctatgttcgggtgcaccgacgccacanggtgnttaangaggtggaagaggtaaaaaaggnntacctgaccttacgtccgcatcancggnttcaanatatgcnccaaggtgcantgcgtcagctcatcgctttaaaccaccgggcngggag

SEQ ID NO: 89060 - DNA, 538 bp, Triticum aestivum
  unsure (1)..(538): unsure at all n locations
  Clone ID: PAT_TA_89060
gaaccaaacaatagtcacacacattcattaattttcacatataaatagttcatttgttatgaatcaatgaccagccaagttttctataaataaactaatgtaactaattaaatagagttaacatgatagttcattgcctcggagcaaaagttcatcactttgttttctgcaaaacaacatctgccttggctccttgtagtgggcaactactactcatcctcacggcttcccagcaagattgtttcatcgctctcgcacttgacatcaaagccttcattcttcatcccattggagaacattctccagcttgaacatcttagctcacctcttttgtgtttcctanatcctgagatacaatgtatcctggtctatgtgcccatgggggataactacctacatgccattccttgtcgccacgcattaacccntggggtgctcactccttgtctcgatgtcagcattctcacaggttgatatagtgtcccttaatcatgagttagccagcacaccttgcctgacaaatacggtcaaatttggg

SEQ ID NO: 89061 - DNA, 569 bp, Triticum aestivum
  unsure (1)..(569): unsure at all n locations
  Clone ID: PAT_TA_89061
ctccgatcctgtctgctccctgctactcctagccagcagcccgacattcccagcaggtcgacactcctacccgtttcaggacacacagccgttttcgggccactccgagaccaatcgatcgatagttcgacgctgctcgccgcggaagacatggaccagctccccaagctcgcggccaactacgcgcccctcagcccggtgggcttcctgccgcgcgccaatgccgtctacggcgaccgcgcctccctcgtctacggccgcgtgcgcttcacctggagccagacccacgaacgctgccgccgcctcgcctcctccctgctcctcaccctcgggtccgcaagaacgactggtctccgtgctcgcgcccaacgtgccggcctctacagatgcacttcgcggtgccatggcggcgcctctcaacacgtcaacaccgctcgagccgccgcgtnnccgcatctggcangcgaggcaactctcttctnantcgatantgctcanaaatggttaagtacnacctagggtacgaggcaggcccgccngnttnatggccccatgganacncttttngg

SEQ ID NO: 89062 - DNA, 406 bp, Triticum aestivum
  unsure (1)..(406): unsure at all n locations
  Clone ID: PAT_TA_89062
attacaatcactttatattattcataactaactgtcaaaaagaatgctacacacccaacatcacaactcacacagtcacatgtatataagcaattatgcacgattacagtatatactgctagtacttgatagttgatacacatttacacaacgcatgttcgctgctccacaccaaaagatagccaggagctagctgcccatgcatgtatgcgttatacagattacacatgacatgtggcatgcatgtactatgcgtacttaccttgagaaggtgctagctccatgcacgcgggcatgcatgaggatgcangtggtggtacagtatgttgtngtaggtgctatcgatcgatggggtgntttgaanggcactggaacnaggncggacntgttgccgcncgggttgaga

SEQ ID NO: 89063 - DNA, 457 bp, Triticum aestivum
  unsure (1)..(457): unsure at all n locations
  Clone ID: PAT_TA_89063
taggcgaggaggaaggaagacagcaaccacggcgcacggtgtttgatttgatggcgtggatggtggtggtggcctagatcgacgtacggggaggacagacgaagttggtgctcagcgccagcagagagggctgcctcatggagatggagggaggtccactaactaggaggggtgagcccatgccacttggaagactcgatggtgtttctaacatcatcgaatgacgtgtggaggtttgtctcggatgcatgacggatctcgtgttcgtttggtaaaacttggaagaatttttatgtgcacactttttatgtgcaacagcagtaagagaaaataccgcccgacaacaccaacgaactgagcactaacagcggnaaatccaccgcttcctnantctccccaacngacattcggnacctcctgaaagggcnnctcncccctactccaanganngggtctc

SEQ ID NO: 89064 - DNA, 318 bp, Triticum aestivum
  Clone ID: PAT_TA_89064
cgtatgtacctagatctacttcaaagatttcggtgcctcacatttcttagtgcttcacattcagcaatgaaactcttaagtgccccaggagtgtgaactttcaacaccttgactgcaacaaggtttgtactttcttcagcttggtcatctatgactcctttgtacactgacccaaatgatccagaacctattaaatttgttgacgagaaaccatccgttgcttttgccaactgcaaataagagatcattgggaggccttgtctggttgttgtggaaggtatcttttgtttgcttttcttgtgcactatgcaggggggg

SEQ ID NO: 89065 - DNA, 354 bp, Triticum aestivum
  unsure (1)..(354): unsure at all n locations
  Clone ID: PAT_TA_89065
ctgcaacgggacgtacccactcccgcgcggctccgtcccgttgcagtcgaacaggaagcccagggcacggttgcttgggctgatcctgaacgggctgagggcgaggctggtcgagacgttgaaatcggcgaggcacacgccgtccgtgcccgccgctaccctggtgtggtagactacgaaggattgggtgccgtagtcgatgctgtggacgtggatgggggatccgctcatggaagccgtggtgttgccgcctatgcaccagagctcgaancccgggtggccgcaggagggctccggccgggggcggntgggcncgccgaccaanannggtatttgnnggtatcncccgcacgc

SEQ ID NO: 89066 - DNA, 580 bp, Triticum aestivum
  unsure (1)..(580): unsure at all n locations
  Clone ID: PAT_TA_89066
gtctcgagtttttttttttttttttttgatcggtggagcctgtacgattatatcacgaacctttgataattacgggccaaataatagcaaaatttgatcaggaatcatggcgtttttgctcggcaacggcggcgtggtcgtcttccgtcggctcccacgacgatgctgtgagcagggagaggtctttccacccgagcttgaggcacccgtcctcctccaccagcgtgtagcccttccacgggtacatgccgatcagcagcctggcctgcgcggcggggctcccggcgagggacacgggccggaacccggcgcggcgcagctcgtcgccccaccgctccacccgcacctcgcccgtccgcttcgggcccccaacggcacatgttccgtatctccgcgcccaggagctgccgctcaacgctgccgctcctcctccgcgngccgcgccgtcgcgcacgcgtcaaaacgccgatatatgaacgcctcacaacggccaagatcncgcttgcccaagtctgccacatgtatactcgcgagntctgacagcgacgtccactcgnccgnactctaaagatgngacatn

SEQ ID NO: 89067 - DNA, 429 bp, Triticum aestivum
  unsure (1)..(429): unsure at all n locations
  Clone ID: PAT_TA_89067
ctctcccctcgcgccgccaaaggccagacccaacgccccatctccctcgcagccccgctcgatcccctcctgcttcgcctcgctcgaccccaacaccagcaccgccacccctcgtccttcccgatccacacgcccgacaccgaacgcctcctccttgctgcctcgcatgtcccgtgcagcaactccgccggccgctccttcccggcctcggcctcgtccccgactgcccaggccggagtttccacccctgcaccttggacaggaggtcccccacggccgcccgccgccttccttgtacgcgcccagaggagcgtgcccgccgagctcatcacgcccctcgtcggcctcctcgtgccgtcgcctcgcaaggacttgcgcngattcccgcgangcacanagaaaaccgggtgncccaaacggnatttcggg

SEQ ID NO: 89068 - DNA, 578 bp, Triticum aestivum
  unsure (1)..(578): unsure at all n locations
  Clone ID: PAT_TA_89068
aggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctttatgacaccaagggtccttccgccttcactctgtcagggatangatgctaattaaactctcaagtcagtcgtcagttcggcagaagggatccctactgaacactatatgcgcacatccgctaccagaccatcataagcaatacacacaactcactgagacacaaatgtgactcacaattnctcggaattgcangtacggggcc

SEQ ID NO: 89069 - DNA, 319 bp, Triticum aestivum
  unsure (1)..(319): unsure at all n locations
  Clone ID: PAT_TA_89069
gtnacatccaccatagcngcgatggctttctttttgcnacaaccgtctcggnttttttgctactacagcgagttgccattttgctactaccaangccttgctccaaacatcangagtttttgcntcgcccgcggcggctacgctgcgagcaccggctcgngagcagnaanatcaagggtccanaggacggcaacngcggctactgtncgggatcccgcgancggccgngggcgctcgcttcccccccttttttccctgtgcngaagatcatcnanctgggatgcnggncanatctgacggtcccgcgcgtccagatcga

SEQ ID NO: 89070 - DNA, 572 bp, Triticum aestivum
  unsure (1)..(572): unsure at all n locations
  Clone ID: PAT_TA_89070
gggcctctcttggttgctattagatcaggcgagaaggggttcctggacaccattttttcatcatcttcttcttccgcttccgcttcgctcgcatgcgaagcttttgatcttgttcttcttgatcggacgagcggagatccggagaacctttttactcctctggatcctcgctccgtcttcttctttttagcctttcttttctagcctttctcgcgagccggcgtcggggctgtttttacagagccccttcaggttgctcgcgccagcagttggtctctctcccctgttcttcntcgcttttattgaagaaaacagggcttttttttatctctttgattttagttcggtttctgcacaaaaagtttcggttttttatcctgttctggttggaatggcggcataatctgtatggcgccgcgaacantaactctcncgtcgtctctctcngacangactcatgagacgccgaactttacaggacgctctcgccactctcactcactcactcgcattcatcacgcaactcactcgctcacctcgcattcnatntatccncccgcgccaaaaccgga

SEQ ID NO: 89071 - DNA, 600 bp, Triticum aestivum
  unsure (1)..(600): unsure at all n locations
  Clone ID: PAT_TA_89071
tttttttttttaaaaaggggtgaaaccatgaaatttacaaacatcagcccagtggcgacactatcgaactgaccggtcgatacaacccgcatgggaaaccgcgtccacatttacaagtttcaccggatatttatatcatctcatttgaacccttatgtcaataacgtggcatatactcaatattcctatcgtatgcgtgctatatatataactgtaccatatacgtacgtgttcctacaaactactggaagcagagttcctggtcttcagccgtcgtcggggaagtcttccaacctctgcccgatgacaacacgctcatccctgacagaatcatggagttcttcgaagcagaagatccagaacagcttggcgcgagagcagagcgcactgaagaacagaacacttggcgcgacatcgagcggttcaagaccagaacagctggcgagatggagacaccagaggcgatgcagccagcaccgagcgggcactcgatcacgcggcgataacgagncggaagccnccgggacaataggacaccanacgnaacattctccnacggacaaattccggagacnggagggacacgcctcagcatcactn

SEQ ID NO: 89072 - DNA, 412 bp, Triticum aestivum
  unsure (1)..(412): unsure at all n locations
  Clone ID: PAT_TA_89072
cactcccacttagctagcagcagcagccatggccgccctctcctctgcagccgtgtccgtcccttccttggccgccaaggtggccgccacccccatgcgcagcagcagcagcaggatggtggtgcgcgcgtcgctgggcaagaaggccgcgagcgccgcggtggccgtggcggcgagcgcnatgctgctgggcgggtcggngatggcncangacgtgctcntgggcgcaaacggcggcntgctggtgttcgagcccaacgacttcagcgtcaaggncggntagacnatcaccttcaagaacaacgccgggttcccgcacaacgtggtgttcgacaaggacgcggtgcctcgggtgtggacntcncaatntcccangngggtntcaaacccngggnatattttcncntcacct

SEQ ID NO: 89073 - DNA, 449 bp, Triticum aestivum
  unsure (1)..(449): unsure at all n locations
  Clone ID: PAT_TA_89073
atgaaaatatattaatgatttgcaaaataaacaaagcaggatcaaaagaggcaccacaccaggctattcacacttacgtcgcaattgcttttgccgctagcatcttcggtcacgaccatagcaccagaatgcacttcatttattattatcacaaaaaggacgtatacaccaaccacactatacatttttttccacaaagaatcactatatacatgttcctccaaatgtttacatcctctagaactttcttccctctcatcctgatgcatcccaccctctccagcacttgtctcctcagccctgggtactcttctcatgaggtctatgaaaaatngtatgctcgctgaggagaagaaacatgagtcattgcgttgcttcgaancaccgggacaaagtggtcacatcacnaccgtgtantgacatagcacactanananagtgcgctctcc

SEQ ID NO: 89074 - DNA, 580 bp, Triticum aestivum
  unsure (1)..(580): unsure at all n locations
  Clone ID: PAT_TA_89074
gatacactggtttggccactgcgcttccactactgggctatcgcctagttctaagaaaaaaccttgataaaaatatctgatcatacaacacacctacaccaaagaacgcaccgaaggcaatcacaaaaacttcttcttttgtaagaatggtagcttgaggtacttttgctgaactacagttgcgatcgaggataataccacagagctttgtgttcccatcgaagctagaattttgaaatgtgttgaactggcctccagatggaataggaccttccagatcattgttagagacgttgaaagctgaaagggagtgcagtccgttcaatgcagctgggattgcacctgtgagatggtgcttgacaagtctagcacctcgagtctgttagatacatattgattctgggatctgccatgttaatcttgaagccaattaagngttgcacctggtgaggtccaaggactcgaattgcccccagactctgaancacatgacttgggacatgcnactgctcagggtcctccactgannancgttgttcccatagnggaagcactccatanaccacaggaccggatagtt

SEQ ID NO: 89075 - DNA, 588 bp, Triticum aestivum
  unsure (1)..(588): unsure at all n locations
  Clone ID: PAT_TA_89075
ctactcccctgcctcccccggagctcgttagggttttctgttttttcgggggagaaatctcaagaggcggcaccatgctcgtgtaccaggacaagctttccggcgatgagcttctgtcggattccttcccgtacagggagctggagaacggcgtgctctgggaagtcgatggccattgggtcgttcaaggagcagttgatgtggacattggagccaatccctctgctgagggtggtggtgacgatgagggtgtcgatgaccaggccgtgaaggtggttgacattgttgacaccttccgtcttcaggagcaacctgcttttgacaagaagcatttatctctcacatgaagcgctacatcaagaactcactgccaagcttgaaggggatgacctagatttttcaagaagaatgttagtctgccacgaatacctcttacaagncaagacttcagtcttgttggcagacatcatatgatggcggctggtgtccntacacaagaggactctgatcacttctgtcttgactggctgaaaagcagtcaatggaatatgctaaacttgggcgcagatttcccgcccagnngtgcat

SEQ ID NO: 89076 - DNA, 570 bp, Triticum aestivum
  unsure (1)..(570): unsure at all n locations
  Clone ID: PAT_TA_89076
cgcccgccggccgcactgccgcctctgctgcacgcggcacgcctgccccgccgttcctcccgcagccttgcgccgccattagccacaggatccgccctgcggcgcgcggagccgcctcccgcagccgcagccgtagccgatgtcgtaacctccccctgcctcttctccgcctcacccatgtgcctcccaaccaccaagccaccgccgcctcatctcctagctgcacggccgggcgacgcagcgaggcgcgctcccacgccgccgccggtgggacaccgcaagaccgccgtcggccgcgtccataccctcatccatctgcatagccccagctttgtctcctccgctccgaggcgtacacgccctgacgcacttgatctggacggaatacaccggggcgcataacttcttgcgcctccaataggctccgtgtctgctgctctgtaccaattctgtcataactcattcatagtatctgagcgcatctgatcaacagnnaagactgcgtaaacannataccattaatgacctagcataagaagacgtgaaanggtcacgacgttaactcggaan

SEQ ID NO: 89077 - DNA, 199 bp, Triticum aestivum
  unsure (1)..(199): unsure at all n locations
  Clone ID: PAT_TA_89077
agaaggcaacgcccaatcgcccacgcttccacctccccctccacgangcaaggnaggaaaccctaggcaacgaccatggcgctgctcccgcncacggnccggctggccctcctctccgcgtcgccgcggncctactccgccgccgctgcggcgggcgcctcgcccacccnnccggtgccgtacgcgngcntncctccgc

SEQ ID NO: 89078 - DNA, 568 bp, Triticum aestivum
  unsure (1)..(568): unsure at all n locations
  Clone ID: PAT_TA_89078
caaactcattggcatgtgatatagtagtcatacatgacacgcaaaacagtaacaataacagcaaatatcgcaaaataaaaacgaacattgttctcccaaaaatgcttgtgtaataccacatgaatttggcagcagccgcaggcatggttaaaacatcgctttcatccgaaaaaaatagaaccaccatgtggaattctttagttggtgcaaaagctggaacaggggaagtancttggagtcttggacttcctccaggaacaaacagatgcaaggtgctaagataggatttggtgcaaggtgtggcattagttccctccgtgcagctgccgctttcagcttcagagaatctttggtcaagcctggcatcttgacttcacagcagaaatttaaccagtgtaacatcaagtgcagcgcctcgtgtgatctcacccttcatagccgaacacaaatgcagtacgtaccctgcaaaaaacagattttcataggtacnccgcccggttactctgtgtcacaaaagcagctcacaaancgntatttctaacgggccatagactctcccggtattagt

SEQ ID NO: 89079 - DNA, 554 bp, Triticum aestivum
  unsure (1)..(554): unsure at all n locations
  Clone ID: PAT_TA_89079
gctactgacctcgccctcgctcgctttcctcgcgttatcccgacctcgccggcgatggcggcgtggcccaatccgtggctgccgctcctcctcgtcgccgccctgctcgccttcgaggactggctctccacgccctcctgctccggtggcgagcccgcccccgacctcgccgccggagacctcagggcaatgatggttgccgacctgatgctcctcgggtccgacgccacctacgccgaccgcttcttccgcgaccacgtcacgtccaagcttttcactaaatctattcaaacaacaaatccagatatgatatagtccttgggggactctcagcaaggggttaaancatacgagacantggatantgttctgaanntttngggaatattgggcatactctccttcctctcanatgtttagggaaaaatnttgcaatgtcnanttggatggnaattggtcacgttggcnatcatttcaagataatcnagtggtgtgcccttgattaatanacanttttgtccaaatgggtggantgccggngnaaanttttggtt

SEQ ID NO: 89080 - DNA, 402 bp, Triticum aestivum
  unsure (1)..(402): unsure at all n locations
  Clone ID: PAT_TA_89080
ttttttttttttttttttcttaataatacaaaatgttggaattttcatgaaatcgtacgatgacgaactatcatggaatagggttttcataacatattacagcaattagattacacatgtacaaaatgcctaagatttgaaattaaggcactcctctacgcttggccccgggctaaggagtatcttgagcataacttgaaagaatgtgatcaaatgtagtataaggtggaattcttgattcaaatctcactactgtggcctgcatctttggcctaagatcaactaatactctgtaaagncacctggggaatcccttgcnggaaatgttgggaaatcccaaatgaaccnaagnggaaaccggaccanaacattccgtcactcatgggaaaacttttcanacca

SEQ ID NO: 89081 - DNA, 261 bp, Triticum aestivum
  unsure (1)..(261): unsure at all n locations
  Clone ID: PAT_TA_89081
ggcgctccaccagttcacccgcaccctcgacaagaacctcgccaccaacctgtttaagatgcttctcaagtaccgccctgaggacaaggtggctaagaaggagaggcttctgaagagggcccaggctgaggctgaggggaaaaccgttgaggccaagaanccaattgttgtgaagtatggtcttaaccatgtcacttacctcatcgagcagaggcaaggctcanctggtcgtnatcgctcatgatgttgaccaagttgggc

SEQ ID NO: 89082 - DNA, 418 bp, Triticum aestivum
  unsure (1)..(418): unsure at all n locations
  Clone ID: PAT_TA_89082
caaaagcttagagttaaagcacggtggggggaaaaccggattaacctgtggtaggcgccggcgacgagatcctggggcggtggggatggcgccggcgaggcgggggcggaggccgtgctggtgctggtagtggagggtagtaggtgggtgagagggaccgacggaccgacggacggacatgaaggccctgcggcgatccagcacctcgacctctccgtcctcctcctcctccccgacggccgcgtcgtccccgccctcctcctcctggatcacatccgctcgctcctcgtcgcggcgcctcgtccanctctcctcatcctcggggcggcggcggccgccgcngccgcggggaactccngcccgcttggcntctgttnctctgcgnggcgnggctcttttcncntgccngggntctctc

SEQ ID NO: 89083 - DNA, 253 bp, Triticum aestivum
  unsure (1)..(253): unsure at all n locations
  Clone ID: PAT_TA_89083
ccatcgagaagatcgtcgcccagcacttccctctgcacgatcaagcggcagctcgcgtccttcgtcctgcactgctcccgctcctgcgcctccccggttcttgagcccaagaatttgcccggcgagctccatgttctttcttctccggcgccggccaaggcggcgccggtgtccacgcttccggatgctgcgaacctcggcatctccaacatttcatccgggggctctgcgganacgggnaancgacccgccc

SEQ ID NO: 89084 - DNA, 432 bp, Triticum aestivum
  unsure (1)..(432): unsure at all n locations
  Clone ID: PAT_TA_89084
cagccaaaacgcgaggcataatttactcacgcagtcgtttcttttctcaaggactcctcgttcttcctccagtccattaattgcaagggatccattaacagcaaggaatgctgaccgtcagagagtcgtcgttcttcaggaactacgttcctcgacccatggtaccgtaccgggttcatcgtacccaaacggattggatcgcgtccccgctataaaaaaatcattcgagagatgtataccctcgttgtaccctattttttttaagcaaccgactctcgtccctcgttcccgttcctcgtccaatcgtaccggaaaatggaactatggtaaactgtcgntnaaaattcgtgggcaantccaantctntgngaaccngggnccntaaataccnaacctnaaaaaaantttgggggtnacccnaaangggggggg

SEQ ID NO: 89085 - DNA, 555 bp, Triticum aestivum
  unsure (1)..(555): unsure at all n locations
  Clone ID: PAT_TA_89085
tggagttcaggcagggcttcctccacccttccgaccgtgtccctgccgagcgcttctccatcccgtcccgctacgacatccgtgggtgccgacatggtcgtgtgctcgctgtacaccgtgagtatgcaaagcttcttgtgtttgccccactctctggtgaggtgtgcaccctgtccgttccggatgagttcaggccaccgtcttgcttccgcctcaatggggcggtgctctgtgatgccaacgaccacggccatgttcatggcatgtgccacctgagccccttcaaggtggtattgctttcaaagttttctatggaagatcgattcattacctctgtttactcgtcaagtccaaaaaatggagtgtctcgttcaaaagagntcatgctccgttgantctgattccgcgatctggtaatatcgacctactggtgcttctcnaagccgtggctgctnagttgatttgatagcaaaccnacgtataagtgcnacggtatatgatccggagcatggatnataaacanaggagncattgcttgcagttcatccgaccaaa

SEQ ID NO: 89086 - DNA, 567 bp, Triticum aestivum
  unsure (1)..(567): unsure at all n locations
  Clone ID: PAT_TA_89086
agagaactagtctcgtctccaatcgacccgaggctcgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattcctccagaccagcagcgtctcatcttcgctgggaagcagctggaggatggccgtaccctcgctgactacaacatccagaaggagtccaccctccaccttgtcctgcgtctgcgtggtggcatgcagatcttcgtgaagacctcactggaaagactatcacccttgaggttgagagctctgacaccatcgacaatgtcaaggcaagatcaagacaaggagggcatccccggacaacagcgcctgatcttgctggcaacactggaggatgncgcacctcgccgactacaacatcagaaggatcacctcactggtgccgctcgtggggnagtatgcctctatcnactgcgcncgcgtaccgttctccgtggtgnccttgtcaatgcgtcccttgtnt

SEQ ID NO: 89087 - DNA, 561 bp, Triticum aestivum
  unsure (1)..(561): unsure at all n locations
  Clone ID: PAT_TA_89087
ctctcgtctcgtctcgtctctcgtcccaatcccatcgcccggcactctcccccgctcgtctcctccccgcacgcatcaccctctctcccctcgcccggtcgaagggatccccgcgccggaggacggctgcgcggtcgctgacggcgcagggagcgcggccgtggacggcccgacggacgtcatcatcgtcggagccggggtcgccggatctgccctcgcctacacgctcggaaaggatggtcgacgggtgcatgtcatagagagagacctgacagagcctgatagaattgtgggtgaattgttacaacctggaggctacctgaaattgatggaattgggtctgcangactgcgttgatgaaattgatgcacacgttccttggtatgcattatcaaagatggaagaacacaaacttctacccttggagaantcatcaaattggtggcagacnttanatggacggtaaacaaagatgcanaaaggtgatcttgccaattcaacggacaagaaaatanncttgctnaaaaatgganattaggntgaatanagttagnagggaaa

SEQ ID NO: 89088 - DNA, 565 bp, Triticum aestivum
  unsure (1)..(565): unsure at all n locations
  Clone ID: PAT_TA_89088
gcggcgtcaacgccgacctctacacccacgccgacaccatcatcagcaacgcctcctgcaccaccaactgcctcgcccccttcgtcaaggtgctcgaccaaaagttcggcatcatcaagggaaccatgaccacaacccactcctacaccggcgaccagaggctgctggacgcgagccaccgcgacctgcgccgtgcccgtgccgccgcgctcaacatcgtgcccacctccaccggcgcggccaaggccgtggcgctggtgctgcccaacctcaagggcaagctcaacgggatngcgctccgggtgcccacccccaacgtgtccgtcgtcgacctcgtggtgcaggtctccaagaagaccctcnccgaggaggtgaaccaggcgttccncnagccgcngccaacaactcaagggcatctcgatttgcnanagccgctcgtgtcgtcgattcaggtgctccantgtctccacatcgacgctcctaacatggtatgggaganaatggtangtatccgtgtacacaacantgggtaccccaaaggtntcnactcncgaatctcncgaca

SEQ ID NO: 89089 - DNA, 289 bp, Triticum aestivum
  unsure (1)..(289): unsure at all n locations
  Clone ID: PAT_TA_89089
cgagcggagtcggcgaagctggcggcggagcggcagctgcaggcggagctgcggcggcgcgcgggcggcgagacngcgtctccgccccgcacggggctggcggagatctcgacgttggngggcggcnacgcncgcggcgggaacccgcacatcctgagccccgagggccgggtacatgccgagggcggacatggctgcnatggnggngtgtggnagnggccgggcagaagaancccttcttcccgcgcatgggtattgttcttggccaagancanatctgcagncttgg

SEQ ID NO: 89090 - DNA, 565 bp, Triticum aestivum
  unsure (1)..(565): unsure at all n locations
  Clone ID: PAT_TA_89090
ggcgagcgtggccgccaaggtggccatatacacgacgctggtgaacccgctggccaagtacgcgctggtggtcgcccccgtcgccgaggccgccgagggcgcgctgggcgtcggcaagagcgcgccgctccgcgcgctcgtcaggacggtgctcgtcgtcggcacggctgtagtcgcgttggccgtgccctttttcgccgacgtcgtgggcctcacaggcgctctcctcagctgcacggcgactatgctgctgccgtgcctctgctacctcaatgtccggtcaaagatcggcggtgacaagggtatggggctggagactgcagcttgcctggcattgtcgcgattggaccgcgattgttgggctgggaactacattccgtgaacaaattgtacgcaattatataacacaacaaactgggggtggagctaacgcggtgaaaactacggactggatttcactaatctctctgaattacttgggcctcncntttagtcagatgtgcatcaaaaaaaggggggccggtaccaatcgccaaagtagtctataccgnctacggcctctttn

SEQ ID NO: 89091 - DNA, 569 bp, Triticum aestivum
  unsure (1)..(569): unsure at all n locations
  Clone ID: PAT_TA_89091
agtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaactgcctatttcgggtgcaccgacgccacacagtgatcaacgagtggaggaggtcaagaaggagtaccctgacgcgtactccgcatcatcggattcnacacatgcgcangtgnatgcgtcagttcatgccttcagcacgggctcaagatcggaaggctaacagtcaccacangggcaatataatgcattgatttgtaancgaattgcttgn

SEQ ID NO: 89092 - DNA, 563 bp, Triticum aestivum
  unsure (1)..(563): unsure at all n locations
  Clone ID: PAT_TA_89092
attaacttgatcgccatggccgcccctacctttctgcactgcctgctcgccatctggctcctctcctgcgccgcccacgcgcagctctcgacgaccttctactccgcctcctgccccagcctggaggccatcgtgcggacggggatgaacaaggccgtccgcaacgagcggcggatcggcgcgtcgcttctcaggctcttcttccacgactgctttgtccagggctgtgacggctcggttcttctcgacgctggcggtgagaagcaagccgcgccgaacaatgggtccatccgtggcttcggtgtcgtcgacgccatcaagccggcgtggaggcgcgtgccccggcgtcgtctcctgcgccgacatcctcgcgctcacgcgcgcgangggacttcctgctgggcgggcgactggagatgccgctcggccgtcggactcgacacgcgaaccgggtctggcaagcgaactccgcgccgacgcgactgtcacgctgattcctgttcgaagaaggctctcccggcgaatacgggcttcggccnaacatcgctgccaatccaaattat

SEQ ID NO: 89093 - DNA, 289 bp, Triticum aestivum
  unsure (1)..(289): unsure at all n locations
  Clone ID: PAT_TA_89093
gccatccatggccgcctccctcttccgcctctcccggccccgccgcgtgctcctccccttgtccgccctccgcctccctttctccacccagcccctcccgcagccccgggacccgtcctcccccaattccaaccgcggccttcctgncttcctctccttcctcgccgccgcagccgcangcggaatcaccggttccgtcgctctctgcgatgccnggcnccganaacgggtctgngggaaangacatcaccganctgttggtgcntggggagcgnanggngtgccacgg

SEQ ID NO: 89094 - DNA, 568 bp, Triticum aestivum
  unsure (1)..(568): unsure at all n locations
  Clone ID: PAT_TA_89094
agcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaactgcctatttcggatgcaccgacccaccagtgatcaacgagtggaggangtcaagaaggatacctgacnctattcgnatatcggatcgacacatcgtcagtgantgctcagctcatgcctcaagcacgggctcangatcggnaggctaaaaactatcacacagcattataaggcattnagtttgtactn

SEQ ID NO: 89095 - DNA, 580 bp, Triticum aestivum
  unsure (1)..(580): unsure at all n locations
  Clone ID: PAT_TA_89095
ttttttttttttttttttttgggaacagagtcgttagtgttttctcattgcataaccagtccactgatacacgatgggttaagtaccccactccaggccatacgcggcccattacatccacggctccagcccacttgcttctggcctaatttctctcctcacctattacatgtccaccgctacacttgtatcagatgtatcaggtgtgacagttgccccgccttgagcggcagcgtcgttcttccagcaaggtgccgtaggatagcgaaggcgcagcacgttgtagtcctcccaggttgctgacgctggagaaagagatgaccactgaacgcgcacctgaaccaccgagttgttgcctttcttgaccatccgtcgattcaagatggcacgggttggaggggagccgcggtgaagtctggcgcgcgaggaactcggagaagaccggcgaatatccngtgtgaaagntcaactgtgacacgtggaaangggtgtaccggtgttgtccggaattggactgtatcaaggngcaatgcgttcaggcattaacgtccgaagaactgtagcaactgggcagggnata

SEQ ID NO: 89096 - DNA, 386 bp, Triticum aestivum
  unsure (1)..(386): unsure at all n locations
  Clone ID: PAT_TA_89096
gagacgcgtcccgtccgcgcacgctactcgattgattgcttccttccgcccgctgctgctgctgccgctgccgcnanagctcccctctccccnctcccnctcctcnaatcccccggtgccctagccatcccgccgcccccgacgacgaccggcggtaatcnaganggcggatcatgccccaagcgccgctccttcncctcccngagggagaccctgccnnggatngatactggccgntctggaatgggnagccncnatgactaacaggggtctcgcggcagcgttgttggnagatgcatcngatcgcataccatggtgcantgtctcaactgcgtnaagnaantcctcacggtcntcttcaagtncngcgaactcnaactcaaaca

SEQ ID NO: 89097 - DNA, 551 bp, Triticum aestivum
  unsure (1)..(551): unsure at all n locations
  Clone ID: PAT_TA_89097
cggacgtggagggcgatgtgcaggaggtagtgcaggtccagctcacgcgcttcgcatgcggctcgctcgccatcgggttcacggccaaccacgcggtcgccgacggccacgctaccagtgatatcctcatcgtgtagggccgcgcggcacaagggttggacatctatgctccttcagcgcacaaccacccgacctcttccggtcgcgtgacccgctggtcgttgagttcgagcaccgcaacgtcggccatcgtccagcaacctcaaacagtcggtggtgggcaccacggggccgacaatgtgatcaccacaaggtgcaccctggaggaccagctgagccggccgctgaagcacatggcgcagacgatcagatttcctacaaattttgactgactttgatttttggatctgtgaggaagacgaacatatccattactncgctctgttgagttgtgagtataggaggagaattctatgtgctccgtggtcttgtggaatgtaantttccccacaatttttgttgtcgtttaaaatgatcgatcatacagttaa

SEQ ID NO: 89098 - DNA, 516 bp, Triticum aestivum
  unsure (1)..(516): unsure at all n locations
  Clone ID: PAT_TA_89098
agcggagcaggcgctggtggaggttgaaagccacttccagctcgtgtcaggcctcccggttgtcgacagcgctcgcagatgcgtcggggtcatcgtcaagagcgatcgcgtgagggcttcacatgggtcaaagacgttgattgcagatgtgatgacatctccagcaatcacgctatcttgcgataaaacagtgaccgatgccgcagctctgatgctcaagaagaagatccacagattaccgatagtaaaccaggacaatcaagtaataggtatagttacccgcgatgacgttcttcgcgccttgggaggcatgctgaattttaagagatgcaggatccatgcccggtacttgtggattttgtaaatatgtgtgtccgcggtactttgagtaacaagcagtctatatccgtaaagtgttgtaacctgtatcgcaaaaataanctgggaactttaggagaactttcctgtaaagaacatgccggaactcgcccgtaagtacgtancggtactgccatg

SEQ ID NO: 89099 - DNA, 523 bp, Triticum aestivum
  unsure (1)..(523): unsure at all n locations
  Clone ID: PAT_TA_89099
caagaccatcacccttgaggtggagtcgtctgacaccatcgacaatgtcaaggccaagatccaggacaaggagggcattccccctgaccagcagcgtctcatctttgctggcaagcagctggaggatggccgaaccctcgctgactacaacatccagaaggagtccaccctccaccttgtcctgcgtctgcgtggtggcatgcagatcttcgtgaagaccctcaccgggcaagaccatcactctggaggttngagagctctgacaccatcgacaatgtcaaggccaagattcaangacaaggagggattcccccggaccaacancgcctgatctttgccngcaagcaactggaggatggccgcacccttgcggactacaacatcaagaaggatcaacctcaactggtgctccgcctccgttggggcaataatgtcctggcntttactgcnggntanccttggcctccgttgnggtgcctgtcatcgtttgaatggttcncnttggtaatccaaatgttggttg

SEQ ID NO: 89100 - DNA, 588 bp, Triticum aestivum
  unsure (1)..(588): unsure at all n locations
  Clone ID: PAT_TA_89100
ctcactggcaagaccatcacccttgaggtggagtcctcggacaccatcgacaacgtcaaggcgaagatccaggacaaggagggcatcccccctgaccagcagcgcctcatctttgctggcaagcagctggaggatggccgtacccttgctgattacaacatccagaaggagtccacccttcaccttgtcctgcgtttacgaggtggcatgcagatctttgtgaagacccttactggcaagaccatcactctggaggttgagagctcggacaccatcgacaactcaaggcaaagatncaaggacaaggagggattcccccgggaccaacagcgtctcatcttcgctggcaancaactggaggatggccgcacctttccnactaaacatccagaanggatcaatctcaacctggggtcccctccccgggggtcaataattgccttggtgcnctggnggtgccctgcttcaagtnaatgttancccattgtgnaaatcnacaacantcgggtnatgnncacaatcccgtaaatttnttggttcttaanattctggatacatncggcanttaanatggcttnactaaaaaaa

SEQ ID NO: 89101 - DNA, 160 bp, Triticum aestivum
  unsure (1)..(160): unsure at all n locations
  Clone ID: PAT_TA_89101
cgcctcgcctgtggccgcggtgggttggtgggtgccgtcgcctccnattctcaaccccactctcnaatctcnattaccacgcctcgcctggatgccctctcgcttctcccccactcnacgcgccgatccgccagccaagaaaccacgaggcgattcagta

SEQ ID NO: 89102 - DNA, 600 bp, Triticum aestivum
  unsure (1)..(600): unsure at all n locations
  Clone ID: PAT_TA_89102
aacaacttcattcccctcactcgactagactccatcttctcccctgctcccttccccctacgatccatccccttcacttcccgtttcagttcatcaatggtggctagttgtaggctgtagctcgccataggtggagcattgcactccggctacagctgtgtcttctttaccctcctgttcacgatccatcgatctccttacctgaccgagtagagcacaccgcgcacaaaggaagggatcatgagcatctccgtgaacgggcagtcggtggtgccgccggggttccggttccaccccacggaggaggagctgctcacctactacctcgccaagaaggtggcgtccagcgcatcgacctcgacgtaatccccgacgtcgacctcaacaagctcgagccatgggacatccaagagcgctgcaggatangaacaggcccgcagaacgactggtactgttcagcacaaggacaagaagtacccacggggacgcgcacaacgcgcaacgcgccgggtttggaaggcacggccgggacaggcatcantcgccgcggtcggcgatggatccaagactctctcaaaggcggcccgacgcaaatcgang

SEQ ID NO: 89103 - DNA, 628 bp, Triticum aestivum
  unsure (1)..(628): unsure at all n locations
  Clone ID: PAT_TA_89103
gatgaagttgtgcttccgtctttcacaaactacccaaataacaataataatacagaccacatctagatgagactgaatgagagcagctactgaacctagtaatcacatctagcctacagtgatacaacatggatacgggcgtgggtacatgatgtgttacctggagatatcccatcaaatgaatactagctctggttaaacctaggtatcataccgccccttccttgggggccagttaatattaagtacactgcgacctggtataacaagtgcttgctccctacactcctccttaataacgccctacgagcagcccttttcccggcactctgacgtaagttggtttaacgtcctcccttncnggttnaactgaatccgtccaacgccttttccaaaaacttacanccgccggttccccgaaacgtntnacccgtcatcaanggtgttacaactgaacacactcaaanttgngaancattatgttggangtaaacatgcccattatgcactggattacatgccaggntcacccgattgcacgatntcaanacntggaannttctggagccattaaccngtgccttttnggaccaancacgaaggggggancttnccattgatnntaaca

SEQ ID NO: 89104 - DNA, 432 bp, Triticum aestivum
  unsure (1)..(432): unsure at all n locations
  Clone ID: PAT_TA_89104
gtggggaagaaggtggattggtggccatttcctgtatgcagaggggatggcaacgactgttccttggttgaaggatgcaatgcatctcgctgaattttaagctgtacgattttgggtcttcctaagatacctatgcaggggagaaagaaatctgcaagttgggttaagaaagctaggcatgattcttaatagtagttacatacatacctaaatgtgtttgggagatgcattgcactgtgtttcatangtggccgtgaccgttaaagggtgactaaaagtaatccatcatcacatcaatttccgggaatcccttggatnaaaaacagttaaagatcatccngggtaatttcaaggatnaaaatccatacagtaaaaaatggtcaatgaaantgtataaccgcatacccttgtgggaaanaaacaaggcnccct

SEQ ID NO: 89105 - DNA, 634 bp, Triticum aestivum
  unsure (1)..(634): unsure at all n locations
  Clone ID: PAT_TA_89105
gnaggaagccggtggacttcgtcggcntcntaggcnaggccatccaattaccgaaagcggancggaggccggggacgaggaggggcggagnaggggcccgccagtcgctcatcgggatctcccagtcnatcccggcggcggganaaggccctgangtcaatccccaaacggccgaacggaacaacgggcaaggacgacaagcgggcggccgacaagtcaagtccaatgctcaatgttcatctccaaacaatcccccggaaggcgcgccaanccaagccgtntccgcanaagaatgccgcttaaggctaaacttgattctaaacccggtaaaaatactgataaccctggaactgcaactgtccanatttncaggtccttttttgggccccnaataatcnccatttcccgggttttccgtgatgaatgtatcatctggatactgatacatagttaaaaagggggggcccgtaccaattcgcctanatgatctataccgcctcacggcgtcgttaaactctgactggaaanctgggtaccactaaccctgagaanccccttcaatgggtaaacaaagcccacnttcctcaaattccactaaggaaggacccctcggataaccngggtngtaccactc

SEQ ID NO: 89106 - DNA, 291 bp, Triticum aestivum
  Clone ID: PAT_TA_89106
ccgaaatgcagccacgcgttccaccagcagtgcatcgacacctggctcaagtcgcactccaattgccccctctgccgctccaacatctccttcgtcgccgtcgaggtggcgccgccggagccggagggccgtgctccaggtccaggcgagaccgaccggagcacccatcaggtggttgtttgagatggatgaatttggagagtatgtgttaagggagcaagcgggatgcggttgagcaatgggcggcgtcaaagctggccgtgatgattaaggagacggagcgcagccgag

SEQ ID NO: 89107 - DNA, 651 bp, Triticum aestivum
  unsure (1)..(651): unsure at all n locations
  Clone ID: PAT_TA_89107
atgatgttagaatcacagcgctgaagaggattctgcagcttgtgaaatcaatcaggtctggtgatagtaagaacattttgcatcaatgggctagggctagtctgcactctgtgattatggaacggttatctgtggaagaacaccccaaatgcctttattatagtctaaggatcatattttcatggaacgtggaatgccagttcaacaatggagaagattgcaatacatttttatccatctgggacagattagttcttttgaacagcactgtgtcacatgcaaaaaccaagagaaataattctatgttgcatgggtatgtgcatgaagcagtttgctaaattgatgagggatggcgtgttaccggaaggtcttaaaacgagtgagctctctactcctctgggagtatccacaaagggaatatagattgtccgcagccattatcaacacagactttttgtcatcttgttaagaagcaaatgcacatctgaaacgtgaatctcgtanggctgctgctgaagcaatacgctcagtctcttaagagnaaatttgcaaacactttcaaanatcatcctcgacagcacaatcaccaganatctgaacaccggtgattcatccagcaganatgcaagtaagacntncgggtagtcaccn

SEQ ID NO: 89108 - DNA, 628 bp, Triticum aestivum
  unsure (1)..(628): unsure at all n locations
  Clone ID: PAT_TA_89108
cataaacccaagtcggactcgccttcctcctccccaactactcctctcctctcctccgcgcatcgcaccggggtcacctgagatcacacacacaatggtgaaggctgtggctgtgcttactggcagtgagggtgtcaagggcaccatcttcttcacccaggagggagagggcccgaccaccgtgacgggaagtgtcaccggactcaaggaagggctccacggcttccatgtgcacgctcttggcgacaccaccaatggctgcatgtcaactggaccacacttcaaccccgctggtcatgtgcatggggcacctgaagatgaaatccgccatgctggtgatcttggaaattgacantggagttggtggtgttgcnacatcaatattactgacggcanatcccccttatggnccaaattaattgttggccngctgttgtctccatggtgacctgatgatcttggnanggtggcataactancaagacatggaaacctgggcactnttcttgcgaacaacggtcaaggtaaattatttccgacaantctaaaattggaacttnaaancaattnaacccatcaaananaagnttttactttanggacatcgtnatccaggntcccnatttcc

SEQ ID NO: 89109 - DNA, 636 bp, Triticum aestivum
  unsure (1)..(636): unsure at all n locations
  Clone ID: PAT_TA_89109
ccggtctcccccgccgccctcctctccgccgccaccttcctcctccgacggtgaggaccgcatcagcgcgctccccgacaccctcctgcgcaacgtcgtctcccgcctcccagtcaaggacgccgcccgcaccggcgctctctcgcaccgctggcgcgggctctggcgcgccaccccgctcgccctcagaaacgcccactcctccggtttncccntccccgccgccacattggtgtcccgcgtcctcgcctcccaccccggcccttccgcgccgtccgcatcgctgagattcccatcgacgagtccaacgangaggcgctcctcccggagttggctcgccaactcgccgacaagggctggaggactcacctcgtcaacgcccctatccttcgacgtgcccgtganctgcccgcgacctcttcgctgcggggctcgctcggcgctctaactcgggtcggtcttcccttaacacggctccgngcggcccaagtcttcccactcaagagtcggctcngaaggatacgagaccactcatactcttctgagccantganactggtattaatangtaccaaggtcgatcgacgaactcgtgctgtgncgatcttgcaaagtcnctncgcattaaganatata

SEQ ID NO: 89110 - DNA, 254 bp, Triticum aestivum
  unsure (1)..(254): unsure at all n locations
  Clone ID: PAT_TA_89110
ccgccccgtgccactagcgccagccgatccccacgcggncggctgctgcttcnccggtctcatggccggcgancaagangaggcggagcgggagtccccggcgccggcgccggctgcggagcgggtcaccgccgcggtggagaccgtggnggcgcccggggagttccggaacgcgtaccggcggcagctgctggcgctgtcccgccgaattcgcctcctcggacccttcgccgaggagctccgggagcgccgcc

SEQ ID NO: 89111 - DNA, 438 bp, Triticum aestivum
  unsure (1)..(438): unsure at all n locations
  Clone ID: PAT_TA_89111
caaccataccccgctccacctccgtctcccaccctctgtcgctcctccaacgcccccaaactctccccctctgaagcctctcaaatncgcgatgggggcacacangcccgtaacggtgctcccgcatccgcgtcaaggtcaacccccggctcgtcgtcatggangcggtggtcatgaggaaggttgttnaagtccgtnaaatggacttntcccctancnttttccaagaccaangacggntgccccnatncnccggcttctttaaaantccccacttaggaaaaaggggtttgncactttttttcaaaacccccttgccttttttgantccccaaaaggtaactcccccgncnatttttttnaanggaatttgggttaaaaaaaaatttaaccccantttattttaaaggnanccccnttggaatgganaatnttctt

SEQ ID NO: 89112 - DNA, 452 bp, Triticum aestivum
  unsure (1)..(452): unsure at all n locations
  Clone ID: PAT_TA_89112
cgagttttttttttttttttttanttacancttctcttctttatctttagntttatctacttagcaatagtatctaccggctcgaactcagaatttgatcgccttccatacttcacaagctgcggctagttcaggactccatttgcaagctgctcgganaatttcattancttcgnnagcaagatcgcncccttcgttacnagcttgtanacaggcttctaaagccactcnnattaagctgctgcaccagntgcattccccaaggatgtcctaaattcctccaccaanttgtaatacanaatcgtcnccaaagattccggtcaagagctggcatatgccaaacctcntgccgaattcngcacaanaactagcttgcccttcncagctgcaactgctgatcngtctttgatcttccgggaagggaagcncgnaattggngtccgtcaagctgg

SEQ ID NO: 89113 - DNA, 235 bp, Triticum aestivum
  unsure (1)..(235): unsure at all n locations
  Clone ID: PAT_TA_89113
gaaggtcagagctccccgcgccatggcttccccgtcccaatccccctcccctctccacccgcaccagctccagcagcacgcttccccccgcaannaaacccccacccgcagtacaanggccccgcccccttcgatgccccccccgccgggggngcccccnaaggccatggattngnaggtcaccgtctctcggggcangcacctgaanaactcaactggcgccncggnnatttcc

SEQ ID NO: 89114 - DNA, 601 bp, Triticum aestivum
  unsure (1)..(601): unsure at all n locations
  Clone ID: PAT_TA_89114
ttcaaccgcgtctgccgtgatgaagccggcgcgcgggtggcaccacgcacaatcttcacttacggcatcctcatgaactgctgctgctgcgcacatcgcccggacctagggcttgccttattcggccgcttcctcaggacgggcatgaaggcaaatgaaacattgccaccaccttcctcaagtgcctctgctccgccaaacgtacagatgaggctgtcaacttgctgcttcaataagatccccgactttgctgcgtgcgtaatgcttctcataccccattgttctgaagacttttgccaagaatagcatgagtcaacgggggtcgactgctccanatnatggcgaaagaaggagggcctgtccccaacttggtggatatacacggcatcaangtcnttaaggaagnaaacaggaaggatcatctatccatgaaatgatcacagggttnnccacgtnggacatanatcnatatgatcttgtcaagcaaacatggcaagnanaatatcctcgcaatgttgtatgggccaccgatantgcatanatgntntcangtatccatagganttaaagnacaaatntaaaataanccggtcttcaatnt

SEQ ID NO: 89115 - DNA, 611 bp, Triticum aestivum
  unsure (1)..(611): unsure at all n locations
  Clone ID: PAT_TA_89115
gagttttttttttttttttttcccaaatttgtgtgttcacttcatctttttaatatgggaacaaagtctgtttaatcacttcatctttttgcagaatgtgatacctgatcaatttcatcataccaagtgcgtgatgttcatgtttcaagagctccacggggctcaccagcggcctccccgagaagaaggcgtccgaggttgggcgaatgacgacctccgagcaccccgccaatggacccggcgttgagcacggcctgtggtccgacagcacacttgtccatggcgagcactcccagccgcacggccggtccttccttgtacactccaaagcccgngccgccgatgacccctcgccgggggggaactgacaactcccggtcgtcaacagccgccccggccacgttntacaacaacccgccttcccaangctcancactccggtcacaatcttgggccctcctcaatgccaagggagacaannttccttcgggggnaagtcccaacnccggacaacggtacggccanggttggcactcaatggaagaacgncaccaagngnaaaccggganccaaccattgcacccnattcacgntcgnactggggaaggacc

SEQ ID NO: 89116 - DNA, 475 bp, Triticum aestivum
  unsure (1)..(475): unsure at all n locations
  Clone ID: PAT_TA_89116
gcgcgcaggagatggcgggagacgacgcccggaccggcgaggtggcgccggcggaggaggagccgcacgtggagcggcttccggccgacatcctcgcgcacgtcctctccctcctcccctccttccacgacctctccatggccggggcggtgagccggcggtggcgccgcgcggttggcccggtcgctgggaacccgcnggcggttgaagcctcgccggggcaacgcaccggcgaacgaatccaccgcgcgcctcctccgcgccgccgttcaactccgcgacctccacatctgctgggggtgcacatcaacggacaaggctgctccacatctcctccggnggntncatcgggaactcactcctctcgctgtnggggtggcggggattactgacaaggcgttgtcatctggtctcaangntccttcttttnacatctgaaattggngaaatcatcactgatgaaccctctatcaat

SEQ ID NO: 89117 - DNA, 600 bp, Triticum aestivum
  unsure (1)..(600): unsure at all n locations
  Clone ID: PAT_TA_89117
caagcacgcaccaccagcagataacgcacgcgctgagcgcaagacaccaagaacgcaatgtctggtgccgctgacacagctgcggccgccgccgtcgccgccgtcgccggctcatcgggtcccgcggcgtttgccgctcagcggacgcgtggccatcgtgaccgggcgtcgcgcggcatcgggcgancatcgcggccactttcctccctcggngcaagcttctccttggtangccggcaacgccggcgaagccgacgcctncccggaaatccccaacaccttccntttaaagcaactnttcnaaaaaggcgggttnntccncttttaaaccncccaatttgnttttgtttcggggcccaatataaatnccaaacccggttttcgggaaattaccccctcgccgaaacncanggggttnacggtttncccttaaaagcgngggctttttgctcgcaaggccaacggtgccctgcgngnggcgatttgcgtantctccttgcggtcaaccnagggatccccaaaggtcaagggcntggnatgggttaatgcagnncaaggccctttngaattttttcngggnagaaanantttttcgnaaaa

SEQ ID NO: 89118 - DNA, 652 bp, Triticum aestivum
  unsure (1)..(652): unsure at all n locations
  Clone ID: PAT_TA_89118
cgccactctccttcccgagccggaggcggacgaggtaagaagcagcagccgcagcgcgaccccgcgagaaaccctaccgccgccgccgcagaagcagccatgggtatcgacctcgttgccggcgggaggaacaagaggaccaagcgcgtcgcgcccaatccgacgatgtctacctcaantcctccgtcaantctaccgtttcctgggtgaggaaggaccaaaganaanttcaacgccgtcatcctcaaagagtcttccatgagcnaaaccaaccgcccgcgtctccatgcgccgctctcatnaggntanataggnnggggganaaaagaaattgctgtggttgtttggtacatcacagattacatgcggttcaaagagtcccaacaatgaaggttacgctcctaggtcaaaagaacaacgangnaaagatttcaatgctggtgggaatgctcaactttgacaacttgantcctgctcaaattgggaaaaaacantctgttagggaccaagaatcccttangcgtaggacttcgaagccctgtgtccnaaacaacaacctatntccncaaggtagaatttaagnctgaagaganacttgttaagttatcccctttttaccgttncgacanggtttttcatnnatattaaantt

SEQ ID NO: 89119 - DNA, 650 bp, Triticum aestivum
  unsure (1)..(650): unsure at all n locations
  Clone ID: PAT_TA_89119
agaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttggggttttccttcctccatttatctttccttatttgttccctaaagaatatgtgtatgtccatgttcatgttccaacatggctcccnagaaagcatgctccgtatgagaatgctatcggtgggtatgttatatggaacggacgccataatattaatacaatatgtccgactatatacttttaaatggnaaccaatgggaaatactccaacaaccgtgcttatactcctccngtaaattaatataagctttcgattactgcttaantgtctaaacctctaagttagttacaagagggatacttttataaanatggacggtggnnttgctaattgtacctgaaagtaggttgtaacatggccaaanatntgcacataaaatagtnattaaattnaaaagggggccngccnattcccaanggtcnatanccgncangctctttaanctacggaacctggtcaataacc

SEQ ID NO: 89120 - DNA, 638 bp, Triticum aestivum
  unsure (1)..(638): unsure at all n locations
  Clone ID: PAT_TA_89120
tgtaagtttacccccccccccccccccagtcctgatatatttggtgcgagagaccctgcatttacatgatattgctacgaacgcgtgcaaattacataatttgttatacatgctgcttaacttgttcaccggtgctgttcattggaccttaagaacagagatgacaccttaccataggcagctcttaattatgtgtgcattaattcaattctaaaagttgattcaagctgttgtgcttgaagtagattcatagaagcaattccgtttagtatgtngaacaaaaacttacttanacccctccgtcccgaaattacttgttatggaaatgaatgtaccnagaatttttaantccnaaaacaccattgtaattattttggggnacaatatttcggacnaaggaatatgtnttacaaanttcnanatttgatagggaatgtttaangttgcaaaactaaatgngttacctggaaaagggaacggntccaataattngggttttcaaaaaaccaantnttaactcgnaacataaaaaagtancataacctcaaaggggcctnanccttccctataataaanaagnttccgtaactcccgggntggccncccctacctgantttcatttacaaatttgnaaaat

SEQ ID NO: 89121 - DNA, 537 bp, Triticum aestivum
  unsure (1)..(537): unsure at all n locations
  Clone ID: PAT_TA_89121
ttttttttttttttttttttttgaacaagacttccaacttccaacattttattgtaactggttgtcgtcaagatacatatccaatttcatcagcacttcgagatccagtttatcttacaatataaaaggacatttccttgcatagtttactgcaggaaacagtgctcacagcggcttcaagatagttcacaccataacacaccatacccaacatgggaatcaacagtatcttgccaatgtggggactcctctccatcaactttgtggaattcaactgcttccaagatagcgggaatgtccttgttaacaaccggttcaaccttnccccgacacgacggcagncaacatcttctccactcgctcacatnnggctttgttaaccgagcttccgttccccatccaacacttggaagggcancctccgggaaacatacctgcangtaattaattgtacactcccaagaaaccgatgatgaaaatctacacaacagtaagcgtcaaatgcncggacnagactactnagaaaaaaaaactgcc

SEQ ID NO: 89122 - DNA, 384 bp, Triticum aestivum
  unsure (1)..(384): unsure at all n locations
  Clone ID: PAT_TA_89122
cttaattcaagagttatagggagggacttatgtcaccacagacagncactaaagcaggtgttggatttaaagctggtgttaaagattataaattgacttactacaccccagagtatgaaactaaggatactgatatcttggcagcattccgagtaagtcctcagcctggggttccgcccgnngaagcatgggctgcnntagctgccgaatcttctactgggtacatggacaactgtttgggactgatggncttaccagtcttgatcnttacaaaggacgatgctatcacatccgagcctgttgctggggangacacccaatgggntccgttatgttccttatccattagacctattnnaaanggtccgttnacaaacantttac

SEQ ID NO: 89123 - DNA, 524 bp, Triticum aestivum
  unsure (1)..(524): unsure at all n locations
  Clone ID: PAT_TA_89123
cgtggagcgcctcaagaccgggttcgagaagttcaagaccgaggtctacgacaagaagcccgatttcttcgagcccctcaaggccggcaaggcgcccaagtacatgggtgttcgcgtgcgccgactcccgtgtgtgcccctcggtcaccctggggctgggagcccggcnaggccttcaaccatccgcaaacatccgccaacatgggcccctcctaactgcaaagaacaattacgccggtnttgggattngggcatccgaatacgccgtcctgtgctctcaaggtttaagtcatcngtgggtgattgggcacagcgcttcggttgatcaagtctgtctaatccaaggatgggcaaacatccttcaatttntcnaagacggtcaggatnngttccccggccaagaagaagtgcaacgatgcgctccatcctttcgatacaatgaacgtctccaaaaagagnaatgaactgtcctcannaactctgactaccnttgtcaagaggtttcaaagganctaaactgcggg

SEQ ID NO: 89124 - DNA, 630 bp, Triticum aestivum
  unsure (1)..(630): unsure at all n locations
  Clone ID: PAT_TA_89124
agagatcagaccagagcctacctagctactcactcatcttcgtcaagaacttcaccatggttgtcccggtcatcgacttctccaagctcgacggcgccgagagggccgagaccatggcgcaagatngccgacggctgcgaagaactgggggcttcttccaactggtgaaccacggcatcccgctgggagttcctttaccgcgtcaaaaaggtgtgctcccgaaantaaccgcctcccgggaagccgcttcccggtcctcccgaccggttgcaaacctggagagttgtngaggcngaccgcgccgcgaagccgttncnccgtnggacgaattgatgggaagaatcttttactccaaagacaanacaattgccctccgacccgccggctttaaaggaacaatgcggattacgcncccactcaanactcccggacngtcatggagcatggcnanactccgctnganaaggcccattaaggcncttaacnggnaaggctcaaacgcaatttcggacaaagggaacaataccgcntnccgcgccgggcnaaaacgggtcngggaaacaaccgggggtatcttttcanaaaagtgngcccagtanaaggggattgncataaccccccaccttntaa

SEQ ID NO: 89125 - DNA, 633 bp, Triticum aestivum
  unsure (1)..(633): unsure at all n locations
  Clone ID: PAT_TA_89125
ctacaagcgagtgacactagttcttgcaccgatcagatccaacttctgcacaggatgctggacaagctgtgggacgacgtggtggccgggcctcgcccggagacgggcctcgacaaagctccgccgggccgccgccacccaacccctccgccatcaacacagctgcangggaagcgattaagcatcgccgttcgatgccgaacgacccccgaccacgccggtgacgccgttcgtcctccacgcccgcccgcgccggcggcagcgtttggcggagcttttccaacccgggganaaccttggcaccaaaaacctcggngccaactcttcnaccgcccgcacccaatcccccaccgtctacgactggttttcaacgacnagacgaggacaanganaaccaccgctaaataaaaccgtcggcaananacngaagcaggtgctcaacaactntncgacccgcattttgcgccctttggtaacnaacctgcgtacgtacttctgtcgagctcattggtttctaacttctacacgtcacaangctgtacttatttctggncgatcncctntcaacatnaggntnagtttcccgttaccancttgattccccgggtggngctccaantaccnagaaaaaaa

SEQ ID NO: 89126 - DNA, 519 bp, Triticum aestivum
  unsure (1)..(519): unsure at all n locations
  Clone ID: PAT_TA_89126
cgatctcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaaggacaaggagggcatccccccggaccagcagcgtctcatctttgctgggcaagcactcgaggatggccgcaccctttgcggactacaacatccagaagganccactctcaattnggggtcaagtccnttggtggtatgcanntctttgtcaaaccncaacggcaaacatcaccttgaggttatccnaaacacattacatttaaggcaagttcaagacaaggnggatcccccggacaanaccctgatttttgccggaacactcgaggatggcgcaccttggggttaacatcaagangntcaacctcaatggggntaagcncnttggggcatnaaatnttgtaanacccacggaanacacacctgg

SEQ ID NO: 89127 - DNA, 299 bp, Triticum aestivum
  unsure (1)..(299): unsure at all n locations
  Clone ID: PAT_TA_89127
ctcgtttccatacacacaatagctttttgtgcgggagaagcaagctctagcttcctggggccggccagttgagcaggcgtttgcatcgtcgtcgcacgcagggagaagctccaatgttgcgcnagaaatggcagggatgcgttttggtcctcgtccttcctcctctctccaacgcggcgtcaaggacttctccgggggaacgacacattctccccaacggagacggagattcccccnttcggacctggcnaaaattnggaacccgtccnaagcaaacaaagnggggcccctttttcggg

SEQ ID NO: 89128 - DNA, 652 bp, Triticum aestivum
  unsure (1)..(652): unsure at all n locations
  Clone ID: PAT_TA_89128
tttgcatccagagtttccttacattatattcacattcacattttttccatacagtaagtcaagtacagtaaactgatcaaccagtcctaagcttcagatgctgagcagtcctacatgctacagttcaacggcacgaaactgtatatggatatatttctgtaaagtacaaacattcagatctatattgccactatctgaagccagcacgaaggagccaacggatcatatgcttcaagatgatactgcaacgcaagagccaaatcctcctcaatttcaagcgtgggcaactacggtctgaggaancctnngctggatgaatccttgccaaggacatccgcttcaactggttcctgcatagtatccnggggcatatgtccgatgggacaagatgttactgggtacaacaactggcaagaacggagggactacnggtccnntttatgcattgaacactgcacttcttctacacggacgngggtaccttcaaagaccaaacaggtggcaccgtcccaaatctactggcactactctgaaatacanatagggcatgtnaaacaatcccagnntcccgatatccagtaaaactgcagcgaatcgnatctattccaccncagnaaanagtttcaggtaagccgngnactgcgggnattaa

SEQ ID NO: 89129 - DNA, 588 bp, Triticum aestivum
  unsure (1)..(588): unsure at all n locations
  Clone ID: PAT_TA_89129
gaatgagggcatacgtagatcaatagatgcagctttgatctacgcgtgtattttagaatgagggcatacgtattcctcgtgtcagcccatttatataaccgtcatcatacgcgtcgtcgtcgccttgtatgtcgagctagaatttcgtatgatctctactgtttctgttgaacgagtgatcttctctgactcgggccgttctaattaattgtacagcctgcaagttgccaatttaacattcaaggtcaacccacatccatgtcgctgaaatgatcgtccaagtgtttacgtcaggcaaccaactaactaaatgaaataattaataattaactaaacatcccttggataaggataacctgactcgcatgtgcagttctttacggcaaggngacagtttaaattatgatnccccggtgatgcattcctcaagttnacaacttccaaggaaagattcntaaantacaaatgctcggaatgggtacngattattaacaagaactctaacctaactacaatatcatanaatgcagtaaggatactttaagttcaatgtanancatagtaactnctacattaactgcaccnttt

SEQ ID NO: 89130 - DNA, 593 bp, Triticum aestivum
  unsure (1)..(593): unsure at all n locations
  Clone ID: PAT_TA_89130
atttcgtccatggatgcatccccttcccctggagaggaggtcctcccgtcgccggcgaggcgacagatgagatgagcctctccgccaccttccgggtcgccaaatttccccgcaccaccctccctccaaagtcttgcaaggccaccccctcctcggtatcggcctcctccgcccccgcgtccggagatccaccgcccaaggccgccaagaagaaaaaggaaggcggcgccgtnngtgcgtctactcatctcctcctcccggcccctccgtacatactccggcgtcacgactgattccctccggngttggagcacatatgggcgatttaaaaggtggtgccaancctcttctgctggaaggcatgatctccaagcttgtcgaaggttcacgaacagaatgaacatcnattttgatccnaatggaaaatctccaagaagatacacgggaaaggattagctggatgatgcaatattcaacacgggaatgggatngacaaataaaacttctggatgcaacactcaactaatgganaaactgagcgttccaatttgagtcaatgttacatnaagaatacatactanagttgnaggttt

SEQ ID NO: 89131 - DNA, 572 bp, Triticum aestivum
  unsure (1)..(572): unsure at all n locations
  Clone ID: PAT_TA_89131
caatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaactccgcgcgctgtgcaccggcgagaagggcgtcggcaagagcggcaagccgctgcactacaagggcaagcgccttccaccgcgtggatccccgacttcatgttccaagggcggcgattcacccggggcaacggaccggcggcgatccatctacggcgagaattccccgacgagaattcgtccacaagcacaccaagccgggtctctccatgggcaacgcggggccaacacaacgtccaattctcanctgacgttccctgcaatggtcgacggaacactnnctccgcgagtctcaaggatgactctcaagaatcaaaagggggtccccaacggactgtcaacaagngtatcccanggggcaatcaaatngccggccggtcccttccgtctctnccncctnttcnttt

SEQ ID NO: 89132 - DNA, 586 bp, Triticum aestivum
  unsure (1)..(586): unsure at all n locations
  Clone ID: PAT_TA_89132
ctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtccgactacctgatccgctccaagtgggtgccttgcctccgantcaacaagttgggtcatctcccgttgagcacaacgcatctcctggggtactacgatggccggtattgggcatgtggaaactgcctatttccgggtgcactgacccaccaagtgatcaacgangtggaggagncnaagaagganaccttancctatttccnancatcgnttcgacaaatgcttcaggtgaangggtcaantcatgnctttaacaaccgggtgcaagatccggaaggctaaaaagnaccacacagcatttaatgcatganttttaancnaatgcttggttcctccaatact

SEQ ID NO: 89133 - DNA, 492 bp, Triticum aestivum
  unsure (1)..(492): unsure at all n locations
  Clone ID: PAT_TA_89133
ggtaagtgctcgtgcaatcctcctctcccccttcctcggcgacctgaaccacaggcgtgccctcccgtagctggagagcctttggtgccctagcacgtctgcacgcgagcagcggttccacgagcagcatcgacggtgcgggagctgcgcggaagcaagcagcggacgcacgcccgggcctgcagatctcaccgagtgccacgggcggcatcacatctcgtgctgttcctgcgtcactgcaattcgccgtgtttggcgtgaccggactttgccgttnccgggggcgggttngtgcccgccaagtgtttcnggaattgtacgattccagcaaagcagttntgctgcaacgggtaacaagatatagaatatcccaagtcgcatttccactggncccatacctgctccaaacattcctaattgatctnaggtggtgattcccttgcacnttaaaaagaaattggccatcaaaaaggtactgcanaaacacgcact

SEQ ID NO: 89134 - DNA, 618 bp, Triticum aestivum
  unsure (1)..(618): unsure at all n locations
  Clone ID: PAT_TA_89134
gcaaaaccaagcagaaacggtgcccgtactgttctgctcgcccgaccgagcagaggtgagcagggcctgatgcgttctcccaagcaaccggcgaagctcgccatgcttttactgttggcactgctgctgctttgtaacggagttggcaacgtccattgcgcaaggatccacgaagagcagcgtcgattctgcacgcgctgctagacttcaaagcagggcatcaacaatcctcaaggaaccttgagtactgggaacatcacaacccattttctgccaactgggcatggtgtcaaactgcaccaacggcaccaccgttccgcgtctcctcgcttnaactcaactgatttggnctttaacaaggccaaatcaactcctctcccttgggaacttnacttcccttgggaacgcttgactttccttaanatacttccgntgggcccttactgtcctttggcatctccaacaatccaaaantttctctggaacaacacttttgggaaacgtttcncngaatatcnancttcanacaacactntcaagggcancccttactctaacaaacaaatactcgcaatctgaccttnaanaatgtntgangnaatncaaggatggtnttga

SEQ ID NO: 89135 - DNA, 572 bp, Triticum aestivum
  unsure (1)..(572): unsure at all n locations
  Clone ID: PAT_TA_89135
gagactttcaatgttcctgccatgtacgtcgcaattcaggccgtgctttccctctatgcaagtggtcgtactaccggtatcgttctcgactctggtgatggtgtcagccacactgtgcccatttacgaaggatacgcgcttcctcatgccattcttcgtttggatcttgctggccgtgatctcacggactcccttatgaagatcctcaccgagagaggtacccttcacaacctcaacccgagcgggaaattgtnagggacatcaaaggagaaacttgcctatgttgcccttgattatgaacaaggactgggagactgccaagaacaatcctcaatttaagaaaaactacgacttcctgatggcaagtgatcacgattggggcaaaaagntnaagtgcctgaagcctcttcaacanccatgatcggnatggatcttctggaaccatgagacaactacaatcatcatgaagttgacctggtataagaagatgttggaaatgtccaatggnganaacatntccaagtatccgactntacaagnataaacctgtcnacaataagtaagcgccncac

SEQ ID NO: 89136 - DNA, 604 bp, Triticum aestivum
  unsure (1)..(604): unsure at all n locations
  Clone ID: PAT_TA_89136
ctagtctcgagttttttttttttttttttggatcaaactgagagtgcatgacaagggtcatggttcattcaaatcaacaatgacacaaataaatgtgtccaatattttctcaagtagtatcaaatatcagcatgcggatggagatgcatgttatattcgatatttctaataggaacagaatattaggattccttgtgctacaacctcaaaagaaactggaaaattctacactcaagccatataactcaagatgttcaccaaaaccaagcaggatactgcgggaacagccatagggattaacganctcatcgggtactgctgcttcaccctctcttaccaaaccagcatcaccattgcttggactggaccaaaccttgccagtgagggtgatcaacttgcattgttacaaggcatcattaccnatgaaacctcatcattgctccaaaaatgccatcttaactgatcattttgtcgactttgaactctcgacaaagaactanaaagttgcttccaagtggatagcacatggatctggctgtacctcaggtcatataagnaaatggccactacagactnaaantcgctgatancccgatcatgcttt

SEQ ID NO: 89137 - DNA, 640 bp, Triticum aestivum
  unsure (1)..(640): unsure at all n locations
  Clone ID: PAT_TA_89137
gtgggcgggccgctcctaagaaactaaatggggattcccccggggctngcaaaggaatttccggnaaccaagaaacaagnttcaatccnggatttaanggtngaatataaaacctcctggaaggncaaatgggcaatggctacaaaaatcaattccaaaacttnagtatcctgggggtnaacactaactaactggggtcaaaatcntgcgggttcaaaacancggggggcttaatgacaagancaagttaatggggccccaanggggaattggggggccccttttcnttaaaccanaacnggnagcaacntntanggtaaacnttgnccnttggccttttggggtnaaattccaaatggganaatcccaaataaataaanttccnaaagggtattagcaattaacccccaaatttggaggnttcnaaagggggngaaccttnggggccaaaacttggggaattttnccaaagggggggaaanaaattnttnggggtaaaaaaanaancccgngaaattgcntttngggtcccccgggnaaaccnaattggggggccccnaaaaaagttttttnccanaaacttttaacccccccangtttntttttgntttnaaaaaannttttntgggggaaaaaaaaa

SEQ ID NO: 89138 - DNA, 540 bp, Triticum aestivum
  unsure (1)..(540): unsure at all n locations
  Clone ID: PAT_TA_89138
gagaaatctcctccgatcgaagcgaagccaaggctctctcgtccccctcctcaagatgcagatctttgtgaagaccctcaccggcaagaccatcacccttgaggtcgagtcctccgacaccatcgacaacgtcaaggctaagatccaggacaaggagggcatccctccggaccagcagcgcttgatcttcgctggcaagcagctcgaggatggccgcaccctgggcagactacaacatccagaaggatncaacctttaacttggtngctaaagntcnntggtggatgcaaaatntttgtgaanacatcaccggnaagacatcaccctggaggttgattcctcgggaacnatcgaaaanntcaaggtaantcaaggacaaggagggancctccgngcaanaagttcaaacttggctggaacaatncaaggatggccaanccttgctggtnaaaaacaananggttcaacnccacctggngggcaanccccntggggaangaaaatttggaaaccncccggaaaaaaaacctggaggttatc

SEQ ID NO: 89139 - DNA, 579 bp, Triticum aestivum
  unsure (1)..(579): unsure at all n locations
  Clone ID: PAT_TA_89139
ctagtctcgagtttttttttttttttattttttttgatttattttgaattttgaaggcgggaagaaactaatggcgcaccatgggcaggtgcgccattagtaaatttttttatttttttgacttattttgaattttgaaggcgggaagatagtaatggcgcaccatgggtaggtgcgccattagtaagtttgaatttttttgcctcctccagatcttaaaagccccgtaccttttttccaataaggtttttgagggattttaaaaaggttaaacggggtcccccaagttaatcccgatgtacttttcnaagaaaagattttcatatnaaaaacttttcancccgagtccnaatcaaaagtatgcacattttcaaatcncnaaaaanttcccaaatnaanccaaatcanaattgtnaanggggggcccgtaccaattcgccnaaaaggagcntataacccgcncanggcctccgttanaacgnctgaccgggaaaaccggggtaccaacttancncctggagaaaccccttcccaacngggtaataccaaaagccnaccgntgcctccaaaaatngnaac

SEQ ID NO: 89140 - DNA, 216 bp, Triticum aestivum
  unsure (1)..(216): unsure at all n locations
  Clone ID: PAT_TA_89140
gtctcgngtttnttttttttttttttttttttttttttttttttaaataactgtcngtacttattgactgcgggnactggcanttacattcagttacataggtcnttacggntgtnacccgtnnaatacacatcnctggtgcatattttgnnatgccgcaaaggcttcaagaagccaaggnactagtantgtanacaanaagagcacacccaacat

SEQ ID NO: 89141 - DNA, 611 bp, Triticum aestivum
  unsure (1)..(611): unsure at all n locations
  Clone ID: PAT_TA_89141
ccgccgcctcctctcggctccttcttccttcgagtttcagccatgggtaaggagaagactcacatcaacatcgtggtcattggccatgtcgactccggcaagtcgaccaccactggccatctgatctacaagcttggaggtattgacaagcgtgtgatcgagaggttcgagaaggaagccgctgagatgaacaagcggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactgggtacctcccaagctgactgtgctgtgctcatcattgactccacaactgggtggtttgaggctggtatctcaaaggatggcaaaccgtgagcacgcctccttgcttcacccttggagtgaacaaatgatcgctgctgcaacaagatggtgcacaccctaagtaccnaagntcttatangaattgcaaggaatcctcgtactaagaagtggtacacctanaggtccttctccanctcgggttaggtgnaatattaag

SEQ ID NO: 89142 - DNA, 239 bp, Triticum aestivum
  unsure (1)..(239): unsure at all n locations
  Clone ID: PAT_TA_89142
gtttttttttttttttttttttcncagctatcacttgcattttcttcatcaatttaanctgacttcaaacatangattccancatnacatcccantccatgncagangggattgctgcatcaccnacgaacannancgactgaaagataacacatgttgnttcttcctcgcgtnnccangctctaattccccccggacagagcgatactcgaactnngatcaaaaacagtanangaccg

SEQ ID NO: 89143 - DNA, 556 bp, Triticum aestivum
  unsure (1)..(556): unsure at all n locations
  Clone ID: PAT_TA_89143
gaccggaatagccggcacgatggggtacatagacccggagagcgtgctggcgggcagggcgagtgttgagtcagacgtgtatagcttcggggttgtcctcctcgaggtcgcctcagggaagcggccagctcaagtccaggaaggcggcgatgtcatccacctggttcaatgggtgtgggacttgtatggtacaggatcgatacttgatgccgctgacgaacgacttaggggggagttcaccggcggggagatggagcgtgtaatggtcgtggggctctggtgtgggcancctgaccgtggcatgcggccatccatcangcaagcgatgaacgtgcttcggtttgaagcgccattgcccagcctcccagctaggatgccggtggcgacctatgggccaccgactaatactctgaattctggaacttggtcctgaacaggttaatggccgatgacgctatccatcggtgncatgacaccgattcctaagtaagcaataatggtcatgaactggacaaatangtattagaataatatctatcgcattgatacacaatta

SEQ ID NO: 89144 - DNA, 600 bp, Triticum aestivum
  unsure (1)..(600): unsure at all n locations
  Clone ID: PAT_TA_89144
tatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccaccangtgatnaacangtggaggangtcaagaaggagtacctgaccctattcgcatatcggatcgacacatgctcaagtgnatgcgtcactcatcgcctnaagcacgggctgcaagatccgcaaggctaaacagtatacaaggcatttaatgcatgaattttaatcgaatgcttggttcctccaatacttcnattgtcca

SEQ ID NO: 89145 - DNA, 467 bp, Triticum aestivum
  unsure (1)..(467): unsure at all n locations
  Clone ID: PAT_TA_89145
catcgctcgctattgaatattgatctgtagcttggcgatccatggatcccaacatgttcacctacaagaccaatgaggcgctcaatgttgcgcacgaggtggcgtcagaggccggccacgaggagttgacgccgctccacctcgccgcggtgctggccaaggacaggtccggtatcctacggcaggccatcgcccatgcctcaagatggcagcgacgacgcgggcaaatccgttccgagcgcgtccgtgggcaaccgcgctcaaggggtttccttncgccgcccctctcccaanccgcgggagccggaaccnggacaccgtccaagctcaactcgctgttcaagncatccgccgcccnatncgggcanattccctaagtgatccaactccgtgtcaacantnctgncgctccttaaagacngnnacctcgaagccncaanaaccgggttccctcccccggtcaagat

SEQ ID NO: 89146 - DNA, 608 bp, Triticum aestivum
  unsure (1)..(608): unsure at all n locations
  Clone ID: PAT_TA_89146
cttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttgggactggatggacttaccagtcctgatcgttacaaaggacgatgctatcacatcgagcctgttgctggggaagacagccaatggatctgttaagtagcttatcattagacctatttgaaaganggtcccttactaacatgtttacttccaattgtnggtaactatttggttcaaagcctaagtgctctacgtttggaggatttacgaatccccctacttatcaaaaattccaaagcccgccnannggatcaaattnaaanagaaattgacaattggcgcctttatggatntccataancaaattggataccncaaaatntgnaacttanatgcactnggggctnntttcaanttgaacntacnccacctt

SEQ ID NO: 89147 - DNA, 338 bp, Triticum aestivum
  unsure (1)..(338): unsure at all n locations
  Clone ID: PAT_TA_89147
ctcagtcctcggttcccggtccggtcccgttccgttcgttagggtttagtagtagcggggaagaggaaggaatggcggacgtcgagtaccgctgcttcgtcggcggcctcgcctgggccaccgacgaccagtccctccagaacgccttctccaagtacggcgacgtcatcgactccaagatcatcactgacaggggagacgggccgatcccgcgggttcgggttcgtcaccttcgcgtcggacgaggcgatgcgccaggcgattgaggccatgaacggccaagacctggacggncgcaacatcaccgtcaacgaagcgcatcccgtcgctccggcgga

SEQ ID NO: 89148 - DNA, 426 bp, Triticum aestivum
  unsure (1)..(426): unsure at all n locations
  Clone ID: PAT_TA_89148
gttgcaacaactgatgttgtcgaggcctgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaactgcaaggttttgggttgttgccaacccaagcaaacaccaatgctctcatcctgaagganttgctccatctatccctggagaagaacatcagttgtttgacccgcctaagaccacaacagggnctcggtcagatttctgaagaaattgggggtcaantttctgacgttgaagatgctattatccgggggannaacccntcaattcantacctgattnttaacaaccaactgtgaaanttccaattgggnnaaaaccttttcc

SEQ ID NO: 89149 - DNA, 573 bp, Triticum aestivum
  unsure (1)..(573): unsure at all n locations
  Clone ID: PAT_TA_89149
atagcaatacaactataagtcgtatgcaacatccacacgatgaattacagtttatttggatgatactatctctatatataattattttggcccgtggcaatgcacgggcattatactagtatcaaataatgatgctagcacatactactaaggccttatacaatgctaggtgcctagagatgtgcttaggaaaataaaccgggttttcctgaagcaccggtttctatttgtacatgatagacgagtatctattctgtacaaataagcaccggtgcttgaggaaagtctgatttatttctctaaacacctcctctcaagggcggagacaaggggcaagcangggctagaccgcgtctcaacactcgcttcagttacangcgcccatgcccccgtgaactgggccggccaagtcgcatgncgctncgtccccacgattgcnatncacctggcctccgtcacttcatngctgttgctaaaaaagactcnattccaatggccgtaaccttgctttngncanacgganacccgtctgaaaacctgggtcctcgtcggcacctccgcaacaaagcgngt

SEQ ID NO: 89150 - DNA, 263 bp, Triticum aestivum
  unsure (1)..(263): unsure at all n locations
  Clone ID: PAT_TA_89150
cggtgatggtgccgccgacggcctgcgcctgccgccggggccgtggcagctgccggtgatcgggagcctgcaccacctcctcctcgccgggcagctccctcaccgcgcgatgcgcgacctggcgcggcgccacgggccggccatgctgctccggctcggcgaggtgcccacgctggtggtgtcctcccggggagggcgccccccaagttattangacccaanacaangggttttncaagcnggccttaacggcaacaaatggc

SEQ ID NO: 89151 - DNA, 627 bp, Triticum aestivum
  unsure (1)..(627): unsure at all n locations
  Clone ID: PAT_TA_89151
caaagctcccaatacacgccgccgccgcccgacgaaacaggtcataaatctcggtgaccggcgaacgggggcaagatgcagatcttcgtgaagacgccgacggggaagacgatcacgctggaggtggagtcgtcggacacgatcgacaacgtcaaggccaagatccaggacaaggaggggatcccgccggaccagcagcggctcatcttcgccgggaagcagctggaggacgggcgcacgctggccgactacaacatccagaaggagtcgacgctgcacctggtgctccgcctccgcggcggcgccaagaagcgcaagaagaagacctactccacgcccaagaaggtcaagcacgaacgcgagaagacccgctcgccgtgctgggctactacaaggtggacgacgcgacnggcaaggtggagaagctcccaaggagtgcccaaaccggactgcgggccgggacctcatggcggcgcangccgacggcaccctgcgnaaatgcggctcactaccctacccgaggccaaagccaaagnnnacatgattataagggggtgataatgacggnttggtaacgcatgntcatgacttgnaagganttcaaggtactgctaaaaanatcgggnt

SEQ ID NO: 89152 - DNA, 585 bp, Triticum aestivum
  unsure (1)..(585): unsure at all n locations
  Clone ID: PAT_TA_89152
catatctgcagttgcaggtgaactcgtgagccagttcatctccttcctgatgaacaagtacaactccttcagccatgcccggtcagaggaggagaaggcggtggagaggttgcagcacctcctgatgagagccggcaccatcgttgaggaggcagacgcgcgatacataaccaactccgggatgatgatgcagcttaagacgctctcagaggccatgtaccgaggataccgtgtgctggacaactcaaggtaccatgccctccaagacagtgccggcttcgacgaggttagcatcaacgactcatctagaaacagcttatatttagcgaagcgctctcgaacaacaaatgttaaggccacgtgcctcgagtcacatggtgccttagaaagcttagaaactgctgttgttaacatggcagaattgttgcgcttctgggtggatttgatcgtagtctcataggcatacatgttatcttacaccgacaactcatgttgggcncacactgaaaacaaagtattgactcttgttcaacataacacctctagtaacatcacggnnttccctataaagtggaaatantggaa

SEQ ID NO: 89153 - DNA, 513 bp, Triticum aestivum
  unsure (1)..(513): unsure at all n locations
  Clone ID: PAT_TA_89153
ctcactcacggngactaccatagaaatcctctcgctttaggggntccatgtacctatgcgccanagcggntgcttgacggcgaggtcttangagaaggccnngtaaaacngcngcggacgccanagcgtggcgcangcnaangagtggcgggcgtcgnggacggcatgctcgacagccggcantgtcccaaccacatcgctggcttcaacttcaacaatcgcaggggttggagacggnancgccgcggattcgtcgtcgtcgncgncgattatgacggaaccgtctagccgactggtgctcaattcccggntcagnggtcgatggaggccatggcgcggacgtaaagctctcngggagcctgatcatnccgcgtttggngtcatntgtttgcaaangccacgggcacnaaagccaggaggcccggntgtncacgtanaacngcccngctggncanagnccatngcangaagncgtgtaccnggcantngggcngggggcgcttcaatanggca

SEQ ID NO: 89154 - DNA, 579 bp, Triticum aestivum
  unsure (1)..(579): unsure at all n locations
  Clone ID: PAT_TA_89154
ttcttggactgccattatatgatgagggtagtatgattctttgtccaacttgttcggttcgtgtatctccattttctattgcatcatgcagtcctctgtacagttctgtcctcaacttaccttggtttgtcctgtaccaatttagtctccactgttcaatgcacattgctgcatcaactaagaactgcaggaacaaacgtccactcatttgcaatgttgaagcttggttcagacgttgttgtatgcgatacgcataaaactccagcattgttacgtactttcttttacctttgctgcctcttttttttcatactctatttctggtctgaaaccatcttctgcatatggaaaaagcaaggggtactgcattgacatatagcttgggtgcaactctgaaatcctctgtaacattcgtccttgggctcaactattatatcaaaattcataatttccccttcctgttcccaataattaagtgctgcgacttctgaggaaatggaagttgtaatgccgtcancttcgactttggtgataactaagctaatcttaaactcgtttgaacntcctgcaacaatattt

SEQ ID NO: 89155 - DNA, 174 bp, Triticum aestivum
  Clone ID: PAT_TA_89155
cagcaacaacaacaaaatcgtcgacatgtctttgtttcttagaacgttttgtggacctctctctcttggccaacctgtgcataatttcgatcaagagaaacatccttaatttgagttcgctcttgagacacatttttgttacaccgtaaactttgacactaaaaaaaggggggg

SEQ ID NO: 89156 - DNA, 547 bp, Triticum aestivum
  unsure (1)..(547): unsure at all n locations
  Clone ID: PAT_TA_89156
gcctcctgttcatccgctcccccctcccgccgccgcctccagcctagggtttcctcccgccgtccgccacacccgccgccatggctcgccgcagcggaggaggaagatcttcccgccctgctccacgtgctgctccagtgagaaacccaccagcgccagcccgtcaagctcctccacctgctactacccanagcagcggtgggtgggtatcatgagcgggaattgggtcaactantgctcaaggcatggcttttgggtactgggaagtgctatggcgcacaaggctgttgatgctgtgatgggtccccgttncaattcaacaataaaatgtttcggtgangctgctgatctaatgatccaatgggcaaanctgctgatganaattgtggaaaccttcaaaggcttcaaaattgatcaacaattanggaagganntcaanaaatgcaantctactcnaaaaggcnaacaattcccccttgagganaagantggggnaanctttaacaacaacttgcntgattggggtaattggccgngcngntttaac

SEQ ID NO: 89157 - DNA, 356 bp, Triticum aestivum
  unsure (1)..(356): unsure at all n locations
  Clone ID: PAT_TA_89157
gggaaggcccaatcagggggcgtcttgaccacctcgctactggccaacgctggccgatcaagcttctgcccgtcgtactcggaaggtggccatggaagctttggggtgaacttggtagccttgtgtaatcatattttttcgtcttcctagatgattgtcagtattgaatgatttattgtcgaactactaagtaaaatgcaaaacgcaagggaatattttgcctacgccttgttattagctgtttttataatgagcaaaaaaatcctatgtcttcgaccatctanggncactgtacctggactattgttacctatattttttaaataataaaaatatttgntgtcaaaaaaaaaaaa

SEQ ID NO: 89158 - DNA, 540 bp, Triticum aestivum
  unsure (1)..(540): unsure at all n locations
  Clone ID: PAT_TA_89158
ggactgaggaaggccacaatcagcaactgaccctgtaataccttacctagctagctaggtgtagtttgcttgagccaagatgttgggggtgttcagcggcgaggtggtggaggtgccggcggagctggtggcggccgggagccggacgccgtcgccnaagaacgcgggcgtcggagctggtgaagcgcttcctcgccggcgccgagcccgccgtgtccttggagctggnatcnttgggnaactcgctaatnccaangcaaacaattcctcctcctccaaaggcctttncttcaaangataaatctctcctgttccaaggaatccttgacaacntngggcggctgaancaagaaatacggctctccaaaggccggaacaagtgtcctcctgatnaaggctanaaaaccttaggananggccctaaccgcaactnaanttccaatnaccggaataaccnttggnttttaaaatcaaatctccccncgtnnaacaaccgnnggaaggcccctnttggganaaggcaaggggttccttccaaaa

SEQ ID NO: 89159 - DNA, 566 bp, Triticum aestivum
  unsure (1)..(566): unsure at all n locations
  Clone ID: PAT_TA_89159
cagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaacggcgaaaaaggcgtccgnaaanagcggnaagccgctgcactacaagggnancggccttcaaccgcgtgattccccgacttcatgtgccaanggggggcgacttcacccggggcaacggcaccggcggngagtccatctacggggagaaattccccgacgagaagttctcaanaagcacacaaagcccgggatctctcaatgggcaaagcgggggccaacacaaanggtccaanttctcatctgaacgtcccctgaattggtccacgggaagnactggnctccgcaagtctcaaggnatgacgtctcaaganatcaaaaagnggtccccaacggaactgtcaacaggggnatcacatggggaatctaatngccgcccggtcccttncgtct

SEQ ID NO: 89160 - DNA, 485 bp, Triticum aestivum
  unsure (1)..(485): unsure at all n locations
  Clone ID: PAT_TA_89160
gaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtncaagggacgcngtgccgcngacngtggagaaattccgcgcgctctgcaacggcnaaaanggcgtcngcaagancggcaagccactgcactacaagggcanctcgttccaacgcgtgatncccgacttcatgttccaaggnggngaattnaacaagggcaacgggaacggcngngaatccatctaccgggaagaatttcnccaccaaaaattnctccanaagcanaacaaagcccggattctctccatggcaangcngggcccaanacaacggtccaantnttanctggacgtncccgnaattggtccacggaananatgncctncggaaggctccaaggga

SEQ ID NO: 89161 - DNA, 598 bp, Triticum aestivum
  unsure (1)..(598): unsure at all n locations
  Clone ID: PAT_TA_89161
ccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcaagcaaggttgggttcatcttccgtgagcacaacgcatcccctgggtactatgatggccggtactgggacaatgtggaagctgcctatgttcgggtgcaccgacgccacacaagtgatcaacgaagtggaggangtcaaagaaggagtacctgacgcgtattccgcatcatcggattcgacaacatgcgcaagtgcaatgcgtcagntnatcgcctnaaacaacgggctgcaaggatcccggnaaggctaaanagtcatcacgacaggcatattaaatgcatgcanttggnaancgaatggntgggttcctccaattacttcn

SEQ ID NO: 89162 - DNA, 395 bp, Triticum aestivum
  unsure (1)..(395): unsure at all n locations
  Clone ID: PAT_TA_89162
gccagattccgcccgccggcgaggaggagcgagcccccaatcccccatccccatcccccaccaatctcccatccgatttcgccaggcctggattctccgccccggctctgattgctccgcttcggttcgcacgaattcgagagggcacgttttcgtcgggagggatgatgctggtggccaaggagttcggcgccctctcgcccccgggggcggtggcggcgcagcggaggtgggccccgccgtcgacggcgagggtgtcgccgcgcggggggtcgccggtgggggacctgtggctgcggacgcggngaagcngngacgggcccggcgggaagccagcacgggagccacnagagcgacatggacctggcatgctcgtcaagcaacttctcnagggc

SEQ ID NO: 89163 - DNA, 455 bp, Triticum aestivum
  unsure (1)..(455): unsure at all n locations
  Clone ID: PAT_TA_89163
gtctcgagttttttttttttttttttttttttttttttttttttttgaccaaaacataaccacaccaatttcacgattaccattacaaagcaaatcccacaattatcagaaagttttcaagacactcaacatctgatagttnccgacacaacattgggagaatccactggacaaccaatagaagcaagagcaaaaatnctggacgaaccgcntaagattttaacaatnaaatggcgattaacaattngnctccttcaagccaatgtggaaagtncaaggaannttggttaacaactncccncttggtataagngaaaaacaagncnggcaanaacaaggaaggtccccccaaaaaagnaatgtaaggcccttgaccttncnaaaaaanaacntnggggaaaccnaaaatcctcctngaaaanntaagggaaaccccttaaacttggaaaaaaggt

SEQ ID NO: 89164 - DNA, 609 bp, Triticum aestivum
  unsure (1)..(609): unsure at all n locations
  Clone ID: PAT_TA_89164
ggaattgcttgctcaaccccgacggtgtggaccgtggagtgagctcctccgaagttgctctagccaaggccccacgccgagtgtccagactggactagagctcctcctcctcctgcataaatcccccaaaaccccggccggccgagtcgttggctctgaactctgagtacggcgcaagggagcacttttggggctgactcttcgccggcggcatgttcctgcggcagagccatcccgtcgtgcacccggacccggcggctaccgctccggccgcgcaggggcaggggccggtggctgctgctccggctgcggtggcgcaagcgcaaggaccggtggctcccgctccggctccggtggcgcaagcgcaaggacaagggcaagcggcanctgccggcggctcaagcgcaaggacaaggcccggntccgggaacggccgcgggggcgcaaggggcgaacgcgaacgggaaccgccgccgcccgggtgtgatggtggacctgcgggggcgccggggancnctggggcncgggccgctccgnagngctgtccggctcgcgtctctaangctcaacganantcgnggtaacgcttcgctctntanaaaacttgaa

SEQ ID NO: 89165 - DNA, 641 bp, Triticum aestivum
  unsure (1)..(641): unsure at all n locations
  Clone ID: PAT_TA_89165
gaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctcggcaaccgcaaccaacaaggcgagctccggcgggatggagatggcggccgagaacggcggctgcggttgcaccaattgnaattgcggaacaagntgcggtggctcctgttgnacntgcaanatcaacaaccantaatgcatgaaccgttccttgcttgnaacaatcnattcgnancgntttaactaatnncaaatccaagttaaccgaaactngatnnaagggcnttaatttcccactgacctgataaaaatcaagngcaangcaatnttntaaaaaaggccccnaaanaaaacccccttggttaactaaaaaaaaggggggnccggttccaatttccccaaaaggngccnttaaccccncaaaggggcctttttaaaacccgannggnaaacccgggtnccaanttaanctttggaaaaacccntttccaaggggntaaanaaaggggnccnctttcctcccaaatt

SEQ ID NO: 89166 - DNA, 614 bp, Triticum aestivum
  unsure (1)..(614): unsure at all n locations
  Clone ID: PAT_TA_89166
caaaactatgtttagcaaccaactcttaactctttagggtgaatttttggcacatcagatattgatggactagtcaatgggtttacaatttttcaaatgaacttcacaaattcacatggcgtctccaatgctcacaaaatagtacattgtgtgagcatgctagttcctatatatgaatacttccccttaattccgcacatagaggacatataggaataaaatatttctactccttgtagtatctgagtcgatacatttgcaaaaatgtgtgaagatagctcaagctgttacagtggcaaaaaatgtggcaagatagcgcattctgttgcatttgcaaaaatgtggcaagatagctcattcttgtaacgaagcccggtgttgcttctcatgccaaacgtcctgtggttcggttcttgaattgtgttgctgtctaacagcagttttttagaattcagattgcaactggtgctcatgtgctaaactggttggtttatgagctgaaattgggcagtaactgtgcaacanaagtgtaatggcnactctttntgaaantnaaaactgcagtttcataanggtaatgtcantcattaaaaantcaaggataactttatcct

SEQ ID NO: 89167 - DNA, 574 bp, Triticum aestivum
  unsure (1)..(574): unsure at all n locations
  Clone ID: PAT_TA_89167
gtctcgagttttttttttttttttttttttttttttttttttttttttttttttttttttttttttttaaatccccanattctttggnatttcatttcattgttgcattcatccttccanaacagttgcaatgtaaaccttgcagtgttgctgaaatactgaacgggtctgctagtctgctaccatttcatctaaggccacacaccatgttcccaatagagataccaataacatggggaaggtaggcaagcaacgcaaagacgtgcacagcacaacactagccaaacaaacatcaccaagtgtttacttcccagggcaaaacaactcacatgctacagctaatttacaagatcctacaagattcttcctccccttcttgtgtgacgggtttgcnccattgtcaagtatntagcaacattgtcatgcaaatcacggngaaaacaaccacngtactaaaggcttananctgggtacccccgtgcctggccgnanctngctgaattcacaaaacccccgcanttgcccaaagaagngttaangtcagtccacaaanagccncaggaagggccccnnn

SEQ ID NO: 89168 - DNA, 495 bp, Triticum aestivum
  unsure (1)..(495): unsure at all n locations
  Clone ID: PAT_TA_89168
ctctcctctgtttttctctctggctctcatggaggcctccgtgctcaagccgtcggtgctgctccctccggcgaggggagcgccctccacggcgcgggggcgggagcggggctgcgtcgtcgccggcgccggcagcaagagactcgagacacggcggccggaagggagcagcagcgacggcgcgcccaggagcgagccggccagaggattccacgggcacgtcctatccctgacggcaacggcagcggcggccatgagcagcagcgccgccgccatgccgtgccacgccgcgaccgccccggcggcgcacgggccaccgctctcctactactacanggcggcgatggtggtgggggaactggacccggcnacggcnaaggtgtgatcggggtgcgggggccggcctntcggcggtgggttccggtcctnggccggttnncaanccgggnacccaggntccgnaacaaattcccaactggggggtacccccaaagg

SEQ ID NO: 89169 - DNA, 392 bp, Triticum aestivum
  unsure (1)..(392): unsure at all n locations
  Clone ID: PAT_TA_89169
cttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttggactgatggacttaccaatccttgatcgttacaaaggacgatgctatcacatcgagcctgttgctgggggaagacagcaatnggtncggtaaggtanctaaccatnanncccaattttaaaagggtcccgttacaacanngttaactccatgg

SEQ ID NO: 89170 - DNA, 439 bp, Triticum aestivum
  unsure (1)..(439): unsure at all n locations
  Clone ID: PAT_TA_89170
tcctctcccactcccatccccctctccaatggcgctcgcctccaccaccgcctcccgcctcatcagccgccgcctcgccgctcccctcccgcctcctccttcctcttcctgcgccgcgccgcgaggaggggccaggccagggccgcgccggttcgcggtgcgctgggagggcaggccgagagcgctgttgggaggattctcggacgccggcgaagatgccagcgacgacgaggacgaggaggatggcccggcgcgctcagcggtgggccgccgaggcaggagaaggggtgcgaagactcatccaactccgccgccgctgccttctccgggcccgagcgctgggacgtgctcggatccggcaagccatggntgattctcaagcatggtggacgatgaattctccaaaaattggggatanagaaggtacaagaaggcctta

SEQ ID NO: 89171 - DNA, 473 bp, Triticum aestivum
  unsure (1)..(473): unsure at all n locations
  Clone ID: PAT_TA_89171
aggctcttacccttccttgcagttcagattccttggccccaaacttcgagttaacacttctcaggtatctagcgcccagaaacctgtagtcggtcttcggttatatcttgagggtaggaagtgcaatcagttggccatccatgtccagcacctctctagtgtcccaagcatgcttggagactcgatggcatcttcgatgtctgagtggcgtgagtcggaagatacagacccagggtacattgaggctatccaatggaatagttactcatgcatttctacatctgttgtgaatacaaccccgagtgggagtaagagatttctgggggagtttcatcgtcacggggccaactcttcacaaagggaactgggcaaggaagtgctcatctgagntcctctacaacatatccaaagtgcacatacataatctgagtggaccgacacaacannatctcaaaaaggaanttttttaacaa

SEQ ID NO: 89172 - DNA, 493 bp, Triticum aestivum
  Clone ID: PAT_TA_89172
gcacgtaccccgcacaggtttgcttcaatattgtttggaagtgcagaccgctcactgaagatgaattttttcctgccattgaagagaactactatatctcaaagaagttctacttcgacctttcctaccagcaggtcgtccagctatatggcttatttgacaaaaagagggtagagcaccctatttgcaattattcaacaagtgctaatctggaaaaggagcactcaagcagaaggagatcagacaaaaggagcttgactccaaatagtcctcctttttctgctgattgttcccacactttgatacctcgagtaccccaaagatctcaactgtcgaaacaaactgctctgcttctacaagcatgcatctaattgtaccactacttttgagacacagcaagtgtgtcgatgccttgggaactaaacttttgggggtcaaacgctccatccacagcaaccaaataaaactacttatcataggcaagaaatcccca

SEQ ID NO: 89173 - DNA, 173 bp, Triticum aestivum
  unsure (1)..(173): unsure at all n locations
  Clone ID: PAT_TA_89173
ccagccccgacccccaccagacctccgccgcaaaccgaatccctcgccccgccccgccccgccccgaaaccctagctaggcagccatgggcaacccggagaagctgatggcgcagatcttcgacctcaagttcacgtccaagtcgctgcagcggcaggcgcganaagaaaaag

SEQ ID NO: 89174 - DNA, 488 bp, Triticum aestivum
  unsure (1)..(488): unsure at all n locations
  Clone ID: PAT_TA_89174
ccgacctcctccagcgccgcgcctctgccgtcgccgcaccaagttccctgctcctgccgccagagccctgcaccgcgtcgcaccctcaagtgccccccctcgtcgccggcccttgctccgcctcgtcgcgcctctctgcccatcgcccaagcctcccggccgcaagctccttcgccccactcgatctggacgctgggtcccgagagcttgactcgccgtctgcttgctggagcaagcaacaacagcccgtgcgctgcctgggcctcccctgcatcctcctctccgctgaactgggtctcctctaantcctcctcgtgcgttcctgcaacaagcatcacaacaagaagccatgcttccgcgcgtcggttgtcggactcgggaaacaaggaccgcaacaatgacctgaaggacaatanggcgaacgcgacattccaacancgctccgtgcctttttccgctccgtgctcaatgnanttctgccgactccn

SEQ ID NO: 89175 - DNA, 495 bp, Triticum aestivum
  unsure (1)..(495): unsure at all n locations
  Clone ID: PAT_TA_89175
ctggttatggctgcccccgtcccctcacaccccaccagtgataagtgctgcccccacccccgccccctcacatctcaccagcgacaagtgctgcaaaccaacacccactggtgttgtcgatactggcgacaagtgatgaagacgagcggtggccggcgttggggcgttgtaaccacggcgaaaagttatggagatctggccttttgtttttgaaagcagacccaattttgctgctaacgccttcgttttttgctgaaacattcattttttttcttgctacgatgtgttttgctttttgctggaaccaacttcaagacggcatggggaaaaagcttctaccctgggaagaaaaagcttcaatcgggtgtgaaaaagcttcatccggctgcagcaaaacttcaagtgccatgaggaaaaactccaccgtaggaaaaaacttcattggtgaaaaaacttcaaccggtgattaattctggaacaatnaagttttgttgn

SEQ ID NO: 89176 - DNA, 490 bp, Triticum aestivum
  unsure (1)..(490): unsure at all n locations
  Clone ID: PAT_TA_89176
atctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgaccggggaagggcgtcctcgatcagcaaggagtgctgctccggcgtgcaggggctgaacggcctggcccgcagcagcccggaccgcaagatagcgtgcaagtgcctcaaagacctcgccaccaagcatcaanccatcaacatgggcaagtctccggcgtgcccggcaatgcggcgtcagcgtgcccttccccatcaacatttcaacaactgcaacatgtcaactattcatatataaccttcctactgcatcatggacccctgcctggacttatttcacgttgatggg

SEQ ID NO: 89177 - DNA, 501 bp, Triticum aestivum
  unsure (1)..(501): unsure at all n locations
  Clone ID: PAT_TA_89177
tttttttttttttttttttttttttttttacggtttccgcctgattttcattatgaaaaccatagtagtccttacaaacatcaaactcaccccatcagcagagctagcatggtgaaggagacggacctccgaaacactaaactacactctagaaccaactgctactacacccataaaggtaaactagagagtgtcaaaaataggtgcatattacaaagttgacataaacgatgctcgccatgcaaaagataaagtaaataacataaactggggcaaataaccgaactactccaaagagggctatcagggcgaagagaaacatcaatagcacaagaggacgtcatcttcaacaacctgttatgcgcaatatgctangatccatcctctccgacacctgtaatntcactttccaaccgctctaaaatcctgccccactnaattccctttgatttcccngctaaccgtnnnatagacaagcacatcaagtacaagagtnaaaca

SEQ ID NO: 89178 - DNA, 490 bp, Triticum aestivum
  unsure (1)..(490): unsure at all n locations
  Clone ID: PAT_TA_89178
cacatacacacacacaagtgctagctagctaatcgatcagccagccatggcggaggagaagcaccaccaccacctgttccaccacaagaaggagggcgaggacttccagcccgccgctgacggcggcgtcgacatgtacgggtactcgaccgagacggtggtgaccgccaccggcaacgagggcgagtacgagcggatcaccaaggaggagaagcaccacaagcacaaggagcacctcggcgagatgggcgccgccgccgccggagccttcgccctctacgagaagcacgaggcgaaagaaggaccggagcacgcgcacaagcacaagatcnaggagaggtggcccgccgccgcagcgtcngcgccggcggttcgtcttccacgagcacacnagaagaagcaagacacaaggaggcaaggaggcaacggcgagaagaacacacactcggtantnctcctgactcgngtggccggctcccgccggcctnct

SEQ ID NO: 89179 - DNA, 458 bp, Triticum aestivum
  unsure (1)..(458): unsure at all n locations
  Clone ID: PAT_TA_89179
ctagtctcgagtttttttttttttttttttctagtattttattattttactgttaactgagatcagatgggctcaggcgcagaaatggatattcgcacaaaaatatcatgctatgcatctgagcatctgaataatacagatacaacaagcttacagggtggaaatatacactatactatacacaccaacaataccttcagttccaattctanaattcgatnatttgggnaacnatttgggaaancggaatcnnacaccnattaacctggaaaccaccattgggngtaaaatttgnanncgcccaaatttggttcgntccctttgcaancccanagagttttgcnggaccggttaaagananccctttttggnaaaaagnacagtgcccatnttnccaaaanccccnaaaattgnacnttaaaaannttaagcccccccaattcctncccaancccaan

SEQ ID NO: 89180 - DNA, 472 bp, Triticum aestivum
  unsure (1)..(472): unsure at all n locations
  Clone ID: PAT_TA_89180
tggtcttctcggcgtgcgtccagctccggcgaccggccgccttgagaggcaggcgagggcttcacctgacgcggttagctggggctggcgtgcccgcgcgcgcccccttcggtccgttccgccgcccgggcagncggggaggggcgggggcaagggcggcgaaggcccttgcgcgccgcaatgggcggcggcgacctgtacgccctcgacttcgacggcgtcttctgcgacagctgcggcgagagtccctctccgccgtcaaaggccgccaagtaagttggccgtnggcgttttancaagtccaacccgccatggaaaattgtaantggngcaaatgaaaacccttcgtccaattgatagaaccagntaagaaaaccgttcttgtaaggttcttgttaaattcaaaanacctcngcncaaantaacaattgcaaatggcttacaatccaanaatttggcancgggcaaattt

SEQ ID NO: 89181 - DNA, 475 bp, Triticum aestivum
  unsure (1)..(475): unsure at all n locations
  Clone ID: PAT_TA_89181
gccgccggtgccctcccctatctctcccatctgatgcgttccgcccctcgtcgtgctgcagcaagagccacgccgtcaagctcgtccatggccgcccgttgcttaagcgttgccgctgcagctccgttgtcccgtcgtcgtcgtgctcctgtcggatcctcgccgtcttgcctatccccgaccacgctagacctgcctgtgccccgccgatggagcagccggccatgcacggaaggagtttggccgccggntcnacaaccggggccgaagggaagatggaggacntaatnctttcctttcaaaaggccttttgcaaaataaattttanccgggatgaaatacangtttttttgcnatgaaccgtgtcnaacgagacaatgttaaaaaccgggctnaaataggccaaannggaaaagttttttggnaaaaatnacccaaaattaaatttttggaaaaaactgtnaaaggttccgca

SEQ ID NO: 89182 - DNA, 383 bp, Triticum aestivum
  Clone ID: PAT_TA_89182
ggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaaagatatgtgtatgtccatgttcatgttccaacatggtccgagaaacatgctccgtatgagaatgctaccgtggctatgttatatgaacgggacgcataatattatacatatgtccgacatatactttttaaagggtaaaaaaaa

SEQ ID NO: 89183 - DNA, 479 bp, Triticum aestivum
  unsure (1)..(479): unsure at all n locations
  Clone ID: PAT_TA_89183
agtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcctacttgccaccgctcagcacggaggcctccttaagcagtcgactacctgattccgtncaagttggttnctttcctccagttaacaanggtnggttcancntcccttgagcacaacgcatcccctggtactacgatggccggtactgggcaanttggaacttcctattttccggatgcaccgacgcaccanggtattaacgagtggaggagnccaagaaggataccttaccctatttccgcatcatcngttcnacaaatcctcaagngattcgtcaacttatc

SEQ ID NO: 89184 - DNA, 485 bp, Triticum aestivum
  unsure (1)..(485): unsure at all n locations
  Clone ID: PAT_TA_89184
cggcacgagctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaaagactggggaagcatggtcacgcaaagtgtcacttttgttgccattgacatctttaaatgggaaagaactttgaggatatcgttccttcatcccacaactggtgacttcccccatgtttgaccgccaagattatcaactgattggacataactgatgatggtattcaaccttctaaactgagantgggaacactaaggatgactgaacttccactgatgatntccncttgggcaattaaanacggtttnccnnatggaaggn

SEQ ID NO: 89185 - DNA, 238 bp, Triticum aestivum
  unsure (1)..(238): unsure at all n locations
  Clone ID: PAT_TA_89185
agctgcgcaaaggctcgacaaaccctaaccctagtccatagctagcttagcttccttcctctcgatctagctagagccatggcgccgaccaagggcgangggccggccatcggnatcgacctcgggaccaactactcntgcgtcngcgtgtggcaacacgaccgcgtccagatnatcgccaacgaccanggnaaccgcaccacgccctcctangtcgccttnaaagactccgagcgcc

SEQ ID NO: 89186 - DNA, 478 bp, Triticum aestivum
  unsure (1)..(478): unsure at all n locations
  Clone ID: PAT_TA_89186
ctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcctacttgccaccgctcagcacggaggcctccttaagcaggtcgactacctgatccgctccaagtgggtgcctttcctccgagtcaacaaggttgggtcatcttcccgttgagcacaacgcatcccctggggtactaacaatggccggtactggacaatnttggaacttgctatgtccngatgcaccgacgcaccagnnatcacnaggtgaggaggtcaagaagggtaccctgaccctagtccgatcatcngtnnacaaancgtcagggatgctcan

SEQ ID NO: 89187 - DNA, 498 bp, Triticum aestivum
  unsure (1)..(498): unsure at all n locations
  Clone ID: PAT_TA_89187
gttcaacgtccaattatgaaatccttgaaagaaaaggatgaatcgaaatatcgctgctacgccaaaactcggcgcaaagaaccaaccagattgccccagtggataaataaggaatacagaaacaaaaacagcaattggaccagagaatgagattgcattataaggccgcaattgaacagaccgagcaagttcaaattggcgtaacatgaaacctattagtgcaaaagccccgtggagagctacaaaagtccatagaccgcctaattgacaccaacgagtaaaatctccttgtgcttcggggcccccatagtagcaacaaagagtgtgcnaaactattggcaagggtagaaactgctgcggttaagaaattacaaccttccaaaataggaactagccaanccatgggtataccaagaattacaaaagtgtccctgtaaaccaacccctaaagcgaattaagcacaaggaaagagcaataggcagaccacctacaanang

SEQ ID NO: 89188 - DNA, 436 bp, Triticum aestivum
  unsure (1)..(436): unsure at all n locations
  Clone ID: PAT_TA_89188
aantcctcncacccccaccgtctcgccgccgccaccacagctanattncanatcaaganagagcaaaactcgttgggagtgctcgatatctgttccggnagagggggaattcttgagatnggaatcggancaagcggagcgcgctcgngatcagggttaccacnacagtttttcccaggacacctttaatgaatgtgctttgggngtcaancggtggcataangtcgaccattagtcannccctggatgnacgaagctcccctcggctagagcaatgnncacttcgtcatgctggctggcgccaagaaagtctctggcnaagaatcganatgnacgatcngancatcncgcatatcgtntttggcatccccntcccgtagtttaagacntttatggaatttctccagncccttnctcccaacaacctctcnggctt

SEQ ID NO: 89189 - DNA, 416 bp, Triticum aestivum
  unsure (1)..(416): unsure at all n locations
  Clone ID: PAT_TA_89189
ctcactcacggagactaccatacaaatcctctcgctttaggggctccatgtacctatgcgccanagcggctgcttgacggcnaggtcttaggagaangccgataanacggtggcggacgccanagcgtggcgcaggngaaggagtggcgggcgtcngngacggcatgtgcgacagtcggtagtgtcccaaccacatcgntggcttcaacttcaacaatcgcatggggttggagacngnatcgccgcggnttcgtcntcgtcntcgtcgattataaccgnaccgtctagcctcantggtgntcaacgtcccggcgcggcggtccganggangncatggcgcngncgtnaaagcatntcccgcgagtctgcccaagcccgcgttngngtctccgngtttngcaanncgcancgggcac

SEQ ID NO: 89190 - DNA, 479 bp, Triticum aestivum
  unsure (1)..(479): unsure at all n locations
  Clone ID: PAT_TA_89190
gcgcctcctcccttcccctcatcgtctccggtcagccaggtagttaacagctccagcagccatgggcaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtctttcaagtacgcctgggtgcttggacaagctcaaggctgagcgtggagaggggtatcaccattggatattgctctgtgggaagttggagaccaccaaagtacccctgcactgtcattggatgctccctgggtcacccgtgacttcatccaaagaacatgatcnactggggactccccaagctggattgtgctgtgcttaacatggancccacaactgggnggtttttaagntgggatctcccaagggagggcaaaccgtt

SEQ ID NO: 89191 - DNA, 390 bp, Triticum aestivum
  unsure (1)..(390): unsure at all n locations
  Clone ID: PAT_TA_89191
tttttttttttgcgaataaaatatagatatcttatatgaattgcaaatacgatgaatagttcacaataggatccattacagatacggtaagatggttcaaaactcaggcaacggcgtccaaaagtagagccacagttgaagcatatgtaacaggactaagagagaccggtagaaacctacatggaatgccttgcctggtatctgaagtagaaggcaaatgtcaccttctttgacgttggtgtcacgacgaaactctgtccaatttgttgtgatggtggcttcttggcattctttcaaatgaggcaagaaataacggagacatcaccatccgcaanttcattgggttatgcgacacatgtgggatggatgtaacccttggggatactctcc

SEQ ID NO: 89192 - DNA, 241 bp, Triticum aestivum
  unsure (1)..(241): unsure at all n locations
  Clone ID: PAT_TA_89192
ccccgatcccctccaccttcctcctggtcaacaccccatgcccagatccacgctactccggngaccttgtgcccccacgcggcgagagcgctgccacccatgagcctccctgtatgatgccggcgatcctctccaactccctgcgtgacgtcggnagcgctcctccccanctcccctgcttcccccgccattgctaccaccaccacctcccctgcntcnccccactccactgncgcaccac

SEQ ID NO: 89193 - DNA, 499 bp, Triticum aestivum
  unsure (1)..(499): unsure at all n locations
  Clone ID: PAT_TA_89193
cgagtttttttttttttttttttcaaagagaggccatcataaaattataatgttaaacataggagtatcacaaaagatacataccaatagcagaaaatgttactacaaaagaatggaaatttacagatctcgagactctatcaactactctgccaggactctggggaagatcgatggaaaaaaccagagcaataatcacgtccttgccttttgttgatctaagtataacattcaagatccttccaggcacataaattctcttccttatggccttcccatccaaatatttggagagctctcgtctgaggctgctatttgggaacacatcatcctcggagcactccttgtcaacaaggattggtacccctgggcttcccattgatttgcacggggagcacatctctgatccttcanatactcaatctttgcctccgggnaactgttcaatgggccaatgatgtgagtggtccaaagacganacaangccctcanccaantg

SEQ ID NO: 89194 - DNA, 436 bp, Triticum aestivum
  unsure (1)..(436): unsure at all n locations
  Clone ID: PAT_TA_89194
ataatattttcatcggaagagtttcataagactacgcagtatggcctctcttacgtgatcgggaggaactgtaggtttctccaaggtcccaagaccaatcagtttagtatccagcgcatcaaagacaaaatagaagctggcgttgaacattgtgaagttgtcttgaactatcggcgagatggttcaccattcatgaacctcttcatgtgtgcaccattgtgtgatagtaaaggaaaaatacgttacttcattggtgctcaagttgatgtgtcaggtccaagttnaaagaatgctctgagctcnnaacatttagacgtccttgtcgctcgcgtccnaagaaagtgtaactaacgaagctgnaaatgatgaaattaaaggatgattccaanaatttgttgaantgcntaacccccngggaaccnnaactatantggga

SEQ ID NO: 89195 - DNA, 487 bp, Triticum aestivum
  unsure (1)..(487): unsure at all n locations
  Clone ID: PAT_TA_89195
caaatccagccccctccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctgggctgactacaacatccaagaaggaatccacactccacctggtgctcaagactccgtggtggcatgcagttttcggtcaagaccctgaccggcaagaccatcaaccctggaggntgancctctgacaccatccgacaacgtcaaggcaagttcaaggacaaggagggnatcccccggacaacacgtctcatttttggctggnaaanaactcnaggatgggcgcacgctcgctgactacaacatccangaaggaaccaaccc

SEQ ID NO: 89196 - DNA, 356 bp, Triticum aestivum
  unsure (1)..(356): unsure at all n locations
  Clone ID: PAT_TA_89196
ctcaaagacctcaagaaagagttttgctgcaatggtacagttgtccaggacacagaacttggacaggtcattcaactccagggtgatcagaggaagaacgtctcaaacttccttgtccgggccggcattgtgaagaaggaacacatcaagattcatggtttctgaacaactgccagctccatatcaagagtctacatgcaaagcagctatatattggtggtgcagtatattantttgtgttgctaagcgcaagcaagcgttaccancttncccgctcctgagttatacgggaaatctaacatagccaaccctcctggcgtgtatgcttgtanccctgnggttgaacnttnttaagg

SEQ ID NO: 89197 - DNA, 344 bp, Triticum aestivum
  unsure (1)..(344): unsure at all n locations
  Clone ID: PAT_TA_89197
gccaccttccctcctccaacaccatggcccccactgtgatggcttcctcggccacctccgtcgcacccttccagggtctcaagtccaccgcgggcctgcccgtcagccgccgctccagcagcgccggcctcggcagcgtcagcaacggcggaaggatcaggtgcatgcaggtgtggccgattgagggcatcaagaattcgagacctgtcttacttgcaaccctctccaangggaggcctcctgaaacaagtcgactactngattcgctccaaatngggtgcctgccccaantnaacaaggttggttccttttccctttagnnaanaattcccccgggtataaca

SEQ ID NO: 89198 - DNA, 500 bp, Triticum aestivum
  unsure (1)..(500): unsure at all n locations
  Clone ID: PAT_TA_89198
cttcaggcgcgccaccgcccacgccttctcctggcgccgccgaccgcctcctcccggcgctccaccgccccaccttgccttctcccggcgcgtccagccccgcctcccccctacgcactgcccccgcctcctcccggcgccgccgcccctgcctcctcctggcccgccgctgatctcgcctctttccggngagagtccgacccgcggctgttcgtcgccctgccttttccatgccggncgcctccttcttccccctccactacgcgccaccgccgccgcccangcgcggctcgatccaagcgccgccgcccagcactaccaagacccggcccgccgcgcccancaacatgancccctctggcgcgcaaatccgatnttcctctgntcnggngcgaacttccatccctccaatgcngnctgcctctcntccggngcgcctctctcngnacanctcctcttnnagctctcatcncaagttgtncctgaatgcgangtgcann

SEQ ID NO: 89199 - DNA, 481 bp, Triticum aestivum
  unsure (1)..(481): unsure at all n locations
  Clone ID: PAT_TA_89199
gagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaagtccgcactgacaagactacctgctgggttcatggcatcattncaatcccaaacnggtgagaatacagnttctttatanacaanggcncttccgcctnancctgtcaaggatangatcnaatcaactctgaagncagncgtcatncggcaaaaggatccctacctgaacactanatggcgcacatccgtaccaaac

SEQ ID NO: 89200 - DNA, 498 bp, Triticum aestivum
  unsure (1)..(498): unsure at all n locations
  Clone ID: PAT_TA_89200
gggagccgaggcagccactgcgccgccagccccgtgcagctcagtcctccgcccaccggatcacggcaccgtcgacacaaagtgcaccaccagtccccgcccactgcacttcatctcggttcgttgcctcgccaccacatcgggcttccctagcggcctgacccgcctttcccggtcagccccggcgaccacgagctctcccggagccctcgcgtccggttgtcgttgaagtgaccacagtgggaagccgccagcaatggagcagatccaagctcaacgagcaccgctgggttcatctcancngtcgctggacaaggtaatttttgcaaattctgttccngtanactatttgctttnacttcgtgcaattcngaatttatttaaccccaagggngnagtgttgatcaatggatctgcnatanagcgggcttgattttgggacaatttcaatccttcggngaaaaagttagntcattcaacnccttgggtcataaccaa

SEQ ID NO: 89201 - DNA, 495 bp, Triticum aestivum
  unsure (1)..(495): unsure at all n locations
  Clone ID: PAT_TA_89201
aatcagttacagacacttgcagatccatcaatatatggcaacaatctggggctctgtggcttcccgttgagcgcgtgtgagcctacgttgggccagggagctggagaccacaaagaactcagggacctggggctgtgttactctgtaattattggcatcgttttcggctctggctttgggttgggagctccgntctccctgggagcaatggcgttangtttcncccgttggngtttacggcttaaggattaagtaantnttcaaggagctnaggctcccanatgttaatccacaacaaacganattttcgnggattntgtccggnatgccccttttatccttnaantgtttanaccnaaacgggactntttcancagttaaaattngagctntggggnganatanacccccccgatnttatccgcaaaaaggggggccggaccatttcccanangggccattatcccgccanggctctttaancccgacggnaan

SEQ ID NO: 89202 - DNA, 345 bp, Triticum aestivum
  unsure (1)..(345): unsure at all n locations
  Clone ID: PAT_TA_89202
gaaatctcctccgatcgaagcgaagccaaggctctctcgtccccctcctcaagatgcagatctttgtgaagaccctcaccggcaagaccatcacccttgaggtcgagtcctccgacaccatcgacaacgtcaaggctaagatccangacaaggagggcatccctccggaccancagcgcttgatcttcgctggcaagcagtccaggatgggcgcaccctggcagactacaacattcaaaaagggtcaaccttaacttggggtcnaagncccttggggggaatcaatatttttgaaaaaccnccccgggaaaacannaaccctgggggtttatcnccccggaaaaa

SEQ ID NO: 89203 - DNA, 513 bp, Triticum aestivum
  unsure (1)..(513): unsure at all n locations
  Clone ID: PAT_TA_89203
gacgttggtactaaaggacatggtggaattccagcatacattggtgtatgcataatcagtgccttttttgggacatctgatgcgcttgttcaaggtggcttggttggcgacctttctttgatgtgcccggagttcattcagtccttcctgtcaggcttggctgcatcaggagttataacatcagctttgagactaattacaaaggcagctttcgagaactcacaaaatggtcttcgaaatggagctatgctattcttctcggtaacatgcatgttccgagctagcttgcctcctcctatacgcatttgtctttcccaaattacccatcgtgaagtactaccgccaaaagcagctctgaagggagcaagacgtttggaacgaccttgctgctgcaagaacaaaacgattaaagataagaagttnangaggntcccaaaagcacaactttaagcacaaggactgctgatncagaatatagacatgcttgggatactcctgataangtctggaccn

SEQ ID NO: 89204 - DNA, 496 bp, Triticum aestivum
  unsure (1)..(496): unsure at all n locations
  Clone ID: PAT_TA_89204
ctagtctcgagttttttttccccttccctcatctcctccatttcatcttttctctctgtctcgagctggcttccagattgctctcttcatgtgcttgttcctagacatcaattctggacctcgtattacagcataaaaagacatctttagcaggcatatcattttggtggtagctggtagatagctaccgcctgggaaatattgtggtctgggtgatgcccttgggtctttcttgtttgatgggcaagtgctaacacaagcgggttccgccttgtgaggtgcccaaagtgtcntaacattctaccaagaacctgcaaatgtttcaatctaccaatgcggtgggatgttacacacccttanagctaaaaccgtgtcancgatgccacaaaacaanttgggaaganccggggataccncctggtcctctgtgaacaagggtgtcncaaaacagtcngnaagaccgggaataaccggtggtacnccggnacaagggggn

SEQ ID NO: 89205 - DNA, 367 bp, Triticum aestivum
  unsure (1)..(367): unsure at all n locations
  Clone ID: PAT_TA_89205
gcacttctaaacctcctcctcctcctcttcctccccgtcctcgtccccgtcccgcaccgccgccgcattgctcggccgcggcgtcgatctagactctagggccgtctgcatttctgtgtttccgttcgaatcggctgggtgctcgatccgaggggcgggggagaaatgtgggtggcggaccggttgtggggaaacgccggatgccggaaattcaacgcttaaccggaacgccaagtcaacaactcngctcatgtcaacaaccctgnttcgnggaacttcnggnggaaattngganccgcaacagacttaaccagtgggcacgtaaattccaaccnnanggggttttcnagaaaanaacccgtccaag

SEQ ID NO: 89206 - DNA, 160 bp, Triticum aestivum
  Clone ID: PAT_TA_89206
aattatcctcgagtctatgaggtggtgtcggtgaacatcttcggtcagtggttatgtttgcgagaacaagaaaaacctatctgtggtctgtggtcatcgcttgtcaaactgaatcttaatcgtcaagtggatgctttgcttggttatcaaaaaggggggg

SEQ ID NO: 89207 - DNA, 506 bp, Triticum aestivum
  unsure (1)..(506): unsure at all n locations
  Clone ID: PAT_TA_89207
gagcaaggcagcgcgccgccacccacccatggagtcgctcgccctcctcagcgccaagcccggcctctctctccgggcggggccccgcctcccgctcccgcgcctccgggccgcccgcgcgtccctctccaccgcgtccagctccaggcccgccgcnctccagtccccactcctctcgtcgaggcccccctcctcgcaggacgccgtcctggggtatgggctcttgaagcgcaggaccagtgctggtgctggcgtctcttgcagcgcggcggacgcggcggnggtgccgcagcccccggtgcagccggaggtcaagaagttcctcggcgtgggcctcncgacgctcaagaagatnntgcccctgggcctgatgttcttctgcatcctcntcaactacacatcttcgggacacaaggacgtgcnggtggtaccgccaaggggagaangcggaatatcccttcctaagactgggtanctgccatggcatnggntcanctcgatatcan

SEQ ID NO: 89208 - DNA, 289 bp, Triticum aestivum
  unsure (1)..(289): unsure at all n locations
  Clone ID: PAT_TA_89208
cgccctcaagcgcgccctcctcgacgccaccgccgacgacgccgtctcccgcgtcatggccgagctcaagagcgccatcgaggagcagcgctaccaggacgcctccaggctgaccaagctcgccggaaccagcttggtaggttggtgggtgggatatgcgaaggacaccgatgactcgattgggaggattgtgcggataacccctggtgtccggagatacntcgccaagaactacagcccaaggaattggncatngantcttcaaggaancattatttggaaantcccc

SEQ ID NO: 89209 - DNA, 302 bp, Triticum aestivum
  unsure (1)..(302): unsure at all n locations
  Clone ID: PAT_TA_89209
gttttgcatgggaaactctcaggcttgctgtcacgaagagacttgttgtctgggaaagctcctttaacaagtgccgtccacttatttcatgcccagcttcccattcccagacccaaatccttcaatttccactcctcagttgtgacaaataaatgactttgccacgccggattcgactgggctaacaatgggttcctgccacacttgcggtagaaaataattgctcactggacaaagcaaatattttatatccgccaagntttcanacccaaaaatgcgtanattcaaggnaagctttacac

SEQ ID NO: 89210 - DNA, 466 bp, Triticum aestivum
  unsure (1)..(466): unsure at all n locations
  Clone ID: PAT_TA_89210
gtttgtaggcctcgtagttctgctgctctcctcgccggcgccatcggccggtgaccagctgttctgcgccggcgccaacagcaagtacagcccaaacagcacctaccggaccagccttagattcctcgccgatgaacttaccgcgagagccatgaagtcccactcggccactggcacggccggcacgggctccgacaaggtctacggcgccgtgctctgccgaggggactccaccggcgccgactgcagcaggcgcctccgggaggccttcggcaggaccatcaacgccgacagcaccggggccgccgcatgcgcgctccacaaggacgtggcgctctactccgagctgtacaacttcgcttctccgacgangactcctctcgcctnaacaagcgccttntggtcnacggnacaactgaacctgtnccggcgccgatgctgggaattnacaactgtcgcaactaan

SEQ ID NO: 89211 - DNA, 464 bp, Triticum aestivum
  unsure (1)..(464): unsure at all n locations
  Clone ID: PAT_TA_89211
gnatttcgtcnancanaggacgcgcatggcgatggncgcnccccacgtctcgcactcgcagccacccgcagggngcgccgctttattcgctcacccnacnaccgcntataactcctcccntctccgnctccctctcggncgctccgccgtcnggcncgtcngcctctacnccgtctccacngatgccgcccctggcatagtacgtccgccgctatggnnnccgtgggcnactgatggctcancccnntcgcggaggccnacaccggaggtgtacgacctcatcaagcgcgnnaagcgatccatcgcacgggcattanctaatcacgtctntgancttcatctcactcgcnntcatggaagngctcgggtccncgctcatcaaaaagtactcgaaagtcataccgggnncgctttacggcggaaanagtaatcaacaagtccaggactctgcggaccgcgcctta

SEQ ID NO: 89212 - DNA, 464 bp, Triticum aestivum
  unsure (1)..(464): unsure at all n locations
  Clone ID: PAT_TA_89212
gatcaaaaatccctagcgcagccgatccccatcgggcctggctcatctctctctctccctcacccctccttctccacctccggncgccancacggncaggccggngtgttggtgcgcctcccacctcatcanccatctccatccaccactccancatcacctccatccatcagngccgtgccacccagcanctcnaccangcaccaccagnaccactcnagatnacctcacgcaactcaccatacagagggtcggcggtgtctgatcatcgcgcgcccgatgctggtgcctccttcntcaacctgctgcttcntcntcctcacctcggctgctgttgctctgctcntcttgcgcatcatgttgctgtcctctgaaaccctcatacngctgcnccaatcttcncaanttgcngctgctctgcttantcnacctccttgcacgctgtggnggcttccccngcgcct

SEQ ID NO: 89213 - DNA, 331 bp, Triticum aestivum
  unsure (1)..(331): unsure at all n locations
  Clone ID: PAT_TA_89213
acaccacctaaacaaacaagaggcggaaagcgaccaaatctcgcgagcgaaatccaccgcacgggctctcccctcccctccccgcaccccccacgcgcgcgatncgggcggagatggacgccggcggggcgcagccgccggacgcggngatggcggnggccggcgccgcggcggnggncgctgnggggtcggcgccgggcggngcgatggacaacatccaggccacncttatncacggtgggaggttcatccantacaacatcttcggcaanatcttcgaggtcacggccangtncaanccccccatcctccncatcnnaaanggcgccta

SEQ ID NO: 89214 - DNA, 473 bp, Triticum aestivum
  unsure (1)..(473): unsure at all n locations
  Clone ID: PAT_TA_89214
ctcgccgagaaatctcctccgatcgaagcgaagccaaggctctctcgtccccctcctcaagatgcagatctttgtgaagaccctcaccggcaagaccatcacccttgaggtcgagtcctccgacaccatcgacaacgtcaaggctaagatccaggacaaggagggcatccctccggaccagcagcgcttgatcttcgctggcaagcagctcgaggatggccgcaccctggcagactacaacatccagaaggagtcaaccttcaactggtgctcaagctccgtggtggcatgcaaatatttgtgaagacactcaccggcaagaccatcacctggaagttgagtcctcggacacatcgacaaagtcaagggtaagattcaagacaaggagggatcctccggacaacancgtctcatctttgctggnaacaactcaaggatggccgcaccttctgatanaacatcaaaaaggntca

SEQ ID NO: 89215 - DNA, 472 bp, Triticum aestivum
  unsure (1)..(472): unsure at all n locations
  Clone ID: PAT_TA_89215
tttttttttttggaagtagctcaaattttattagagctcggttaagtccaatcacacatcatacatacaaagtgttttttagttgccagtagtacttgagaatttctgaaacggtcctagaggcccagatcggggatgcagtagtcatctactcgaatttatctcgagcagaatgagtcgtgctggcatccccgctgccgctgctgccgctggtcaccgaggaaccaaaagaatcgtcagccggcggctgcatcangtaagttgccaccggcatcttccccgggaagcttngcngngggaactccaaacgcancanatcacggctgcctgaatggacggctcaaggcgggtcaaggggtcccgcacaaaagcccgaacaacatgatacactccanctcttctcgtcaaactgccgtcaaacgcgcgtcngntgccccaaggataaccctcnggcgtgcgacccanaccaang

SEQ ID NO: 89216 - DNA, 469 bp, Triticum aestivum
  unsure (1)..(469): unsure at all n locations
  Clone ID: PAT_TA_89216
cagtcgagtcggccggcgacggcagtctcctctctccgctcgccagtcgccaccgcttccgctttgcctccggcctcgtcggcatccacctcctccggccgcacgcccgcgacctcaccagcgtcgccccccgggactaggcgacgccagtctccactcgccactgctcccgcgccgcctccgatctcgccgccatccatccgtcccggccgcgcgcccgcgcacctcaccagcgtcgtcgacgtggcaaagtgtgacgcctgccctcagcgatgcagcagaaggtgcgcgtcgccgcatccaagcaatggcgtgctgcctgaagacatgctgcgtcaatcctcgtgcgcctcccggcaaagacgctatgcctcttccgagcagtctcccgattctggangtcctcctctcagatcgctcttcgttgaacgcanagtccacaacccgggcactgantgtacatgtacgg

SEQ ID NO: 89217 - DNA, 465 bp, Triticum aestivum
  unsure (1)..(465): unsure at all n locations
  Clone ID: PAT_TA_89217
ccgatctcaccgagaaatcgacgcgaaggctctctgcccgtcctcaagatgcagatctttgtgaagaccctcaccggcaagaccatcaccctcgaggtcgagtcgtcggacaccatcgacaatgtcaaggccaaaatccaggacaaggagggcatccctccggaccagcagcgtctcatctttgctggcaagcagcttgaggatggccgcacccttgctgactacaacatccagaaggagtccaccctccacctggtgctcaagctccgtggtggcatgcagatttttgtgaagaccctcaacggcangaccatcaaccttgaggtcgagtcctcggacactatcnaaaacgtcaaggctaagatnaagacaagganggnatcctccngaccaacnangtctcatcttccctggaaacaacccaggatggcgcaccntnctganaaaaatcnaaaggngtcaccc

SEQ ID NO: 89218 - DNA, 477 bp, Triticum aestivum
  unsure (1)..(477): unsure at all n locations
  Clone ID: PAT_TA_89218
ctgcctcctcatcgtcctctgccgccggcgacgtactgcctctgatgccttgtcccgattggggcggcaaggttataagctggatttccagcggcggagctatcctgggctccctgttctacaggtgcgtcaggaaagatgctggcctgtgtggattcagatccaccgaggtgtacaccgccgtgttcatgaatcttctagctggcggccgatgtcccgtgtcctgtgtattcatgttgaccccacaagatggatatctattagtaatgtgtactcattaatgtcctggttaagttatccatcatgtagtaatattaaaaaagcaagtaatgggatggtcngtantttgggaattcccactgtcccntttgtggcaaccaagggtaagtgtcaatgtggtcnttgtaatcatcccctttaaatggtaagtaattttaaaaaaaaggggggcccgtaaccaatngcctaaaatgagtn

SEQ ID NO: 89219 - DNA, 455 bp, Triticum aestivum
  unsure (1)..(455): unsure at all n locations
  Clone ID: PAT_TA_89219
ctcgtgccgcaactaccctgtgaaccaacacttctgccgtgcctgtgcacgattgctaaaaaatgtcctgatttttaggcgatttgacttgtaaagtttgtctggtttcgtagggaggtgttcatttccagacgggggttaagtttattttgtttcgtatatcagggatggttttagtgccagacttgtgaattgcttgtccgtgaagattaaatcgccttcttgttcataacagtgtaatcccttgttgtatatatatgtagcctgctagaatatgctgcttgcgacctgattaaactcttgctttgttgctgttattctctttcagaatttgaagttggatataagaaatcaacctaacgtcgtcntgttctctgtgtaacgcttcctttggattgcaaagaatttcaaacaaacaacaacaactncatctgaatgacttaagtaacatncaa

SEQ ID NO: 89220 - DNA, 462 bp, Triticum aestivum
  unsure (1)..(462): unsure at all n locations
  Clone ID: PAT_TA_89220
tgaacggagatgctcaaatctgaaatcatcgatcggacgacattttaacttgtgtcagagcttgctcctacttttgttgctcttcgttggccaggcaggggtcatccactgcctccctatcgccaccagctcgccggatcccatcttccgcacccgcaccacggcggccgtgagcttccctttccggcccaccacccgcccgtccaactgaacctcctcgttgcacgcgacgggcgagaagtangacaggccgtagtggacggtggacgtngggcgcgcccaccaccgtgaagaccaacgccgagcacatgtttccgccgccgccgccagcgcccccgcgtgccacgtcccgtcagagtcgtgaacggcggcggcacgtggaacgagcacacgaccngcgtgctccgagaaggagatccttcgccggcaacacaacgagttaacncgtgcccttttggtggg

SEQ ID NO: 89221 - DNA, 286 bp, Triticum aestivum
  unsure (1)..(286): unsure at all n locations
  Clone ID: PAT_TA_89221
gcggnacgaaggtgaacaagagggctggnatgttgggtctaggnaaggatacanatgggatcttgttcgcgggattactacgtaaactggatttctggttgtgncantctcatttgtcttgngacaaacgactcnctcttctatcattntcanttattgtattcnacttttattagccttcannaaaacagtgcattggctggtctttccagcagccgtcaananaagttgttgctcgatgtccgnntcataacatnacntgaananttgnacaacnccctgctat

SEQ ID NO: 89222 - DNA, 458 bp, Triticum aestivum
  unsure (1)..(458): unsure at all n locations
  Clone ID: PAT_TA_89222
cttcctgccgccgccggccatcgtctcctcgcgccccgagcgcatccgcgaccatgaccgccgcacctcccgcagccccccgccgactcgccgctgtccaggaggtccctgacgccgccaccgccggccatcggctcctcgcgccccgagcgcatccgcgaccaccgcacctcccgcagccccccgccgcgccggcgccactcgccaccatccaggaggtcccgtcgccgcccttcaagtggtcctggcaggacgatgggtacgaccaccgaggaggccgcggcagcccccaccacggtacaccgaggaggagcagangtgggtttgatgatgaccggcacacggtaagcatcgtcttcaaattggctgattctaaattnngggnaccgaatgatgtcctggggaataccaaagtttcatcnaatcggacatgatccattttaaagtgtaattgggaa

SEQ ID NO: 89223 - DNA, 456 bp, Triticum aestivum
  unsure (1)..(456): unsure at all n locations
  Clone ID: PAT_TA_89223
ccgccccacccgccgccatggcccgccgcagcggaggaggaaggtcttcccgccctgctccacgtgctgctccagtgagaaacccaccagcgccagcccgtccagctcctccacctgctaccacccagagcagcggtggtggtatcatgagcgggattgggtccaccattgctcaagggcatggctttcggtactggaagtgccatggcgcacagggctgttgatgctgtgatggtcccccgtaccattcaacatgagactgttgtccgtgaggctgctgcatctatgactccaatgggacaatgctgctgatgacaagtgtggcaaccttccaaaggcttccaagatgcatcaacaactacnggagccatatcaacaatgcaantctacttnacatgctgaacgaatgccccgttggagganatctttaagtactancttngcttgattggggtt

SEQ ID NO: 89224 - DNA, 331 bp, Triticum aestivum
  unsure (1)..(331): unsure at all n locations
  Clone ID: PAT_TA_89224
ccagtttgagctccacttcagcgcaagtccttctaccacttacagagttcatccagatacacatacttacagctgccaagtttctagcttacttcttaatttgcatatctcgatggagtgcgagaacgggaaggtcgccggcaacggcaacggcttgtgcgtggcgcaacctgcacgggccgacccactgaactgggggaaagcggcggaggantgtccgttagccatttggacgccgtgaaancggatggtccaaggantacgttnaggccggttggtgacaatggnggggggccaaaccnaacattgccaaagncccccctttttggcc

SEQ ID NO: 89225 - DNA, 285 bp, Triticum aestivum
  Clone ID: PAT_TA_89225
acaagatcacgctcgccgggaacttctacctctacgccagcatagctgccgccgggtgggtgttcatgttctgcttcctgccggagacgaggggccggggcctggaggacaccgagaagctcttcggtggtggcgatggcgtggagaaggaagacggccatgggcatgccgagtccacggagttgactactcagtagtgagtcaacactgtatgcggtactactgtttagcggtcgtccaaaagcttcaataactatctgaatattcataaaaaaaaaggggggg

SEQ ID NO: 89226 - DNA, 175 bp, Triticum aestivum
  unsure (1)..(175): unsure at all n locations
  Clone ID: PAT_TA_89226
ggtgatcgcacacggtcgcaccccatcgaccgcatcgcgccctcaccgccactatggactacgccgctcacgccgccgccgcggcgccgccggccgccgatccccgtggggcctaccctcctggctacccctacgcctacgcctacccggcgtaaactacncggatctcgcgccg

SEQ ID NO: 89227 - DNA, 464 bp, Triticum aestivum
  unsure (1)..(464): unsure at all n locations
  Clone ID: PAT_TA_89227
ggtcccagcagcccgcgcctcccggcggcgcttgctccccgtcggcgcactcgcttctccccgattcctcggcgctgctcgctccaccccgtcgtctctcgcgcgcagcctcgcttgcctcccccctcatcgccctagccggccgcgggtgcgcccgcgcccccaccgttgctgtggcctgctggccgcatgcgcacgcgcccgcgtcctggtccccgcctcgccgtcaccggagtcgcgctgcgccgttcgcctccttgcctgagccctcgtgccgccctcgggcctcctctctcctgccttaaatcggttctgcgggttgcggtcttgcggattacgcatgtcgtccaactcctgcctaacccctctcgctccgcggntcccctgcngtaaggttaagctccaactcctcgccgccggcganaggcatactcagattaagctccggggctgccccaacaagg

SEQ ID NO: 89228 - DNA, 471 bp, Triticum aestivum
  unsure (1)..(471): unsure at all n locations
  Clone ID: PAT_TA_89228
ccgacttcatgtgccagggcggcgacttcaccaggggcaacggcaccggaggcgagtccatctacggcgagaagttcgccgacgagaagttcgtccacaagcacaccaagcccgggatcctctccatggccaacgccgggcccaacaccaacggctcccagttcttcatctgcaccgtcccctgcaattgggctcgacggcaagacgtggcttccggcgaggtcctccnagggcatggacgtccgtcaaagaacatccgagaagtggggtcccgcaannnggcacctgctccaaagcaagtcgtcaatcgcccgactggcggcactctaaattcgcccgcccgccggtcgccgtcctccgtcaccccccgtttgtcccgtgtcctgtcntccattctaaataaanatcctgtgtcgtgtcttccctggccgtccgatnaattccgtggtngttaaganggtttaagtnnnc

SEQ ID NO: 89229 - DNA, 471 bp, Triticum aestivum
  unsure (1)..(471): unsure at all n locations
  Clone ID: PAT_TA_89229
gtctcgagttttttttttttttttttatttcgtttcttttttatttataccttctcttctttanctttagttttatctacttatcaatagtanctaccggntcgaactcgaatttgatcgccttccatacttcacaagctgcggctagttcaggactccatttgcaagctgctcggataatttcattaccttcgcnagcaagatcncgcccttcgttacnagcttgtncatangcttctaaagccactcgattaactgccggaacnagggtgcattttcccanggatntccctaaaagttcctcnaccaanttgntaatnacagnatccttcccaaagattncngtcaanagctggcatangnccancatggatnacaactgnaagctancgggtttacacctggcanggtacccanntcctggtngaaangaaccncaagcanatnnttttaaaaaaatcnnnccccacg

SEQ ID NO: 89230 - DNA, 477 bp, Triticum aestivum
  unsure (1)..(477): unsure at all n locations
  Clone ID: PAT_TA_89230
ttttttttttttttttaaatcacaggcggaaggatatttgcaatctggagcctgactgcatccaacgaacaaatttcaggcagatagcaaagtctgcaaatatcaagccatccgaggtttaaacaaaggaaattattgccccgtatggcttcttcaagcagtgatcatgggaaccatgaacacgtcaatggatctccaaggaccaagaagtaagaaatctgactcatattcttcttgatctcttttcaatgttccttggtccttcctgtccgaactgggtacttaactttctccctggacaagcaagaccaattatccgatcactgcggtaatgaaatgccactgtcacgcaaatnaagtatgaactatcaaacccaaaaatatgactttgcatgcatcccatgaaaggannattttgttcacttcnactgaacctctcctgggctcancctccggcaagcacnggaatggtgcacc

SEQ ID NO: 89231 - DNA, 444 bp, Triticum aestivum
  unsure (1)..(444): unsure at all n locations
  Clone ID: PAT_TA_89231
ccggccgccaagcccaaggccaaggcgccagccaagaagactgccgccaagtccccggccaagaaggccgccgcgaagcccaaggccaaggccccagccaaggccaaggccgtcgcgaagcccaaggcagcatccaagcctaaggcggccgccaagcccaaggccaaggctgccgccaagaaggcgccggccgccgcgacccccaagaacccgccgccgcccggaagccgcccaccaagcgcgcgacccngtnaanaaaggcggcccccgccaagaagcccgcngccaagaaggcaagaantttagcccggaataaccggctaatngctggcggtatattcantactattcccngttcggctgttcgtcaaactttttaccntttcttngcggtgatgtctttttncaggaanatatatcatgggattattgtcttnnataaca

SEQ ID NO: 89232 - DNA, 469 bp, Triticum aestivum
  unsure (1)..(469): unsure at all n locations
  Clone ID: PAT_TA_89232
ctcatcactaggctgtcagtctgtctgttcaacgaacgatcagttcgtcctaagcagatgaaaatgtctccggaaagaaaaggagcggaggacaaggaagaaggatcgaggatggcttctgctgcgctcccggagccgggggcagtccatccaaggaacaagggcaatttcaagtacgccttcacctgcgccctctgtgcttccatggccaccatcgtcctcggctacgacgttggggtgatgagcggtgcgtcgctgtacatcaagagggacctgcagatcacggacgtgcagctggagatcatgatgggcatcctgagcgtgtacgcgctcatcgggtccttcctcggcgcgaagacgtccgactgggtccgccgccgcgtcaacgtcgtcttcgcgggcgccatcttaacaacggntccntgctcaagggcttcncgtcaactacgcaagctcatggtcngcgctt

SEQ ID NO: 89233 - DNA, 436 bp, Triticum aestivum
  unsure (1)..(436): unsure at all n locations
  Clone ID: PAT_TA_89233
gctatatacctacatagtacagccatggcccccaccgtgatggcctcttcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcnagaccctgtcctacttgccaccgctcaagcacggangcctcctcaagcaggtccgactacctggatncgctccaagtgggtgccttgcctcgagttcaacaagttgggttcancttcccgtgtngcacaacgcacccctggggtactaataatggccggtactngacaatgtggnaactgcctangtnccggtgaaccgtcncaaacaagtgttaacnaggtggacgaagtcaa

SEQ ID NO: 89234 - DNA, 431 bp, Triticum aestivum
  unsure (1)..(431): unsure at all n locations
  Clone ID: PAT_TA_89234
agaactactctcgacttttttttttttttttttgactttttgcggtgagctcgccatgtcattcatttcctctagctctttggctgcttcaagancttgtctttcctgttcctccaaaaactgttttttanctanagcctcaacctgttggtnatacnctgtactagcanaatcaacatcccatgactcataacatagtggttccngngtcttcatcaatttctgcttctaaatcttcnttgagtttttcaangccgttcaagttcccanncttcctntgaaatattcaactgataanttacaancanncttcgtcaatctantgggatnncaagagctccaanaancctcanttgcatatctaatctatttgncccaangtgatttcnngggnggggcccnttntttanattcnnccaatagcgantcgt

SEQ ID NO: 89235 - DNA, 460 bp, Triticum aestivum
  unsure (1)..(460): unsure at all n locations
  Clone ID: PAT_TA_89235
gtcgactggaggagcgacgacctggcaccaagccctttcccttcctcctggttcccacggacggacgggaccgacaggaggcatctcctcgctcgctccgcggatctgctaccctcctccgccgccctccccatggaggaagccaagggcttgcaagaagctcgggaagatcgacctgtcggattgcgaaatgtatgcatcctgcgaaccatgtccgatgtgtttccggcgccgttccgtctatcccggttaaagaggctgggtgtatggagcancggaaaacttgtaattgccatggggaaactgctacaaaatgccaacctggganataaancaancgttgggatgggcccctgcttgcctgaaaaccttttgnanaacaccaaggggaatttcaaatgtccaaagttttaataaaaactcatnnattnttccnatcaaggaacctttctgcancggn

SEQ ID NO: 89236 - DNA, 458 bp, Triticum aestivum
  unsure (1)..(458): unsure at all n locations
  Clone ID: PAT_TA_89236
gaacaagcaggcatgtacgtttcccttgcctggcgcattcccatagtcaatgtgccaacgaagaggattgacagataagaaagtagtccaaactttcaaaataccttttttagagatctagtcctaataagactccaggtgcaaggttaactgttatttcttcaagtgcgctctaactgttatttcttcaagtgcgctcatacaagctgaacaaggaattctcaaatgtttaaagcaatggatccaaagatctagctcgactgggactcctagatcacggacagttagcctggccttaattangatggctaaattacatttgaagtatcatttgatgggatatttgccaatgagaattatgaatttaaggaatctatatatatacgtatggtttgaatatggnattgaatgcttgtattttttaatggtgcaatagctattccncacagaancccttg

SEQ ID NO: 89237 - DNA, 342 bp, Triticum aestivum
  unsure (1)..(342): unsure at all n locations
  Clone ID: PAT_TA_89237
cagcagttgcctgcacgactgggttttgggacacaaggtgcgatctcaagggtgtaaaaggtagtgactcttgttaattccctgcacgtcatggtgttgcttactttctagtacctcccacgttcttatcatcgaaatatcacgtggcgttcgcgggaaaaaaattgcttggcgcttagaaaaaacaaaagagtanaatgcatcagtggtcatcaaacttatcaagagattcgaacaccatacctcacgctaatgtgcgcgcangctaaccagccggtcnatcctacccttgtgtcaaattataaggggaaatggttataccttanacattcanttacaacc

SEQ ID NO: 89238 - DNA, 482 bp, Triticum aestivum
  unsure (1)..(482): unsure at all n locations
  Clone ID: PAT_TA_89238
cagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcctacttgccaccgctcaacacggaggcctccttaagcaagtcgactacctgattccgctccaagtgggtgccttgcctccgaattcaacaagttgggtcaaccttcccgtntagcacaacgcaacccctggggtactnacgattggcnggtactgggacaatgttgaaactgctatttcgggatgcaccgacgcaccaagtnatnaacaagttggaggagtcnaagaaggataccttgaccctatttcgcatatccggtccnacaacatcgtcaagtgnatgctcaactt

SEQ ID NO: 89239 - DNA, 502 bp, Triticum aestivum
  unsure (1)..(502): unsure at all n locations
  Clone ID: PAT_TA_89239
gcagatatttgtgaagacactcaccggcaagaccatcaccctggaggttgagtcctcggacaccatcgacaacgtcaaggctaagatccaggacaaggagggcatccctccggaccagcagcgtctcatctttgctggcaagcagctcgaggatggccgcacccttgctgactacaacatccaagaaggagtccaccctccacctgggtgctcaaggctccgtggtgggcatgcagatatttggtgaaagaccctcaccggcaagacatcaccctgggaggtttganccctccggacaccatccgacaacgtcaaaggctaaagattcaangacaaggagggcatcccttcccggacaagcaacgcttgatctttggctgggnaagcactccaaggatngcccacctnggcagactacaacatccaagaaganccaccttnactggggctcaagtccntnggnggatcaaattttttgaagactcacgggaagacatcaccn

SEQ ID NO: 89240 - DNA, 198 bp, Triticum aestivum
  Clone ID: PAT_TA_89240
caacgttactttatgccctcagctctgtcagacgccttgaagcttcgtgacaaactccatcactctattaatttctactaattttatttctgcttatccggaaagtttacgtattgccgcaaacccttatcttctacgagcgaaaattcatcgcgtcccgactattattcagctagacctcacttgctcattcattta

SEQ ID NO: 89241 - DNA, 487 bp, Triticum aestivum
  unsure (1)..(487): unsure at all n locations
  Clone ID: PAT_TA_89241
cgcctgcccaacccagtaaactactgccacccatccgccggcgaaatggcccacgcccgcatcctcctcctggcgctcgccgccctggccacggccaccgtcgccgtcgcctcctcctcctcctcctcctcctccttcgccgtctccaaccctatccggcccgtcaccgagcgcgcggcttcgacgctcgagtccaccgtcctcgccgcgctcgggcatcaaccgcttctcggacatgagctgggaggattccaangcgacccggtcggcgcggcgcaaacctgctcgggcacgctcgccggcaacaactgatgcgcgacgccgccgcgctccccggagacaaagatgganggaagattggatntttaaccccntttnaagacatcccaatngggtcccggtggacttcaacataangggtnactttaggaacatatatcaaggcactgggaaanaaactctcnttctgaagaanantggtgacgtn

SEQ ID NO: 89242 - DNA, 357 bp, Triticum aestivum
  unsure (1)..(357): unsure at all n locations
  Clone ID: PAT_TA_89242
caaacaattgcattcttatactcatcacaagataccattaatcaatgcatttattcaacatacatagaagattctagtttcttcactcaagttaaaaccagtaaggagatacataagtcaacatttaggcagtggtctgttgcacaatatgatggccaagttcctaacgcaccagatgtttgaacactactacaatatattatggaagagacaaagtcttcaatcccaagctgacatcaacttccatatgaacaaaatgtgtcaaccatgttatgaacaagagcgatcaccgcctcactgggacatcttaanatcaactgggttggacntgggnaatttcttcactttggggggggg

SEQ ID NO: 89243 - DNA, 448 bp, Triticum aestivum
  unsure (1)..(448): unsure at all n locations
  Clone ID: PAT_TA_89243
ncactcttcnaggataantctcacacnaaccgantcctcaacaanngtcaacaaccatgactgttgnaaaatcnatcatacacagctgggcacggtgctttcccctancgcctgctgnctaccntcacaactggagtatacaggctttcttanagatacnggatgtccacacaacaagggtgncacaatttnacagttcagtcngacncngtgatttcnaggtnatgattggtcgaacatgtgtgataaaaggctgggatgaanctatccccacgatnaaagttggcgattaatgccacactanatatcaggnacgtatntccatatcgggntaaatggctttnnaaatatcattccgtcaaaatgctcannctaaccttcgatgtcaagntcacnaaaattaagttaccacatganatcccctaatatcanccctgaaatttacagc

SEQ ID NO: 89244 - DNA, 270 bp, Triticum aestivum
  unsure (1)..(270): unsure at all n locations
  Clone ID: PAT_TA_89244
cagcactgagcagcaggcagcgcgtacacgggagcagcagcgcgcggcagctcgaacgagctccggccatggcggacaagggagctatggctacggcggtggcgtgctcgagctcgaatccgagctagttcagaaggagaaaggtacaggcgctcacatcggagcacacaagtggctcggcnaagtttagaancgcanacnacggcattgacaaggttnaacggnaacaaccnaaggaaggggattaggtcattcccgtaanttggccaa

SEQ ID NO: 89245 - DNA, 467 bp, Triticum aestivum
  unsure (1)..(467): unsure at all n locations
  Clone ID: PAT_TA_89245
cctcctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcangtcgactacctgattcgctccaaatgggtgcttgcctcgagttnacaaggttgggttcatcttccgtgagcacaacgcatccctgggtactacgatggccggtactggacatgtggaactgcctagttcnggtgaacgacgccacacaggtgatnaacgaggtggaanagtaagaaggntacctgaccgtantcngataac

SEQ ID NO: 89246 - DNA, 309 bp, Triticum aestivum
  unsure (1)..(309): unsure at all n locations
  Clone ID: PAT_TA_89246
ggcnanccaaccaccancgccgcnagactancaccacnagcgagctcggccgattccnattccgtctgcgctattaaggtttgttggaggaatttttctttcttccatggaaaanataataatttataagcataatctgaaacaataataanaaatttaagcaaactgcganatcgactganggcatggtgacggnnacngtgtctagacntaggcgtgcttctccagcagcttgagcacctcctnctggctgttgagcctcnccacgtcaatngncgtcntcncgtccangttctgnancntcacagt

SEQ ID NO: 89247 - DNA, 337 bp, Triticum aestivum
  unsure (1)..(337): unsure at all n locations
  Clone ID: PAT_TA_89247
tgaagcctccacagatggtgacgtatatagctacggtgtgttgctattggaaatatttactgcaagaaggccaactgacaatttcatagatggtgtgacaagtcttgccaactatgtcaagatggcctatcctgataagctactggaaataatggatgttagggcaacctacagcggagacatgcaaagtatcacagacatatcctaatanccnatatttaaccttggccaacttgcngtggttgantccccaagacacaagattaaggttaacanctttnccanggantttaccccnnaanaaggatttncaaccaaaagtctggccaagnanttt

SEQ ID NO: 89248 - DNA, 518 bp, Triticum aestivum
  unsure (1)..(518): unsure at all n locations
  Clone ID: PAT_TA_89248
cgtcttcgtactcgcctctctccgcgcaaccgagccttcgccctcctccttccccatttcgccagcggcgcagcccaccaaccacccccacccgccgccatgagggagtgcatctcgatccacatcggccaggccggcatccaggtcgggaacgcgtgctgggagctctattgcctcgagcatggcattcagcctgatggccagatgcccggtgacaagaccgttgggggaggtgatgatgctttcaacaccttcttcagcgagactgggtgctgggaagcacgtcccccgtgctgtcttcgtaaatntcgagcccactgtgattgatgaggtnaggactggcgcttacgncagtcttcacctgagcaacttataatggcaaggaggatgcancaacaacttcgccgtggcantacacaattggaaggagattgttgatctcgcctanatctacangaagttnaancaactgnacgggctgcaggatccttgtcttaaagctttggaggggaacggtt

SEQ ID NO: 89249 - DNA, 506 bp, Triticum aestivum
  unsure (1)..(506): unsure at all n locations
  Clone ID: PAT_TA_89249
tttaaatgtcccgacaattcgaataaatatctcattaagtcccaaacagtcatcacaacaatgacccggtgaacatgaacaaaattatgaactgaaatgtagagaaactgaatttcgaaacactcttgctacatttgataaagcgaggctaaaggaagttcggctcaaattgatcggtaagtcacacattcttcctgtgaccaagcactacacacttcgaacactttggcaatttcctcggagccttagggatgtcacctcgtttagcacatgcatgtggtaatcttgtgtccctgacctcgacgtatgggtgcagaacctanacctttgcttatccctgaagtatgtcgacatgcggtacgtcantccttcgcaagcgctatacctcgatagttgtanaacgtnnaaatcntcatcctccctttggtttccgataatanagttcccnctttacgtaaaacactcgctcctncgggttcaanggggggccggtaccaaatcgccca

SEQ ID NO: 89250 - DNA, 350 bp, Triticum aestivum
  unsure (1)..(350): unsure at all n locations
  Clone ID: PAT_TA_89250
gggaagtttccgttcccaacctcccgcctcctccctcccaagccgccggtcgtcgcccgccaccaatccggccgcccccccccccgcctcccctcgacgcacgccggccatcccgcccctgcgccgctcgtcccgatactgctgtccctgtcctcggtcctcgctgtgcgccgcctcgcccgcacgcgctcaggtgcgccgcccttcgagtcgccggcgccggtctccgttccttccactgcgctgccctttcttccataccaccttgagtccctagcctanccgtccgcangccatcantaccgtgccggaagnatnaactggccgnaatcttcnngccnttccnaagg

SEQ ID NO: 89251 - DNA, 246 bp, Triticum aestivum
  unsure (1)..(246): unsure at all n locations
  Clone ID: PAT_TA_89251
taaccacactcatctgatcacccactagctagccagctagcagcttaaggaactagcttgcagctagcgatccatggctcgtctcaacagcaaggctgtggcggccgccgtggtcctggcggcggtggtgctgatgatggccggcaaggaaggctccggnggngctgttcttccgggcaaggttgactccaagctcccncgtttcnttgctatntaccggggaaaggggtcctcnatttaacaagg

SEQ ID NO: 89252 - DNA, 507 bp, Triticum aestivum
  unsure (1)..(507): unsure at all n locations
  Clone ID: PAT_TA_89252
caccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggccaacaggttcacggtcatggcagcggaaaacatcgacgagaagaggaacaccgacaagtggaagggctttgcgtacgatatctccgacgaccagcaagacatcaccaaganggaaagggcatcgttggactccctctttcaaagcgcccaatgggcgaacggnacccacganggcgtcctcaactcatacgagtacgttaagcaanggactcaagaagtacgacttcgacaacacatgggaaggntctaatcgctcctgcttcatggacaagcttgttgtcatctctcaaagaactcatgancctgcccaacatcaagatccactcatc

SEQ ID NO: 89253 - DNA, 518 bp, Triticum aestivum
  unsure (1)..(518): unsure at all n locations
  Clone ID: PAT_TA_89253
agtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgattcgctccaagtgggtgccttgcctcgagttcagcaaggttggggttcatcttcccgtgagcacaacgcatcccctgggtactatgatggccgtactgggcaatgttggaagctgcctatttcgggtgcacgaacgccacacaanttatnaacaagtggaggaggcaaagaagggtacctgaccctatgtccgataaccggntcgaaaaatcgcaagtgnatggtaagctcatcgccttaagccacgggctcaagatcggaaggctaa

SEQ ID NO: 89254 - DNA, 494 bp, Triticum aestivum
  unsure (1)..(494): unsure at all n locations
  Clone ID: PAT_TA_89254
cacacaagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccaatgcaagtgcggcaccagctgcggctgctcctgctgcagctgctagattattgatcatcgattatgcatgcaccgcgcgtgcaacatcgatnatatcgatntactactaccataccaagtaaccgctactgatcaagggcttatctaatcacctgacctgcatcaacagtcaggtgccatgccatgcttgttgtaaacaagccccctaaattaaatctcctggttaactaaaaaaaaaaaa

SEQ ID NO: 89255 - DNA, 289 bp, Triticum aestivum
  unsure (1)..(289): unsure at all n locations
  Clone ID: PAT_TA_89255
caacagnttgcaaatgccttccaggccattcttttgtgacgaagggcacattcatactgatgatacttaccatttatcgtctgagttgactgaaatctccgaggangatgactgaaaaaaatatgtgtgatgtantacatgangtgatgcaatttgctcctgaaangctgaaaagctgaagtaatggtcatagctgtagccagtatgttattaatctaccatgtgtgttctgantcctgtgaacttcttattgcacaatcatgtattcttcctggatggnctgtantat

SEQ ID NO: 89256 - DNA, 451 bp, Triticum aestivum
  unsure (1)..(451): unsure at all n locations
  Clone ID: PAT_TA_89256
gaagctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgagctccggcggcatggagatngcggcggagaacggcggctgcggctgcacccaagtgcaagtgcggcaccagctgcggctgctcctgctgcanctgctagattgattatcgacatatcatcaccgtgcntncgtgcatnacnattatatnatttactactacatacaagtnacccaactgattnaagggctttactatcacttactgancacancangtcatgcatatgtaacaggcccctaataaattcctataact

SEQ ID NO: 89257 - DNA, 512 bp, Triticum aestivum
  unsure (1)..(512): unsure at all n locations
  Clone ID: PAT_TA_89257
caaggttgtggctcacgccaagggaatccatatccaggccggaatggacaccgaagactactatgtttctttcaacatggtgttcgacgatggcaggtttaaagggtccacgcttcaagtcatgggaaccgttgtcgcagaaggtgaatgggctattctgggtggaacaggagaatttgcattagctcgtggagtcatttataaaacctactccgaaatacattaatcaagtgggtgatgtgattgaacttgacattcattgtctttacactgctatggaaaggtcaaagggtacttattgggcattggaggcatgaacaaacgattcnagtcntgaaaagaccatccatgcaattccttcctgaaagcatgtgcgcgcttagtacgggtccataacttagtaagtancgtccggtgtcnataattattgccaacaataaaagtcttgggttatcaaaacaaaaaaagggggggccggtaccaattcgcctatantgatctattacgcncgc

SEQ ID NO: 89258 - DNA, 517 bp, Triticum aestivum
  unsure (1)..(517): unsure at all n locations
  Clone ID: PAT_TA_89258
tgattgttctgctgttctaaaatttatgctcactttgtgtgataaatgctgctgtgcaatttcatttttgtttatgcctctttacagtaatcatgtctcttgctgttatctgctggcaatatcttacagtgccatcttagttctgagtttcatttaactaaaggtgtcattctactgctctttgttatcctgtactgccatcactgcagttttttcgtgtaactagtttattgttctgctgttcttaagtttatgctcacttagtgcaatcaatgctgtggtgcaatttcttatctctttatgactggttgtagtaatcttgtctattgctgttatctgttggcaatatcttacagtgccatctaagctgtgagtttcatttaactgaaggtgtcattctgcttctcaattttagatggacgccaacactcccaagtaccnaangccgttacnaanaaatgttaaggaggcncttcgtacttaagaaggccggtanaacctnacaaggtccctctcc

SEQ ID NO: 89259 - DNA, 284 bp, Triticum aestivum
  unsure (1)..(284): unsure at all n locations
  Clone ID: PAT_TA_89259
tttttttttttagtctactagcataaaaatgaacttcaaacaaaaaccatcacttgacacaaaaataaactctaccaaggcaaagccaaaggccttgcttgcggcatcacaggcgacctcactacgacgggtgcgcgcgcgcaacagcagagaacgccgggtttctgcaagcttggtcttattcatcaagagacaaacaaacaaactatatgcagtagtagaggtgtatatttcaagctcccagtactttcaccatcaccatcttctatangtnaggggggggg

SEQ ID NO: 89260 - DNA, 416 bp, Triticum aestivum
  unsure (1)..(416): unsure at all n locations
  Clone ID: PAT_TA_89260
ggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcantttgtcaactctgacattgctttgggtttccttctccatttactttcntatttgttcctaaagaatattgtatgtccatgttcaagttccaacatgntccaagaaacatctccgtataaaatgcttccgtggctattntatnaacngncgcataatatttncaatatgtcaactnaaaaaaaa

SEQ ID NO: 89261 - DNA, 274 bp, Triticum aestivum
  unsure (1)..(274): unsure at all n locations
  Clone ID: PAT_TA_89261
ggtgcgggcggcgctccccggcggcgggcggcgtcccttggcgcggtgggccgcctctgcctggccgtgtgggcggcgggccggcggtggatctgagcggctggtggtcgggtccccgtgtccggcctctcctgatctgaaagacgcctcctttggctcctgctgcggcctctcctacgccatgtcttgccggatccggtggacnctggngtgntgggntngggaaaacccttgnatcggggtaactcttggccggcggtggcggaaactccgg

SEQ ID NO: 89262 - DNA, 410 bp, Triticum aestivum
  unsure (1)..(410): unsure at all n locations
  Clone ID: PAT_TA_89262
agttaagcatcattacacaacgtcagaggatagtcaaggaaacagaaagggaggcgagtgaccaattctccacaagactttggcaacctgaggcgaccggcaattcttaaagacatcactatcaaccgattctccattagtccattgacagtcttgagtgacaagcttcagcagacaaccacttcttccccctaaccgatgcaattcttgttactcaattcttgtcctccctgttgaacagcacccaagttgtttccccccgctttatatatgttccaaattgcctgggcgcttatgccaagggnttaacaaattcaaggggaatttnanggtatgaattnccgaaggtaacccaggcgatgctttgggggcctaagttgattncgccgacagatgtgcatgagctgaac

SEQ ID NO: 89263 - DNA, 485 bp, Triticum aestivum
  unsure (1)..(485): unsure at all n locations
  Clone ID: PAT_TA_89263
gttttttttttttttttttttttttttttttttttgaaacaataagaaatagcangtagtctcaaatatggtctcgtacatgacataaatcacaacaatttagaagatatgtacaaatgcttgacataaacagtgcatggcagtacatacatagttccaagttcaacaaggcagtacatacatagttccaagttcaacatgacataaaatagatggttcaaagttcaacaacacataaaagcattgatcttcaaggcaacattagcagccatgtcttcctcatggtaatggggcactccttcanagcttgaaataggcgatcattgagtaccaacttcccgtaacatcgaagcataccttgctcaactaatcangtatcaanctaangcatcaantattcatgggtgtggnaactttnggnaatggaataggncattttccttgaaagcatcaacaatccttctcaaancccaagcangaaagaa

SEQ ID NO: 89264 - DNA, 402 bp, Triticum aestivum
  unsure (1)..(402): unsure at all n locations
  Clone ID: PAT_TA_89264
ctcagttcaacctaggactcgaaccgtttacagaaaatggtgttcagtatgtctgcaaacatgacatggacgcaacatctaagaaaatccaacgagtaacatgcagcagctcttcagcctaagctgtggcacccttgcccttcttcttctgggagcttcctcatgtagaactccagctccttgccctccaaggatgtacccatcagtctgccacactgtccaanggngagaccaaatgcaagncaacagcttccaacactgaactggtcctcaatgtgcganccagtgtaactccccggctggggctttctcaagttcctccnggacantgttgtcctccttgctcctccggtgngnaacaacaanaactcaacctccttgccctcaacaagtccttcttgg

SEQ ID NO: 89265 - DNA, 423 bp, Triticum aestivum
  unsure (1)..(423): unsure at all n locations
  Clone ID: PAT_TA_89265
ctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtngaaggatcaggtgcatgcaggtgttggcccattnagggcatcaagaattcgaagaccctgtcctacttgccaccgctcancacggnaggcctcctcaagcaagtcgactaccttattcgctcaagttgggtgccttgcctccaagttaacaaggttgggtcaacctccctnnagcanaacgcacccccgggtacnataatggccggtactgggacaatntgnaaactgcctaatnttcgggtggacccnacccacaaatttagtg

SEQ ID NO: 89266 - DNA, 458 bp, Triticum aestivum
  unsure (1)..(458): unsure at all n locations
  Clone ID: PAT_TA_89266
acagatccgggcggccatgggggacgcccgccgccgccgccgccgccgccgccgcaagaattcccggcgggtacccgcgcgggagggagatattgaagccattccgggcgagcttctcgagctggtgttcctgcgcctcccctcgcctgcccacctcatccgtgccgcgtgcacctgcaggcgatggcgcaacgtaatcgcgggcgacggcggcagttcctccgccggttcggtctctgcccggcgcgtcctccgacacgttgtcngcactaccgcgtcaacnaacgccaacggcaccgcgtccgcctggcttaaccccgtattcgtcccgtcctcctcctcttcctcgccnaaggcgacgccgtcgccgtcggaactcgcgctcattctccgcgggggagtttggcaatttcggntggaacccccanatccggggcgctgtgnctcttcantcggan

SEQ ID NO: 89267 - DNA, 483 bp, Triticum aestivum
  unsure (1)..(483): unsure at all n locations
  Clone ID: PAT_TA_89267
ctcgaaccaaggcgagttcgtcggcgaccatgtccgggcgcggcaagggaggcaaggggctcggcaagggcggcgccaagcgccacaggaaggtgctccgcgacaacatccagggcatcaccaagccggcgatccggcgcctcgctcggagggggcggcgttgaagcgcatctccggggctcatctacgagggagacccgcggcgtcctcaagatcttcctccgaagaacgtcatccgcgacgcccgttcacctacaccgagcacgcacgccgcaaagacctcaacgccatggacttcgtctaacgcgctcaaacgccaaggccgaacctctaacggtttcggnggtaagcctcgnnggcctcatcttccnttgccccccngnaatccctaaantccattaaacttattgttaatttgctttnccctgtnattcaaattaaccatgaacaaantatcccactggatttgggaaaaaaaaaaaa

SEQ ID NO: 89268 - DNA, 213 bp, Triticum aestivum
  Clone ID: PAT_TA_89268
gccgggaggagcaaaaaacgcaattggcatgaacggcatgtgactgctcttgaccatgattcattccctgccattcaagaccaacaaatagagggcaagttgctggtgccatacaaaaacgatactagattctcacagatctgggaaaaatgagggaagagcactggggacgaaagaaggtgcaatcaagattttgtataaacaagatttgca

SEQ ID NO: 89269 - DNA, 476 bp, Triticum aestivum
  unsure (1)..(476): unsure at all n locations
  Clone ID: PAT_TA_89269
ccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatnaagcagcgtctcatcttcgctggcaagcagtcgaggatggccgcaccctggctgactacaacatccagaaggatccacactccacctgggtgctcaaantccngtngtggatgaattnttcgtcaaanccctaaccggcaagacataacctgaggtttganncctcctaaaacatccacaacttcaaggcaaanttcaagacaaggaggaattccccccgncaaaagtcaatttttgctggnaanaactcaagaatggccnacctccctaatanaaatccanaagaatccaacccaactgggngtnaggccgtgn

SEQ ID NO: 89270 - DNA, 476 bp, Triticum aestivum
  unsure (1)..(476): unsure at all n locations
  Clone ID: PAT_TA_89270
cgccggcgcccaggatgtctggcttttcgacagcaaccatctgtgctctcctcctcatcttcttccacctccctgctcctgccgtctccctgtccttcaactactccaccttgagctcagcggaccagaacgacatcaagatcgaaggcgacgcgtcgttcagcgtcggatggatcgacatcagcgccaacaggttcggtaatatcgactacagcaatggccgggcgtccgtacaatgccaggccgatgctgctctggggacaaggcgaccggcaaggtggcagttcaccacgcggtctcgttcgccatctccggcgacatcaacagcaaaggggcaagggatggctttttccttgccgcctaccctcctacctccccngccgctgcatccattacaactcgccctcaacaaaccaaagcgccnatccgtnggcgaccggggacaccgnttcctgcggttgantttgacactacaa

SEQ ID NO: 89271 - DNA, 481 bp, Triticum aestivum
  unsure (1)..(481): unsure at all n locations
  Clone ID: PAT_TA_89271
gttgccgtgaaggatctgaagcgtgggtttgttgcatccaactccaaggatgaccctgccaaggaggcagccaacttcacctcccaggtcatcatcatgaaccaccctggtcagattggcaacggctacgccccagtgctggactgccacacctcacacattgctgtcaatttgctgagctggtgaccaagattcgacaggcggctgggtaaaggagctgggaggcctgcccaattcctcnaagaatggtgatgcttgcatagtgaagatgattcccaaccaacccatggttgttggaacttttgcaacttaacctcctccttgncctttttgcttcccnttacaanaagcnaactgtggtgttggtgtcaacnaagcgttttanaaaaangaccaaccnggcaaaggttacnaaggtgccatcaagaanaattattccaaattgataccnanaatgttcaanaaccaacattttttntat

SEQ ID NO: 89272 - DNA, 277 bp, Triticum aestivum
  unsure (1)..(277): unsure at all n locations
  Clone ID: PAT_TA_89272
gccggacgaggtgccggtgagggcaatgccttccgcccctccatggctgtaggctttccctgctgccgccgcccaccacgcttcgagccggaacgatagccaaccacgccagcccgaccggctcacgtcgcaaccgccggaagcctaccgtcggccccgcctctcctcatctctgcgccgcgcctcgccggagcggaagggtcacagcgcgcaagactccgtcctcgccggattcgaagtgtttaacatccgtccggtcgcaagnccgcggtgggtt

SEQ ID NO: 89273 - DNA, 435 bp, Triticum aestivum
  unsure (1)..(435): unsure at all n locations
  Clone ID: PAT_TA_89273
ttttttttttttttttttttttttttttcttcttccgagaaaaaactgttagaccaaaactcttttaggaaatcaaaaaatccagatacaaatgcatgatgtatatattatatcatgcatatatcataaagaaggagtatggagccggtagtgggaatcgaacccgcaaccccaaggttatgagccttatgagctaccaaactgctctatactcttaaactaaagaggggtaactagtgggataaaagagggttggatacgcccctctaccaatatctatacaaatagaatagtccatttattcaagaatggtaaanagggncccnccaatgattacaattccagaaatccatcaaatncaaaagggtatttaaccctaacaacnggttttngttgcncccggtaanaanattccataacatttcccaaantatt

SEQ ID NO: 89274 - DNA, 477 bp, Triticum aestivum
  unsure (1)..(477): unsure at all n locations
  Clone ID: PAT_TA_89274
ccaaggccgagaagaagccggcggcgaagaagccagtggaggaggagcccgcggcggagaaggccgagaagaccccggccgggaagaagcccaaggccgagaagcggctgccggcgggcaagtcgtcggcggcggccaaggagggcggcaaggcgaagaagaaggccaagaagagcgtggagacgtacaagatctacatcttcaaggtgctgaagcaggtgcaccccgacatcggcatctcctccaaagccatgtccatcatgaatccttcatcaaacgacatcttccgagaaactcccccngcgaagccgctnagctggcgaaggtacaacaagaacccaccatcaacttcccgggaagattncaaacttccgttccgctcctcttccccgggnactccnccaacacgcctctcccaanggcaccaaggcttcacaattcactctcctgatcncctattacttttggtgttttgtn

SEQ ID NO: 89275 - DNA, 308 bp, Triticum aestivum
  unsure (1)..(308): unsure at all n locations
  Clone ID: PAT_TA_89275
aagatttcatctttgcttggtggtaaaggtcgcggtgcgctgctgttcatggctggcttcttctagaagtggggcgcatccagccggccggagtccgcggactccccgccccagcccacacgccagccccctcccaggcagcagcgctacatacaaaccgctcaggaatcccccctcgatttcttttattttcctccatagccgtcgccgccgcctcctccgcttaatctactctngcngcccggccgcccgcccccgatcagcccgctccgccgccgttanttaggcccatggggaactgctgcggc

SEQ ID NO: 89276 - DNA, 476 bp, Triticum aestivum
  unsure (1)..(476): unsure at all n locations
  Clone ID: PAT_TA_89276
ccacgcccaactccgcgcagcctcgccgccaggagacaggcgttgagtgaggatggcgagcccgcagtgctgcgcgaacccgccgacgctgaaccccgccggcggggaagggcagggtcgtcgacgacggcttcggcgggatcgcggcgtangttgctggctccgccgggtccaaagccgcagtcatcctcgtctccgatatcttcggnttgaagcgcccaatctgaggaagatagcttatgaagtcgcttcgtctggatactttgtttggtgccagatttcttacatgggggagcatattcacacgaaacccattgacattccagcgtggataaggttatccccggaaaaggatttnnaagaggaaaacaaattccgctctaaagaacaagacgtctagtacgggcncaagtattctgggggcaaactattccgattncnaaggtatgaatcaagcaacttctantctaaccttn

SEQ ID NO: 89277 - DNA, 513 bp, Triticum aestivum
  unsure (1)..(513): unsure at all n locations
  Clone ID: PAT_TA_89277
ttttttttatcattacaccacaagttcataagatgcaccaaccaaaataacatagccagtaacacacccaaagaaactcatcaaccccaggtccaaacaactcagcatcaaaagtcccaaagccaacatcgaccacgttgtagtaactaatttaccttcgaacagatccatgagacgcgcaaatctagaatcacttgctgcagccctagcatcggtggcctcaactctttgcagtaacaactgatacctgcggcgcgtacagtttcggtcncctccngattcctccttgacttcaacaagtnctccttgcataactcaagnggtcgctncccttnctcaagntttancccagtcctngncaatgagnatcaaagtacnggagtttattgaattcaactggggcccanccaaggnaaaattttaagnaattccggnnggaantctttngggaaantcaggaacaaaagaanaantctttggttccaactncnggggaccctgggtcaaaaattt

SEQ ID NO: 89278 - DNA, 354 bp, Triticum aestivum
  unsure (1)..(354): unsure at all n locations
  Clone ID: PAT_TA_89278
caatcatccaagcctcaagtagtactcctcctctctcacgtgtgtgtgtgcgcgcttattcagtgcagaagcaagtgagctacactcttgctagtacgtgtgtgtgtgctgcttcagtgagtgtcttgggctaacaatcttcgcctcacgttaccggaaagttgtgtgggcaaagagaaatgcccactacgacggcctgagaggcagccatggccggtcgccggcgggtacgcccactacgacttccagctcgacgcgtggctccggcttcactcaaccgacgagggaaacagctatggtggttgtttgcttgatgggatgacatctaatttccggtnangcacttaagccctc

SEQ ID NO: 89279 - DNA, 435 bp, Triticum aestivum
  unsure (1)..(435): unsure at all n locations
  Clone ID: PAT_TA_89279
ggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaactccgcgcgctgtgcaccggcgagaagggcgtccggcaagagcggcaagccgctgcactacaagggcagcgcttccacgcgtgattcccgacttcaagtnccaaggcggcgacttcaaccccggggcaacggnaccggcggcgatccatctacggcgagaantcgccgacgagaattncgtccacaanacacaancggggatttctccatggcaangcngggccnaaaanaaggtccaattcttcancctnacgtnccctg

SEQ ID NO: 89280 - DNA, 503 bp, Triticum aestivum
  unsure (1)..(503): unsure at all n locations
  Clone ID: PAT_TA_89280
attggaagggaggtcaaaaattatatttacaaaattactgctgttcaaaatccaaaaaaggagcaggtgaactaaacagtgcagctttcaaatcagcaaaacgctgtgcttcggcagtcctgccagcactagtaagaaggctgatgatgcagtcataattctcttcagatgcttccaggttgtacccttgtaccatggagtcgaaaatctcgagagcttcatcatgcaatcctgctgcatcacagatctcaagaaccacattgaaggtgacaatagttgggggcaaattatttgacagcatccatgaaaagagatccagtgcctccttgtgccgctggttgattgcataacttcctattaatgcaatgcacgtcaaggatcccttggganccnttcgattggacacctccggtgctgccttcaangccccacacctgccatacatgttaacaattctgcggnaactaacggagaagtccatccgnaactnaacactgaccang

SEQ ID NO: 89281 - DNA, 260 bp, Triticum aestivum
  unsure (1)..(260): unsure at all n locations
  Clone ID: PAT_TA_89281
gagaggccgagtagctagcctagtctagggtttcggtagagaggaagtgagatccatggcggagacggngtaccgctgcttcgtgggcggcctcgcctgggccaccgacnacaacaacctccagcaggccttcanccagtacggcganatcctcgacgccannatcatcaangatcgcganacngggaaggtcncgtgggttcggcttcnccacgttcgcancgangagtccatgcnccaggccatcnatngngatgaac

SEQ ID NO: 89282 - DNA, 455 bp, Triticum aestivum
  unsure (1)..(455): unsure at all n locations
  Clone ID: PAT_TA_89282
ggatcctgggcctcgagctcgcgctgcgctcctgccctctcccgccgactcccggagctccgttcatcggtgagccccgccgaccctttcccgtgcccattccgagatgtgctagtctgtacctcggtgtgatcttagccttgctcacctttgatgctggcgattccgtatccatgattctttatgcgttttactgcttcctgctgttaggtagtggatcgattgaatctaccctactacggaagttaggattaagtataancctgaactccgttggaatttcctggangaagatttttgtgctgcttntggtaaggaaatganatgtattggtaaaatgggccnaggacccttgccaatttcaanataaccaacgtttgcctggtngntttaanaagcccaattncatgagccgnattccggatttantgacaacaaaatatggagtcttgaca

SEQ ID NO: 89283 - DNA, 367 bp, Triticum aestivum
  unsure (1)..(367): unsure at all n locations
  Clone ID: PAT_TA_89283
acagggaggccccacctgggtccggaatcgggaggaagcggagatgcagggacgccggcgccgcngnaggcctacccgacccggccgccgccgctggcggcggcaacaggctcctgnccgggtacctcncgcacgaattccttgcntgcggcanggtcctgggtgaaaggcgggcgcccggcggtccggacacgggctccgaggcgagtcacggccganggcaggccgcncggtactatgccntggcaacgatggtgcangtcggcggcntctgcgttccctcggtngagaaccccgcacatctcgccgcgtggnngacganactgttcnggaggccgacgcgaacgtgacaagtatgtaantgttc

SEQ ID NO: 89284 - DNA, 478 bp, Triticum aestivum
  unsure (1)..(478): unsure at all n locations
  Clone ID: PAT_TA_89284
aagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcctacttgccaccgctcagcacggaggcctccttaagcaggtcgactacctgatccgtccaagtgggtgccttgcctccaattcagcaagttggntcacttcccgtgagcacaacgcatcccctggggtactacgatggccggtactgggcaatgtggnaactgcctatttccggagcaccgacgcaccaagttannagngtggaggagtcaagaaggatacctgaccctattccgcataacggtncaanaatctcaagngattng

SEQ ID NO: 89285 - DNA, 482 bp, Triticum aestivum
  unsure (1)..(482): unsure at all n locations
  Clone ID: PAT_TA_89285
ctccctcgctcgtcctcttctgtgcaacgcgcgcagccgttgccacggccttgccgtccgcgtggccaacgtcgtccccgcgccaaattagcttgttcccccggctcccccttcgtcgtctacatcacctgcgaggaccagctcgagccccctcgcgctgcatcgcctggatcaagtcatcttctacctccggtcgccactcatcgccgcttcgatttgtcgcctccaagccttccccgagcttgctttgcacctctacaggttccgcgatgctggagtccaaggagctagagattccgaggatgatctatgtgggattcggcttccaaggagtaattaggaggcccaagcaagaggcttgcttttcatcgttgcacttttgggcaaccttcttaagnaanttgtttaaccnaggctgtaccaaatatgttgctccgctgatntctanatcgaccattgtttcnagcctcnaagcctggttg

SEQ ID NO: 89286 - DNA, 512 bp, Triticum aestivum
  unsure (1)..(512): unsure at all n locations
  Clone ID: PAT_TA_89286
gttaattggggttattagttttaactagactgattagtttcgtacatgtcctgcagtttcaactgcaagtctgtagccggagatatggctgtagaatacagatgctatataatactccctcggtcccaaaataagtgagtcaactttgtactaattttgtactaaagctagtacaaagttgggtcacatatttgagacggagggagtacataattagagaaaaattgttcatcaaggaatgaaccctcctataattcacgcacttgttacatagcaagcaattagcctagtatactaatgtccttctgcaaaaaagactactctactatgntcttggtccaaaccagtggcagctatactactannaaaagctnaatngaaacagtttcaacaagatcagaggantacaaattttatnaccacgcacgctactgattcncctaactggacccntgatatcatcaagggcatgacgattgcctgagttggttaaagggaccngcaaaatctgt

SEQ ID NO: 89287 - DNA, 337 bp, Triticum aestivum
  unsure (1)..(337): unsure at all n locations
  Clone ID: PAT_TA_89287
gcgacgcaccaccgtggcgcgccagtccctccccttttttttccttgctctcgcccgcacgcggcggtctcgtgcaggtcgcctgaccaccacgccgcgtccttccgccggcgatggcgtcgaccgccacctcgccgcgccagggggccggcgacggcgtcgacggcaaccgcgccgcacgctcttttccttctccctcctgttctccccgtccatcgcaagcagtggcagagagagacgcgaggtctagcctcctctgctcccctgaatangacaacggtggacaaccctacagcgggcngtgggcancccttcgccngtacngnttttcccttgc

SEQ ID NO: 89288 - DNA, 503 bp, Triticum aestivum
  unsure (1)..(503): unsure at all n locations
  Clone ID: PAT_TA_89288
cttggtaaggcaatgaacttcatgttactgtctttgatgtatgcctactactgcttcgagtatgtacatctgaatgccttttatcacccattcaaccttttcctcaagtgctatacagcaaggttactttattaccttataaagtttgccaactccttttatcaggtacaagtggaacttctttgcagtgagcctgaatcaccggcttgatttctttgagtcaaattgggctttctttgccggatttgggtatgtgcattgttgtcatcatatggtgcaaaatatgtgtttcatcttcttaccacagttagcaaatgtactgtgtaaagggaacttttgctttccccggtagtctgctgtcaaaccgttttgcagtgtatgcagggtccttgactcctgctaagaactcatgctcatactccggttgatatcattttttgggggcaagaactctcaaactgcaggacatgcacactctgatagtccctgcatccaaaganata

SEQ ID NO: 89289 - DNA, 487 bp, Triticum aestivum
  unsure (1)..(487): unsure at all n locations
  Clone ID: PAT_TA_89289
gcggtgcggcctgaggcgtagaggcgatgcggcggcgtcgtttgcggtggaaggcggccgttggtggcgattggaagcgagaccagtggcggcggcgacggatcccgacggatctctccggatccgattgcgagtgatggaggccgtggtctcctgtgcgcggcgtgctgatgcatagacgggtgcggggctggcggtaggcagcgatgtggcgcggtctcatgcggcggcagantgcagctgcaaccggcacgctgctccccctgctgttggacacggcttnccgggcaaaaggcgtccttctaagcngtgaacacgggttaccctntaaatctacgctgggtgcctggcattcgtngttctcaagaacacgnngttaagancggaanccaatcccaacactnnaagggtacaaaactcctttgaccgcaaaacggnctcnacggggctcncaatcctgaanctccctcgccattaaaagnangga

SEQ ID NO: 89290 - DNA, 503 bp, Triticum aestivum
  unsure (1)..(503): unsure at all n locations
  Clone ID: PAT_TA_89290
aactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttgggactgatgggacttaccatcttgatcgttacaaaggacgatgctatcacatcgacctgttgctggggaaagacagcaatggtcngttatgtacttanccattaactattnnagaggttcctttacnaaangtttactccattggnggtaactatttggttcnaaacctaactgccnaactttggnggtttacattnccccnacttatcnaaaantttcaaggccncncaangggaccaaatttaaaanaaaattnnacaattaggccnccttatgggatgtccattaaccaaatgggattnccccnaaa

SEQ ID NO: 89291 - DNA, 499 bp, Triticum aestivum
  unsure (1)..(499): unsure at all n locations
  Clone ID: PAT_TA_89291
cagtcacggacctgagagaagacataagaagtggatggcttaaatgtgaaaggcataaaagttagtcatatgtagtgtgtttcttcccgcaaaaaatatatgtagtctgtttctgacaattaagtgtacatgccaattttttcatttgtgatcgtaagtacatgttaaaaatcatatagaaacgactcaaccttcaatactttttaaaccatgataagttatccatgcatccaagtgaagatatgcaaactgtgtcctgatgaaaagggaagtgagatcttacgtgactatgccagttcgattaagagaacatgaaacataaaattaatccaaatagtttaccagctgcgcctaagtcaaanggtaataaanccacatgatacatgattatcncaagtaaatccccattagaanggactgacntataattacnaagtggttatccgttggngcaggatcaacacntaacttgcatccgggntcctttaataaccccann

SEQ ID NO: 89292 - DNA, 511 bp, Triticum aestivum
  unsure (1)..(511): unsure at all n locations
  Clone ID: PAT_TA_89292
cgagaagctgctcgtctacgactacctccccgccggcagcctctccgccatgctccacgggagccggggctcgggccggacgcccatggactgggacgcgcgcatgcgctcggcgctgtcggcctcccgcggtctcgcgcacctccactcggagcacaagctcgcgcacggcaacgtcaagtcctccaacgtgctgctccgcccggacctcgacgccgccgcgctctccgacttctccctccaccccatctacgcgccgaactccgtccgcgcggggggccggcggtaccgcgccccggaaggtggtggacacccggcgggccangctcaaggccaactttatccttcggnnttgtccttgcttggagtcctcaacnggaantcccgaagcaagcttccttcaagaaggngaacggcggaacctttgacttccgccttggntcattcgttgtccccaagattgacnccaagtgttgacttcactntncgcctggggcaacgcnaagaagaa

SEQ ID NO: 89293 - DNA, 495 bp, Triticum aestivum
  unsure (1)..(495): unsure at all n locations
  Clone ID: PAT_TA_89293
caagagttatagggagggacttatgtcaccacaaacagaaactaaagcaggtgttggatttaaagctggtgttaaagattataaattgacttactacaccccagagtatgaaactaaggatactgatatcttgggcagcattccgagtaagtcctcagcctggggttccgcccgaagaagcangggctgcagtagctgccgaacttctacgggtacatgggacaactgtttgggactgatggacttaccatcctgatcgttacaaaaggacgatccttcacaccgagcctgttccttgggaaanacaacccagggttctgttaagttacctaanccattaaacctattttaaaaggtnccgttacnanaaanttacttccatggtaggtacttatttggttcaaagccctacttgccnactttggnggtttaacattcccccacttttcnaaacttccaaggcccccaaggtaccaattgaaaaatattnacaat

SEQ ID NO: 89294 - DNA, 502 bp, Triticum aestivum
  unsure (1)..(502): unsure at all n locations
  Clone ID: PAT_TA_89294
aaaggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgatccccgacttcatgtgccagggcggcgacttcaccggggcaacggcaccggcggcgagtcatctacggcgagaattcgccgacgagaattctccacaagcacacaagcccggattctctccatggcaaaccggggcccaacacaacgttccaattctcanctgnacntccctgcaattgggtcgacggnaacacttgtctcgcaagtctcaaggatgacgtctcaagaantcagaagng

SEQ ID NO: 89295 - DNA, 494 bp, Triticum aestivum
  unsure (1)..(494): unsure at all n locations
  Clone ID: PAT_TA_89295
ccttctcccgcctcgtcgcctccaaaccccctttcaacctcgccaagcccaagcccaccccgccgcctccaccacctcccccaccgccgccgcattcctctcaccctatcccgcccccgccgcagcccgccatgccgccgcacgggcgccgccccgcgccgccggccccgggcggccacgtcttcccgcaggcggcgtccacggtgctgcccgacccggcccgcttcttcgcgccgggcctcctctccgcgccgctccccaccaactgcttcttccagaacttcacgctcaagaacggngaccagcccgagtacatccacccctactccgtccgctccgccgcggccggnctcaccgtctgttacccggggcgcagccactccccgaccttcgacatcaagacttcgcgncgactcagcgtctcgtccccgtccgagcgcncgcggcgcggcgccaccggacgcgtntcccttgagactctcgtcacctcantt

SEQ ID NO: 89296 - DNA, 432 bp, Triticum aestivum
  unsure (1)..(432): unsure at all n locations
  Clone ID: PAT_TA_89296
gcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcagtgtggcccatccagggcatcaagaattcgaagacccttcctacttgccaacgctcaacaaggaggcctcccttaagcaagtcgactacttattcgcttcaagtnggtnccttcccccagttaacaagggtnggttaacttcccttgagcanaacgcaacccctgggtactaacaatggccgtacngncaatttggaactgccaagttncggagcaccgacccaccaagttaacaganggangaggnggtcnaaaagg

SEQ ID NO: 89297 - DNA, 485 bp, Triticum aestivum
  unsure (1)..(485): unsure at all n locations
  Clone ID: PAT_TA_89297
ctttatttcacttgttttttatttcacttgttttcacctgcggcgagctcgatccagtcgctgcaatctgttggcagggaggcctcgtcagggccagggccaaggccgccgccatcccaccgccgtcgcctcgcagggcctggtgccgcctcttccaggaaggccgccgctgcaggtcctgccccccgccccaggccggatctgatccagggccaaggaatccgccatccggcacctgccatgaacatcgccgccgctctttcaagatgcaaacacattttggatatagaaaaacatgttaccgctgctcaagaataagatganctggagtccgccacataagatgaactgggttaactttaacatttggtngatacattgtccaaaaacatttacatcngtncatccaaacatacctgantttcagagacacgntccaaatcgaacaaancaattccaaagcagagttacataaaaaaaaaaaa

SEQ ID NO: 89298 - DNA, 260 bp, Triticum aestivum
  unsure (1)..(260): unsure at all n locations
  Clone ID: PAT_TA_89298
ttggcagcaatcgtgttggaaattcagttttcatctttgggtagtggttctttatacaggtgtgtccctagtgaacactagtagcaaagctgctttcaaagaaacgaacaacaaaagtagaccaaggatctattcttccagatgcccacnanatcgctcctgatctcgacggaaacatatttccgcgcagaagtcggatcnnnactccccttcaaaagnagngatncgggtgttnncccaaggccnaaaaccccggnatg

SEQ ID NO: 89299 - DNA, 511 bp, Triticum aestivum
  unsure (1)..(511): unsure at all n locations
  Clone ID: PAT_TA_89299
ttttttttcaaattttcaaagccagctagatagttttatgcgactccaaagtacatttgataacagttcattcatcatacccacgaattgtcaaccatttcttcatacgcgacggcaaccaactgcatacacttcactccgaaccttcaagttcaggtgcttcatcaccaactaaagaaggaggccatgccataatgtatggatagccacgaccatcatacctcccctgaatcagcaagtcaagctccatagtctccaagcaaagggagaaaaaccagcagcagagtaancagaaggggncatcatggtcctggataagtaagcggtccatccctaacttgcacaacctttaagctccctggaaagcctcaataagcgattngactttagaaccaaagagatgncttttgcggnaccaatctggancccaacaacanccacgctagggtccaaactgggaggaggaanaacaantacatgngcaataagatcacatccctggctccancct

SEQ ID NO: 89300 - DNA, 440 bp, Triticum aestivum
  unsure (1)..(440): unsure at all n locations
  Clone ID: PAT_TA_89300
ggcgcacctcccggccaacttccgcaagatcctgctgacccagatcaagaagctcgtcgccgccggcaagctgaccaaggtcaagggctcctacaagctcgccaaggcccccgccgccgtcaagcccaagacggcgaccaagaagaagcccgccgccaagcccaaggccaaggcgccagccaagaagacggccgccaatccccggccaagaaagccgccgccgaacccaaagccaaagncccagcaaagccaagccgtcgcgaacccaagcggcggcgagccnaaaggcggttncaacccaaaggcaagttccgccaagaagngccttctgcttcgacccnnaanaacttttcccggaacccnccacaagagggaaccgtacaaaaggcctccngcaaaaacccccggcaanaagcaagattnaagccttaagnctaaat

SEQ ID NO: 89301 - DNA, 460 bp, Triticum aestivum
  unsure (1)..(460): unsure at all n locations
  Clone ID: PAT_TA_89301
tcatanccaatcaaagcctctccatctccgaagctccaaccgaaccgaggatgtcttgctgcggangaaactgcggctgcngcaccgcctgcaagtgcggcaacggctgcggcggctgcaacatgtacccggaggccgaggccgccggngccaccctcctcgtctccgccaccgccacccacaangcgagctccggcggnatggagatggcggacgagaacggcngctgcggctgcacccagtgcaagtgctggcaccagctgcggntgctcatgctgcagctgataaatnantgatcaacgatcancatgcacgtccgttgcancatcattatatcggttctactaanaacaattcangttaccnctnacttattgaagggcntaaccaaagnacnnaacttcaancntaattaaggtccaatccaggttttttnaaaaaaggccccnaaanaaattcc

SEQ ID NO: 89302 - DNA, 439 bp, Triticum aestivum
  unsure (1)..(439): unsure at all n locations
  Clone ID: PAT_TA_89302
cactcccccgnccngcngccgccgccgccnaaaanccnaaggnaaanaagganggaggaaggaaggggaanntgccggcggggnacgggntgcggtcgcggacgcgcgacctgttcgcgcggccgttccgcaagaaggggtacatcccgctcaccacctacctgcgcacctacaaggtcggcgagcactctacgtcaangtgaacggcgccgtccacaagggcatgccgcacaagttctacaacgggcgcaccggccgcgtctgcaactnaacaaacgcgccatcgggtcnaaattaacaaacaagtcggaacaagattatcaagaanaggntcatttcnttttgacaantgaacatcaagttnaaccaagattctccanaggnattaaaaagaaaactttaagggnngcaaaggcccgggaantttaaaacaaaaaga

SEQ ID NO: 89303 - DNA, 491 bp, Triticum aestivum
  unsure (1)..(491): unsure at all n locations
  Clone ID: PAT_TA_89303
cccaacttttgcaaccgnancagtcnctctnaacnatttcccttnaaaaacggntctgcgctntcaatttcgcctcgctnctccctagccggtnactcccctngnatttgtacttagttaanattaattactcgccngtcccctctaaaacnantttgtcggcatggcatcatactaccagtataacanttatcaancactcgggtgcctcanaatcaatccaccttgtcgcctcaagccactagcctaatcntcgcgnancttgtcccttggcaaaatctcaaaagcagtcatancgctttncacgcaggggnanaaagagctatnaacgtaaccngttttgccnaccttttaaggnggcgctaattcanctanacaacaactggaatncgccccattcggggcaccgatttaactgttccaanaaatnaccccgtngatnttaactntttgagcgaacnccngggntctcccaattaacaatccanctc

SEQ ID NO: 89304 - DNA, 472 bp, Triticum aestivum
  unsure (1)..(472): unsure at all n locations
  Clone ID: PAT_TA_89304
ctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgttggcccattngagggcatcaagaattccgagaccctgtcctacttgccaccgctcagcacggaggcctcctcaagcangtcgactaccttattccgctccaagtggggtgccttgcctcnagttcaacaagttggntcatcttcccgtggagcacaacgcancccctggggtactaagatggccggtactggacaatgtggaaactgcctattttcggtgcacgacccacacaanttacgagggttgnnggagtcaagaaggatacctgaccctatttcccataacg

SEQ ID NO: 89305 - DNA, 448 bp, Triticum aestivum
  unsure (1)..(448): unsure at all n locations
  Clone ID: PAT_TA_89305
gccatggcccccaccgtgatggcctcgtcggccacctccgtcgctcctttccaggggctcaagtccaccgccggcctccccgtcagccgccgctccaacggcgctagcctcggcagcgtcagcaacggtggaaggatnaggtgcatgcaggtgtggcccatcgagggcatcaagaattcgagaccctgtcttacctgccaccgctcaacacggangccctcctcaagcaggtggactacctgattccgctccaagtgggtgccttgccttgaattcaacaaggtccggttcaatcttccgtngngcaaatgcgtctccccgggtaacnacaaanggccgctaactggacaatttggaaactgcctaatttcggggtgnaccgacccacaaagtttaacaagtggnggaggcaagaaggatacctgaccgtantcggataacggatcga

SEQ ID NO: 89306 - DNA, 446 bp, Triticum aestivum
  unsure (1)..(446): unsure at all n locations
  Clone ID: PAT_TA_89306
cttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgcgtacatggacaactgtttggactgatggacttaccagtcttgatcgttacaaaggacgatgctatcacatcgagcctgttgctggggaagacagccaatggatctgttatgtagcttatccattagacctantgaaganggttccgttactaacatgtttacttccattgtangtaacgtnttgggttcaaaagccctactgctcnantttggnggattaataatn

SEQ ID NO: 89307 - DNA, 457 bp, Triticum aestivum
  unsure (1)..(457): unsure at all n locations
  Clone ID: PAT_TA_89307
ccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgttcggcaagagcggcaagcccgcttcactacaagggcagcgccttccaccgcgtgatccccgacttcatgtgccagggcggcgacttcaccccggggcaacggaccggcggcgatccatctacggcgagaattcgcgaacgagaattttgtccacaagcacaccaagccgggattctctccatgggcnacgccggggcccaacaccaacgtcccatttttcancctcacctcccccnnaatttgtcgacggcanangtttctttg

SEQ ID NO: 89308 - DNA, 522 bp, Triticum aestivum
  unsure (1)..(522): unsure at all n locations
  Clone ID: PAT_TA_89308
cgggtttgcacagtcgtccaccatgccgaagcagatccacgagatcaaggacttcctgctgacggcgcgccggaaggacgcgcggtcggtgcggatcaagaggaccaaggacgccgtcaagttcaaggtgcgctgctccaggtacctctacacgctctgcgtcttcgacgccgacaaggccaacaagctcagccaatccctcccaccaggttcgccctccgtgcccccgcctccttccccatttangtctcgaccagttcgatttgtgatgtttagctgcttacggtacaagataaatgggtggaagattccaattatgcgtagcgtgtttcgtgttccgatgcacccatgagtangtacattaaatgtgttgctccacgccaattctgaatggtttgacgtaagcttgtgcaaacnattgtttgtgacatggtatgtggagngttgatttatctgggataactgcacgcgacaataaaanctcggtatcatagaatctgcatatgatcaactatgacttca

SEQ ID NO: 89309 - DNA, 360 bp, Triticum aestivum
  unsure (1)..(360): unsure at all n locations
  Clone ID: PAT_TA_89309
gtcnaaacaaccctgctatcccagcctctgttccatatcgacgccctccgctgcaatatgtcccaaaattcagaactagagaaagcgccgaaaacattccggagttcagatcttggtcgctttcagtttcttctgcaagcgctcacaagggtttgatacataaatnattgtgcatggtatccgataggcaaganttcaacanggaatatagatgtgcantggnaaatttatatatncactcaatgtanatatgntatccaaatcttacaagaaatgcaaagatncatgttccgaactactaatttgtaatgttgcacttttccgctgcatgaccaaagttttcgggttaaaaaaaaaaaa

SEQ ID NO: 89310 - DNA, 508 bp, Triticum aestivum
  unsure (1)..(508): unsure at all n locations
  Clone ID: PAT_TA_89310
caaacaccagccatggcgatggcgtccttccgcccccttcccctcgctctcctgctcgccgcgtgcctctcggcgctcgtgctggccgtggcgcacgcgcggaccctacggctggagcccaccatccggctgccgtcgcagcgcgccgccgggcangaggacgattactccgttcgggaccangtgggccttcttatcgccggctccaacggctactacaactaccgcaaccaagcngatatcttgccacgcctacaaattatgaagaaaggttgtctcaaaggattagaacatcatcatattcatgtatgacnaacttttcgcaaaacccgganaaccccaaggccgggntcatcatcaacaaccccaaggtgganaattcnatctggggtcccctaggataaactggaangaggtaattcaaaaantccttnctgtcctctcgttataaaacncttnattgtggaacgnaaatcctngacatggcctatatanattttgttttaaa

SEQ ID NO: 89311 - DNA, 534 bp, Triticum aestivum
  unsure (1)..(534): unsure at all n locations
  Clone ID: PAT_TA_89311
tgtcactttgctagctccaaaaagggtgcagctttgcttattttcctctccttccctatttgcatcctccccaagcccaggcaggcatggcgcaccacgcgccgtccaactctctcatactcttcctggtcctcacttccatccaagacggcagaggtgcgacgtcgcgtccatcgccggcgccggcgggatacgttgccggttcgcgccgtggtgtaccgattcggtgggcgctcccggccgcgacggtagccgccgccggggacgangcgccgggcggaggaattacgaccgttccagctgtgcatggggtgccggtgctgcgcggcggcagggagcggcggcgccaagcagctcatgcgtggacacgcggtgctgctacccatcgactgcaantccccggcaacccttcgggtctgcgccttctccccccgcanatcggctgcggcgccngngccggggccggnaaaaatgcacgcaactagggacacgntaanctcgtnacgttaagcaaanatngtctataactgctng

SEQ ID NO: 89312 - DNA, 513 bp, Triticum aestivum
  unsure (1)..(513): unsure at all n locations
  Clone ID: PAT_TA_89312
cagctgcgcaaaggctcgacaaaccctaaccctagtccatanctagctnagcttccttcctctcgatctagcttgagccatggcgccgaccaanggcgaggggccggccatcggcatcgacctcggcaccacctactcgtgcgtcagcgtgtggcancacgaccgcgttcnagattatcgccaacgaccagggcaacctgaacaagcccttcgtacgttcgcctttaaccgactccggacgcctcannggnaaattccccccnagaaccaagttnccctnaaccccacaanacgttttccattcnaaacgtctttaatggcaaaaggttgctnaancccctttccaaagtgattttaaaaatttgnccttaaangttttccctggccccccaaacancctatnattctngtaaantaaaggntttangacancatttctaacttaagatttctccaagggcctnancaatatcgtgatatcctgnggttacctggnttnctttaaaaagcttt

SEQ ID NO: 89313 - DNA, 534 bp, Triticum aestivum
  unsure (1)..(534): unsure at all n locations
  Clone ID: PAT_TA_89313
ctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtggcccatccgagggcatcaagaattccgagaccctgtcttacctgccaccgctcaacacggaggcctcctcaagcaggtggactactgatccgctccaagtgggtgccttgccttngatttaagcaagtcgggttcatcttccgtngagcacaatgcgtctccccggggtactacgacggccgctactgggacaatgtggaactgcctatgttcggggtgcaccgacgccacacaagtgatnaacgagtggaggagtcaagaaggattacctgacgcgtacgtccgcatcatcggattcgacaacatgcgcaagtgcaatgcgtcagctcaatgccttcaagcaacgggctgcnaggatccggcaaggct

SEQ ID NO: 89314 - DNA, 281 bp, Triticum aestivum
  Clone ID: PAT_TA_89314
ggtaagaagaagcagccgcagccgcagcgcgaccccgcgaggaaaccctaccgccgccgcagcaggagcagccatgggtatcgacctcgtcgccggcgggaggaacaagaggaccaagcgcgtcgcgcccaagtccgacgatgtctacctcaagctcctcgtcaagctctaccgtttcctgggtgaggaaggaccaagagcaatttcaacgccttctcctcaagaggtcttcatgagcaagactaaccgcccgccgcttttcatgcgccgcctctctaagg

SEQ ID NO: 89315 - DNA, 489 bp, Triticum aestivum
  unsure (1)..(489): unsure at all n locations
  Clone ID: PAT_TA_89315
ggtaaatcgaggtatgcctgcagtcagggcaggctttccaagagctggttccccaggaatgctgaatatggcatcgacaggaaacatgccactcaaaagtgtgcaaggagtgccaaatgccatgtctcccgctgggaaattctatgatgaaggccacgccgattctatgcagatgcttccgtcctgggtcaagcagcatatggcgaangccggaacaccacatgcagtttcacaagggaaatagtcaagctgcccattttnagcagcatgatccatcattctccnaaggctgcaactccttnactcttcaagcaaacccaaaggcaaatcagttttcacaaccactgacatgttnggtaacccgaactttctcaanaccaanggaccagcatccaancccanagaacagcanttccacnangcctatgaactggttaaggaaagnatttaaaactttggggntccaagaannaaaacctcctttcnagg

SEQ ID NO: 89316 - DNA, 347 bp, Triticum aestivum
  unsure (1)..(347): unsure at all n locations
  Clone ID: PAT_TA_89316
ccaccgcccgcctcgaggacgccgtcctccgcatcgacgtcgtccacgccaacgccggcgggggcaccaagccgctcgtggggtccgcgcgcctccctctgcgcgacgtcctcgacgacgccggcctcggcggccgcgcgtcccgcacgctccgcctcaagcgcccctccggccggccccagggccgcctcgacgtccgcgtcgccgtccgcgaaggcngccgcccgctactacgaccccgcctacccgccgccctacggccagagccagccccagtccngcgacccctacgcggccncggnccgtacggctcgngngggtagggtatnggnaagcacanccgtagc

SEQ ID NO: 89317 - DNA, 353 bp, Triticum aestivum
  unsure (1)..(353): unsure at all n locations
  Clone ID: PAT_TA_89317
gggaagcgatacgccaggcaggcgtcatgatggagaagatgaagatggtgcgggacgccagtcaggctgcctacgacgctagctcagctctccaaagcaacgttcagattagttggtcgccgcttgttctgttaggatatgatatctaaagactctttccaaaaatctttgctccgaaaatctttgcgttagtacacccactgggtgcgttggttgaactttgaattaatgggggcacgcctgagtgcaccactgggtgttatcctccgagactacggttggactgcgggcagtcgactgtatcttttggtattttgtccnagtgtnaatcgaacttaattttttgggggggg

SEQ ID NO: 89318 - DNA, 456 bp, Triticum aestivum
  unsure (1)..(456): unsure at all n locations
  Clone ID: PAT_TA_89318
cttgagagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtcgacatcgacgcccacggcaggaangtcggcaagaaggcgtgtaccantttgtttacaattacggcgccacgtcgaacggtacagcccatctaaaccccggagaatggctaaacttggtaacggtaccccggcggaacaacggtttcttaactggcggtaaccttgcccggctccttcggggggggtctcctcgtctaaaaaacaaggttttgcccggnaaaaaanactacntttaaaaaaggcggttcttcttgcaagaancctttaacacttacctctctgtnaa

SEQ ID NO: 89319 - DNA, 410 bp, Triticum aestivum
  unsure (1)..(410): unsure at all n locations
  Clone ID: PAT_TA_89319
ctctgcggcggcgcacgagggatctggagaagacgagaanatgatggggaggaaggccctgnactacaatnagctcaacgagaacgtcaacaangtgnagtacnccgtgcgcggggagctctacctccgcncctccgagctccagaaagangncaanaggatcatcttcatnnaacgtcggcaacccncacgccctcngacanaagccactcaccttcncccgccaggttagtggcnctctgcnangctcccttcctgctcnatgatccaangtcngcctcatcttccccccngattgccanngcnaaggcanccactacctctccctcancgcccggaagntttangtncttacagtnaattcncgatgntccctggggttaggnangaaanttncctntttantcaaa

SEQ ID NO: 89320 - DNA, 479 bp, Triticum aestivum
  unsure (1)..(479): unsure at all n locations
  Clone ID: PAT_TA_89320
gtcgcttagggcgactccggaggcgccgccgccgggaccttagaaggcccgtccccagctccccgttcaccacgccgccgccggaggacgccgtaccacggcggacggcggcggcggggcatgtccgctcgtcttttttctttctctaagtctgatggtcttccaatctggccgtcgtcgttctatatcccaggtctgccgatctgggctgcgactgtcctacttngggcggcatcgcgatctgggtccgccaatagctcccgatttggcaagacgccgactttgggtttgcaattgtctccatggattcggtacgtccaagcaagattgttcggcaagtntctcaaagtccangcctccctgcatgccaagcaaccaacganctgccaatattnggctggnttaagtcctccactacaangncatcacatcgcatgcagttnttcctggnntaacanaaaanttgaaaaaattacgan

SEQ ID NO: 89321 - DNA, 478 bp, Triticum aestivum
  unsure (1)..(478): unsure at all n locations
  Clone ID: PAT_TA_89321
gaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcatgcatgcaccgcgcgtgcagcatcnatcatatcgatctactactaccataccatgtaaccgctacctgatcganggccttatctatgcacctgacctgcatcaacaatcaagtgcatgccatgcttgttgtaaacaggcccctaaataaaatctccctggttaactaa

SEQ ID NO: 89322 - DNA, 397 bp, Triticum aestivum
  unsure (1)..(397): unsure at all n locations
  Clone ID: PAT_TA_89322
ctgcaagggaaattncgggcaaccgaagccgaacaaaccagccgctnggaaagccncaagcccgttactactgaagcngaagccaagccaagcnccgttgccaatngcatggccgtngcgtngggctccgtggcaacgggtncaacngcaacgccnttggagantcaacaatgcccnaaaccntaccnatgcccgttacgttacgttacctactattactactgaagaaaacgaatntgngactgtcccgggataaaccacantnnatgcttcctctcgctaccttangccgcaanaaataaacggganccaaacttgtntttgtgcttgtntgtngtaatggacaagtttacgttaacnattaaangggaccttttanggagctaaaaaaaaaaaa

SEQ ID NO: 89323 - DNA, 467 bp, Triticum aestivum
  unsure (1)..(467): unsure at all n locations
  Clone ID: PAT_TA_89323
caactctcgccgccctctgcagtgagggccatccaggcctccacggcaggtcccgggtgttggctgcttgggcttctccttctctcactgccttctccgctcgtgctgcatgctgccgtgcagcggaccgctgatgctgccgccggctgggtaaactaatcggtgaaaagcgtcgaaggagcaagactgctgcaaaagcaaaaggtaacactggtgaaacagcaaacatgggtccaaggaagagcatatctgtatttattggtcgtaagcatctttgggcagtcccggtgtgttcctacagttggtngctatggagcacttttgggcatttgggtgtatccaacagttctgactatggacactggataatataagtaattatccacaagacaagtttgtggaatgaaaatggtnaagatcatccaaccgtctcgaatcaattaaggaaactaatnggcncaaaacan

SEQ ID NO: 89324 - DNA, 480 bp, Triticum aestivum
  unsure (1)..(480): unsure at all n locations
  Clone ID: PAT_TA_89324
gaaaggcgtcttcgtactcgcctctctccgcgcaaccgagccttcgccctcctccttccccatttcgccagcggcgcagcccaccaaccacccccacccgccgccatgagggagtgcatctcgatccacatcggccaggccggcatccaggtcgggaacgcgtgctgggagctctattgcctcgagcatggcattcagcctgatggccagatgcccggtgacaagaccgttnggggaggtgatgatgctttcaacaccttcttcagcgagactggtgctgggaaacacgtcccccgtgctgtcctcgtaaatttcgagccactgtgattgatnaagttaggactgggcgcttaacgccaagctcttcaacctgagcaacttatcaatnggcaangaggatgcaaccaacaaatttncccgttggcattacaccaatnggaaggagattgtttatntccgcctaaattgttacaaggaant

SEQ ID NO: 89325 - DNA, 515 bp, Triticum aestivum
  unsure (1)..(515): unsure at all n locations
  Clone ID: PAT_TA_89325
cattactgcctgagtagatgaagaatagatcattatatatacaaatatattgtgtggagaatgaagttcatctttattaatctcattactgcctgagtagatgaagaatagatcatttatatatagcaatatatataatgaagaatgaagttcatctttattaccttgtgatacacccagctgtgtttgtgccccactgatctcagcagaggcaattttcttctgtttgtaggcctcatgtcgtctcttattaatctcatccttattttgtgcataccgctctctatccctctgcctttttacttctttagggtgtgcacataatgtcacaattcagcagttggggtacaaaaactgaaattgggtggttgtgtaatgctcatcanccaaggattggttgttgcttatatcctggaacgggtgcgcgccctgttgggactggttggggcatatgaatcctcaacctgtgaatgtcaagaatggatcacacaattgtaactgaaggatactntaca

SEQ ID NO: 89326 - DNA, 472 bp, Triticum aestivum
  unsure (1)..(472): unsure at all n locations
  Clone ID: PAT_TA_89326
ctcccgcagcttgctctccccgattcctcctgcgacgagctcgccgccccgcccccgatctgcccccgcccccacgcgccctgcctcaagatttggcagccgcgccaccacccacccccggatcaggccgccgcgccgccaccgttcttggatccggccgccgtgccgcctgcacgaggggatgccaagccctcgtgctcctccatcggcagccacaggggggactccggcgcaccttcccttcctctcttcctctccttccttctccctcacaccctctctctctgttctcccgcangtacccgccatggccatcatggacagcagccatgcggcaagagctcgccaccaaagtcccccnagcactgtccgccccgaatctggctgggaacagacaaggcgagccctcaagcccagatcgcttcancaatctcaaatttgccgccncaacttcgggngttnaantaaanac

SEQ ID NO: 89327 - DNA, 268 bp, Triticum aestivum
  unsure (1)..(268): unsure at all n locations
  Clone ID: PAT_TA_89327
ctcgtcggcgcagcctccgccgtcgtcgtcaggcgtcgatgtggccgttgacgcngggaaagactacgaacggnggcggctgctcctcgatgccgccatcgacngcaacctcgacctcctcnccaggatggcgctggagctgctgccnccggcncccagcgccactggngcngacnccaccaccngcgtctggtcgacgtgcggcagggcgcngcaccttnccgcgaccaacaggaaggaccgangtctgcgctactcatccaaggac

SEQ ID NO: 89328 - DNA, 463 bp, Triticum aestivum
  unsure (1)..(463): unsure at all n locations
  Clone ID: PAT_TA_89328
gaaatatgtcatatgttcatgtatctgtcgagtgttacagatgtacagaggaggaggatgcaggttcggccactacactaacaatctccgtaaaaaactcatctggataagcttgtgcgatcatgcactagagacgaggattggtagttacagagagagagagctacgctggttcttttccaacaggttcagaaaattcagtttgttggtttcgccgaagtttcagttgttagctaatttctggcgcacgtcgtccacttcgtcacatcagtcatgcacgtagcccacctcgccgctgcatcgcacacatcgattccggtggttgttggccggtccagtcggtctggctcgggctttgtcggcgccggtccggtccccaaaaacaagaccgctcgcctgctcngtccgattccggtctggcctgccngcggcaatccaaacnacggtccgnncaagacgtnac

SEQ ID NO: 89329 - DNA, 421 bp, Triticum aestivum
  unsure (1)..(421): unsure at all n locations
  Clone ID: PAT_TA_89329
cttgttcctagccttcaccggtctccaggcgaaccagggccttggcatggtgggtgcgagcccgtccacgctggtcacgctcaccgcctgctcccaaaccgaccccgtcaccggcgcctgcctcggcggcaccttgcacagccccacgttctggctgggcgtggccggcttcctcgtcaccgccacgtgcctcgccagggacgtcaagggcgccatgatatacggcatagtcttcgtcacggccgtgtcttggatnaagaggcaccaagcgtcaccgtgttcccggacacgccggccggcaatgccggcttctcctaattcaagaangtggtggacttccacatgatcaagacacgggcgggcaactcaacttcggtggcttccgccatggnaactnttggttggcaatctcaangctgtc

SEQ ID NO: 89330 - DNA, 187 bp, Triticum aestivum
  unsure (1)..(187): unsure at all n locations
  Clone ID: PAT_TA_89330
ccgccacccaaatccctccgctcccacccataaacttatccaaaaccgcccgccccatcccgctccanccnagccccgcnccnaacgcgatcgccccaggctccccgcgctgctgnancaatgcnngccttcnggacnctctccgccggcngcgccgccgccngtattcngggnctgttntgcctcc

SEQ ID NO: 89331 - DNA, 502 bp, Triticum aestivum
  unsure (1)..(502): unsure at all n locations
  Clone ID: PAT_TA_89331
acgggacgggacgtgtggccgtcgagccagaggccacccgcaccgtccgttcccgcgccgcgcccacaccccacaccccacgctcggccgtgcttcacatggcgcatggcgggcagatcagaaccggaggaggncaaacccaagccgccgttcctctcctctcctctcctctccaccacctacccaattcatctcgcgcgcgcccataaatccgnggccctgcgctacaacaacctccaataancagngtcagcaacaacagtgcccgccccgtctacaagaccctcaactgaattcacaccacgccggtgctgtagtctgaacccacctgctcgtgnccggtgccancngcancgagaacgannaccgatgctnntaggagcgcgtccatgccggngctcggaccgctgcaacgcacctcaggnnccggnaggactcgctncctcanatcgccantctcgccanggttnctacatctncgggcacncctnagccgtcgntg

SEQ ID NO: 89332 - DNA, 503 bp, Triticum aestivum
  unsure (1)..(503): unsure at all n locations
  Clone ID: PAT_TA_89332
aagtagtctatgtccacaaaaagttcatgatatcagtatgaatacgcgtacggtttgttggatgaatatatcatctgatgtagtatataaatgtatgtcaatcttaattgtgtagtttacaaggcaaggctagctagctagcgtgagatgtctggcttggatggtgagcaggtcctggtgtccacggacgactcccagctgagcttgacggaggaggcgtcgtggtgtgccggcacgtactcctccagcgcggcgagcagctcaccgggcgtgggcgccgccacgatgatcttccgcgccgccggcgccacgaacccctcctccaccgccctgtcgatgaacgccagcagcgagtcgtagtacccgtccacgttcaacaatcccaccggcttgtcgtggatgccgagctgcgcccaagtgatgactccagcagtctccancgtgccgtaccgccaaggagcgcacgaagngtcgngccgcgggcatctaaactnggctggnga

SEQ ID NO: 89333 - DNA, 495 bp, Triticum aestivum
  unsure (1)..(495): unsure at all n locations
  Clone ID: PAT_TA_89333
agatattagacgagcagcaaagaatcgtcggtgcctgtctgcctgcctgatcaaagcgtccatcagaggatccttggccattgagacgttcttcacagcgctcgtcttctgcgaggcgccgctggacggccacggcacatcaagtgctaactgtccgcacgggtgaacaggctggtctcaggcggcagcggcgcgacagagccggcggccacagctaacaaggcggatgctgagaaagtgcaaggcttcttctccggcaagcccaacggctaacaaagcagaccgtgagaaagagcaaggtttcctcctcctagcaagccnacagcgcaacggctgctggattccagctcgctttccatggactcaattgctttaataacttcaacaaatngttaatcngtgggatgttatgctgtgtgactgccttgtcacccctttcntggaacaatgctttccaaaaaatggtctgncaatctcaancctncaaataacaan

SEQ ID NO: 89334 - DNA, 476 bp, Triticum aestivum
  unsure (1)..(476): unsure at all n locations
  Clone ID: PAT_TA_89334
caagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtngaaggatcaggtgcatgcaggtgtggcccatcnaagggcattaagaagttncgagaccttgtcctnactngcaacgcttnaacaagggagccctcctcaaagcaagtcnactaacttattccgctcaaagtgggttgccttgcctccaantnaacaanggtggggtttatctcccgttaagcanaacgaacccctgggtacnacaatggccgtncngggcaatntgaaactgcctagttcngggngaacgacccccncaagtattacaaggtnnnggaggcaaaaagggtaccctaacctagtcnnataacgntncaaaaan

SEQ ID NO: 89335 - DNA, 484 bp, Triticum aestivum
  unsure (1)..(484): unsure at all n locations
  Clone ID: PAT_TA_89335
tcaaaatcaagcaaccttttgtacaagaaagggaccctctcctatacttcctaacgtaacaatgtttatacaattatgtcttgaaagaatcagtgtttgttgtatcctaatcttcttggtttgtacactgcaatgcatcaagctacgatgagctgctgctgtgtcctacactaagtgagattgttcccgaacccaacgccgaaccatctccgggtcgtgtcgtggagcaagagtatcattcacctcgcaaaacttgtgcgtccaaccgaccggttcgaacggctcgaaaccgaagccgggggtccggtccttgggactgaaggttcaccgggtccgtcaagtcggcacgtactccacacccggcgcctgaacttgacttgaaccctccaaacttgggacttgtagtnggttgacacggaccgcttgtcaatcnacccggacccggggcggacntgaatnatggtgattnncaacnatctccgcc

SEQ ID NO: 89336 - DNA, 511 bp, Triticum aestivum
  unsure (1)..(511): unsure at all n locations
  Clone ID: PAT_TA_89336
tttttttttaacaccataaccatattttgattccacatgaaaatagtaacatgagtactaaaaatacattgatactgtaccagaccttgcagcctgccaaacaatctactcaaaacaagtgacatgatcagcagaacatccatcaaggtggcggcgaaatgcttagcgaagtaatttgatcgtcgcagcangaaacatttgttaggatcattagtcccaactaacctaacgacttgtgttcaacatnggaagctcctttnagcaactccaagcccgacaccgacacanctccgggcgctgccaatgcaagaccaacgacccggngggttctcaacccggaanccctcnaccgggaacttcntnaggancgantcggcctgcgccncgggaaattggttatttccccggaacaaaccggccagggngaaaatttncccaagggaaaantttccccggggcccgnctggtccccnnatacnaatccaattttggngggttaagganccccttt

SEQ ID NO: 89337 - DNA, 493 bp, Triticum aestivum
  unsure (1)..(493): unsure at all n locations
  Clone ID: PAT_TA_89337
gctaagctaaacagcagcgagcaatggcgtccacctcctgcttcctccaccagtccaccgcgcgcctggccgcctcggcgcgccctgcgcccgccgtcgggcgcacccagctgttcgtctgcaaggcgcagaagaacgacgaggctgcacctgacgctgccgtcgtcaccagccggcgcgccgcgctgtccctcctcgccggtgccgccgccgtcgccgtcaaggtctcccccgccgcttccgcctaagggagaagcagcgaacgtgtttcggcaaggngaagaaaaacacggatttcgtggaaanaccggggaaagggggttnaaactgattattcccggcaaattggaacccaacaaggagcgtgagttcccttgggcaagtgctccgctacaaagacaacttcgaagccaccaacaactctccttntaatcaaaccgacacaaggagacatcacgacaangtcccctaagantctctccaaagttnggtn

SEQ ID NO: 89338 - DNA, 495 bp, Triticum aestivum
  unsure (1)..(495): unsure at all n locations
  Clone ID: PAT_TA_89338
cttcttccgccaccaccgccgcgcccttccaggggctcaagtcgaccgccggcctccccgtcagccgccgctcctgcagcgccggcctcagcagcgtcagcaatggcggaaggatcaagatgcatgcaggtgtggccaattgagggcatcaagaagttcgagaccctgtcttacttaccacccctctccaaggaggccctcctngaagcangtcgactacttnattcgctcaagtngggtgcctgcctccaattnaacaaagnttggttcntcctccggtgaacaanaaanctccccccggtaataanaacggtcgnaaacngacaatttggaaactgcctaattttcgggggnaaccganccanaaaangtgctcaacaaggtgnngaagttaaaaagggntacctgatcgtaagtcccgtcaaccggttcaaaaaatngncaagtgaatggtnagctcaatgctttaggcacaagctnnaagaactggaaggc

SEQ ID NO: 89339 - DNA, 178 bp, Triticum aestivum
  unsure (1)..(178): unsure at all n locations
  Clone ID: PAT_TA_89339
tttttttttttttttttttttgcctatgaggctctgatattcaagaaaatcggcagttgccaagaatacatcatttacatagttacgagtccagcaggacgggtaaaaaagaaggcaaaacaactgaanttacttaacttggttcaaaaaantnaagttanaacggntgnangttcca

SEQ ID NO: 89340 - DNA, 489 bp, Triticum aestivum
  unsure (1)..(489): unsure at all n locations
  Clone ID: PAT_TA_89340
cttcctttttctctttgtttctccctctgtctccgtgaccagcaatggccttggagacatgcctcagaggctgggccctgcacgcgccccaggctggcatcagggaacggcttagcantggcagctacgcgccatcccggncaangaccgccgcccccgccgtcgtctcgccgtncccatacaagtacgctctngtggcggnaagggggccgtntcgcttcctctgcaagttcaagaacgtcntcnacgaaagtgattgtggctgacgaagaagaattgggataacatggtgaatngccgtgcgantcncccgtgctggtggagtttttgggcgccanggtgcgggccgtncccgatgattccccngttattacgaatgggaanggtanattggcaagatnaaatgctgcaaggtgaacacggacnacggccaaacatccaacaactncggatccggagcatcccaccgtctcaantttaaggacggna

SEQ ID NO: 89341 - DNA, 489 bp, Triticum aestivum
  unsure (1)..(489): unsure at all n locations
  Clone ID: PAT_TA_89341
ccctcgtgcgcctctactaaaccgagtagtcggcaaggaggggcagcaggggagggagatctgactgacgaggccagggagggatgatggagagccaagcgctgcaagccccgaaggncgaaccccaangggccnggagccgnggcgaacaaccccggaccnggagttcccccggcnttctttccgggaaagganttnaaccnggnccttnaaaggnctcctnctcctgnttaaancgggggntanttgtttgttcaaattctnccgtnctcctcaaataactngncatcaatcccngccaaganaattccctttgtatnggacgtcnttnaaggcgggtaaaattancaaatcctcccaagggntattggaatttcccttggctttctttncgggaaaggaatntaacaattttgggcccaaaggatttttaaattaaaanctnnttaaaccaactgngggaaactttgttttgaanancnttccaaa

SEQ ID NO: 89342 - DNA, 280 bp, Triticum aestivum
  unsure (1)..(280): unsure at all n locations
  Clone ID: PAT_TA_89342
ccacacaagacaaggaagcagtaagcagtgaagaacagctagcatccatggngtgcatcaataccttgcagagctgctcatgttcaaaggggccaagggtganggcaagnaggggcaaaaccagccggcggcgggagcttcggtgcccggcgtccaaattcatgattggaaacngggctccgggtcggntccaacaanaancccganggccataatctccggggaattggccccaaaactttccctttncaangtngaanaacttccgggggtttcttca

SEQ ID NO: 89343 - DNA, 263 bp, Triticum aestivum
  unsure (1)..(263): unsure at all n locations
  Clone ID: PAT_TA_89343
catanccgcgaggaatcaanaaccttgcctgccgcacgtcgtccctgaggaccgaaaggagacgatggagggcggctgcggcgtggncggngggacggagggcagtggcggcaataagcancancagcaggcgcggtngcagttcgggcggtcgctgacgtnccaccaccacnannggcaccggntgctgtcccngtggctgctgtcgcagctggnggncgatccccncgcgctnncncaggctgtnntnctctacactacgt

SEQ ID NO: 89344 - DNA, 293 bp, Triticum aestivum
  unsure (1)..(293): unsure at all n locations
  Clone ID: PAT_TA_89344
gtctcgtctcgtcgaggaatcaacagccatgggcggcggcaacgcgcagaagtccaagatggcgaagggagaggaacctcgagaagctnaagggcggcaaggggaaccagctcgaaggcaacaagaaggccatgaacatccaatggcaagatatncatgcagactttcatctgcacaacttctgaagcaaantgcaaggagaatgccaaggcaaagcatccnaagaagcnanttcntcaaatggttcctnaactcaaagnattggttttngcccatnnaagccnagagagagt

SEQ ID NO: 89345 - DNA, 471 bp, Triticum aestivum
  unsure (1)..(471): unsure at all n locations
  Clone ID: PAT_TA_89345
gcactgctccgcgcacgcaccttctccgcatccaccgggcaatccggcccgtgcgccaccgcccaccacacgcgcgcagctcgacctcgacctcgacctcgatcgcgcgccagggcggcgggccatggcgttcctcttcggcgccctgctggggctgggtgctcggcgtcggcgtcgtcatggcgttcgcgcgcatcgagaattcccgcgccgagcagcgccgccagctggctgctacagttcatctttctcaaaattgtctgttcaagatctgaagcacttattcctactgaaggcctatcatcgtgggtatctttcaaacaaaaagcagagcttaaatggctgaatcaanatttggtgaaatctggcatttgtcaatgagntgatccggaactgataancttctgtggaccttatccagcantaaatcatcatttggctcatcatttaaagtnacactggtacgttctc

SEQ ID NO: 89346 - DNA, 210 bp, Triticum aestivum
  unsure (1)..(210): unsure at all n locations
  Clone ID: PAT_TA_89346
gccgcacacaagcgtttacctaacgctaatatgcacgatccacttcgccaactgcccgcccacccgcaccacagtttccccgcctccgctcgctgccccgcctccgccgctcgccccgcccgccgccttcccttcacgccgcccccgctcagcctcgcctcagcccgctcgcntcnctccccgnctctcgcggcctcgcnggatctcccc

SEQ ID NO: 89347 - DNA, 496 bp, Triticum aestivum
  unsure (1)..(496): unsure at all n locations
  Clone ID: PAT_TA_89347
cggatcctaggcgcgcgcgggaggtaaagctggtcggaggcttggccgtgagggcggtgagccaccggcgggagttggtcgccacgcagtgctaccctgcgtcagatctggaggttcaagctcctctcccctgccctctctctccctctggcctcggcggcagccggcctcgtccgtttgcctggtgcaggagggttctggtggaggggtagggactgggggaatccctgggtctggcctgacgttggtgatggccaaggtcgccactttcctccttggaggcgccgtcgaggtcctacaatccaccctgatcccacacccgagtgaaagcccaaaatccatctcgaattgggcggcggtggcgccatgtgcatcgtgcccttctaagaggcgattcntgggtggttgggttagttgaagcaacgctnacgtggaactcggaactttgggttctttggtcggtggacctatgctaaagttctcntgctcaanttgg

SEQ ID NO: 89348 - DNA, 484 bp, Triticum aestivum
  unsure (1)..(484): unsure at all n locations
  Clone ID: PAT_TA_89348
tctctctctccctcacccatccttctccaactccgcccgccgccacggccaggccggcgtggtggtgcgccttcgcctcccatccatccaccagcgccaccatcttcttctccttccccgcatccaccatcatccatccacaccgccgtcaccagcgccaccatctccagccaccagcaccacagcgccccgcgcgactctccctgctgcttcttctcccatgcctctcctgttgctcttctccttccctcgctgctcctcttctccacgcccctgcagccttccttcttctcctcaacctcctcgctgctgctcctccttctctccaaaactgctgttgcttcctctctgaatccctactgctgctgcctttcttctccccttgctacttctcctccttcaagcgccccctttgctgctcctctttccttcgcttgctctgcttctcccctgccctgctaaagttctctcctcangccctctg

SEQ ID NO: 89349 - DNA, 489 bp, Triticum aestivum
  unsure (1)..(489): unsure at all n locations
  Clone ID: PAT_TA_89349
gttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttgggactgatggacttaccatcttgatcgttacaaaaggacgatgctacacatcgacctgttctgggnaagacagccatggntctgttaggtacctaaaccattaaactatttnaaaaggttccgtttccnannagtttacctccaatggtaggtaactatttggttcaaancctacttgnccnactttggggatttacaatccccctacttatcaaaaacttccaangccgctcaanggtaccaaattgaaaaaataattnaa

SEQ ID NO: 89350 - DNA, 489 bp, Triticum aestivum
  unsure (1)..(489): unsure at all n locations
  Clone ID: PAT_TA_89350
aagaccccgtggacgtcaagtttcgtgtcgttgaccccgaacctctacgaaaacgtgtacgactacttccgtcttcgaagaaccggagcatgcgacaacgactatttccactacgaacgtcccgagaacgtccaattcccctacaccacatcgaacttggtccgttctaacaacacacgcttcgaaggtataaccccgagacgactgcccgtgaacggatgcatgtgtgatgtatgagatgctcgtgcttgcttcatgctccaattgtcggtgcacgttgcccctcctttacgttgtcacatcgtcgaccatgggacacccggtatccnggagtgctcaacacctttgcacggttcgganactttcctttgcatccgtatctcaatcgattaccngaaccnggaattgccgtgggaacgttcaatatctcccntgggaccctttgtttncccacnaanacaaaagctcanaagnnctataatcttaana

SEQ ID NO: 89351 - DNA, 289 bp, Triticum aestivum
  unsure (1)..(289): unsure at all n locations
  Clone ID: PAT_TA_89351
ctagagtcctggccggcccggtcgatactttctatctccaaacctacaaattacgctcaagacacgactaactcggtcactcaagatataggacagagcagtaaataccccgaatagtactatcgtaaaacctgcagcactacgacctatccaactggaccaacgcttctccacattcttttggaacaaaagttatcacttgggtattcactacatcctcatgaattcaattcnncttctgcaagggaaagntnaacaaccncatttaaatnaatnacancnaacccaa

SEQ ID NO: 89352 - DNA, 498 bp, Triticum aestivum
  unsure (1)..(498): unsure at all n locations
  Clone ID: PAT_TA_89352
cttaaccacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaaggcctcggcggcgcttcgtgcgggcaggtggactccaagctcgcgccgtgcgtggnnttacccgggaaagggcgtctcnattaacaaggaatgctgctccggcttgnaaggctgaacggcctggccngnaaaaacccggaccgcaananacttgaagtccctcaaaacctcncaacaannatcattcaataaaatggncaagggtcnccggttcccggaattnnggttcngttccttcccaataanattcaacaantgnaaaattcaccnanttaataaanacctccaacttnatnaaggaccnctgcgtgagctaatttcacttaatggatgtanacatttagc

SEQ ID NO: 89353 - DNA, 515 bp, Triticum aestivum
  unsure (1)..(515): unsure at all n locations
  Clone ID: PAT_TA_89353
taaacatggggagcgccaagaagaaggcgctcggtgtggcggcgctggtggccgcattggtggtcatgcagctgctcgtggcagctccgacggtgatggcccgccaaccgcacgctctagaggaggagatggcggctcggtcggcaaagatagcaatggagcgcctcatcctgaagacaacgatnggagacggcctgcacctgcgggggttgagatgtgctactctagtctttgctttcgcagcggttgcagatgcctgtacccctactgctggaagcgcccaacactcctgcctgaancctcccatgcatgcatcaacccttaaatgtttngacaactatgtacccgtgggtcgcgtgctttcctttcctatacacgaatgtnaactatttagtgtgtccccgtgcatgcatcaagaagtctggattaaagcttgtnatactatcttggggtgggtnaataatggataatttgtnctgaaaaaaaggggggccgnaccaatcgcctatatgagn

SEQ ID NO: 89354 - DNA, 404 bp, Triticum aestivum
  unsure (1)..(404): unsure at all n locations
  Clone ID: PAT_TA_89354
acatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcagtgtgggcccatccgagggcatcaagaattccgagaccctgtcttacctgccaccgctcaagcacggaggcctcctcaagcaagtggactaccttgattccgtccaaagtngggtgctttgcctttgatttcaacaagtcggtttatccttcccgtttaacacaatgcgtctccccgggtactaacaacggccgctactggacaatgttgnaactcctattttcgggtgcaccgacgcacanagt

SEQ ID NO: 89355 - DNA, 158 bp, Triticum aestivum
  unsure (1)..(158): unsure at all n locations
  Clone ID: PAT_TA_89355
ggaaagggagagggacagaggagatagggaaagggagagggataaagganataggganagnnacagggatganaganatcnccatggtgattatcacagacacagggagcgtgattctgatcgtantgaanactgggatagangaanatcatctggga

SEQ ID NO: 89356 - DNA, 503 bp, Triticum aestivum
  unsure (1)..(503): unsure at all n locations
  Clone ID: PAT_TA_89356
ctcatctgatcacccactagctagccagctagcancttaaggaactagcttgcagctagcgatccatggctcgtctcaacagcaaggctgtggcggccgccgtggtcctggcggcggtggtgctgatnaatngccggcagggaangcctcggcggcgctgtcgtgcgggcaggtttgactccaagctcgcgccntgcntgnattaaccgggaaaagggcntcctccattaagcaaggattgctcctccggctttnaaggctaaacgggctggccggcaanaaccccgaaccgcaaaatacgtgaaaggtncctcaaaaagcccccccacnagnatcaaatccaatcaacatgggcaaggtccccggttgccccggnaattnggttcngcttgcccttncccntaacaattcaacaaactcaacatttcaacaattnaattnataacctcccaanttaatcaatgaccctgcttgnagctaattccactttaatgaatgtaaaa

SEQ ID NO: 89357 - DNA, 383 bp, Triticum aestivum
  unsure (1)..(383): unsure at all n locations
  Clone ID: PAT_TA_89357
ccttctcgctcgcgtccccactccatttccctttcccccgaggaggctgccgccgtgacctgagagcacacgcacgcaccatgtggcgccgcctccaaaccctagcccccgccctccaccgcgctgccgccgcagccggcgcggccccctccccggccagcgccggggccgctccctctccacggggtngcggctttccgccgnaantggcccttcttctcttccgganaanccgggcgcggaaggaanaatttgganggacttcatcccatacacgggttttagccccaagaattcnaggngggttcaagggaaaaaacttcaatggatttcccgttnggccctttcgtatnnaggagacaanctcntttannccatttttc

SEQ ID NO: 89358 - DNA, 481 bp, Triticum aestivum
  unsure (1)..(481): unsure at all n locations
  Clone ID: PAT_TA_89358
ctcgagtttttttttttttttttttaacaaagaaaactcaatagcacgtaacattagatttcaaaagcgctcagtctttgaaagaaaattaagcaagtttcttctctgcttttcggcatgaaattaaatctcatttctaagagggactggaggattcttgcgctcatatttgtaccccgtccggaatacaacttgtcggagatagcggataacctcatttattgaaggctcttgccgggattaatcttcacacaccgtagcccatatccgaggnagcttttacccgttggaaggcanccgcatccnaaggatgattncatgaaaaaaatngccccngtntcccaacgtttaaaaatgggtgtcaataaagcattccacaanttggttggcttcngggaatctccnccccggtaaatcccattacattacccaaacanaatctgctaaccgaattccctcgtaacattcaggaaanattcaa

SEQ ID NO: 89359 - DNA, 330 bp, Triticum aestivum
  unsure (1)..(330): unsure at all n locations
  Clone ID: PAT_TA_89359
taaccacactcatctnatcacccactagctagccagctagcancttaaggaactagcttgcagctagcgatccatggctcgtctcaacagcaaggctgtggccggccgccgtggtcctggcggcggttgtgctgataatngccggcagggaangcctcggcggcgcttttcgttgcgggcaggtttgactccaagctcgcgccttgctggagttaaccggggaaaagggngtcttccatttancaaaggatgcttcctccggctttnaagggcttaaacggcctgnccggaanaaccccgacggcagaaacttaaagntcctcaaaaccc

SEQ ID NO: 89360 - DNA, 268 bp, Triticum aestivum
  unsure (1)..(268): unsure at all n locations
  Clone ID: PAT_TA_89360
ggctgctacagatgcgggaagggaggcggcttctggggccgtggggacaaggaggcgtgcctcgcctgcggcgcacggtactgctcggcttgcgtgctccgggcaatggggtccatgccggagggccgcaagtgcttgtcctgcatcgggcggcccgtggccgagtccgaggcggaatgcccttgggccgaggctcacgccttgcttgcggcgactgattnattgcggcggaaggttgagctcctcattaaaanccaacgttaattcc

SEQ ID NO: 89361 - DNA, 507 bp, Triticum aestivum
  unsure (1)..(507): unsure at all n locations
  Clone ID: PAT_TA_89361
ccgacgccgatgtcggcaagtacgccaccggcgccgtccgcttccgattccgcgacccctgtcttgccttatcctctgacgcagcagcccagttngcccaccactccccccccccccctcctccttcccggngtctcctccttccaccccatctcctccgacgccnaccttggcaagtacgccnccngcacgtttcatcccccgagctcgcgacgccnctcttgccgccngtactatgcctctgctgctgcctctccttcccanccntcccgcctcccaagttcaaaatttctgtcaaagttcaaatccgcgcgcccagtttcaactcttcagaaaccacttctacngcccaatntaaataanttggcangcatatnggactcacgcttctaaaactacacccccanaatnacacattgggtaancaaacttcaaattnaagggatgtnaggaaatntgatcattctctcgcctctaactcttgtcanggcangcagcctcgcctta

SEQ ID NO: 89362 - DNA, 494 bp, Triticum aestivum
  unsure (1)..(494): unsure at all n locations
  Clone ID: PAT_TA_89362
ggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctcactgagagtggtaacactaaggatgacctgaagcttcccactgatgatgttctgcttggccagatnaagactggatttgctgatngcaaggacctgatcctgtctgtgatgtccgccatgggtgaagaacagatctgcgctgtgaangaaatcngttgtggcaagtaagcanctntgcgtggntncctaacttcgatacttgggaactaatgcttctgggttttgagatacacatacatagnctcaagatacttttgggtgaaacaanttgatcaaaattgtgtgtttttaaaccaaaggc

SEQ ID NO: 89363 - DNA, 458 bp, Triticum aestivum
  unsure (1)..(458): unsure at all n locations
  Clone ID: PAT_TA_89363
cggaggccctcctcaagcaggtcgactacctgatccgctccaagtgggtgccttgcctcgagttcagcaaggttgggtttatcttccgtgagcacaacgcatcccctgggtactacgatggccggtactggacaatgtggaagctgcctatgttcgggtgcaccgacgccacgcaggtgatcaacgangtggaggangtcaagaaagagtaccctgaacctttgtccgcatcatcggattccaaaacaatgcccaagtgnattcnttcagtttcantgccntttaanncaaccggttccaagaatccgggaagggctnaacaaattanttaacnaanggcaaatttaatngcaatncngnttttaacccaaaatgnctttggttccttttcaattacntcccngtttgttcccaaaanaaaaantntttntcaaattcccaaatacccanaaaangtc

SEQ ID NO: 89364 - DNA, 488 bp, Triticum aestivum
  unsure (1)..(488): unsure at all n locations
  Clone ID: PAT_TA_89364
gaaatttcaaaatttcaaagtgaaacctgagaatacatattacgttggtgtgcacagtgtcaagtttaatccaagggacaccaacacttttgcttgtgttaccgatgagggcaaagtagaggtctggaacaccaaaacttccattcttggaaaccacactgaagggggcattccgtcatggccgattattcttcaaatccgcggcatcacacttgatggtactttgaaattttgacgcacacaactcccnaatatgggattttntaagacacnaaaantttttcacacccctancgtnaagtttggcacaaaatgactgggttgcttgccacccaaagcttccaatactggttacaagttttnacaacggactgtatgttttgtgggatccaatactacagcttttaaaaatggtcaatttaccnacggaatgtcctgatttgnattttccccaaacacaaattgccatcaagccgcttccattntaa

SEQ ID NO: 89365 - DNA, 519 bp, Triticum aestivum
  unsure (1)..(519): unsure at all n locations
  Clone ID: PAT_TA_89365
tatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactaccttatccgcttcaagtgggtgccttgcctcgagttcagcaaggttgggttcatcttccgtgagcacaacgcancccctgggtactacaatggccggtactgggacaatgtggaaactgcctatgttcgggatgcaccgacccacgcaagttatcaacaagtggaggaagtcaagaaggagtacctgacgcctatgttcgcatcatcggattcgacaacatcgtcaggtgcatgcgtcagctcatcgcctcaagcaacgggcg

SEQ ID NO: 89366 - DNA, 540 bp, Triticum aestivum
  unsure (1)..(540): unsure at all n locations
  Clone ID: PAT_TA_89366
ctagcttcagctagccaccctcttccactccgggcattttcttgcatccacgacggcnatggccaccgctgatgtccagaacccgacggccgcgctgacggaggaaggcgcccgcggtggagacgcccgtcgccgcccaaggaggccacgaaagacggangaangtccccgcgcccggcggaagccgagtccaaggcgcttgtcccgtccaaggtttnagganaccaaggaggaaggcgccccggcagccgcttagacgganggaaacaaaggagccccaagccangcaactccggcccaagcccggaaggcccaaggcgcccaaaaaagccnaagcgccgccnttcttcccaaggcanaaacaaaggaaggcntttgctttaaggaaaaccgnantctccagaagtntaaggagaagncggcgccccngtncccanccaaaagtgccggcttcgccnaagaaacaaccggcggaaccgaacgggnaccnctnccccggaaaagaaccgccnccccgtttncaaactcccntttaggccc

SEQ ID NO: 89367 - DNA, 504 bp, Triticum aestivum
  unsure (1)..(504): unsure at all n locations
  Clone ID: PAT_TA_89367
gaagcacagtgttttcgaatgctgaggagcacgcagcatcccagctgtgtgtttttagtgtgaggtcgagtggtgtacagcttgcatgagattggtgatgaacatggttgctggtgatctgctcatgcggcgagttagtgtgccggaggcggctcagcctggcacagaacagtgcctgatccgttctcgaatttcctgttctgcctctccctttcggttgtctactcatttaatgcgtctgctggctggctttattttcccctccatacagctgctatacagagcacaatacaacactgggtcacacatccacatgccacctgatggttgtgatttcangatcagctgagcctgggctcagaaacaatattcgcatgaatgctccatagttctacatgcaacacagctaattactgaatctgcaatgcatgcttaattctggcanaagctaatggatgaataacantttgattatggcaaggacatggncntcnggtctggggn

SEQ ID NO: 89368 - DNA, 480 bp, Triticum aestivum
  unsure (1)..(480): unsure at all n locations
  Clone ID: PAT_TA_89368
ctccgggcggcgccgcaagctgcttcgcttcgctccttctcgctccgctccgctccggcggtcccccgcctcctcgccgtcgccgccagcaccagggtttcctgctcggctcccagcaagccaggttctaaaggtggtccatcagttggcgcaatgggcgtcgaggaggagcaagacgtgcagcaaccggacggcggcggaaagcctgttgccgccaccgccaagccgccgcctccggaaagcgatcagcaaaaaccgagcaacccccgcgtgtcgacctgcagcacggacaaggacgacggctcgctctctgccgggtgtgccactgcgtggagcctgactcagangcgaatctgcattgggtttcctaagcattgtgccgccttctcaagacctttgtgcctcaagactgacaaaggaccaagcaatgagccaccaagccttcataacaagaatggtctgatctccaaattctcagtt

SEQ ID NO: 89369 - DNA, 464 bp, Triticum aestivum
  unsure (1)..(464): unsure at all n locations
  Clone ID: PAT_TA_89369
cttctctactttggggtagtatcatacaacctgatgtagcagaagtaccttcctctgcattatatgataactttgtcttgtaactatgttggtcacaatgtacaacgatcacacctcctatctttggctggacactgcaattagcatgcttggtatccagggagagggtgatcctacctatgcctacagcccaattgccacaactgtgtacaaaatgaatcagctgatcctcaccgcaacattcgctattgccacaacgcttctggcggtctaagttnatcgctacgagtagttnttaagaggtccattgatcagggacggttaggaagtacttggacatggccttcctgaactcttcctgtactgcatccgggatatatggtgggggcttcgttcttggggcctccaagatgccagaggccttnaccaagtctcaagctgtttgtccaagtgtattggngcaa

SEQ ID NO: 89370 - DNA, 292 bp, Triticum aestivum
  unsure (1)..(292): unsure at all n locations
  Clone ID: PAT_TA_89370
ntcncgngagcncgtgtngcctcggntcctccccccatctcctctctcgccaanaaccaccgagcttggagcgccaccgccatggccatggccacncaagcctcggcggcnanncgccacctgatcancgcggtctggtcgccctcngcaaagccccgncccgccaccctcgccatgcnatcctccgcccgcggcccggccccgctctgcgccgcggactcaganacncgcgacncacanggagaagncagcggagnccgncccgcaggcttcgtgcagccgcaactgnact

SEQ ID NO: 89371 - DNA, 470 bp, Triticum aestivum
  unsure (1)..(470): unsure at all n locations
  Clone ID: PAT_TA_89371
gttcatctgagcgctgagccgccgccgccgccgccgctattcatctgagcgctgagaagacgccgccggtgccaccgcccactgcaacttctcccccactcggccacccccgaggccgactcctgcggcggctggcatctcccgcatctgcgccctcgccttcgcactgaccgccgaccgtcgcgccgtcgctggactcgctgcacgaaaggaaggagaaggaccaaaggaagacatggacccgccgtcgcccatccgtccgcccagcgcccatccaccttcgattcgagcttcgagccttcgacatcgttcaactctccacattggcaactcaagcangcgaccgtctgtcaacctcggatctcggcgcgtcttctccagttantccatctncaacaattgtattgaattttgttcaatcttggtgactgttngtagtgaaaggaacttggtgtattgttgtacttgtt

SEQ ID NO: 89372 - DNA, 492 bp, Triticum aestivum
  unsure (1)..(492): unsure at all n locations
  Clone ID: PAT_TA_89372
agagagctctcctctccagacctctcccttctctccgccaggagtctagggttagagagagagcgagacgagcaaaaacaatctctcgccccactgttataccaagttcgcatccacctcactgttatacatctttgtatcacaatgggtggcctatccatggagcacccttgggcattcgccttcggcctactaggcaacgtgatctctttctcaagcctcctgggccccgataccaacattctaccggatcttcaagagcaaatccacggaggggttcaagtcggtgccctacgtctgggccttttnagcgcgatctntggatcttctaccactgggtaaagacggtaagggctcctcacagcatcaacctcccggtgcgtcatcaagacgtcaaatngtcctgtactnggtagccctggaaggcaagatttcacagcaaaattgtttcctcctcaacacaccggntcnggtaactccttctaacctctn

SEQ ID NO: 89373 - DNA, 475 bp, Triticum aestivum
  unsure (1)..(475): unsure at all n locations
  Clone ID: PAT_TA_89373
gagacctcgtcgcgagggagctgcgggaggaggagctcaacccaagaggagaggatgccagccagggagtcgtcttggctcgacgcggtccttcgcgtcttgaacctaacgccgtaggcggctcgtgcagttgcgcagcagacggcggccgaagctggtcatgacctcgcatcctgggtgcgtgctcgattagctcgtgtcttcacggccttcaggtgcgcaggtgagtccccaaccatctctctctctctcgttttgcctctgaggttgcaaatgcaagcacctgtttgcaaacgtgagcactagctgtttgtaaaagtgctgaaggagagctgctcanagganggcaatatgtgtgttccaagagaaaaggatggaaaagaaggtgactggnataantggagaagaaagttattagttaatcctatcaaacaaaattaatacaaccatgttanactttaatgtgtttgtagtn

SEQ ID NO: 89374 - DNA, 472 bp, Triticum aestivum
  unsure (1)..(472): unsure at all n locations
  Clone ID: PAT_TA_89374
cttgcttaccttttctctctcgcgcatccccaccctgctccgacctgcccaatctccaatcgaactcggtggggcccttttgtgtccaccagcgctgcgccatagatccgccgccgtgttgcatcttcttcaccgttcccgttccgcctcatcgcgcacctgctgtccccaaccccgtccgcgatcttggagattgattttttgaagcccctcatagccggcagtgganggaaggaggaggccaggagatactatgaagattacgtagtcaattctcatggaatctgtgataaatctgtcgttcttttgctatcccataaggaaaatgatccagagaagaaagttacatctcttcacactgggtaccatttttgcatctggggagaaatcatgttgtatcatgacgacgtcagcatttactttgaatttgaagactcatgtatgttaaagcgcatttttttaaaaaacaaaa

SEQ ID NO: 89375 - DNA, 444 bp, Triticum aestivum
  unsure (1)..(444): unsure at all n locations
  Clone ID: PAT_TA_89375
aatcctccagcgaaaccccaccccgccccaccccaccgtcagcatccatggcgcccaaggccgagaagaanccggcggtcnaagaagccagtggaggaggagcccgcggcggncaaggccgagaagaccccggccgggaagaagcccaaggccgagaagcngntgccggcgggcaagtcntcngcggcggccaaggatggcggcaangctaanaagaaggccaagaatagcgtggagacctanaagatctacatcttcaaggtgctnaagcaagtgcaacccgacatcggcatctcctccaaggccatgttcatcaagaactccttcatcaacgacatcttccataaacttgcccggcaaggcgcttaacctggcnaagtacaacaagatcccaacaacacgtccccggaaattcaanacttccttcgcctcgtcctccccggg

SEQ ID NO: 89376 - DNA, 477 bp, Triticum aestivum
  unsure (1)..(477): unsure at all n locations
  Clone ID: PAT_TA_89376
gttccgtatcatcgcggacttctcttcctcctcctcctcctcccccctccctctctctgtctctactttgcgcagccgcgctccaaaattccgaagcgagacgcctccacctccaagcaatctcccatcgatccggaagcttcccgtgtgcccaatgcatcgactcctccgcgcggctgcggcggcggccgcggggctcgccacggccacgactcgccgccaccgcgcgcccagctggggcgcggccgcagcgaggtggttctcggtcgaacgggaggcgatgagctacgacgtcgtgatcgtgggcgccggcccggcgggcctcgccgccgccatccggctgaagcaactctgccgcgcggncgacaacgacctctccgtctgcgtctccagaagggagccgaagtcgtgctaagtactgtcggggaatgtgttcgaagccccgtgcgctggataactcaacccgaagtgaggnaa

SEQ ID NO: 89377 - DNA, 462 bp, Triticum aestivum
  unsure (1)..(462): unsure at all n locations
  Clone ID: PAT_TA_89377
gaacgaaaaatccccaaccaatctcgtcgccgatcaaccctaggctcgtcgaatcctcctcccccgccgcctcaagatgcagatctttgtgaagacattgactggcaagaccatcacccttgaggtcgagtcgtctgacacaatcgacaatgtcaaggccaagatccaggacaaggagggcatccctccggaccagcagcgtctcattttcgctggcaagcagcttgaggatggcaggacccttgctgactacaacatccagaaggagtccacccttcaccttgtcctccgccttcgtggaggcatgcagatnttcgtcaagacgttnactgggcaagaccatcaccttgaggtggagtcntctgacacatcgacaacgtcaagggcaagattcaagacaaggagggcatcctccggacaacaacgcctcancnttnccggcaagcaacttgaggatggcnn

SEQ ID NO: 89378 - DNA, 460 bp, Triticum aestivum
  unsure (1)..(460): unsure at all n locations
  Clone ID: PAT_TA_89378
aaatagtctagtctggcgttcacgtaggagtcagcgcacgcgccgttccgttccaacaagaagaagagaagcagcgagcgtcccccctacagctcgttccacaaccgctcaggcgagcagcaccgtacagcagcatccgccggaggaggagatggagatggggccgggttcgcggcgccgccggtagctggagatcctgtgcgacgtcctcctcccgccgctcggcgtctacctccgccacggctgctactccacgcggttctggatcagcgtgccgtgcaccgtcctcggctacttcgcctgccttttcttcgtcactgangcccccttcatgggctacctgcacgactacctcgccctccttggtgccttggtgctactctgcaactgcaacaagggttgttactgcacaaactgttcgccttccttggngtctcctccactccggtaacaacccaaa

SEQ ID NO: 89379 - DNA, 476 bp, Triticum aestivum
  unsure (1)..(476): unsure at all n locations
  Clone ID: PAT_TA_89379
cgcaatccactcctccacgatcctgatgctaataactgcagggactgggcgagcctcggggaaggtccggcggggctcatcgcggatttcgtcctcgccaacgacgtggccgactacgtccgcttccgcgccgtgtgcggcccgtggcggcggtgctgcaccgacccgcgcgggcacggcgctctggaccgccggttccaccccaggcgctgggtcatgctccgggagaagtccgcctacgcccgccgcttcctcaacgtctccaccggcgagtgcatacaaacggaaatcttgggactccgccgagcatgacgantcgggttcacccccgaaggcttaatantcttgctccaanggcctaaccgaaccaacttcgttctgncaaccggttanccggcaananttnaaaatttcccgcaattacaangctgtnacctccaaaaggnnatcganttccttcccaacgngntttcccc

SEQ ID NO: 89380 - DNA, 489 bp, Triticum aestivum
  unsure (1)..(489): unsure at all n locations
  Clone ID: PAT_TA_89380
cctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaattcgagaccctgtcctacttgccaccgctcagcacggaggcctcctcaagcaggtcgactacctgattccgtccaantgggttccttgcctccgattcaacaagttgggttcancctcccgtngagcanaacgcatcccctggggtactatgatggccggtactnggcaatgttggaactcctangtttccgggngnaccgacncanaaaagtgnttaacaaggtggaggaggtcaaaaaggnttacctaaccntttcccnannatgggtncaaaaat

SEQ ID NO: 89381 - DNA, 293 bp, Triticum aestivum
  Clone ID: PAT_TA_89381
caaaggcaaggcattccaatataagaaatggatgaaggcaaggagacgtcggatcctccttggctcggggtgtcatgggcggcgcatgcctcgccccctttgctggcggttggatcggcgtaaccggggaagggaaggattagggcagagagtagggcggttggtggtggactctttattagcagtccgtcgggaagtatggtgcgaaggagagaggtgtcattgcgatggtgatgcgggcgtcatctgcctttgaaggagagtgctccagtgagaaatgtcctgctacacaa

SEQ ID NO: 89382 - DNA, 339 bp, Triticum aestivum
  unsure (1)..(339): unsure at all n locations
  Clone ID: PAT_TA_89382
ctcaagtcgcgaacgacacgatggcgctgagccacctccgccatgcgccgctcgcgctccgcctcgcgctcccgtccatcgcctgctcctctcccgccacccgccgcctcttactctttgcgccggcgcgcccgtggcgcctcctctccaccgcctcgaagccgcgctcgctcgccaccgccgccgccgccgaggccgacaacaccagcgcggggcaccgacggcttcttcgccgaggacagnacttcntggaaatccntcggaatctcgnnaggcntcgttcggccttgaaaggnaatggggctcgaagaaccncgctggtcnaggnacttgtacaca

SEQ ID NO: 89383 - DNA, 385 bp, Triticum aestivum
  unsure (1)..(385): unsure at all n locations
  Clone ID: PAT_TA_89383
ggaagagtancatccatggcgtgcatcaataccttgcanagctgctccatgttcaaaggggccaaggctgaggccanaangggcaaanccaccggagcagggancttcgggtgccgggcgtccacgttcatggacgggagcgggctccggctcgggctcgacnaagaaccccgacgccatcatctccggcnagtggcccgagaactctccctcctcaagctacgacnacctccgngcctacctccantcccaagcaagcaagcancaagcagcagccaccttcccacgctgccgattnagcaacgggggcgtcctgcncgaggcatgtcgaccccgtnctnatggcaaaagcngagcaagcgctggtggaggttaaaggcatttt

SEQ ID NO: 89384 - DNA, 319 bp, Triticum aestivum
  unsure (1)..(319): unsure at all n locations
  Clone ID: PAT_TA_89384
gatcagcggtcgagcccgacacgtgacgcgtcgtcgcccgcacccaccacccaagggccaaggagagggcagggggatacccaacccaaaaccaagaccaagtgcccgacctcgcctcacgcgcagccgccggccgtgccccgtgccgactactcgctcgctcgctcgcttccaccangaaatcccccaacccgcggctgactcactcccgtctccccccggatcccgatctgcgctgccggctggcttggctgggcggggccaatgnggaaaggggccgcaaggggatgggccgaccncgggncccggcgagngtgga

SEQ ID NO: 89385 - DNA, 521 bp, Triticum aestivum
  unsure (1)..(521): unsure at all n locations
  Clone ID: PAT_TA_89385
ctcgcgtccgccgcgcccatcctcgtccgcgcctgcgcccggcccgtgctcgctcgctcgccgcctccctcgcctcgatccaccgcgccggcggcatggcggatcagctcaccgacgaccagatcgccgagttcaaggaggccttcagcctcttcgacaaggacggagatggttgcatcaccaccaaggagctgggaacagttatgcgttcgctggggcaagaacccaacggaggctgactccaagacatatcaatggagntcgatgctggatggaaacggaacaattanttcccaaannttccctcaacctgatgggcccgcaaattgaagggaacngaccaagnggaggantcaagggggcttaaagggnttncgaanagggacaaaggtttaatctcggnggnagnaccccacatgtcangaaaactcgggggaaaactcacncacgaggggngnacaaatatccgttaacccgacttccacggttangccatnttaanacgagattcntcanggcat

SEQ ID NO: 89386 - DNA, 252 bp, Triticum aestivum
  unsure (1)..(252): unsure at all n locations
  Clone ID: PAT_TA_89386
cgccgcacagccgcagggagagaaggcaaggaggaggaaggaaggggaagatgccggcggggnacgggctgcggtcgcggacncgcnacctgttcgcgcggcccttccgtaagaaggggtacatcccgctcaccacctacctgcncacctacaangtcngggagcacgtcnacgtcaaggtgaacggcgccgtccacaagggcatgccgcacaanttctaacacngccgcaccggccgcntctggtancgtt

SEQ ID NO: 89387 - DNA, 366 bp, Triticum aestivum
  unsure (1)..(366): unsure at all n locations
  Clone ID: PAT_TA_89387
ttttttttttgatggcctttccaaattattaccaaacaagcttgacaagcaagtggcaagtgatgcacaaggtctctgcacatccatagcctaatactagtacatgtacatacacacgtatatacgtgcagggtacgtacacacatacacacacatacacaaggtgggacaagttaaacagcggagatcgatgacgacatggttgcgacggtggcggccgccggttttgcacgagctagctgtgcttgcttcatcatggccggattcatttagatgtcgatgacgccggaaagcgtcgccggttccttgatgacgactcctacaagttggaccgagcttaacncaccacctggggnagggagaaat

SEQ ID NO: 89388 - DNA, 395 bp, Triticum aestivum
  unsure (1)..(395): unsure at all n locations
  Clone ID: PAT_TA_89388
ggcgcgtgtacgacggcgagctctggaacggcgcctacttcgactacgataacagcggcagcacgaacagcaagtccatcatggccgaccagctcgccgggcagtggtacgcgcgcgcgtgcgggctggagccgatcatcgaggaggagaaggcacgcagcgcgctggcgacggtgctggactacaacgtgatgcgggaccatggcggcggccacggcgtaggtgaccccgggccacacctccctggattgtatcgaggacgcgtccacggcgccgtccggccgcatcccgttcacggngcccaccgtgccgccctgcacctcgtgccgaattcggcacgagctagtctcnagttttttttttttttntnttttntctccanactgtgattcatt

SEQ ID NO: 89389 - DNA, 520 bp, Triticum aestivum
  unsure (1)..(520): unsure at all n locations
  Clone ID: PAT_TA_89389
gcaaaggccactctctccctccccccttctctctcgcgacctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatggggttcantgttgaaactgtggagtacaagaacatcagcttcactgtctgggatgtcnggggtcaaggacaagattaggccactggtggaggattacttccannaacacacanggtctcatcttttgttgttggacaacaacgataaggancgtgttgttaaacaagggatgactccacaggatgctgaataggatgantacctgatgctgtng

SEQ ID NO: 89390 - DNA, 512 bp, Triticum aestivum
  unsure (1)..(512): unsure at all n locations
  Clone ID: PAT_TA_89390
caacctcgtagcgcgaaatctcagcgcaatttcatgcacgtccttgcgccgcactcaggcggtcctccgtttgcaccactactcggccacctcgatcgtcgtctaagggaaggcatcgcggccatccacggcggcgacctgccaggagggatggacgacgtgctgtcgcagatcggggacgccttccggctcgccggggagctcatgggcgacctccccgcggcccagaacgacccggcctacctcgccgcgcgatgctacggcattgtccgcgcctacaacacggccatccgcatgctgcagcaccacggcgtgggcgccgtgaacgtggccgcggcgcgtccgctcgacggcggcgggccgctggacctcctgcgcccgcgcagcacggaggaagcagccggcgccagccagcttctcggggaaaccgcgaccgtctgcaggagcgttcaacatgctggcggtgcgcgagcgcaacanacgcggtcgctcggtgcngacgnccgggcacc

SEQ ID NO: 89391 - DNA, 506 bp, Triticum aestivum
  unsure (1)..(506): unsure at all n locations
  Clone ID: PAT_TA_89391
agttagtgtatgcctgcatgcctcattggaaatattactgcatgataccatacagatatttcagtttataaactgataaggtaattatgagtttattagagagtacagatttgctcagctactagcctacaatgacttgtatatttgtaaatagtgaagtactctatgcaccttaaaaataatctttaagtgaaagatgcagttactttacattagtaccttcgccatttaggcagggtgggaggcgacgcacaaggacgcctctagcacgttcaccgccagccgttgccgttgctttcttcttttttgggcttatattcttaatacctaaagtgaatgcctgggtaccattctcctaatgtttcaaggtattctcattattaagagcattacattgctttacagagtatacatcaagcacagttnaaantacatacaaatagtgtatccagagttggttggtcgcatgataaagatctaaaaatagtcccatgccataataagtt

SEQ ID NO: 89392 - DNA, 509 bp, Triticum aestivum
  unsure (1)..(509): unsure at all n locations
  Clone ID: PAT_TA_89392
cacacgtccgtcccccgtaatatctctcctccctctcccatcccctctctctcctccacccgacgtcgccgtcgccgtccaatctccggcgagatcccctcccccgccggcagccatggcctccaccttcagcggcgacgagaccgcccccttcttcggcttccttggcgccgccgcggccctcgtcttctcctgcatgggggcggcgtacgggacggcgaaagagcggggtgggggtggcgtcgatgggggtgatgcggccggagctgggtgatgaaagtccatcgtgcccgtggtcatggcgggggtgctcgggatctacggcctcatcatccgccgtcatcatctccaccgggattaaacccaaagccaancctattcctcttccacggtacgcgcactctcctccngcctcgcctgcggctcgcngggctcgccgccggcatgggcatcggatcgtccggcgancccgggtcaagggcaaagcgcaacaaccaactttcgtcggn

SEQ ID NO: 89393 - DNA, 514 bp, Triticum aestivum
  unsure (1)..(514): unsure at all n locations
  Clone ID: PAT_TA_89393
gaagaagataattgccatcaccgccatgatgctggccaccgccttcatcgtggcggccgagcaagaggcgggagcctgcattgtggagacatccgacgtccctggcgccgcaaatccctgcatctgctccgagaactgcgcctgcgccggcaagtgcatcctgaatgccggcgacggcgcgggtgacgtccagacctgcttcgtcgagtgcgtgctgaagaacggctgcggcggctgcccagtaccctggacaagacccctcccggccaccttggaccaagaccctgagcctgaaagtgacaaggcctaagccctcgcaagagatccacgggagggagatgcttcgcatcatcttccgacgtcgancccatggcacggacacccagtgattgaggtgtacttaatatgtgccgggagggcaaagatactaacgacaantcccaacactacttgcttactttcccgcaagaaccaagcgacccnggggaatcaatggacatacccgggtgctgcg

SEQ ID NO: 89394 - DNA, 520 bp, Triticum aestivum
  unsure (1)..(520): unsure at all n locations
  Clone ID: PAT_TA_89394
gcgacctcctgtttccgcccaccttctccggctccggcgccggcgaacccaccgcggatcgagcgattcccccgatcaggagaggcgagccgggaggaagagcacctacgcgggaggagaggagatggggctcacgttcaccaagctgttcagccgcctgttcgccaagaaggagatgcggatcctgatggtgggtctcgacgccgccggaaagaccaccatcctctacaagctcaagctcggcgagatcgtcaccaccatccccaccatcgggttcaatgttgaaactgtgcgagtacaagaacatgagcttcactgtctggggatgtcgggggtcaggacaagatcaggccactgtgggaggcattacttccaagaacacacagggtctcatctttgttggtggacagcaacgatagggaccgtgttgttgaaagcaagggatgagtccacangatgctgaatgaggatgattacgtgatgctgtgctgcttgtgtttgctaacaacaaatctccana

SEQ ID NO: 89395 - DNA, 520 bp, Triticum aestivum
  unsure (1)..(520): unsure at all n locations
  Clone ID: PAT_TA_89395
gcaggagataccctcactgaaggccaagtgcttgccgtcagcgacaagctcgtctcgacgaacggaaagttcgcgctcgggttcttccagctagcagcgagcactgtcagtaagtccgagaactccaccggctccagctggtaccttggcatatggttcaataagatcccgatttttactgttgtgtgggttgctaatcgggagaagcccatcccccacctcaacatgaactcaacaaactcaagttctcaagtgatggccagcttgtcattgtcacaagccgtgctgatgccgtcactgaatcacttgtttgggtccactcatattgtgaataggacacaatctaagtagcataaacaccaccacctctagtgtcgttgttctcttgaacagtgggaaaccttgccttcaaancacaagatagcccacatctgacttgaatcgggcttcctaatgccaaagttgggccgggacaagttcactgggttcagtcgcaattcaatatcaaaaaaagactcat

SEQ ID NO: 89396 - DNA, 511 bp, Triticum aestivum
  unsure (1)..(511): unsure at all n locations
  Clone ID: PAT_TA_89396
ctcgagttttttttttttttttttttttttttttttttttttttttttttccagccaaagcaacgcagggaattcttttcattattaacttgaccaatgtacaaacagagcaattccttgaacatttctccgcatttgttccagagggagatttaaaattcttacaacacacttccacgcaaaagaaaaaacttcttacaccacacttctacgcaaaaataattcttcaccgcacttaaaatactacataatacagaagaatctatgaccaaatcacagccgcgtctctcctcgactcgggtagganaactattccgcttccagccaggatgtacttgccccctgggttcaaactgagttgactanctttgtctgggctttcataaccagctcctcggtagtaccaccaatgatcccattgggatcgctttagaggaacgcaaacaatcttcccaaagaanctcttgtaacaataccaaanctctctaacttttgaacanatccacaccgg

SEQ ID NO: 89397 - DNA, 521 bp, Triticum aestivum
  unsure (1)..(521): unsure at all n locations
  Clone ID: PAT_TA_89397
gccgccgcccagcccaaacccaaccccgccgccgcactgccgtcgccgccgcagcgcgcggaggcgaccaccccaccgccgcgaagatgcagatcttcgtgaagaccctgacgggcaagaccatcacgctggaggtggagtcgtcggacaccatcgacaacgtcaaggccaagatccaggacanggagggcatcccgccggaccagcancgcctcatcttcgccggcaagcagctcgaggacggccgcaccctcgccgactacaacatccagaaggagtccaccctgcacctggtgctccgcctccgcggtggcgccaagaagcgcannaagaagacctacaccaagcccaagattcaaaagcacangcacangaaggtgangctcgccgtcctccagttctacaaggtcnacgacgccaccggtaaggtcaccaaggctcaagaatgagtgccccaaacgccgagtgcggtgccgggacctcaagggcaacacttcaacgtcatactggcggaagtgggg

SEQ ID NO: 89398 - DNA, 505 bp, Triticum aestivum
  unsure (1)..(505): unsure at all n locations
  Clone ID: PAT_TA_89398
caaatccccaccaatctcgtctccaatcgacccgaggctcgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattcctccaagaccagcagcgtctcatcttcgctgggaagcagctggaggatggcccgtaccctcgctgactacaacatccagaagggagtcaacctccaactttgtcctgcgttcggcttggtggcatgcagttttccgtgaagaccctcactgggaaagactatcacccttngagggttgagagtctgacaccatccgacaatgtcaagggcaagattcaagacaaggagggattccccccggacaagcancgcctgatctttgctgggnaagcaactggaggatggtccgaacctcgccgactacaacatccagaaggatcaacctta

SEQ ID NO: 89399 - DNA, 322 bp, Triticum aestivum
  Clone ID: PAT_TA_89399
gagaaagtttactatttatgcactgtctagaccgattttgacttttttgccacgagctctctcatattgccttcatcccaaaattcttgtcttagatttgtctagatacagatgtatctaatctaagacaagaattttgagacggagggagtatgtcgtaacagggtgaaattttgcccggacatcaggcactcaaacatcttatttgctagtattttttgagtttactgtttatcaggagcagatgaatattcagcatattaacaaggctgcacttaagtaccaaagctaccgagaggtaagaaaaagtgaggccactaaa

SEQ ID NO: 89400 - DNA, 499 bp, Triticum aestivum
  unsure (1)..(499): unsure at all n locations
  Clone ID: PAT_TA_89400
cgccgtcctccgcctcgtgaagagcctcggcgccaaggtggtcgtgtccgtggaccgcgggtgcgaccgcacggagctgcccttcgccgcgcacctgttccaggcgttccagtccaccgtcttcctcctcgagtccgtggacgccgtgggcaccgaccccgacacggccggcaagatcgagcggttcctggtccagccggccgtggagcaatgcgtggtcgggcgccaccgcgcgtccatcgagaaggcgccgctgccgtggcgggccgtgttcgcgtcggccgggttcacgccggtgcaggccaagcacnttcgcggagtcgcaggccgagtcgctgctgcacaaggtgcccgtccgggggttccgcgtcgagaaacgcgccccgggatngctctgcctctactggcagcgcgccgagctcgtgtcggtctcggcgtggcggtgctgacaacccgacctcgccggcgccggcgccgtcgccggcgtcaaaanaancca

SEQ ID NO: 89401 - DNA, 511 bp, Triticum aestivum
  unsure (1)..(511): unsure at all n locations
  Clone ID: PAT_TA_89401
ctcccgcctccggtcctcccttctctcagccgccaccccacgaaccctagccgtgccctcctgcatctgtcctcctcccccttcctggtccgtcccaagcccctcctcgtctcatgagctagccgaggaaaagaggggtgacgcgacgacctggtcgtcggccggtggggagcctcgtagaggcggtggcggagacgaccctagatgggccaagatctggacagggtgcctttgtcctgcgtcgtcactaccgccacggccttgctcgccattgacctccccaagtgcttctctccacaaatggtgccgccatgtccaagatcaattcaagcgccaggaaagtacaacacgtgcataacttgtttgaggaaattccatctggaagcaatatttgatcatgacttgtgttcttgatgcttcatctgcggctagctgactacaacatcacatatgtaaagggaaacatcgtaagaaacacaggtaaaaaggantttccntggtctatagtttg

SEQ ID NO: 89402 - DNA, 494 bp, Triticum aestivum
  unsure (1)..(494): unsure at all n locations
  Clone ID: PAT_TA_89402
aaaagaaggggcgacgctggtgttcacggtggcggcccaagaagctcgagatggatcgagcagcgtccagtcgcccagttgctggccccggtcaaccacagagccttgcacgctggatacagcggatttggttcttccacgcgccgccacttggtccctgagcgcccacaggagatggcttcggttctccgccaaccgacaagcgaggagggcgacgacacgagctcctcctccggcgaggatcccagcaactacccagccgccccatggcacttgtcctggcaaggatgagggtcgaggacgcctanatgcnggttgctgccaacatcctagttccctggtgcagtccatactttttgctgattgaacctcaacaagctccaatcaaaaatgtgggcgaggcaaaagaggacccaatgacgattagaagctacaactggtgctccattaaaattgacaaaaggganaacncncttgttatncagccacngagg

SEQ ID NO: 89403 - DNA, 512 bp, Triticum aestivum
  unsure (1)..(512): unsure at all n locations
  Clone ID: PAT_TA_89403
catgggttgagcctcttttcttcagccgtgcggggattctgagagctcagcacatctccaggttttccttctagaggtcaggctagtagaagagtataaatatggatggccgtggcgttatctccctgatctctcggattattgtgccggcgacagccaaaaacaacgaattcaagatacacaactaatccgacgttggcagagatgatgatggcaacatcatcgtccaccttctatatctcatcatcgagaccagtataaactaggcgttcaagagcacgtggccagaaacggctcaagtcgcagtcgctcgatgaggacgagaagatttggtggccggcgactcgacgacgccatgctactcgtggccggcggccggcggctcaacaacatcacacaagacttgaccggcggcagaccgacgacatcctcacgcaacgcactatgtgtctcctaatgatcancgtgcatggattaatagatnngntactccaatcacaagtgcacacacc

SEQ ID NO: 89404 - DNA, 289 bp, Triticum aestivum
  unsure (1)..(289): unsure at all n locations
  Clone ID: PAT_TA_89404
aaattactacctctccttgcagcatgtggctagctaaattcagagttactacacgatctaaaaagttgagagttaccactctgggtttgggtggttccgtccggtgacggatggtgcgagcatccctttttgcgagggcactggtgaaggtgcggtttggatgtgacagagcgtgatgttcggccgcttgctttgcccgatcccgtcaaaatatgccatcgtactggtagtcactggctttggtcttttggggcggtgaagcgcgcactgaggctgggggatncccgga

SEQ ID NO: 89405 - DNA, 524 bp, Triticum aestivum
  unsure (1)..(524): unsure at all n locations
  Clone ID: PAT_TA_89405
acatcgtaaatgttaaatttgtgataggcttactatagacaaatgtttctgaatcttatggtatatcagatgttacagagtaaattatcaatttactctacatgatacattaatcttttttgtttttgtttctattctatttatggtggaaaaatggtttcttcaccattttgttgatgttaaattaaaacatttttgtatgcctatcgaatatatgttagttcaaccgatattccaaattacatttttatattgtgctgcttactatagttttttcctccaaggaaacaacaccaaggcaccccatgagtatttgtcagttcaactgatattccacttttgcatattgtagtacttccatagttatttcatctcaggaaacaacaccaaggcaatatatttttaccctatttataacagcctaattatttccaacaatagagatcaggcatcttaataaatgttccttttgcaccctgttgatcagctacataataccctctgatatatgacaatttgaaagn

SEQ ID NO: 89406 - DNA, 505 bp, Triticum aestivum
  unsure (1)..(505): unsure at all n locations
  Clone ID: PAT_TA_89406
gacttcatgcaaaagttagagacggataactcgtgggcccaggatgaaaggaaggcgactgcatgggctattctggagaacatagacagtaaaggcattttccattgccccgagagatttgacatgccagataagctagctgagcacacaagtcaatgcaaatttaggatactgaactgcacaaatgatggatgtgtagcttctttctgtgctattcataccgaaaagcatgacgctgtctgcccattcaagctcctaccatgcgagcagctgtgtgaacaacatgttatgcggtctgagatggacaaacattgtggaacagtttgccctatgaagcttaccaactgcccgttttttagaattggctgtgaaacagctttccacagtgttctcttgataaccattgttcgcggttctacaaacccatttgantatgtcgcaaggtgattacaagacaaggtgattgtgtaatgatatggataacggctgcaacccttgagaagng

SEQ ID NO: 89407 - DNA, 510 bp, Triticum aestivum
  unsure (1)..(510): unsure at all n locations
  Clone ID: PAT_TA_89407
gtgtttatctgctggacaaggaaatgtttctaatggcaaggatcctataaacaccgttgataagatcaatgaggccagctatgagattgacaagcaaattagcgaattgacgtgtggtagaacgatgaaagctggtgaggcagctggtaccactgagtgcaaaagtaacaaaatttgcgttgaacattatggatcaagtgagaatgcagaacccatgctcgatgatagtcagggagttgggaactctgaactttcttgtaatggaggtagtaaagatgaaggatctctcattggcactagtcaagtagaggttgacagcatgacacaaatccaaaaaatgccgccttctgacgtttcaagggatataaagcaacaaggcaatgggatgctggtgcatccagtttccatggagcaagagcaacattcaagcactctccggaagttcaaaagtctgantgggatgagaaggaaagatggatttggagtcattcatgagtccaactggcttac

SEQ ID NO: 89408 - DNA, 529 bp, Triticum aestivum
  unsure (1)..(529): unsure at all n locations
  Clone ID: PAT_TA_89408
tgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataacttatgatggatatgtcaagcttctaactnagagtggaacactaaggatgacctgaagcttcccactgatgatttctgcttggcagattaagacnggatttgctgatggcaaggacctgatctgtctgtgatgtcgccatgggtgaagaacanatntgcgctntgaaggaaatccgg

SEQ ID NO: 89409 - DNA, 529 bp, Triticum aestivum
  unsure (1)..(529): unsure at all n locations
  Clone ID: PAT_TA_89409
caaggtcgtcggcagcgacgatgccgccagccgcaagcgccgccgcgaggacgacaaaagagaagtttagatctttttggacagttattgcagccaacagccaacattctaaatgagtataaaacaattctatgagtctggtagatttggaaagaaaggaattgcagattttgtctggacaaagagatgaagccagaaagggataatacgattgaaccaactgttaccggtgcaatgcttttggggtcgaccaaaacatttaaaaatgttaaatgtggttatgtgataaaatcaagtatgaaaggaggaagagatnaacaccagccgcggcaacaaagatgacagtgtgtctcactgagcatgagcaatggcacactcttgtcgagtacctaacaagatgctccctggncagacttcgagcacttctccttgccgccgccgcctgggctaaagttgtggttccnccgataaccgtacaagggtattnnaagttgcaatttaaggtgggcaaacaacaatgcgctgaagg

SEQ ID NO: 89410 - DNA, 508 bp, Triticum aestivum
  unsure (1)..(508): unsure at all n locations
  Clone ID: PAT_TA_89410
gttttatgcatactaattttttgagtaattctaatatttctctcataatatgaaagatatacataaagagaaagaatttcgacagctggaaatctggacatgaaaaaactgcgttaggctatctattctgcacaatttcaaacaaactgaaactttactaaaattttcttgaaatatataagaaatataagagtcaataatcagatgggcacaacccacctgagcgcgtcagggagtccaggcgcgctctgatgggttgtgctcttccaagcccatccatgatgctcatcttttaagtatatgtgtcattttgacttaagaaaaaagaaggtgaggactttcgggacgaagcatagccgtcctgaagcggaagttgggtaggatcatttttgccttccggcanaatgatttgtcggggaaatcccttcaaaaggggaaacatcgtcgtcatcatcaccaacaacctcctantttgggaaggtaaccncatcaacatttcaacaatnnc

SEQ ID NO: 89411 - DNA, 576 bp, Triticum aestivum
  unsure (1)..(576): unsure at all n locations
  Clone ID: PAT_TA_89411
ggactgccttcagaatgtgttctatattatcggcctggtgacgttccccgccaaagttcgatggtcttctatgaaaactgtggtctgcaaaatctttatgacatagcgcgatattgccagtctaagaaaaactgccgtcgtggtgctttctttcaacattttggagaggccgtgcaggaatgcaacgtttcttgcaggaatgtgtgacaactgtgtttccagtattgagctcaaggacatagatgctacctaccatacaaaaatcactgtttcacttctccaagaaatgcaacaaaatgaccaaagagctacattgctgcagctagtggataagttcaaaacaaagtggaaacatcangttgttcaaatgaagcantgatcttaagaaggaggaaattgagcantgatagtcaacttatactgacgtgttttgaaagaagattcacatacgcattcaacaatgcatatgtgtctagacacgtggagcacatgcaaggaaanacgtgagcnacangcatcacccagaaggggaagatcaaatgaaaccatngtgacattggactaatggnacngntg

SEQ ID NO: 89412 - DNA, 414 bp, Triticum aestivum
  unsure (1)..(414): unsure at all n locations
  Clone ID: PAT_TA_89412
gctttattacctaccgagaagaagagagaaaaaanggttcgagtgcgttcnanagtgangagtgagaagagatggntccggtgaagctgtacngcgcgaccctgtcgtggaacgtcaccaggtgcgtggcggcgctggaggaanccggcgtctagtacgagctcgtccccatcaacttcggcaccggcgagcacaagggncccgaccacctcgccaggaacccctttggccacgtgncanctttgcaggatggtgacttgtacctcttcgaatcacgtgctatttgcaagtangcgtgccgcaagagcaagccaganntgttgaangncggcgacatcaaggagtcagctatggtggatgttggctcgaggtggangccatcagtacancgccgcgctgagcccanntcctcga

SEQ ID NO: 89413 - DNA, 577 bp, Triticum aestivum
  unsure (1)..(577): unsure at all n locations
  Clone ID: PAT_TA_89413
ctcgagtttttttttttttttttttttaagcgagtagagtaattctttgccgtcctggtctggaatctgaactgatggatcgagtcacggcacaccggcgcacgagtcgtgccttagtgacggagtccgtactgccccacaaccggccaggaaccaaactccaaaagttccaaagctggttgggtccgtagggcggcgctgcgaatgcagaccgcagcggtgcagcgacggatcggaataggatagcgcactggaaggatgcagctcgtgatggacgtcgtggaccaccacaaccacgggtcagatgtgatattcgatattacataatgctctcgcgttgcgtcacgcatgctatggggaaactgcacgccgatctatctcaatctgccctcctctccgtgttctggcaatcatctcgcccaagtggaaactgccgctaattggcggcattattgatgtgctanccgtaaggcacagctccantgagtgtcacaacacacgattagatcgngcgcacccattgcgtagnacacgcattcatactgaacacgatanacgtacgatgacatacccgacg

SEQ ID NO: 89414 - DNA, 344 bp, Triticum aestivum
  unsure (1)..(344): unsure at all n locations
  Clone ID: PAT_TA_89414
cttttttanttataccttctcttctttatctttagttttatcnacttagcaatagtatcnaccggctcgaantcgaatttnatngccntccanacttcacaagntgcggctagttcaggactccatttgcaagctgctcgggtaanttcattaccttcgcgagcanngtcgcgcccttcgttacgagcttgtnnacaggcttctaaagccactcgattagctgcggcaccaggtgcatttccccanagntgtcctaaagttcctccaccannttgtaatacagaatcgnccccaangatttcngtcagaggtggnntntgccaancatgnntaccagctgaagc

SEQ ID NO: 89415 - DNA, 245 bp, Triticum aestivum
  unsure (1)..(245): unsure at all n locations
  Clone ID: PAT_TA_89415
tttttttttttttttttttttttttttcatttcggaacgaaaaccaaagataaaataaaataatgccacttccccttggaagacatcactgcgggcggatttgtacagacgantcaatcaatcaatcaaaaancaaacatatcccgggtgaaacaaacggcanctcataaccacatccanatgtacacacttgcaagtaccacacanggtttgctggatccatcagcagcagtttcncgtttttc

SEQ ID NO: 89416 - DNA, 592 bp, Triticum aestivum
  unsure (1)..(592): unsure at all n locations
  Clone ID: PAT_TA_89416
ctagtctcgcgttttttttttttttttttttttttagaaatttcagctgatcgatgaattagcaattcaggatatcaaatccaacattacaaacatcaccaaatttttacacgggattaaaatccagaggtaattaaaattcaccccgattcagttttgtgaggaccttgtctctgaagatccccagcatctcattcctgcccctgatcacctcatcaaagacctgatcaagaacacagtcgaacatctccaccccctcccggagctcgccggacctcgtcctcagcagtccacatgatcctcggatcttccgtcttgccgccgtcatgtccctcaccgccgtgacgacacctcgtgctccgcgatgctcgccggcangccgcacacggcgttgtcgccgacaggatcgcgccacggcgcanctgctctgggacgcggcctgggacgtgctgctgccgggtgcccccccggagccgactctcgtccaagaggaagggtgagctgggtaaccntgacacgagnggcacacgcatgtatctgggacactacagacanctcgctcgtgactggatatttcccancgctcgccnta

SEQ ID NO: 89417 - DNA, 254 bp, Triticum aestivum
  unsure (1)..(254): unsure at all n locations
  Clone ID: PAT_TA_89417
gggaaaangaaggcatggcggacgtctantaccgctgcttcgtggngcagcctcaccctgggccacccnaacgaccantccctccagaacgncttctccaantacggagacttcatcgtactcnaaggatcatcactgacangnagacnggccgttcccgcnaggttcgggttcgtcanctnctcgncngacgangcgatgcgccacccgatncangccangaacggccagnacctgnactncncaanatcatc

SEQ ID NO: 89418 - DNA, 325 bp, Triticum aestivum
  unsure (1)..(325): unsure at all n locations
  Clone ID: PAT_TA_89418
ancagntacgctagctanctangantacatcntncggcggccatggggagcancagcagnagcctggacggtctgctgctcacngacgtgctgtgcctgcagctgccngtccacagccgcgcgcagctgcgcgtggggttctacaacaccanctgccccaacgcntangctatcgtccggcaggacgtcacggccgacttcgccactaactccggcgtcgccgccggcctcatccncctccactttcaccactgcttcntcganggctgtgattcctcggtgctcctgtccgtcaagcnggcggangcatccggagcatnncgcc

SEQ ID NO: 89419 - DNA, 410 bp, Triticum aestivum
  unsure (1)..(410): unsure at all n locations
  Clone ID: PAT_TA_89419
gtccacggcgatttctcctctcctctctcctctgctctcgccgatgcaccgcatggctcacttcccgctgttgccggctctagcgctggcggtcacctgcgcgttggttcccttcaccgtcgctgacccgcaggctacgcagctcaaccttgggtgcagccagtacaacgccacgcccacggccgccttcctcgcggccctaaactccaccttcgctgagctccgcgccaacctctccgccggcagcggcttcgccaccgcagcggagcctcgcgccgccgcgccggcgttcgcgttggcgcagtgccgcccatacgtcaccgggagggatgcgtcgcctgcttcgacgccgccgcggcgcgcatcaaancgcctngggggttgnaagggggggccaancccnnaggggg

SEQ ID NO: 89420 - DNA, 156 bp, Triticum aestivum
  unsure (1)..(156): unsure at all n locations
  Clone ID: PAT_TA_89420
gtccacngcgatttctcctctcctctctcctctgctctcgccgaggcaccgcanggntcacttcccgctgttgcnggctctatcgctggcggtcanctgngcgttggttcccttcaccgtcgctgagccncaagctangcagctcaaccttggggt

SEQ ID NO: 89421 - DNA, 173 bp, Triticum aestivum
  unsure (1)..(173): unsure at all n locations
  Clone ID: PAT_TA_89421
ngacttnaaggagcttgngaacaangttcatccctgaagtgattggnaaggatattganaacgccacctcaggcatcttccccctccagaacttgtacgtccgcngggtgnacatcctgatggcccccaagttnnacntggggaanccatggngggttacggtgactacaagg

SEQ ID NO: 89422 - DNA, 328 bp, Triticum aestivum
  unsure (1)..(328): unsure at all n locations
  Clone ID: PAT_TA_89422
gaggcggccgatgggctcgcgccgccccggtctaagcgcaagcgcgaggcgtccgccgccgccgccgccgcgctcgaggatttgaccctcatcggtaaggggcatgttgcgttattagccgttctgcctggagtgggtttggcggctgccgcgactgggattctgtgaacctgctgctagggtttaccccttccacaatatggaagtctagctttcctgctaatgtgattttagttgggatttatggtgccgaacgctgctctgctgtaacaaggatanattaacccggtgttttcngcangggaantttntnaaaantcncccaatt

SEQ ID NO: 89423 - DNA, 573 bp, Triticum aestivum
  unsure (1)..(573): unsure at all n locations
  Clone ID: PAT_TA_89423
ctggcacacgcactgttggaccactccaactcccgcttcatcctcttgtcggagtcacacgtcccactctttgacttccccaccgtctactcctacctcaccaactccaccaaggtgtacatggagtcctatgacgagccgggagggacgggccggggccgatacaagcgtggcatggcacccaccatcaccccttggcagtggcggaagggtcacagtggttcgagatggaccgtgcccttgccattgacatcgttgccgacaacgtctactttccggtcttcaaaaattctgcaagcgcaactgctacaccgacgagcactacattccgacatcctccacatccgccacctgaggtggcgccagacgaatgtgacgtgggttgactggcccatggcggccccaccgtcaaggtcacgaagatggaggcacgtggactcctcggtggtaagggcggacacattagtaaatgggaggacacacgtctgcttctatccgangaattctgccaatcgctaaccgcttctnaattccgcaaagtatggcttgcnaagatcatatatacggacaaaa

SEQ ID NO: 89424 - DNA, 198 bp, Triticum aestivum
  unsure (1)..(198): unsure at all n locations
  Clone ID: PAT_TA_89424
tttttttttttggtggtaaatagttaaaaatttattactattacctggctcgttaacagattaacacagaattatataaaattatgaccaaattgtgacatgaaacaaacaccattgcagctcaattataatacancncnaattgtaaaaangattcatcaccacnanttcccccccncnaatngggcccnaaacccc

SEQ ID NO: 89425 - DNA, 301 bp, Triticum aestivum
  unsure (1)..(301): unsure at all n locations
  Clone ID: PAT_TA_89425
agttgtcacataaataatggtacaaatcacatggtccattcatttaaattattacacattaacaacatctaatccactcttaacaatgttgcaatttcttatcggatcaaattggtgttgctataatacaaagaggcacgaccttcgctagtgtaatgccaaactgatctccatatcaatccatcaagttccatctcaacaaggaananccacctaaatgggttaacaatggannnagcatcaatgcacaaccgaatgccaagttntccanggaantncgnccccccccaaaagggggggg

SEQ ID NO: 89426 - DNA, 195 bp, Triticum aestivum
  unsure (1)..(195): unsure at all n locations
  Clone ID: PAT_TA_89426
gtctcgagtttttttttttttttttttttttttttttttttttttttttttttttttttttttanagctcanaatangtacatacatngattcttgtgtanatanaaacaangnagtgnattacaaacaagtattacaacagaaagnaggcgaaccatgggnagggactttagatgaanacggcantganggcag

SEQ ID NO: 89427 - DNA, 206 bp, Triticum aestivum
  unsure (1)..(206): unsure at all n locations
  Clone ID: PAT_TA_89427
ccgctccccacgatgcggcacctcctcctctcccgtctcctccgccgcgcctcctccccctcccagcctcaccacaacctccaacttatccgtgctttctcctcctcctcccctctcccggcctccgacancganctccgcaantangccggctacgcgctcctcgtcctcgggtgcggngccgccacctaataatccttnccctt

SEQ ID NO: 89428 - DNA, 351 bp, Triticum aestivum
  unsure (1)..(351): unsure at all n locations
  Clone ID: PAT_TA_89428
gcgaaaacctccgaaccagtaatggcgggctcatcctccccacacccaaatcccctccccactcccgcagtcccctcccaatccctcactcccacgcccccgaccctcggcgcagatggcgccgtcggtgccgaggaagaagcgcaaggtgagcctcccgaagaacgaggaggtcacggccaggatcttcgagaagcaccgctccatggcggcgcagcagccggccagcctcctagaccaccaggctcgcgcnctctgcgccgcctacaccggtgtcnacnccgccanggancctttngggacccccggaantgcccgtcaaattatnggggnaanctntttggggataac

SEQ ID NO: 89429 - DNA, 313 bp, Triticum aestivum
  unsure (1)..(313): unsure at all n locations
  Clone ID: PAT_TA_89429
gtcaggcgtgcctttggagccttgccctttcccctagactccccagccccagaggccacaacacctaccaaactaacacaagcctttcttaccagctgcatccaagcctagctaaccactctctcctcccccccccaccccccctccgtctcctgaggtgctcatggcctcgagctcaaacccggtcagcatggacatggacccgccngtcttctnaatngcngtcgagcanggcccgccggngtcgngcntggttanttcggcgtnaggtcctggccnanggnggggntgcccgagggggaaanttccggtg

SEQ ID NO: 89430 - DNA, 344 bp, Triticum aestivum
  unsure (1)..(344): unsure at all n locations
  Clone ID: PAT_TA_89430
gaaagaggtagagatgttagctcggtgcttgatcagtatgggaggtttgtgaagccagcatttgatgattttgttctgccttcaaaaaaatatgctgatgtgatcataccacgcggaggtgataaccatgttgcaattgacctgatcgttcaacatattcgtacaaagcttggtatgcatgacttgtgcaaagtcttccgaaacgtctttgtagttcaatcaactttccagatccgaggaatgcatacnctgattcgtgataggggatatcactacacctgacttngctttatncaatngaataanacnttgggattnaanatggttggcccattttccattta

SEQ ID NO: 89431 - DNA, 521 bp, Triticum aestivum
  unsure (1)..(521): unsure at all n locations
  Clone ID: PAT_TA_89431
ggatcccgatgtggagctccactgcggcccgatctgacctgggagcggctagatccgtgcgtctccgcctcgctccgcgcggcctccatggtccgccgtcttctccagcgccggcgccgcgctcggccgccgccgtcccatgccatggtcgcctccctccagaacgacctggcatggccacctccccgcctctcccgcaagtgggcctctgtgcaaccagatctgtaagtctgtgcctcgctccgcgggcctccatggttatccgtcttcccgagcgccggcgccgcgcgcagccgccgcgccgtcccatgccatggtcgcctccctccaaaatgtcgtgccatgtccgcctccctgcctctcccgcaagtgggccgatgcgcccccgacctacagattaatggagggcgctgccgactcgttcatgcctcggttaactgctcctgactcaatcctttgttgttgcatatcaactcactctgaaatttaatctcctgtntgctgtgagtgtataattcana

SEQ ID NO: 89432 - DNA, 208 bp, Triticum aestivum
  unsure (1)..(208): unsure at all n locations
  Clone ID: PAT_TA_89432
gtcaangangggcanggggaggncgcggangacaanggcnggccanccggcctgctcgacactccccccggcgtcctgttggaggtcaanaacgacgncgtngtgctgctgggcggngnattgngcggggtgcctgctcccntgttgcggattggccatttcattgcacaagaggacattttgggggcagcgattgangccganatgt

SEQ ID NO: 89433 - DNA, 361 bp, Triticum aestivum
  Clone ID: PAT_TA_89433
ccaccctgcagctacattgtgaccaaggactacggtcatctggacatgctggacaataacgcctccaagttaatgacctgcgtgtgcaaggatgggggtgggtgcaaggacaagatgaggaggtgcgtttctgggatcatggtggcatttctgaatgctaccattggtgagaaacatggagatcttgaggccatactgagagacccgacagttgcaccagccacgcttgatccggttgagcaccgcctggcgtgaaatggcagctgactcatgccaaagttaaccagccgcaggttgctccaataaataattgtaatatgaggttttctatgctcagaccatgataaataatttgagtaaa

SEQ ID NO: 89434 - DNA, 384 bp, Triticum aestivum
  unsure (1)..(384): unsure at all n locations
  Clone ID: PAT_TA_89434
cacagccccactcgtagagagcacgcgcaccggacacgcacgaagtctcctcgaccagcgagcaatggcgaccaccgcgatggcgctctccccctcgtccttcgccgggaaggcggtgaaggacctgccgtcgtcggcgctcttcggggaggcgcgcgtcaccatgcgcaagaccgcggcnaaggcnaacccggtgtcntccggaagcccgtggtacggctccgaccgcgtgctctacctcggcccgctctccggcgaccccccgagctacctcaccggtgagttccccggcgactacgggtgggcaccgcggggctgtcggccgaccccganacttcgcnaaaaacgggaattgggggtttcaangcnggnggaaatggggcc

SEQ ID NO: 89435 - DNA, 392 bp, Triticum aestivum
  unsure (1)..(392): unsure at all n locations
  Clone ID: PAT_TA_89435
ttttaatctcaaacaaatatcttcaagcccaaagtatagagcaagccaccaaacccaccaatcaacagctccaaacatgaaaatagcatatgaccagtagtagttgtgccccataaatgctagtacaacagcaagagacacgaagaacgaatcttatcggcttatcctgttataggctgagttctgccagcttaacacaagctgaatttattcccaaaccatcaatggataactcataactgaaaaggtgccagacttgtcaaaaattgacttcacaaagggaactgttgcnagtaccccncnntcgggaaatattgtcattgaaaagagtgtccnagntnttttttntnaanatatncacanttttcccnccggggggtttntttangaac

SEQ ID NO: 89436 - DNA, 204 bp, Triticum aestivum
  unsure (1)..(204): unsure at all n locations
  Clone ID: PAT_TA_89436
aaggaaggaaaccctaggcaacgaccatggcgctgctcccgcgcacggcccggctggccctcctctccgcgtcgccgcggacgtactccgccgccgccgccgcgggcgcctccccgaccccaccggcgccctacgcgggcntgcctccgccggnggcggggtnnaaggnggcnnatttcgtcntcccaagggtggaaancctca

SEQ ID NO: 89437 - DNA, 461 bp, Triticum aestivum
  unsure (1)..(461): unsure at all n locations
  Clone ID: PAT_TA_89437
agctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcatttcgaggtggccgccgggcagtccggcgagggctgcagctgcggcgacaactgcaagtgcaacccctgcaactgttaagctgcatcactcgtacgtacgtgtgttggtgtnaagtanacgtaaaaaacgacctctgatnngaggactcaaaagggttcnttgctgtgcggtgttgcttgccnccccaangccncgccanggttccttttgtagttgtgtcagttcccngtattgcttancacccacnggggggntgataata

SEQ ID NO: 89438 - DNA, 520 bp, Triticum aestivum
  unsure (1)..(520): unsure at all n locations
  Clone ID: PAT_TA_89438
cacaacccctccccaacccaccaccggcggcggcgcagcgcgaggaagaggaagcgaagatggtgaagttcctgaagccgggcaaggcggtgatcctgctgcagggcaggtacgccgggaagaaggcggtgatcgtgcgcgtgttcgaggagggcacccgcgaccgcccctacgggcactgcctcgtcgccggcctggccaagtacccgaagaaggtgatccgcaaggactcggccaanaagacggccaanattcccgcttnaaggtgttcctcangctcgtcaanttcacccacctcatcccacccgctacaccctcgantcnacctcaaggaggtggctccggcgcgccgactcctcactccaanganagangtggccccgcaaggcgccaangcaactcgaggagcgttnagacgggaananangtgttctcacanctcnctcaagcancgttgacggtcnccaggtttcctgcgttacacaccaactttnattttgtnttgtagcgggatgtncgc

SEQ ID NO: 89439 - DNA, 588 bp, Triticum aestivum
  unsure (1)..(588): unsure at all n locations
  Clone ID: PAT_TA_89439
aagggacgaaaaatatacttctccctttaaattagcatgatttcattaaaaaaatagcatgatgacgagaacaaaaaccgaaccgattatatatttcgtgtacaaatatatcaagcatcatcagcacgatccgacggccagctttgctcggaggtccttcctcagaatcttgcccgacggcgccttggggatggggctcacgaagaagaccttctgcagcctcttgtagaacaccacctgcttcgccacgtactgcttgatctcgtcctcggtcatgtcggcgctgtccgacgacggcaccacgaacgccacagggacctcgccgctggcgtcatccttcatcgggacgacgcggcgtcgcgatccggggtgggcgatgacatggctcgactccgcgggcgcactggaacccttgtctgatgactcctgagcggtcacatgaagattctctcgngtcacaaccgagtcccgttnancaccttcctgcacgtctcgcgtccctccggtttcaggaccttagattgctccctatcaattccggtgttcccgagaaccggtcccggtcacatntaccggtctacacngcgn

SEQ ID NO: 89440 - DNA, 515 bp, Triticum aestivum
  unsure (1)..(515): unsure at all n locations
  Clone ID: PAT_TA_89440
agctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagatatacgtgaataacgagcgtctgatctgatggagtcnacaagggtgcgtgtgcgtgtgcgtgtggtttgcttgctcgctctccatgctctccatggtgtcttgtgtgtantgtgtgtcatgttcctgtaatgcttatcatcccacatggtggaggatgaatatgtagatgaanattactantacacccnaaaaaaaaaaaa

SEQ ID NO: 89441 - DNA, 582 bp, Triticum aestivum
  unsure (1)..(582): unsure at all n locations
  Clone ID: PAT_TA_89441
gagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacnatgctatcanatcgancctgttgctggggaagacagcaatggntctgttatgtagcttatccattagacctatttgaagagggttccgttacnaacattttacttccattgtngtaacgtatttggttcaaagcctacgtgcctacgtttggggatcacnantcccctacttatcaaaacttccaagcccgcctcatggtatcaattgaagaatantgacaagtaggnctccttatgggattcatanacaaatgggatacccaaaaatatgtaancttatagttcantgtgctgnttacaagtganaaactaccn

SEQ ID NO: 89442 - DNA, 452 bp, Triticum aestivum
  unsure (1)..(452): unsure at all n locations
  Clone ID: PAT_TA_89442
cccagattcgtccgccatccggtctcatctctcctcctcccccctctgccctgctctccgtccccgagctcccacgcgcgcccccacccgaccagccccggcgacgcggccccggccgtcctgctcgtctctcccgcccgcgaccccggcggccgcccccactccgtccccgaccctgcggcgccgtgatccaatcgatccatcaaggctcgactaacctcttcaagcgcctcttcagngcgggagattaccanagtcngcgggcgttgaagcntagggccgggcgtggacgtgcgtncaacccgagtccgccccggctctaagtttctgcaatcttctactacctgcgatancgctccggggcaagaannctcgtngcgggtgctcntgctcggnatggnaatggggaancttcngatttacttcgnaagggtaacaanncnaaaatgagg

SEQ ID NO: 89443 - DNA, 175 bp, Triticum aestivum
  unsure (1)..(175): unsure at all n locations
  Clone ID: PAT_TA_89443
tnctnagtcctcggttcccggtcctcgtccagttccgttcnntagggtttagataagtatttggagaagaggttngacagncngcattcgggtaacgantgcttcgtcgnatgcgcncnctccagctantcntgnccatcggattccnctcacatttgtnaaactgngcgatttc

SEQ ID NO: 89444 - DNA, 183 bp, Triticum aestivum
  unsure (1)..(183): unsure at all n locations
  Clone ID: PAT_TA_89444
cttttntgtccttgggtctncngtgataantcacagaanacaacggganattttcangactgcaactccaatatncttgttgctgttcctggttctctggttctgcacctctcaggctgttacgtcagcangntanttcctgnangtaagtcccaccttggnntnattttccntgggtaagaa

SEQ ID NO: 89445 - DNA, 334 bp, Triticum aestivum
  unsure (1)..(334): unsure at all n locations
  Clone ID: PAT_TA_89445
cttatatttttctttcgccataaagaacacttatatcttgactagaacaaataaccccgtgggcctttggattggattttgagctagaccgatcactaggcanaaaanaaaatacatgcaatgcagccccgttgtgccgtcgactgccatggcaccttcttctctcgttggctcaccaatgtctgtgaatgcacgactgtggtcactggccanangtccagccngnggncatctcgaanccgttgcggcggttcaggtaatcctccctgngcctgttgcacntcctcgctcgtgttcagcannaagggcccgtcnaggggcatcgcctcncaat

SEQ ID NO: 89446 - DNA, 283 bp, Triticum aestivum
  unsure (1)..(283): unsure at all n locations
  Clone ID: PAT_TA_89446
cctccccccccagatccgccacagcccgcgccccgatccccgccccctcgtctgccggtcgggggatcagcacctgcgccgatcgaggggtaggaggaggaggaggaggaggaggaggaggaggaggcgggtgcncncgacatggctgcgccgccggaganggccngggccgactacnactanctcatcaanctcntcctcatcngggacagcggtgttggaagagttgcctccttctgcggtnctctgatggtcnttcactaagaagctttatnancacgat

SEQ ID NO: 89447 - DNA, 217 bp, Triticum aestivum
  unsure (1)..(217): unsure at all n locations
  Clone ID: PAT_TA_89447
gcaacactagctaacagccgggcagcacatacgcacacatcgtatcattcctagacaagagcatggctccggcgatcgccgcaaagcctctcctaagcgatctggtggcgcaatccaagcaagtcccgtcgagccacatcagagcggtcggagaccgcccggacctcgccaatgtcnaccacnantccggngccggaattccgctcatcgacctgaa

SEQ ID NO: 89448 - DNA, 201 bp, Triticum aestivum
  unsure (1)..(201): unsure at all n locations
  Clone ID: PAT_TA_89448
gtctcgagttttttttttttttttttttttttttttattanntatntcatattcataanatatattntgcaanattacntatcagacatcaacatacntacatagtnataangtgcttgacattattcgncanggnagaaggatttcataaatnaaatgttngaattcanaaccnaaacgntnaaaggngggggactaaat

SEQ ID NO: 89449 - DNA, 316 bp, Triticum aestivum
  unsure (1)..(316): unsure at all n locations
  Clone ID: PAT_TA_89449
gttctccgggttcactggctccatggagaccgtgctcaaggttctgaaagacggtctttcgactctccatgttccttatccatatggttttgcgatcatcctcttaacagttctgattaagggggccacttttcctcttacaaagaagcaagtcgaatctgcacttgcaatgaggtcacttcaacctcaagtganggctattcangaacgacatgctggggatcaggaaaggatacanctcgaaactgcccatttaataattgtccnggcgttgatcaacttnnaggggggttnncaanccgtgnaananacaagt

SEQ ID NO: 89450 - DNA, 262 bp, Triticum aestivum
  unsure (1)..(262): unsure at all n locations
  Clone ID: PAT_TA_89450
aagaattcctcccacccccaccgtctcgccgccgccaccacagctagataagaaaaaaagagagagcagaactcgttgggagtgctcgagatctgtgtcgggagagggggaattcttgagatcggaatcggaacaagcgggcgcgctcgggatcgggggttaccatacattttttccaanganctttagtgnatgttccaaatgggtcaaaggggtggcaaaaattctaccagtgttattccctgantanaacccccctcgg

SEQ ID NO: 89451 - DNA, 325 bp, Triticum aestivum
  unsure (1)..(325): unsure at all n locations
  Clone ID: PAT_TA_89451
gccctggcctcatctgccgtgggtgcttacctgcacattgccctgaacatcggtgggatgctgacaatgctcgcgtgtgttggaaccatcgcctggatgttctctgtgccagtctatgaggagaggaagaggtttgggctgctgatggntgaancccccctgaanggggcttcggtnggncctcngattgngggggccatannntttgacccatgtancctcgtnanagggtttgtcanaaacancnatctcttcgggngtttctnggggcnccccnatnatngaancccggngggattactntacnnggggccccccccggggg

SEQ ID NO: 89452 - DNA, 386 bp, Triticum aestivum
  unsure (1)..(386): unsure at all n locations
  Clone ID: PAT_TA_89452
gcaggccccgacggccgagccccacggcgccggagccgcggacgaccaggccggagccggagctccccccgccgtcgttcccgggaaggagttcacgcggacctgcaagggcctcgtcgtcgtgctcatcggcggctacgtgctgctgcaactcctcccatcttccntaaactacttcgcnatcatcccngccaagacaattcctttgtatggacggtcttcaccgccggttacatcgagcattcctccnaggggctattggaantcccttgggnctctnttcngngggaaaggttttanccaatttgggggcnaaagggntttttganntaatattttgaaaacncatgggggaaactttggntnggattggntcnntttaattt

SEQ ID NO: 89453 - DNA, 562 bp, Triticum aestivum
  unsure (1)..(562): unsure at all n locations
  Clone ID: PAT_TA_89453
gtttgagtgatattgataaattgaagactgaggtcattgggctgaaaggtagaattgacaagaaaagtgcatatctgcaggaattacaagatcaatatgcgggcctccaaaatttggtagagcgaaatgagcagctatatggttcgggagatgctccatctggcggagtggccctgccattcatattggttcagacacgtcctcatgcaactgtcgaagtggagatatcagaagatatgcagttggtgcattttgatttcaatancactccgtttgagttgcacgatgattcctttgtattgaaagcaatggggttctctggtaaagaagaaactgacggtacagtggctctggttgcaaatgcggttgaatgctcaagtgcatcaaatgtttatgggcgtcgatcancacatcctgcagggcanatggaattagctacgaactcacctcctattccatggatactgaaaggcgttcaacataacacatgactaatggttgtaatgttnaganctcntgattaanccccgtggctcgtactanatgtangggttgtnattnt

SEQ ID NO: 89454 - DNA, 334 bp, Triticum aestivum
  unsure (1)..(334): unsure at all n locations
  Clone ID: PAT_TA_89454
cttcttcctttgtgtggcttcttgtatcgtcaccataagcttcaggacaaccggtttcatcgccaaagcacatgagatctgtgtggctcttgtgatggtgatcacgacgctgttgatgacgatcgtgatgctcctggtgtggaaggtgaacatctggtggatcgccgccttcttcgtcgtcttcatgtccacggagacngtctacctgtcggcggtgctgtacaagtttacgcagggcccctacttcccgctggaaatgtcggnggtgcncatggngatnatgatngtgnggactactgcangtaaaggggtacatnacganncaanaaaggtt

SEQ ID NO: 89455 - DNA, 556 bp, Triticum aestivum
  unsure (1)..(556): unsure at all n locations
  Clone ID: PAT_TA_89455
gatcagtggaataccagcctgcagtccaaggagcaaatcgaggcgagcctcgtgagcaggcaagaggccgcggctagaagagaacgggctctcgcatacgcattctcccaccagtggaagagcacctcaaggtctgccaacccgatgttcgtggacccgagtaacccgcactggggctggagctggctggagcggtggatggcgtcgaggccgttcgacggccgcaacggggcgtccgagaaggagggcagcagcgtcgaccgcacgtcggtgcacagcaccagcctgagcatgaacctcggagaaggtgagacggtcacaaaggcggacaaccaggtgggtggactctttgaagccgaatgatgataaccgccgccgctttcgactccgaaccgtccggcctgccccaagaatcccgtcgaccctcgccggcgctggcaagaagaagaccgaccccaagatggagatgcgacgngacaccnaagacgtggtcacacgtcggtcgaacggccggagnaagatcgggctcanctgcgtacacncggctctccctcgg

SEQ ID NO: 89456 - DNA, 544 bp, Triticum aestivum
  unsure (1)..(544): unsure at all n locations
  Clone ID: PAT_TA_89456
agaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctacctgctgggttcatggacatcattccatcccaagactggtgagaactacangctcttatgacacaanggtcgcttcccctcatctgtcagggatgagatgctaattcaactctgcaagncaagtcttcattcggcaaaaggatccctactgaaactatgatggcgacatcgctaccagaccaccataagcaanacacatcaaccgactgagacaaaaatttgctn

SEQ ID NO: 89457 - DNA, 561 bp, Triticum aestivum
  Clone ID: PAT_TA_89457
aactgaaacttttgaaaagcttggtgtacatggtttgacaaacaacgtcaagtaaacaagtgataaaaatcagctgtcaactacatattcatctgacaaaaaaccatcctaaatcgacaaagctcatacttaacattcacagcatcaccatcactggtgggccatacaatggcggtacatcgaccggcgaccggcaccgtagagtgaagcatgcagagcatcattgcatacgtcatactactcgacacacaaagaagcgttccagatccatcttgcctttccgccaggtggctccacagaaaacgacagttcaatcctaggctccaaaacccatagacaaggagagagcaaaagagagtggaccaaccatccctcaccagcaatgccaatacggctgaggggtgagatttcagctgcagactgcattgcatctacacacactcactaaatctcaacaacaagaacatatcgtaatcatcagtaatcagtcattaatcctgactgaaataggatggtgtcagaggaagagaacaattctctaggagcagaagttggaacgtg

SEQ ID NO: 89458 - DNA, 543 bp, Triticum aestivum
  unsure (1)..(543): unsure at all n locations
  Clone ID: PAT_TA_89458
cacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatttccgcctaaaatgaaataaaagctcagacgagatgagcaacgtcatcgtgcctatcgtgtgtgttggcaacaaatattatacaatatccgttctcgtcgctgttttctctctnaaaaaaattgtgttgctgttgttcaatatcggatatcctcctgaataataatgatgtcntggtggaataagtagtcctgtcaaaaaaaaaaaa

SEQ ID NO: 89459 - DNA, 436 bp, Triticum aestivum
  unsure (1)..(436): unsure at all n locations
  Clone ID: PAT_TA_89459
ccgaggtgctcgccgccgtgtccaccgccgccaggcgcggcaacgcccctgtgtgcgggcagctcgccgccagggctagggcgatcggcaaggagagcgaccgcaaccgccggtgcctcgcggccgcgggcgccgctcgccagctctcgtcggctttccagagcctcgccggggagcccgtggagggtactagcgccgccgttctggtcgcgctggggaagatcctggcggcactcaccgtgttcttcccgctcgacgacgaggcgcggcgctgcattgcctcaccggcctccctcaagaccctcgtctcggtgctctcccacggcgacctcgccgcgcgggccagcgccgccatcgtctcngcgagctcgcctcntccgccgaccggnacaccgtngacgtatctcgagaccncggcgtgtgaaggcgctcgtcg

SEQ ID NO: 89460 - DNA, 580 bp, Triticum aestivum
  unsure (1)..(580): unsure at all n locations
  Clone ID: PAT_TA_89460
tggtcgagcaggaagttaagaggaggattaagtggcgtgtactgatatggagtactttgtcatgcacgtgagctagaccgttaattggagcgtagctaggagcagccggagggcatgcatatgcatgcacgctatggcgatccacatcgatcgtatgtggactatccaacggccgtgctgcggacgttggaccagaaacttgatttgtcccagcatgtatgtatacgcatgaggtctctactctccatatattcattcctagctaggcttcctgccaattgccatgtacgtgtggtcgacctctactctgcccccctacaatattcctggcccgcttgtttaataaatccaactagctagtgccgtgcaagtactacaccatttaaccataccatttgattggcgattgcatcttaagagtacacgtactgtaaaaaaatctgcataatgatcacagtacgtcacgtacaactatcaagtgtgacctttacgaataggtagagtagttggtacaacaatcaccagggtaaaatccggagcagcaagtcatcctccttanggtgccncgggacagtacaag

SEQ ID NO: 89461 - DNA, 197 bp, Triticum aestivum
  unsure (1)..(197): unsure at all n locations
  Clone ID: PAT_TA_89461
gttatttttttccataccttcttttcctcgatacattattttccagtggtaggattcagatcctcanataccaagnanaatttgcaaattgcgctgtacaattcgggaagaactaggccctaaatctgagcagagaagtgctagaacttcttttctgaagctgcacgggtgagnaggtttctgnaggctgcacagtc

SEQ ID NO: 89462 - DNA, 572 bp, Triticum aestivum
  unsure (1)..(572): unsure at all n locations
  Clone ID: PAT_TA_89462
caagaaggtgaaacgagctgttgagtttaccgcagaagacgacgacttcttagaggagttcaggcaaggaatggctgggctgaggggcatggcggaagaagttaggcaatcttcatcgaaaatgggtgctttcggtaaatatctcttttcacccgacattcatgatgccgatgagtatagtccttcatttcctgaaggtatagagtctgtcaaacgcaaactttcgaggaatgatgaatcttgggttgttaacacttgggcatatgaagaaaaagctgttgctttaaatgcgtgtcttaacgcatacaacgccgatcttattcaaatgaaggcatatccatggctatagctaaatgcgatccaataaagtactatggatggtgcttacataaacaagtgggctaagacggtggccgaagacatgacaggaagaatcggaaccaatttttatcacacattanttgatacatcctcggagggttgaattcancggatataactcacagaagagaccaangnntcagaccggattggatattcangtgcacanaaggcattaacagacnanttca

SEQ ID NO: 89463 - DNA, 609 bp, Triticum aestivum
  unsure (1)..(609): unsure at all n locations
  Clone ID: PAT_TA_89463
ccgccgcctcggcccgcaccgcttccacgcccacgaccagaaccacctccagatccgccgccccgccgagtccctccccgccgtcggcacccccgagaccgacgccgacgccgcctcctccttccaggagcgcgccaaggacatcctcgtcgtcgtctcgggcctgctcttcggcttcggctgcggcgccctcaccgccgcctccatgtacctcgtctgggtccctcgtcgcctccaccggcgccgccagccctacgangagtctacagngacgaccaaggacgacgacggggccnaanagcccaagaaggcggtacntaatcatccanngggccnaggantcttccccggtaagaatactaggatcgggttngnatcgtcttcggaagnaagnttcggttgaaaattaatgaattgngggnaccttaancaaattcnaaccataaactgtgcnccgtttacctcccaatggtntttntgtttgnagaaaaatttaagaagtgatccaacggtctannaatatggcaattnatgccaaacatgatagttcatcctagataactnanggttcgtgcataaatgcaatgtnaaaaaaggggcgnccattcc

SEQ ID NO: 89464 - DNA, 381 bp, Triticum aestivum
  unsure (1)..(381): unsure at all n locations
  Clone ID: PAT_TA_89464
ggttcgggttctggttcggttcgggttcggttcgagagagaggccgagtagctagcctagtctagggtttcggtaganaggaagtgagatccatggcggagacggagtaccgctgcttcgtgggcggcctcgcctgggccaccgacgacaacaacctccancaggccttcagccagtacggcganatcctcnacgccaagatcatcaacgaccgcgagacggggaggtcccgtgggttcggcttcgtcacgttcggcancgaggaatcgatgcgccaggccatcgaggagatgaacagcanngacctcgacgggcgcaanatcaccgtcaacgaggcccagtctcgccgctccngcggtgggggcngcngccgccgctacg

SEQ ID NO: 89465 - DNA, 380 bp, Triticum aestivum
  unsure (1)..(380): unsure at all n locations
  Clone ID: PAT_TA_89465
attccccactctctcagtcccgatccactccgccgccgcgccagctcgccatggcagccgccgacgaggcgcagggcttccgcccgctggacgaggcgtcgctggtggcctacatccgggcgaccccggcgctggccgccagcctcggcggccgcgtcgacgacctcgccgtcaaggaggtcggcgacggcaacctcaattcgtcnaatctcaactnccgaagcccgtncgttctncttcnaacaaggttttcctnaaancgctngnttggggnaccttgccattacaaaggnaaggggnaattttaagggcngggctnggggaaaanagggcntttgcccggaaattcccgngnnaaaatttacgggcanttnctcaac

SEQ ID NO: 89466 - DNA, 572 bp, Triticum aestivum
  unsure (1)..(572): unsure at all n locations
  Clone ID: PAT_TA_89466
cagagatggtgcagcctgctttctaaatatgggatcattatctgctggctgtgaaggggcaccactgctaccgctactatttgtgttggttaatatgggattcaatatatccttgctacacctgctaaagatttcttctgctgttgcatcttgtctagcctctacattctcagtcccgctgtcgatctacgccttcaccctaccgctgccgtacatcggcgtggcgtcnacctccctcccggttcgttgcaagcgctgcattctcaatcgccggttactaaatgcacagcttcccgcaancaaaaaatncggggaaagcaagaatgacaactnattacatnattcctcctatccacatacaaggtggtcctcaaccngctgtctttaaaggaaacanattctcctgtgacaactgactgacgtgtgtgtttagggacantcattaccnataaaacaagagaacccagggnacatnacaagataaaagtgngnnaaacaggaataccncctggggtccnccacgaaacgaacgggaccccncntttttttgggaagtagaaaaagcttccccc

SEQ ID NO: 89467 - DNA, 375 bp, Triticum aestivum
  unsure (1)..(375): unsure at all n locations
  Clone ID: PAT_TA_89467
ctccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtngcgctgcccngatataaatcaacgttcgacggactgcngtggaccctgcaagagancggttcggtnnaagccggaaataanttttccncctaaaattaataaactncggacaaataaaag

SEQ ID NO: 89468 - DNA, 517 bp, Triticum aestivum
  unsure (1)..(517): unsure at all n locations
  Clone ID: PAT_TA_89468
gttttttttttttttttttttttttttttttttttttagaggtagagtaatgcctttccatataatgaattggtactttcactacaattgttaccttttgcgggtacaaagtcaaaactttagagagtaaagcttgtcttttcctactacaagtataaactggttgctgacgagatgcaatgttcgatacttttcatatttgcccaattatttggtaaaaagcagagccgccaaatagtgaggtaaaaaccttatttaaatgccaaaaattagcataccaacacacattgttcatgccacattttacaacggcttattacagtaagggagcanagtaatgaaacacccgaaacacatggtactttaacggattctccatcatccttcctaacccnaagaagttgatctcccatctcancctcancgaaggngcaattancctcanacancctcataatcgcccttctttcaacccnacctctcancaattcaaaatcccccgggcatatgacccacc

SEQ ID NO: 89469 - DNA, 378 bp, Triticum aestivum
  unsure (1)..(378): unsure at all n locations
  Clone ID: PAT_TA_89469
gagggcagtagatcatcaccaaccatgtcgtgctgcggaggcaactgcgggtgcggatccggctgcaagtgcggcaacggctgcggagggtgcaagatgtaccctgagatggacgagggggtgaccaccacctcccagaccctcatcatgggcgtcgccccctccaagggcaccccgtcgttccgaggccgccgccgagaccggagccgacaacggcgggtgcaaagtgcggtcccaactgcaacttgcaaccccttcaacttcaagntgattccatcaaatccaagncaangagaatgnaatgcaatggttgncctaattgaagggcaatantggaatttcnagggtgttccttggttncctttttaantgcccccc

SEQ ID NO: 89470 - DNA, 331 bp, Triticum aestivum
  unsure (1)..(331): unsure at all n locations
  Clone ID: PAT_TA_89470
ctccagtatggaaaggctctatacagaacaaagacgctctcccgtacggcccaaccagtttggaatgacaagtttgaatttgatgagattggtggtggtgaatatctgaaggtcaaatgctataatttagatacattcagtgatgatagcattggcagcgcaagagtaaatctggagggactctagatggtgctagccgagatgtgtgggtaccacttgaaaaagtagatccagganaattcaaggctccanaatagaggcaatacaaaatgatcacancaacntctganaatttcangcnataaagtttaaacctggctgnatnagccta

SEQ ID NO: 89471 - DNA, 561 bp, Triticum aestivum
  unsure (1)..(561): unsure at all n locations
  Clone ID: PAT_TA_89471
ctccccccgtcgtcgcggctccagctagggtttccgcccccgccctcccgccccaccgccggccccgtccgccatgtcnaagcaaggaggaaaggccaagccgctcaagcaggccaaggtcgccgagaaggactacnacgagaatgacctggcatacctccagaagaanaaggatgagcaaaaggccctgaangagctgaaggccaaggnaggccagaanggtgcgctgggaggatctggtctcaagaagagtgggaagaaatgagtctgcccanccattcgtaataccanaaaatgataatctatctatctanctatctgtgtcacgctcactatctntngttgtaacaaactacttaattntgttnancattgtgcatcgtcgcatattnnctnaaactatggatntaagaanctcttctgctaatctaagatanaaatgncctagcnatatgnatattttttngnggggggccngtacaatccctaaattatcnatnagnagtaatgncgttgnttaaantntacggaaactncntacaactaaccttcaaaatccct

SEQ ID NO: 89472 - DNA, 297 bp, Triticum aestivum
  Clone ID: PAT_TA_89472
gaaagacttgacttgttcactgtaaaccagaacatctggatcatcatcttcggcatcctcatacacaccagctgacacaatactaatggccacggggtcctcctcgttaccaaacttagcagacatataatctatccctgccatgctctgactatttaaccctaccaggcacatctcgattctgaagtagaacatgtcaccgacctcgacacctgggaacctctccaatcctcttgttcttattgaggcgaattcagcgttcatcatgatactcccagcttcaattttggggggggg

SEQ ID NO: 89473 - DNA, 572 bp, Triticum aestivum
  unsure (1)..(572): unsure at all n locations
  Clone ID: PAT_TA_89473
gagaagtactcctagtaaatccagaattcagccagaaaggcctgtgaaggacagagctagtatttcgaattcacagcctggaaatgctagtcctcatcatgacactgaagggcctggtgaggaaacaatgcaaggcattgtaatggaacaagaanaattaagtgattccgaggaagagagccagcatgttnatttgaatgtgaggaaatggatcattctgaagattagcaagttcaaggcacaagacaatgttcgactacnaacaaaggaanttcaaaataattgtttnttcaaaaggtgcaagaaaataataccattgtcaaancccaacaaggattaaacaagttggttancnggttttggttcaaaancgatcccttggtcttctaattgaaggcngtttaagcaaagtccaacccnacggagnaaattcnnaaaaccncaggactnnaanaaccgacgggatccantcaaanctcnanaaatganctaaccnggccaaatccggaagaggagtctgaacanaatcangatcaaaaggctagaanatctccctnttaagggccacgctc

SEQ ID NO: 89474 - DNA, 432 bp, Triticum aestivum
  unsure (1)..(432): unsure at all n locations
  Clone ID: PAT_TA_89474
gagaccgggaggcatgttaggatgctaactcatgaaatcagaagcacgctcgacagacatacgattttgaagactaccattgtggagctaggaagaaccttgggtctggaagagtgtgccctgtggatgccgtcaaggagtggttcaagtctccagctttcgcatactctgcgccaccaaatcactgttgggtcatctatatcaattaaccttcctgttatcaacaagtttcaagtagcaatcgaacaattatataccgcacaantcccctttggcacggttcggcncttgccggacaatttttccaccaaaaattggctgcaatgcnaaatacccttccnaaacttncaaacntccaaattaaagacggccaaanttnaacnaaaanctatgcattnnggcctgagcttcaacngaaaatgcaaggaactg

SEQ ID NO: 89475 - DNA, 365 bp, Triticum aestivum
  unsure (1)..(365): unsure at all n locations
  Clone ID: PAT_TA_89475
gcgatggccgccgcgctctggtcggaggtcgccggatccggctgcgcggaggccgcgctgctccgccggctggaggcaagctcgcacgtgccggcgaggctggtggtcacggtggcgtcgtggatggcacgcaccgcggtccgggcccccgcccccgcccccgccgttgagggctgggccgagtgctcctgagccacgggtccggccgggccatctccctcccgtccgacgtncccgaacaaggaagaaggaacaagcctgagatagaattacacgttanaatgtacatgtnaacaaattctttgttaattttccccaccttattctnagcacatatacaaatatccctgttnaaaaaaaaaaaa

SEQ ID NO: 89476 - DNA, 626 bp, Triticum aestivum
  unsure (1)..(626): unsure at all n locations
  Clone ID: PAT_TA_89476
tcgagttttttttttttttttttctcaaaaaaataaaaaatgaattgattaactcaagagcaacaataccatgtccgaattaataataaaaaccaagataagctgggcactaaagccatattgagttactgacacaaccccatgatgaatgagatgtgaaccaagtcttgatacacgtgacacaagtcttggatacatgagacccgtgcttgcaacgacgcagtcccgacgggacatacactgcaccgctacgagaaccccttggcggcctgcaagtggtccgtgggacaccgacgccatcgaaagaggaatccgctgggtaccggcaatggtataggcgttcaagtgttcctgttcgncaaaattcncctggcaatggatccnattgcacaacaaccaagncatgtataaccgttccatcctttgcaatgtatccgactactgtcctaagcatganaatttttgggttgagccnccaacntggtattgggttgttgncacagaacaagactggggttgggntaccacaatgatgaanaagttggtccgcaacttaaaatccatcgataacaagcantgttcangataaacattaaatcgtcnantacacccccttaananggtng

SEQ ID NO: 89477 - DNA, 412 bp, Triticum aestivum
  unsure (1)..(412): unsure at all n locations
  Clone ID: PAT_TA_89477
agtggctggagatcgtgttcaacatcgtgaccatcactggggggctcatcctggtcaccatgctcatcggcaacatcaaggtgttcctgaacgcgaccacgtccaagaagcaggccatgcacacgcggctgcggagcctggagtggtggatgaagcgcaaggagctgccgcagagctaccggcaccgggtgcggcagttcgagcggcagcggtgggcggccacccgcggcgtggacgagtccaaatngtgcgcgactccccgangcctccgccgcgacatcaaantacactcngctcgactcgtccgccaggtgccctcttccncanatggacactcgtcctcnagaaatttncgaccgcgtcggtccctcatcnaccccaaggggnaaaacatccttccggaaggtgcccc

SEQ ID NO: 89478 - DNA, 571 bp, Triticum aestivum
  unsure (1)..(571): unsure at all n locations
  Clone ID: PAT_TA_89478
cgaccctgtccctgatgggctccacggcgtcgtcggctctaccaggtgccgccctcgagctcttcttcccgtcgccccccgtcaacgtgtccaccgaggtgcgccgccggcagccaccgcggccggcgcaagtgcacccacaggcggcaccggccgtctcgccgccggtggctcatgcaggcattagaaggcatgcgggtccgccgccaagttacaacgacnacaggcggaacaacaaccggttttctttccgccgtcgccgcccgttgtttatncccgcagtgccaacaagcgttcggntatcctgttaattnacaactactaangaggtttggcaaaccggcgttggtcnacnacaacaacggtgatgggcttggggcnngggggggccaaggacggttncccccngcggcgggttcgcnccaaagggggttcctttcctggccaatnngactgccatgggcccttttgaacntctntnaggcacccgggtaatcctnagtnaaacgggcggcttaaactcgcgcgcnnccgaaaggtcgcttcacgcaaaatcacngggtaatggcca

SEQ ID NO: 89479 - DNA, 615 bp, Triticum aestivum
  unsure (1)..(615): unsure at all n locations
  Clone ID: PAT_TA_89479
actggcccatccccacataccacacacgtatccccacctcctcagatccgagcgccatggccgcccacccccacccgcattgctatgcccaccgctagcgcctccatggccgccgccgcctcctgccggagcccgctcgtctggttcttctccctcgccgccgcgctcttcttcgcttcctgggtacctcctcctcgactccgccgccgccccggccgcgctcgatgcccgccgccagggcctccgcccggcctctccaggcaagaaaatgcgattcggataaggcgctgctgcgcgtctacatgttacgacctgcccttngattccacttncggcatgctcgactggggagcccgggagcggcngtgggcggcttttggccggatgtcaagcacggctnccggataccccgggaaggctcaacctgcaacacacatcantactgggtcangctngactcctcnctccgaacaaggcgcgcccangccgttcacgcttcgggtgcgcaaccgccaaggcgantctcttcgnccttctngctcctanntnaacgcatcaagnctncgccgccgacacaagacggnctcacggggtataatctccnncggccatggg

SEQ ID NO: 89480 - DNA, 198 bp, Triticum aestivum
  unsure (1)..(198): unsure at all n locations
  Clone ID: PAT_TA_89480
attctttcgctgcagatccgccacgatccagatccttctccccgatccagatcgacgacggcggccccccgtcgccgcctccntctcccacccaccctgatccatcccctcccccagcgggatgcgccgctccactctctaccccgcacaccactcgtcgtcccctcctctttctcctagatccatacgccgccgcac

SEQ ID NO: 89481 - DNA, 615 bp, Triticum aestivum
  unsure (1)..(615): unsure at all n locations
  Clone ID: PAT_TA_89481
gtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatccttccagtgtgagcttgtcttcgccaagatgggcatcaacccaatcatgatgagtgccggagagctggagagtggcaacgccggagagccagccaagctcatcaagcaacggtaccgtnangctgcagacatgatcaagaagggtaagatgtgctgcctcctcatcaacgatnttgacgccgtgcggtccggattgggcgggaacacacagtncaccgttcaacaaccaaatgggtgnacncacctcnatgaaatcgccgatgccccacaaagttcagtcccannattttaacaaggnggngaactcntgtgccanctcntcactnggaacatttcaangtgtagccctctancctnatggcttgngaatntacnggggncancncaaaacgttcgntttgnaggntctcaacgaaantac

SEQ ID NO: 89482 - DNA, 538 bp, Triticum aestivum
  unsure (1)..(538): unsure at all n locations
  Clone ID: PAT_TA_89482
gacacttctcccgtcccgtcccgtccccagccaacctcccatctccgtctcgcgtcgcggcggcagttccactccctcgccatgggcaagattaagatcggaatcaacggtttcggaaggatcgggaggctcgtcgccagggtagccctccagagcgacgatgtcgagctcgtcgccgtcaacgaccccttcatcaccaccgagtacatgacctacatgttcaagtacgacaccgttcacggncactgggaagcacagtgacatcaagctcaaggacgacaagactctgctctttggcgagaagcagttaccgtcttcngcgtcangaacctgaggagttccgtggggtgangctggtgccgattacttgtggatccaccggtgtctcactgacaaggacaaagccgctgctcatttaaggtggtgccaanaaggtggncatctctgcccaagcaaaatncccnattttgtggtggntcaacanganantcactcanacttaanatgtccaaatgcaactggacacaatgctggnccc

SEQ ID NO: 89483 - DNA, 623 bp, Triticum aestivum
  unsure (1)..(623): unsure at all n locations
  Clone ID: PAT_TA_89483
atcaacctctccactttacacatagagaacaatcagtttggtgggaacatcccagcggcggccgttgggctccgggagttcatcgccgggaacaacaatttttcaggggagatgccggcaagtcttggtaaaggcatgccgctgctgcaggcaatgaacttgtccggtaaccagctctttgggtgggatcccgagcagcgtagccaagctccgattgctgacgcagctggacctgagtaggaatcagctcgccggcgagataccggcagaattgggcgccatgcgggtgctcagtgcacttgacctgtccgtccnaacaagctatctggctaacataccgccgccgcttngccgggctaccgctcactttctcaacctgtcatcaaacaactcnatgggcaangtaccggcaaggtcgccaaccgccgcttacatngggactcctcgggaaccccggctctgccatctgtcctgggcccccttctcacgggntncgncctgcctcgggataaaaancgctctctcccgggggtccgcggngtcccaatggctccaatcctccgggngctcttgcctaacggggcttccntctcacgtcgnanatnagaaagaacgccgaaggg

SEQ ID NO: 89484 - DNA, 617 bp, Triticum aestivum
  unsure (1)..(617): unsure at all n locations
  Clone ID: PAT_TA_89484
ccttcattaacaacatgtctcagctcagtgatcttctcgcttatcattcggggaactccatcgaggctatcctccagtctttccgacataccttcacaaaaaaatcctataaacgcgctgtttctgacttttactctgatctgggaaattatgtgtatcaacaacgaagtaataacaacatatatcaacttaacatgtctttcagtaagacctcaatcaaaatcattgaaggaaaaatcaacattgtacatttcgcagatcttagttccgccattctccatcaaaaggatgagcgacatatcttaagaattatccatccgcttcacttngaaaagatattattaatccaacatcaatgggcccatcgaaaantaaaacatcatttnagaaaaatcactccagaattagaaggttttgactnaacggcttgaaacgggaaagtcatgagagttgatctagatgacaacgtatccacaaancccaccttgggaatatttcnaggacaagagtgggccaaacagatccccatatggaagttcagaatagagaancgaganaanagagatataaactagaaatnaaatgcgganaatccacaggnaactnataagcaaatg

SEQ ID NO: 89485 - DNA, 586 bp, Triticum aestivum
  unsure (1)..(586): unsure at all n locations
  Clone ID: PAT_TA_89485
gagctctcctctccagacctctcccttctctccaccaggagtttagggttagagagagcgagacgagcaaaaacaatctctcgccccactgttataccaagttcgcatccacctcactgttatacatctttgtatcacaatgggtggcctatccatggagcacccttgggcattcgccttcggcctactaggcaacgtgatctctttctccgagcctcctgggccccgatgccaacattctaccggatcttcaagagcaaatccacggaggggtccagtccgtgccctacgtcgtggcctgttcaacgcgatgctgtggntattctacgcactgggtcaagaccggtganggctcctcatcaagcatcaacgctgccggtgcgtcatttaaacgtctaatcgtcaantactcgtctacgcccccaagaaggcaaatttcacaagcaaatngtcgtctcctcaaatcgccgnttcgggtcaactcctctcaactcttcgcttcacgggagaagctctccctgggtggttggtcggtttcgtcnggtctntgccanagacatgngatcnagacaaattggnaatcctc

SEQ ID NO: 89486 - DNA, 577 bp, Triticum aestivum
  unsure (1)..(577): unsure at all n locations
  Clone ID: PAT_TA_89486
gtagcactagcttcagctagccactccaggcattttcttgcatccacgacggcaatggccaccgctgatgtgcaaaacccatcggccgcgctgacggaggaggcgcccgcggtggagacgcccgtcgccgctgaggaggtcgcgaagacggaggaggtccccgcgccggcggagaccgaggtcgaggcgcctgctgcccccgtcgaggtcgtgggagaccaaggaggaggacccgggccgccgccgagacggaggatgccaaggaggccgagccagcagcttccgccgaaccngaaggccaagngnccaaaagagacanaagcgcanccctntgtccaagacagaaacaaggaagcctttgctnaagnaaaacccgcgncgccgggaagttnaagaaaaaggcnggcgccngtngccaaggccaacccggcgtcccctgcttctnaagaacacngttgaggaaccccngcnccgaaaaagaccggccccccgtngcaanttactttagngcaanccccgangaagactggnggtaactnaaggggngccttgtctaatganggtnatctatcacatg

SEQ ID NO: 89487 - DNA, 417 bp, Triticum aestivum
  unsure (1)..(417): unsure at all n locations
  Clone ID: PAT_TA_89487
cttnncgaagggcaanaaacangcgaccgancggccaaaacaangtcnctcggcgctgcttccgaatctgaccccgtcggctcctccttcctcatcnanggatcagtgnggagtaagaagggggacacctcgccatnaaggcgctcatcctcgtcggngggcttcnggacccncctacngactctcacgctcaacntccccaagcnccncgtctatntcaccaacaagccatgattctgcaccagattgangccttganaattttgggttacanangtcatttttancaccaactacgcccaaaagtcatgattaatttccttgaagnttttttaaggataacttngatcacancaaatctccaacaaactgaccctttggaatggtgncctccttgccctagnnanggacaacttt

SEQ ID NO: 89488 - DNA, 446 bp, Triticum aestivum
  unsure (1)..(446): unsure at all n locations
  Clone ID: PAT_TA_89488
ccaggacaaggagggcatccctccggatcagcagcgtctcatcttcgctggcaagcagctcgaggatggccgcaccctggctgactacaacatccagaaggaatccacactccacctggtgctcaagactccgtggtggcatgcagatnttcgtcaagaccctgaccggcaagaccatcaccctggaggttgagtcctctgacaccatcngacaacgtcaaaggccaagattcaggacaaggagggcattcccccggaccagcagcgtctcattttttgctggcaaacactcnangatngccgcacctcgctgactacaacatccaanaaggatcacatccacctggtgctcaaggnccnttggggatgaaatttctttnaaaacctgaccggnaagacatnacctggnggncgatcctctgaaacaatcnaaaactnaaggncaa

SEQ ID NO: 89489 - DNA, 595 bp, Triticum aestivum
  unsure (1)..(595): unsure at all n locations
  Clone ID: PAT_TA_89489
ctcactcactgttcttggtggcagcttcttctttctgttaggtgtcaggttcctctgttcatcggcgccagctttctagattcaactttgcctctgaatcgtctgggtgggaggagtatcgatgctttggttggcctcccaccaatggtgaatccgacttaagtttgccgtcgaagaaaggaacagaaaccgctggcaaagggggaagaaaaagatgcgggntttgagtaagcttggcgtcgggtcacgtggtgtccgcgctcctcctcctcgcgctcgccgccgagctctactactcctcgtgcacaagcgccgccagcgacgaccgcgccgcttcgnaaaagccgcctcctcgcctcctcctcccgccagctgctcannccttctgcttaaagaaacccccgcntcgctcaactangcgaaagagccaaccaaccntgccnaagtcctctcaacaaggacaagacacacacaaaggtgaggcaacnatcgntggcatcngtcggcccgggtgcctnacaacaagnggnacaaggngactcatcnagacgcgnanagtccgaagaccgacctcggactgtgatncncaaacctt

SEQ ID NO: 89490 - DNA, 655 bp, Triticum aestivum
  unsure (1)..(655): unsure at all n locations
  Clone ID: PAT_TA_89490
gaaatttggaagatcataagaaacatttacaacaggtttttcaaattttgagagaacatcaactctatgtcaaactcagtaaatgttcttttgcccagcagcggttagagcatttaggccatattatttctgacaaaggtgtggccactgatccaagcaagacaactgctatggtcaactggccagttcctactacagtcactgagctcagaggatttcttgggactcactggttactataggaatttgtgcaacattatgggattattgccaaaccacttaccaacttactgaagaagaaggctttcaatgggacggctgaagcacaaactgcctttgaccttctcaagcaagctatgacttctactccgnccttgggaataactgattcaacaaacctttcngtatacaaacacatgcttgtgacccggtatggagcattctacacaggaagncacctgtgcttactacaacaatctctagggcaaacaacagaaatgacattnagagaaagatccnactatacatggcattaaagggngagcacttncaagggcctctgataaacgacacagactagtacttgaaacaacctactaactcagnangttacaacaacggncaatcattcatcaaaggaggaaaggcgcgtgct

SEQ ID NO: 89491 - DNA, 617 bp, Triticum aestivum
  unsure (1)..(617): unsure at all n locations
  Clone ID: PAT_TA_89491
ggccgtccaacctcgtgcaggtctccctcttcagggcgctccacgagaaggaagtgcggagcaaaggcggcttcacgcgcagccagttctcctggtggccttcgtctgcagcttcgtctactacatcttcccgggctacctgttccagatgctcacctccctctcctggatctgttgggtcttccccaactccgtgtttgcccagcagctcggctcgggcctctacggtctcggcatcggctccatcggcttgactgggctccgtctcctcctaactccgggagcccctccgccaaccctgggtcgccaacggcaattcccgcaagatctcaacatcaagttcgttgatcaccccatcgcgtacggtcaactctacaaaggcgcggacttcccatctcccgatgggtctcanccagacgggnaaaattaaatcagacatntgatccatcattttaacaagctanaaagaagncacgtactaaactcttgatactagggtggttgacctacgnanattcaatcccctcacgatgaattgagtacnatacttanaaaaggngggtaacaacntagganaaaaggccatgggtncnactangaaanngaggnttttaaaa

SEQ ID NO: 89492 - DNA, 635 bp, Triticum aestivum
  unsure (1)..(635): unsure at all n locations
  Clone ID: PAT_TA_89492
aaactctcgactccaggccgccgtttcaatcccctcccctccgctcgccctcgcctcgccgccgtgcgcgcaccgccgacagctaccggagctgtgcaggctccggagagctgcctgctccctgtgatccgccgcgggccggagtacctccgcgtcgggcggctgttccgcgggttatcatttccgtcggcgcgccggtggagtggaaccccccgtcgggggccgcgcgtcgccgaggccgccggtttcggcctccctcccctgccgcggttcaaggatataacaactgttgttgaagctgatattgctgttattgaacaatgaangatgaaatgctgtggtaaatcnnattaattgatatancnacaattgaacaaaatacaaagtttgtattgtgttcaaaattaaacaactngataagagtgttttccccaattcaaaaagacattggggnaagaacaaanggcaccaatgaagactccngtgttgagaaanaacaagattactanaagattggtanggaactcaagatggcaatcaananatgtgaggagtatggcaattataggaaaccaggatganacgttcataaggncccttcatcagaggccaggaattttagatataatttattn

SEQ ID NO: 89493 - DNA, 625 bp, Triticum aestivum
  unsure (1)..(625): unsure at all n locations
  Clone ID: PAT_TA_89493
ataacgaccactctaatgctttcgaaattttgggctaatagtgagactgtaggaatctagagcaaatatgaaaaaagaagcaaggtcacttctacagtcgtgactttcgctgagatttttgccatagcaagctttcatccaagaggaaatcaggatactcaccttgcaacatggatgcactaggtgttctccagtcaccgccatcaattacaagaacagcaccattaacaaaattacctgcctccgctgaacagatagatagtgccatcagctatctctttggacaagagccatagcgctgtagaggaccttccttgaaagttcaccacttgcctcactatccctattaccagacgtttcatgccttccgtacctgctatcgggccggtgcatcacattactcngtgagacgcgtgggccctaactctaaggcaacngggccttaggcacaataccgcctaactacactacgtagctnggagangatccaatgtatgaaaggtaccgcacaanattatacggccctgtcctgggtacgccctgttgggtncaatggaaanctntaatcggaagtccttagatatgtgggcaaagtncattcanacgncnaaggttcaaaaacttt

SEQ ID NO: 89494 - DNA, 360 bp, Triticum aestivum
  unsure (1)..(360): unsure at all n locations
  Clone ID: PAT_TA_89494
agaagagcagctaaggcacccgtaaagaggatctttggtttagcagctctcctgtaagttcgtactacctagctgaagaagctcgggggcaccggccggtcggaggaccccagcatgtcgcccgtgcacgtcccggagctcagcagcggcgggtcggggtcggggtcgctcaccctgaaccccgtgcagcgcgcgctcagccggctgtcgtcgtcgtcgggcctcacgcccagtcgcccccgccgtcctacgggagatcgtcaccgtgctcancatcnacggcggggggnntccgcgggnatantccccnggancaatctcgctttcctcnnaaanaaattcaagnagcncnattggccg

SEQ ID NO: 89495 - DNA, 607 bp, Triticum aestivum
  unsure (1)..(607): unsure at all n locations
  Clone ID: PAT_TA_89495
tccatccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactggggaagcatggtcacgcaaagtgtcacttttgttgccattgacatctttaatgggaaagaacttngaggatatcgtccttcatcccacaactgtgacttccccaatgttgaccgccaaagattatcaactgattgacataactgatgatggtaagtcaanctttctaactganaattggaacactnaggatgaccnaacttcccacggagaantccgnctgggcaattaaaacgggtttnctgatggaagactatccgtcgttantcccccagggtgaaganatttcccntnaaggaacgtgggggaataacacgtctgtnctactcaaactggaacaagctcggtgttnaaaatctagctannttgtggtaaaatt

SEQ ID NO: 89496 - DNA, 653 bp, Triticum aestivum
  unsure (1)..(653): unsure at all n locations
  Clone ID: PAT_TA_89496
ggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactgggtgagaactacaggcttctgtatgacaccaagggccgcttccgccttcactctgtcagggatgangatgctaattcaagctctgcaagtcaggtctgtccattcngccaagaagggcatcccctaactgaacacctatgatgggcgcacatccgctaccaagacctctcaatcaaaggcaatgacactatcaagctccgactggagacaacaagatgttgactcatcaattcgacttggtaactggtcatggtgacggcgggccacacggcgnttgtgtgataagacaggagaacataaggaactncagacaccacttnaggatncaaggcacaatnccaacctcnggaagtttcccatggnaggnacaaccatggtancnccaagnaaggttnancncatcttggngnaggaacgatcccgcaanttcaggctt

SEQ ID NO: 89497 - DNA, 420 bp, Triticum aestivum
  unsure (1)..(420): unsure at all n locations
  Clone ID: PAT_TA_89497
gaagttatagctgaagaaaagccatcagcttcaactgaaaagagaaaatttcaagctcaagaaactgttgcaaacactgagccaatcaaacgtcagcgtcgatgggctgcagatagtggcaatgttccagaaagacaaccgttgagtcaaagtggttctgatgctcgtaaggatattctccagtctgccttaaaacgttctcttgggcaggtctgattcaacagcaagtggagatctccaaaaagagaggatttgccaccatctcaagaaaccggcaaaacttccttgagaatccaccggtttntccccatttacctgaacntntcnagacntcttgggnaaacggttcgnttgnactcccggtggttaattcaaaccantggcagttaattccccccggnggnggacctcanatcccta

SEQ ID NO: 89498 - DNA, 378 bp, Triticum aestivum
  unsure (1)..(378): unsure at all n locations
  Clone ID: PAT_TA_89498
agtttttttttttttttttttatataattgccggtatgatccttcaagtacttcgacatctctgcgctcgttccatctttccatcggaaaaagtttcctctcagcaatgcacttcttggccccatgccctcaactacatgtgtagtcagcctaggaaagaatcaaaatcaaaatggctggtctctgtcagttaactaaggatcctctctattcggccacccctgtcatgtggaggaagtgtcatctccatccgtgttacacctgctaccaagccagcagcagcgtctctgaagaccgaaccatttccctttgagataaacctgcttcactttactcccctgcacctttttgganaaggantcccggganaagggtttg

SEQ ID NO: 89499 - DNA, 410 bp, Triticum aestivum
  unsure (1)..(410): unsure at all n locations
  Clone ID: PAT_TA_89499
gttatntggangganttatgtcacnacatncanaanctaaagcaggtgttggatttaaagctggtgttaaagattataaattgacttactacaccccanagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaagggacgatgctatcacatcgagcctgttgctgggggaagacagccaatggatccgttatgtagcttatccattagacctatttgaanagggttccgtttactaacatgtntacttccattgntagtaacgtatttggtttcnaaagccct

SEQ ID NO: 89500 - DNA, 294 bp, Triticum aestivum
  unsure (1)..(294): unsure at all n locations
  Clone ID: PAT_TA_89500
ccggttcgggttctggttcggttcgggttcngttcgagaganaggccgattatctagcctagtctagggtttcggtatagangaagtgagatccatggcggagacngagtaccgntgcttcgtnggcggnctcgccngggccaccgacgacaacaanctcnancaggccttcatnactacggngagatcctcgannctaagatcatcaacgaccgctnagacngngaggtcccgtgggttcggcttcgtcanntnccgcagcgacgagtctattcgccatncnatcgatgatat

SEQ ID NO: 89501 - DNA, 590 bp, Triticum aestivum
  unsure (1)..(590): unsure at all n locations
  Clone ID: PAT_TA_89501
ggtggtttagcctttggaagtgtcttaggacttctgtttgcccctcccatcattcagaaccttggctgggaatctgtcttttacatatttggtcttcttggaattatatggtgtctggtgtttgaatctgtacaagaactacagccaggtgacaatgaagacatattaaatcttgaaaatacttctgctggatctaatggtcatgtctcatcatccgtgccttcaaagtcatcgggctcatcacttggaagagatgacagactcactaaaggatgtgccttgggggggaatccttaaaagcaagcagtgtgggcaatgatatacaccactttgtggaagctggggcactatactgcttgtcttggcttccaacatccttaatgaaggactaaactttaactntacagacctgcaggggtgcaatcctcccctttgggctcnaggtaatacactaatgcaacacttttgnaagacaactngatncaatggattgcacncaanggtacggaaaattcaacaatgctctgtaccgcaactttagaagcttccccgtcatctgngcgcccccgggcntgtgnntcctanagggg

SEQ ID NO: 89502 - DNA, 615 bp, Triticum aestivum
  unsure (1)..(615): unsure at all n locations
  Clone ID: PAT_TA_89502
ccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccagggcggcgacttcaccaagggcaacggcaccggcggcgagtccatctacggcgagaattcgccgacgagaattcgtccacaagcacaccaacccgggatctctccatggcaacgcgggccccaacacaaacgtcccattctcatctgcacnnccctgcaattggtccacgnaacacttgcctccggcnagccgtcaaggatggactctccaagaaatcaaaagggggtcccccaacggactgtccaacaatcgnatcgcnacgnggcantcaaatctcgccgcggtgcttctctcnccgtttcgtgngcattaanaaaatcnttctgtcgtctncctgnct

SEQ ID NO: 89503 - DNA, 221 bp, Triticum aestivum
  unsure (1)..(221): unsure at all n locations
  Clone ID: PAT_TA_89503
gacgggagataagaggaggagagaagaggccgccgcggcgccgagccctcgtgtcgtcgtgcagccccgctcccacccggccacgccccccactttcccccccgtgatccgcccgtgggatctcccgcccgcccgccaggatcaagccgcggcccgagtctgccatggggatccctcgctgatcgcggcgcgtaggcaggcggganccaggnangagnatt

SEQ ID NO: 89504 - DNA, 617 bp, Triticum aestivum
  unsure (1)..(617): unsure at all n locations
  Clone ID: PAT_TA_89504
cttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcnagcctgttgctggggaagacagccaatggatctgttatgtagcttatccattagacctatttgaanagggttccgttactaacatgtttacttccattgtnggtaacgtattggttcaaagncctacngncccancgtttggnngtctaacaatcccccaacttatcaaaaanttccaaggccncctcatgggatccaagttgaaagagacagttgnacagtctggcgccttaatgggantctataancaacattggatancccanaaatatggaaactgtatgatgtcactgggngactgattcnagnagtgaactaacccacat

SEQ ID NO: 89505 - DNA, 648 bp, Triticum aestivum
  unsure (1)..(648): unsure at all n locations
  Clone ID: PAT_TA_89505
gaaagcgagtcttaatagggcgattgtcactgcttatggacccgaacctgggtgatctatccatgaccaggatgaagcttggatgaaactaagcagaggtccgaaccgactgatgttgaagaatcagcggatgagttgtggttaggggtgaaatgccactcgaacccagagctagctgggtctccccgaaatgcgttgaggcgcagcagttngactgggacatctaggggtaaaagcactgtttccggtgcgggctgcgccagcgggtaccaaatccgaggcaaactcctgaatactagattatgaccccaaaaataacangggtcaaaggtccngcaagtngagacgatgggggatnacttcatcgtccaagaaggaaacagcccggtttacaaacttaagcccctaaatgacgctccaatngatnaaggagttggggtgcaaaagacaccaagaggtttcccaaaaacaacaaccttttaaagangcgtaataccacgatntaacgcctncccnnaaatnaacgggtaacgnttgcccaactgnggattcaaatcacngtagggancttcccctaaaggaacaaccnaaaccgggtcacaaccgaacanaattcgcttatacaaannntgggatcatnccaancag

SEQ ID NO: 89506 - DNA, 557 bp, Triticum aestivum
  unsure (1)..(557): unsure at all n locations
  Clone ID: PAT_TA_89506
atagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttgggactgatggacttaccagtcttgatcgttacaaaggacgatgctatcacatccgagcctgttgctggggaagacagccaatggtctgttatgtacttatccattagacctatttnaaaagggtccgntaccnacaanttactccaatggtaggaacctattggttcaaaccctacntgctcaacgttgggaggtncacaatccccctactaatcaaaattccaangccgcctcaangtancaattnaaagaatantggacaaatangcnccttatgggagncataaacaaatgggattncccanaaatntgnaaactttagattcnctgggg

SEQ ID NO: 89507 - DNA, 625 bp, Triticum aestivum
  unsure (1)..(625): unsure at all n locations
  Clone ID: PAT_TA_89507
aggaagcacagctgcccccatctccctccccggcagacgcgccaccgacctcacctccctccccggcagatgcgccgtcgtgctccacctcctggctgggccgccgcatgcctccacctccaggcttcccgacgaccccgttcgatccagccccagttggttcaagatgtatccggcgcctccctgcagatacttcaatacatagaaatagtgccctgccatcctccctgctctgctagggcccgacgacgcgttccaccatatcctccccgcgtcgaaagcactcatcgggagctccacactgtcgggcatcccccatgtagcagagggcgcctcccttcggcagtccaaccccaacgcgtgccgctaagccaactgcatcagcaccgcggagcaatcctcccctcaacccctcctatccactgcacaacaacggcaagaacaactgtgctatttttgtagtgtgattttgtgtaaaaacacaaacacgctggagtcgcttgctgctatcaccaatacatacaaatcgtggagtctctncnnaggaactanacngacggattgtnaaggnattcacaaatcttaccaaagttatttcctntaaagaaacaatgttccccacaac

SEQ ID NO: 89508 - DNA, 637 bp, Triticum aestivum
  unsure (1)..(637): unsure at all n locations
  Clone ID: PAT_TA_89508
taaanatgaacacagtttgcaantcnatnaagttatttctttacatccaaattganttgcgaanttcaangtaaangcagtantattggagattttagtccaaactccaagccccccaacaatggaattactcnaatccacaaattaagtcacaangtataagcaaaaacaaacaagacacaaatcacaaatgtttcccctttcatccttctttctcctcatcagtggccggttggcggatactcttctagaacttcattggcctttggttgttcgactctttcgtagaaaataatgtangcctgacactccagtacctcctcgagcantacctctgtgaagctctcgtcacttgcacgaaaccacgtgggagtgcacggctcncctgctgcngnnatcaatctggcttgctcncacataagcananagtgtccgtcaacaaccntggccacgttacaatgncannaacagncatacttgtctntcatcctcagagtnanggtcatgaactactattaacntacctgaaaccancggctcaatngcggctacnggtggatagcgaacctcatnacggtataaagcntctcaangntacgntgtgaccgnaactgccctctcggtttagacgtcctgt

SEQ ID NO: 89509 - DNA, 639 bp, Triticum aestivum
  unsure (1)..(639): unsure at all n locations
  Clone ID: PAT_TA_89509
gtcgtctgtcgcccccgtgtgctagggcctagggcatcgccagcttccggcggcgattcgtgtcttcatcgtctgtcgcccccgcgtgcgggcctagggcatcgccagcgtcgggtggtgatgggtctgttcgtcggccgtcgcctgcagcctgtctatatatgcgccaatttcatgatatccctgtgtcaggcgcttcaaaattataagataattgtcttcttcgccctcctatgttcaacaccttctgcttggaaattcattgcttctctgttcttgcagaatgaagggtcgtattgaggtgatgcgttccctctgcaaggttttgggactcaaacttcgaagataagttaaaagaactgggtcaatgggaggagcttgacgagggaacatagaatggaaaacggtcgagagcagattagagcggacgatacagacctactnaggtcagaatganagatataacaactaaagatgtgggacnaggcatacaacagtggaaanaaacatcacaacacaagatctngattttaaaacctagcattanatgcngacggaaanatatcaanagtaacggannaaagtncacacataatagagtaataggattttgaaanacaactagatnaagaattncgg

SEQ ID NO: 89510 - DNA, 268 bp, Triticum aestivum
  unsure (1)..(268): unsure at all n locations
  Clone ID: PAT_TA_89510
gatccacatcncggnggtggcgtacaacatcgtgttcctcggcnanttcatgctcccggactgggacatgttccactccctccaccccgccggcgactaccacggntcggcgcgcgccatcagnggcgggcccntgtacgtcagcgacncnccggggaagcacnacttcgagctgctgaggaanatggngcngccggncggcacngtgctgcncgcgcggctgccgggncggccgacnanggactgcctgttcgcggccccngcgcgc

SEQ ID NO: 89511 - DNA, 338 bp, Triticum aestivum
  Clone ID: PAT_TA_89511
acacaggatcctatcagccgatccatactttcaccgaagctggtgagtgcaaaggacattcgaaaggccgctgtctaaacacaagttcttatttcttgatcagcatgcaagccaagagttctccaggcaccaatgcatgaacatcatcacatgtggactgaaccaactgttttcttcaatgatgacctgactgccaacagtttcagattgtccaatcatcccccatttctttctttgctactaaagacctcttgtaaccattgctctgttgggtcccactgtcacattcaatcagagaagctatatgccaaattctgtttgacaaaaaaaaggggggg

SEQ ID NO: 89512 - DNA, 351 bp, Triticum aestivum
  unsure (1)..(351): unsure at all n locations
  Clone ID: PAT_TA_89512
gccgaacggcgctagccgtgtcgagcacatggtgagatcaggagccggtctgcgccggcgacgcgcacaaggcgctcggtgccaaggtgcgaaggcggccgccgatgcctgtcgtttgctggtctacgacgacttgcgcggcgcactggccacacaatattcgcgtccaatagggcggcgccgctggccatttctttccgccggtcatcaatagagacggcggcgtcgtgggatcagtagataagcctcaaatccctttcgcttagtcttaatttcaacattttttgggcttcaaaaattggggatttggatttggagaaaaanacaaaatccaanaaaaaaaaggggggg

SEQ ID NO: 89513 - DNA, 316 bp, Triticum aestivum
  unsure (1)..(316): unsure at all n locations
  Clone ID: PAT_TA_89513
gtctntnttttttttttttttttttttcaagtanaangcccgcagtattttattttagctgancaacgaaatgcttgttgtcttgctacgtangtacgcntatacatgtgtcccgccttctaaaaactganggggtaagccggngatttgnccgggntnaacagccnaaagtgcttctcgatctcagccgggcccttcttgtcctcgtngancatggcnaacacgtacgcctccanggcactgggcctcttgggcntcccntgtccgacatgtttgatcaggtncaggntgtatngtctgcgcgttgtccntggtc

SEQ ID NO: 89514 - DNA, 566 bp, Triticum aestivum
  unsure (1)..(566): unsure at all n locations
  Clone ID: PAT_TA_89514
agcgagctccggcgcccatggtcgacatccacgagtgcgccgtggtgctcgtgcaggagcccgaccatgcggcggcggcggcggccaacccggacccgtcctcgatctccgccagcgcctggcggcccttcgaggatgccgcggccgccgtcgtgggccggatccagccgtctgtctcctccgaggaccgccgcgccgccgtcgtgcactacgtccagcgcctcatcaggtgcagcgtcggctgcgaggtgtttccatttggatctgttccactgaaaacatatcttcctgatggagatatcgacttgactgcatttggttccacaagctctgatgaaaacctagcaaatgangttcgcgctgttctggaatcagaagaactgangaaagatgctgagtttgaagtgaaggatgtccaatatatcatgctgaagtgaanctggtcaaatgccttgtgcaaaataatgttgtnacattcttcatcanattggtggatctgtacncttgttttctgaacaggtgatgaagattggaaaaacactttnaagaaaacataanncgataaa

SEQ ID NO: 89515 - DNA, 591 bp, Triticum aestivum
  unsure (1)..(591): unsure at all n locations
  Clone ID: PAT_TA_89515
aaaatcaccagtcctcttgcgattctctggaaatccttcagtcttgttttctttgcggagtggggggatcgctctatgctggctacaattgctttgggtgctgcacagtctcctttgggcgttgctagcggggccatagctggacacttgggttgcaactttgcttgcgatcatcgggggagcattcctagccaactacctatccgagaagctgggttggcctgctgggaggagtgctgtttttgttattcgccgccgccacgcttttccggcgtgttcctgatcctcctgaagntctgttgggtaacagaattctcccgacccccaatgtggtaaccatcctgaattttaaggcanttcccactcctaaattttaagttttgcaaatttaccggnagtnattangatcntgtacccttgggaaattccnagtgtaaattggacatgtttgatgacgagtagttctaagattcggatccgttcatgttggcacaaacactactaatagaacgtcaanacgtcgcctaaagctcaaanactgtccgtaaacccgtaattcaatgactgtacttgtgcatagaaaaacttctt

SEQ ID NO: 89516 - DNA, 616 bp, Triticum aestivum
  unsure (1)..(616): unsure at all n locations
  Clone ID: PAT_TA_89516
gcgcgcgcacaggacagcaggcgccgcgatctcgcgcaggagcggagatggggctcacgttcacgaagctgttcagccggctcttcgccaagaaggagatgaggatcctcatggtcggtctcgatgcggctggtaagaccaccatcctctacaagctcaagctcggagagatcgtcaccaccatccccacaatcgggtttaatgtccaaactgttagattacaagaacattatttcaccgtttgggatgtccnggggtcaagacaaatttaggccctgtnggagcactacttcaagaacaccaaggtccatttttgtccntgggacacaatgacagaagctttttgttnaagcaagaatgacttcaaccggtgctgaatgagggatgactgcnttatctttctctngtgtttgccaaacaanaattnttcccaatgccatgacctggctgaatcactgacaactnngcctgatctctgcgccaaggaactggtaatccaaganaattnctactctgggaaaggtntacgaaggctgacggttcaaaacatgcaacaaggctgaacatctcgaagggcttcatgattggtaactgtatngcnanacgccttacttaa

SEQ ID NO: 89517 - DNA, 592 bp, Triticum aestivum
  unsure (1)..(592): unsure at all n locations
  Clone ID: PAT_TA_89517
ccgaaccgaaacgcaaggcggcactccggttgttgaccccgcccccgcccctgcccccgccgtcgccgccgccgggtctcccttgtcctgctcaccgctgttcatcacgcccctcaggtggaaacagagagtgaattccaggcctacatagcagggcagtcccaccgaaccctcttcttctgcctcgtgattagagcactggcagcaaccgcatcatgaaaggtttgagggaaggcgatccgatatgcatcagtgacagcgaagaaacattcaaatggaaaccaatggattgtctctcaaagactcaggaaatcgagtcaaaaagaaagtgggagacagccgcagactcaaccgccgcttttgcagtaacaaacatgaaagccatgggaaggcggtacaacgaacacatcgcatgcatcctctggtacaaaggcatctcgaagatggctcatggatgatgtcgctcatacaacctagagaatatgaccccgacaatcaatcaatatcatacatgtaaacaaaaacaaggaaagagntatcttnnttctganaaagcacanactanttctaaantaaanaaattcaacgtaaa

SEQ ID NO: 89518 - DNA, 488 bp, Triticum aestivum
  unsure (1)..(488): unsure at all n locations
  Clone ID: PAT_TA_89518
ctgcagcgggagctgctgggccgcctgagatgcagatggaggcgcagctcctccgagctgccgggtcgctgagatgcagatggagtcggagcacctccgagctgcagcaggagctgagatggagatggagccggagcaccttcgagctgcagcaggagccgctccgctgccaagctgtaagtgtgatccaccgcgaaagatgggacccaaggtgttctcacttcataagttggggaagaggaacatgacgcatacctttgaatgggttggatgggaaccaaagaccagcancatgctaaacacgtnggcaancgctgcgcatccgtgggtggcggttnngtggaancaactattggcggttttttngccccttaacacttggnatgatggtatatccttaactttgaggttnatatgttactngaacgtatccccctggaccttttnnttccggtttaaaangttgtcccggatgcaaaaaaaaaaaa

SEQ ID NO: 89519 - DNA, 369 bp, Triticum aestivum
  unsure (1)..(369): unsure at all n locations
  Clone ID: PAT_TA_89519
cccagctcgccgcccgtcccatactgtagcaccccacctcaccattaaagaaacgagctaggccagtgggagagagaagagaggggacggagagaganagcancggagcagagcanagcatcgaggagcaggggagctagtaagctaacatgacgtcaggngcggcccgggctgntgcggtggcggaggcagangccgggctggggcngacncncacntggaaggagngngagancaacaagcggcgcgancgccggagncggtgacatcgncgccaanatcttnaccggnctctgcncgctcggnanctacaanctccccaagcactgcganaacaacgangtgntcaangagctctgcctcgangcc

SEQ ID NO: 89520 - DNA, 573 bp, Triticum aestivum
  unsure (1)..(573): unsure at all n locations
  Clone ID: PAT_TA_89520
cagctcctctcccgatgcttcctccctggcaggaggtcgtcttccggccaagttctacgcgcctcttctccgagtggtaaggtctggcctacctcgtgggcgtcgtccccggcggcgtggctggtcgccggccatcgtagagcagcgggctggcggtccccgcgcttgctccgtccggccgccgccgcgcatgtggatctgaccaaggggtcattctccggctgcctgccatgggaccagcccacggttttgggtggccccctcncngctgatcctggattcttgggcgtggtgcccctcctctcggtccgggaaatgacttttgggncatttgttctaatttgtatgattcctcttcctctggtgtggttggcaatggggggacaataccttggaaaactttaatgcgaaacnaggtggtggaaccatcnacgtctctctctgataaagcgnaagttgctctggatcaaaacgggtccggatgtggctggcgtcttccaaggtgactcgtggtcngntcaactgccttgacgtaagaacactggngatagcattgnaggaaacctctgtttt

SEQ ID NO: 89521 - DNA, 643 bp, Triticum aestivum
  unsure (1)..(643): unsure at all n locations
  Clone ID: PAT_TA_89521
tttttttttttttttttttttttttttttttttttgaataaacatagcatanatttataatatcacaagcagaagcatccaacaagctcataaaaccaatttagagcacagtggtgaagccaccaaccgttatgctacacataacaaagaaaacatacgttccaacacacctcggtgcagggtggggactagtcaactccaacccaccttgacaggtaaacatattgatcatggaaacaaaccaaggcatggttaatacacaacaagtagatcctgggctaccaaggaatcatgaacctaagtatgagaattatcatgaccagctaggtgaatgaaaggggtgtgcaatgtgagtgaacacccatggggagctaccctttcccaagtacttgcaaagccgcacggtgatttcctggagacaatcccacganangtgantcaaaagactccacaactncacaacaaagcatgacngaaacaattanaccatgaattgaacatgcttgaaatgatgctaacttgaanttcaagcttggcatgnatgngaactnnagaattatgcaccacntagacgaggactggtccaactttncgnaactaggagggnactttactnatccttaacccacaatnaaggcanaat

SEQ ID NO: 89522 - DNA, 328 bp, Triticum aestivum
  unsure (1)..(328): unsure at all n locations
  Clone ID: PAT_TA_89522
cactcccgcacgactccctcgccgcgctcgccgcnaagcacgacgcgcctctcangctgctcngcctcggctccntgccgacgctcgtcgtctcctccgccgacgcggcgcgcgccgcgttccagcacaacgaccgcgccatgtccggccgcccggcgctctacgcggccgccaggttctcctacggcctgcagaacatctccttcgcgccgccggaaggcgccttctggcgctctnnncgccgcgcttgcctgtccgagctcctcgggcgccccgccttttccccgggttccncaaggcaanggaaggcaaaggccccgcctttttt

SEQ ID NO: 89523 - DNA, 248 bp, Triticum aestivum
  unsure (1)..(248): unsure at all n locations
  Clone ID: PAT_TA_89523
gcggccagggggctcgccttcctccacagcgacaaggccaaggtcatctaccgcgacttcaagacgtcaaacgttctccttgactcgagctacaatgccaanttgtcagatttcgggctggcgaaggacggnccgaccggcgacaagagccatgtcnccacaagggtcatgggcacncatggatatgccgcgcccgattatcttncaacagggcatctgacggcgnantanttttttaaactttcggg

SEQ ID NO: 89524 - DNA, 206 bp, Triticum aestivum
  unsure (1)..(206): unsure at all n locations
  Clone ID: PAT_TA_89524
gtttttttttttttttnttnttttttttttttttttgggttttntttttttttttacaactcggncaggagactaataacagnagtctccgcgaacaaacccgaccacccccgaccanaanacanagnaagtagancacnaattanccangtctcctcgcccctacnaacccagtacaaaaattggntccttccaaaccatcaaca

SEQ ID NO: 89525 - DNA, 605 bp, Triticum aestivum
  unsure (1)..(605): unsure at all n locations
  Clone ID: PAT_TA_89525
atcagtgtccccatgatgtcatcttctcnattgtttgccaatgcaccacctganaagaaaggtgtcaagaactttgcaattgacttcctcatgggaggagtgtccgctgcantttccaagactgctgcagctccnattgancgtgttaagctgcttatccagaaccaggatgagatgatcaaggctggnaggctctctgagccatacaagggtattgggngactgctttggccgcacaatcaaggatnaaggctttggctcattgtggnaaaggaaacactgctaactcaaccgttacttccnaatcaaggctttgaacttggcatccaaggattactcaaagangatntcaacttcaanaaagacaaggatggttacnggaattgtccggtgnaacttgctttngggggtgctgctggtgctccccccctccttgggtanccctggacaanctagganaaggtggcaatgaccaaaggaccaaggtgagngannggaatnaaagcctggtnaanttacncaanaccaatcaaatggattccgggttacctgntnaaaanctntgtggaaaatncaaccngcctanttgccgnnattccaacctt

SEQ ID NO: 89526 - DNA, 369 bp, Triticum aestivum
  unsure (1)..(369): unsure at all n locations
  Clone ID: PAT_TA_89526
naccctcccctcngcccgacctcnagntcccgaccccatcgtccgtcnatggcnaccgccttcgactcgccgacntcctcgccggcggccgcgcccttcaacaangaccccttcctnagcttcgccgantcccccgcccccgccgcggccgacgtcaacntctccgggggcgccaaacaactctccttccnggcttcccccgacccctaangccttncggcaacaanccggcggcggngaacccctttgggaatgcccnattccaaagggaaacggaatgcacnannacccggaggattacggctcttaacgatcccgggccnnntttcccgaacccgnccaaaatnggggccaacaaaggcttctccc

SEQ ID NO: 89527 - DNA, 424 bp, Triticum aestivum
  unsure (1)..(424): unsure at all n locations
  Clone ID: PAT_TA_89527
gcaaaggnncgacaaaccctaaccctagtcnatanctancttancttccttcctctcnatcnacctaganccatggcgccgaccaagggcgaggggccggccatcggnatcgacctcggaaccacctactcgtgcntcggcgtntggnancacgaccgcgtcnagatcatcgccaacgacnagggcaaccgcacnacgccctcgtacntcgccttnaccgactcggancgcntnatcggcnatgccgccaagaaccaggtcgcnatgaaccccatcaacaccgtcttcaatgcnaagcgtcttattggcanaaggtttnctnatgcccntgtcaagagtgatattaaatgtggccgtacaggttatccntggccccncaaacaacctatgattgtngtgcattanagggtgnggaaancattcc

SEQ ID NO: 89528 - DNA, 397 bp, Triticum aestivum
  unsure (1)..(397): unsure at all n locations
  Clone ID: PAT_TA_89528
ggggcggaaccaaaacnccggttgcggccgcnccaaaactaaggggttccccngggntgcaggnaaagctcgagcatagcaacagcactaaagctaactagagcttcnagcannggcnacctccccggtgctcttcctcctccncgctgttttcnccgccggtgcnagcgnggcnaccttcaacatcaagaanaactgtggcttcanaatttggccggcgggnatcccggtggntgggggcttcgcnctgggctnagggnagacgtcaancatcaacgtgcccgcgggcacccaanccggnaggatntgggcccgnacggggtgccccttnaatggcggtancggnagctgccaancgggaacngcggnggcnactaccngctcctcccnggggggc

SEQ ID NO: 89529 - DNA, 235 bp, Triticum aestivum
  unsure (1)..(235): unsure at all n locations
  Clone ID: PAT_TA_89529
tgggtttccccngggttgcaggatttcggcacnaggtttcncgnccgtnaacccnatcttcnagcggncnagggantccgacgaccacctggggtgggtgtncccggccaccgccgacaaggtgcccggcgccggccccgaccccttcaacggcgccaagagcntcagggatctgtncgagatcgcgagcaccaactacaccggcaagccaactgttcccgtgctgtggaaaacc

SEQ ID NO: 89530 - DNA, 620 bp, Triticum aestivum
  unsure (1)..(620): unsure at all n locations
  Clone ID: PAT_TA_89530
ctcgtttcctcacccccgccgccgcgccgccatgctccggcttcagcgctgcgtcctcacccagctcctctcgtctcggtccgcctctcccgtctcccatctccgccgcctcatctctgccgccgcgccggtcgtctccccgaaccctagcttcgcggtggagaactacctcgtcgacacctgcggcctcaccggggcccaggcactcaaggcctccgccaagctcaaccacctcaggtccccctctaatcccgacgccgtcctcgccttcctcgccggcctcggctctcnacgctcactcgccgccctccgtcgccaaggacccaattctctgcgccggcgtggagaagacctacccccgtnctcntcgggtnacggctcngtcttcgcgtctgagattncgngctcgtctcgctcgggggcgccattccgttgcaatcaacgtctcaanctacatacnactgactcttgggtcngccgagaancttcnggcgtaagtatggtcctgctctcngtccgactnaacttgtataancaaagtgnttctggagatgngctcatctgcanatgcaacntcactgcccatgtgctacaaactgaggtncagaagntattctang

SEQ ID NO: 89531 - DNA, 606 bp, Triticum aestivum
  unsure (1)..(606): unsure at all n locations
  Clone ID: PAT_TA_89531
cccgcagctccctcctgcggagctcccctcgcgcccgcaagccgcctcgccggcgaccccacacctccgccacgccccgccgccggcgaccttccccgctaaggatctccggtcgctccgccacctcgcccctctcccttctcctccttctcgatctcctctcacctctcttcctctttctcgctggacatgacctccatggcgccgttggacctcaatctcgctggatccggccgcctccacaccaaatccgccggaaatggatcctccgtggccagatccgcccggatncgaccgggccncgccgtcatcgccaccgggagcaccgccccgctcgaacctgcagcgccacttccacgggcagccccagtctcgggtcggcatcgataatgtgggatgatgctcggcgtgtccctgtaaatgccgggtatgccgctcccgccctgttcaattnagcaagcttgaattttggtcaaacggactgtctcnatcctgcnattgtggtttgaaccaccannaaggtcncttaagangagacgcgttctgaggctgcaaaatcgtcgcgcacanaatcgcttgnaaantgtaaancggagggcanntatc

SEQ ID NO: 89532 - DNA, 487 bp, Triticum aestivum
  unsure (1)..(487): unsure at all n locations
  Clone ID: PAT_TA_89532
gaagctcatagccattcaaagcctctccatctccgaagctccaacccaacctcgaagatgtcttgctgcggaggaaactgcggctgcggcaccgcctgcaagtgcggcaacggctgcngcggctgcaacatgtaccccgaggttgaggccgccggcgccaccctcctcgtctccgccaccgccanccacaangcgagctccggcgggatggagatggcggccnagaacggctgctgcngctgcacccantgcaagtgcggcaccagctgcggntgctcctgctgcagctgctacattcatcatcgatcatgcatgcaccgtnccgtgcgttcatcatcgattcgtatcnatntactactaccatacatgtaaccgcaacctgatnnaaggcctttantnaccacctgacctgcataacatcangtgncaatccatgnttnttaaaagccncctaataaacctcccttgntnattnaacnaatctcct

SEQ ID NO: 89533 - DNA, 657 bp, Triticum aestivum
  unsure (1)..(657): unsure at all n locations
  Clone ID: PAT_TA_89533
tctacgtattaaaagggtaactacaatgtcaagtgacctttacaattattgggtagaaacatttgttgctaattgaactataatttgtccaaataactatagtaatgttgtattcaattttaactaggtcctgtaccagcaagtcgatacactgttaactgggaagcagagaaagaggtgggtaggaagaggagatcatgtctagcgctctgcatctccccgttaggcaacttggatggtagaacttatcaccaacgtcgtcctccaagtctgcatcctaatgccatttgtttagttgatanttttccatgaatgccaaccacttttggaagcaagagaatttggtacatgcagattttattggatagcaaacagactggttgtttttgctctcaacatatgtgcctcctctcaactccgtgcccaatccggacgaacggggacgacccgcggccggttaaacggaggcngcggaaaggtanggtgaagngctgtcctcccccgcnccgggattnacggctcccggagctcctggagngccnccgggacacncngggaatccncgccggtgcngcncttcccaaccggacaaantcgccncatgggccngccaacaggataccccaatcccccntccacggaaaccccaaacccatn

SEQ ID NO: 89534 - DNA, 308 bp, Triticum aestivum
  unsure (1)..(308): unsure at all n locations
  Clone ID: PAT_TA_89534
nggncaaggnctncaaagggngtcaantcacccttgccatanggaacatatgaggagcagcagcagcacagggagcaacnccttacagtancagaggcantcgccgacagcagcagcagatgcantcgccgacagcagcagcagatgcantcgccaacagcaacaactggtccgcgcggactcgattcgggcggactgcagcggcagaagtaggtggcgggcnaaggcagcggnaggcggcaacggnagttggcggacggacggnagcggnacaacagattnccgcnaccgggaaaaccccctggctc

SEQ ID NO: 89535 - DNA, 244 bp, Triticum aestivum
  unsure (1)..(244): unsure at all n locations
  Clone ID: PAT_TA_89535
tttttttttttttttttttttttttttttttttttttttttttttttttttntgaccanaaaccganattgtcnattcaagngtacccanantcaanaccanacaccanataaattacgtagacatnantaaccacaatcacatcncatttgctttgactaaancagattttctctgacnaaatgcatcnaaggtcccatnngtaatagttcgtggnaccatgatgttcctttcttttnccttt

SEQ ID NO: 89536 - DNA, 630 bp, Triticum aestivum
  unsure (1)..(630): unsure at all n locations
  Clone ID: PAT_TA_89536
ccgtggtggcatgcagatatttgtgaagaccctcaccggcaagaccatcaccctggaggtggagtcatctgacaccatcgacaacgtcaaggcgaagatccaggacaaggagggcattcccccggaccagcagcgtcttatctttgctggcaaacagctcgaggatggccgcacccttgcggactacaacatccagaaagagtccaccctccacttggtgctcaggctccgtggtggtatgcagatttttgtcaagaccctgaccggcaagaccatcaccctggaggtcgagtcgtctgacaccattgacaatgtgaaggccaagatccaggacaaggagggcattcccccggaccaacagcgtctcatcttcgctggcaagcagcttgaggatggccgcaccttgccggattacaacatccanaaggagtccacctcaccttgtcctccgccttctggagcatcaaatctttgtcaagacctcactggaagatatcactttggagtggatcatctgacacatcncaacntaaggcaagatnaagacaagnaggatccccggcanannctcatcttgtggaacacttagatgcnccttganatnaatcaaagntcacctcattgggnntn

SEQ ID NO: 89537 - DNA, 613 bp, Triticum aestivum
  unsure (1)..(613): unsure at all n locations
  Clone ID: PAT_TA_89537
cgagttttttttttttttttttagctgagtgtaatcaattgcctcatcccctcaagggtagggttgctctccatctgagaaccaattgatctagaaactctttcccacatctttatgccctcagccgacctataggttggcaaaaggctggcgatgctaacaatggccaacggcaacccaccacattttttcaaaattgtgtccatggttcctttaatttctaaggggcaagtaccattctctacggaaccaaacactcttttcacaaacaatttcttagaggcttctggttctaggggcttcatatgatggacaaagtactccgaggcactagccaccttgggccaccgcctctatccgagtagtcacaatgattctactgtggctatttttttctggcaattcaatgcggatagctccatgctggtatgctcatacatcatcgacacaatgagaaactctccgattgaggagccatgantccttgacagtgtcanatcaccggcaattgaattcttgcaaggattattgaccccgnacccntgggccggtttcnaaacggtgttaccttnaacacgtcctgatnaggttattgtccaggcaccttcagcgg

SEQ ID NO: 89538 - DNA, 597 bp, Triticum aestivum
  unsure (1)..(597): unsure at all n locations
  Clone ID: PAT_TA_89538
gctaaatgaagtaaatccttatattaatacaacacttttggtctgttagctatagtcagttaaagaactccccagatttttggttcatagtttctcaccctttatcaaaatctgagacggttggcaaataatgattgtcatgtcatctaattccgtattgaaacagcattctctgtttcaactaaatgttgcgaaacgggtctgggttgttggtacaatcatacttttttcattagctggctgaacaatttgtgaccacaaatttatctttcagcttgagtttgccctgggaatgttaagggactcacaaatcttanagtgccagtantatcaattgtcatgcacaacanaaccttttttttcataatcccctcagtaatatttaatggtgggtatgtgcttctccaatctactccacagtatcagcaatctcgcaatcgggcagacanagcagcggttgcctcaatttanaggtttnaaactgtatancatccctanccgngtaattccgcttgtnaangaaggngtcaaactcctgatnccgacattattccattgnggctccangtcttnnaccggntttgnaaccaaanatgc

SEQ ID NO: 89539 - DNA, 173 bp, Triticum aestivum
  unsure (1)..(173): unsure at all n locations
  Clone ID: PAT_TA_89539
cgcccccttccccaaaaacctttcgaaaaccgccgcgccanncgccaccnagccccgtccaanaaaccgcangncacgggggatcnancccccgccggngccaanatggtgcggctaancaanacggtgatcgggatcctgaacgcggtgaccttcctgctctcggtgcccat

SEQ ID NO: 89540 - DNA, 628 bp, Triticum aestivum
  unsure (1)..(628): unsure at all n locations
  Clone ID: PAT_TA_89540
gcagtggtaaatcaactctcatacaggcccttttccgtatcatggatcccactgtcggccagataacagtagacggcgtcgacatttgcaccatcgggttgcatgatctgagatctagattgagcatcattccgcaagacccaacgatgttcgacggaaccgtgagacacaaccttgaccctctaggagagtacactgacaatcaaatctgggaggccttggatcactgtcagctaggagatgaagttcggagaaaggagctcaaacttgactcgccagtggtggagaacggagagaactggagcgtcggccagcgtcagctcgtctgtctcggcagggtgatcttgagacggaccaagatactgggtcctggacgaagccaccgcttcggtggacaccgcaacagataacctgatcagaagacactgcagcagcatttctcgggggcgaccgtcatcacaatcgcgcatcgaatcactcgtcctcacagtgatatatcctgcttcttgacatggatggtgtggacacaaacgcagcaagttgctggagacaatcccncgttccaaactgtacggataacatagtcacccattagcccattcaggtgtaacaatacnnatgattcatt

SEQ ID NO: 89541 - DNA, 632 bp, Triticum aestivum
  unsure (1)..(632): unsure at all n locations
  Clone ID: PAT_TA_89541
gaacaattgactaccacgattaccccaccagtcattcgatcaccagaaaagaaaccagccacgtgggatcagcctcccacagcagcagaccaatctaatttcttcaccaatttgcagccaattgttagtcaaacctcttctgtttcagtcagttttagcgcaccaaagcagaaccctgctactgcgcttgacactatattgtcggggaatagttcgtctattgattctgtccagctaacacaagcaacacgcccacttaggaggttgcacatcgagaatataactggttcagcttcagaggatatgttgcttggttgcttgaatgactcttgctgtcatcgggtgttaaccgtatccagaggtctaaacaaccatgcctcagttgcacgataaataaggaaaaacccaagcatttgttgaatttcntacacaagaggatgcaacagcagtcttcttcgatggaaatcttcaaanggtcacccgagaatancccccaaagaatatttgaaatgnaatttgccaaaagaaccntggaagaangataacgacactgagtgtgcantcacncacaagattcatgcggaatcngggtcttncnaatcctgaatgtntnttgcattacgnncactgtt

SEQ ID NO: 89542 - DNA, 216 bp, Triticum aestivum
  unsure (1)..(216): unsure at all n locations
  Clone ID: PAT_TA_89542
tttttttttttttttttttttttttttccccaagngtttcagntacancttgattgatcantntggggncatcatcatcatagtcntgctgcaggatacatatccatcctgccaatacananacttggtaggcagtactcatcccngccaacanatcgtctaactaattcatctcaccanaaacccaanatccaancangaangacnccncatcac

SEQ ID NO: 89543 - DNA, 591 bp, Triticum aestivum
  unsure (1)..(591): unsure at all n locations
  Clone ID: PAT_TA_89543
aaaaaaagaggacgccaagatgcggtagtacaaggaaaggcgaggcttcttgctcacttctctcttgccctctgcatgccgatagccgctaagctcttctactaccagcgccgccgcccgccgccgccaccgcttccggagcccaccgagccccgcagcgccgactcctccgccgcccgccgccgggttcaccccattcgctccgcgcaccacaggccgggctacgaattcttcnaggaagccagagagagcgaggggcgtctaacgggaagcataaccgagccaacaaggaactgctcttcagcacaagacaaactgcaaccatcaaatgacgantccctgatccgttcaacangcaaggaaagntcatcaaaggtccnattgtaactgtttcaaggaaaaggtacacacaaccntngacattgggtggactattccttcggaattgatacggacataaaggaggaaacggcgacgattcnctaatcaaactccttanacaaaattacagtaacanaactaacatcgngtgtgccaatatnagcttccaatngaaagatntaaggggttcgtccaangtttcaacctagn

SEQ ID NO: 89544 - DNA, 368 bp, Triticum aestivum
  unsure (1)..(368): unsure at all n locations
  Clone ID: PAT_TA_89544
gctagggacacctgcanangcgcatacatacacnaggnagagaaggagaaaaggttcactcacgggnggaggaggaagaagatnatagggggagagatagatcgatgggggacgacnatggcgcnaagctggtgaagagcctgcggggcgcggcgcanaagtacgtcngcgtcggcttcttcctcggcttcnncatcgtcctcntcacctacttcaccctctccgnttntttcttnatntccgacgcctaaagctatcngaaangacctcancggngcacccgacgccgaacgccccggccgtgggcagngnanacgtgcaagcagcagcagcanctccccgtcananacggangaancacctctgcc

SEQ ID NO: 89545 - DNA, 234 bp, Triticum aestivum
  unsure (1)..(234): unsure at all n locations
  Clone ID: PAT_TA_89545
ctcgggtacaaggtgcgggcgtccgacatggcggacgtggcgcagaagctggagtagctggagatggccatggggatgggcggcgttgggcgccggcgccgcncccgacgacagcttcgccacccacctcgccacggacaccgtgcactacaaccccaccgacctctcctcctgggtcganagcatgttgtcngagctcaanncgcccnccancccnctttttttttttttttt

SEQ ID NO: 89546 - DNA, 184 bp, Triticum aestivum
  unsure (1)..(184): unsure at all n locations
  Clone ID: PAT_TA_89546
gttttttttttttttttttttttttttttttttttttttttgcggtggcaaagatgtttcncatggnttacccaaatacatagncnacagattgtacttagaatattatgtgcatgtgcatanacatanccatcggtagcattcacataccagcangcnttcncgagtcangtctggaccatgg

SEQ ID NO: 89547 - DNA, 675 bp, Triticum aestivum
  unsure (1)..(675): unsure at all n locations
  Clone ID: PAT_TA_89547
gacaacacgcgagaagaaaggagaggacgatggtgaaggaagaggaaggagctgctgtcgtcggcgccatggcggacgggggaggcggaggaggacgacgaggcgtccaggatgagccgcgaggggaaggtcaccgtcaccagcaaccccggggagacgcccaccatgaacatgccacgcagcaagcgcccggacctccacctcgccgtcgacgacttccaaggaggacgagatntacccccgagcttgcgctactcccttnccaagcgcaacagcanntccctgcggagattttcacggtgggacacactttgtcaagctcttcctcctgttatggcatacagtttctcccccttaacgttaanttttccttccaagattttcaccatttctgggattnaagaaggatttccaatcacagaattccttnggactgggaaaccaggatactccccgcgtttccctgattaccgactnccatggacattnctgcncaagtctggagacttttatatcctaatacggtgtggccggtaattccagactngttaagcttaaaggnggtgtggccgtcaattnaattcatnatttcanataaaatggtgnttaancaatnttttccaaatcttgttcccaatttaaaaaantnngttgcaatccaattttaaagggccn

SEQ ID NO: 89548 - DNA, 157 bp, Triticum aestivum
  unsure (1)..(157): unsure at all n locations
  Clone ID: PAT_TA_89548
gaccggacccggccgagccanatggcnagcttcggngtcaanacgcgccccgccgcggccggggnagggggcgntctcnttcttctcccgnaancctgcgggaggacntgcgcctcatccgcgcgcgggcngggganctcnaaancttcnttattgt

SEQ ID NO: 89549 - DNA, 266 bp, Triticum aestivum
  unsure (1)..(266): unsure at all n locations
  Clone ID: PAT_TA_89549
ttggcttctcctccccactcagtcctcggttcccggtccggtcccgttccgttcgttagggtttagtagtagcggggaagaggaaggaatggcggacgtcgagtaccgctgcttcgtcggcggcctcgcctgggccatcgatcgancagtccctccagaacgccttctccangtacggcgacgtcatcnactccaagatcatcaatgacaggganacgggccnntaccgcgggttcgggttcntcacnttcnctcggacgangcga

SEQ ID NO: 89550 - DNA, 573 bp, Triticum aestivum
  unsure (1)..(573): unsure at all n locations
  Clone ID: PAT_TA_89550
gccgccgtgcgtggccatcctaattcctagactagacgactcccggcgatgtactcctgcagcgagcgagaccgctcggccgcggcggcgcgtatcatggagtccagcgccaagtaccagccatgcaacacggcggcgacgcggacggccgccggccaggtcccctcggacgcgcagcggcagcagcagcagccgtcgccgcggcgcgccaggaggaagcacccggcgtcggcgtcncgccggtcgtccaccaccgttggtggcgaccgacgtgtccaatttccgcgccatggtgcangantcaaccggtttccgccggccgcatcttccgggccgctgccgcgccgggcccaagcggcaacaaccgccggancntccgggcnttgtgcaaccctggcgacccccgaattcncccccccggggtttttnacgggngcccactcggnccccggtttnaactccccnattgactncnaagaaaaacatcctggcgtaatnttanacaagngatggaattcccccgccatttanttgcttggaatctttnaaanatctttttncaacattttacag

SEQ ID NO: 89551 - DNA, 357 bp, Triticum aestivum
  unsure (1)..(357): unsure at all n locations
  Clone ID: PAT_TA_89551
agagaactagccccgagttttttttttttttttttttttaancagatatccagttacngccaangtaattccngctcagatcttaaaacaggacaaagaaaatgataaacattcaatcaaatgatgaagaaggcagcaaaatatgtgttcgcaaccaaaaaacatgaggganaccgcnatnanaggacacanggacttnccngtgatgacnacaacgccattgatgtaacctttgctccctttnacaatcacattttcctccatttncnatcaattttnggctacaaattgttncaagaccacatggggtaacatccactaattatancatattaatnacaaaaccatgccaaaata

SEQ ID NO: 89552 - DNA, 556 bp, Triticum aestivum
  unsure (1)..(556): unsure at all n locations
  Clone ID: PAT_TA_89552
gaaacaactatttttctctgccccgacgtagaaactcaaccatatcatatggtactccctccatagacgttttggtnaggccaagcgagggctttgccaaacgaaatccgcaagtgggccaagtttattccataccaagtnaaccctcancaaactaaaaaggccatgctaaatgaagcttgtcggttagccttatncaagaataatataaataccctctaaactaaggagatgaaatgtatatggccgctgcgccgcccaacatgtcgcgctgattttgatgagctgacgaaagaacataatccccaacgaagagcatgccagcttttnagtatggcaacggggtggctgctgcaattctgccgctccaaaagagaaaaggaaacaagcgttgctgcgattacnattcnacnatttaaccctttgcgcccccgctttntgcaaaacngccaanagctttcanaacttaccttgcttnaacctcttccgatcctgatnaanaaacaatacgcttcgtttcggcgcgcnctttggcccaaaattnaaggtaactgaa

SEQ ID NO: 89553 - DNA, 658 bp, Triticum aestivum
  unsure (1)..(658): unsure at all n locations
  Clone ID: PAT_TA_89553
agattctggcgtttagtgcatccgcactgaactgattgctggatttggtagggggtgatatcatttcgttcatgggtgaacctgaacactgatgtagcttcccagattcctctacgctccagtcattcaaatattttgtgatgccttagttctatcttcaggaataaattagcatcaacacggtgatttggagaatgcaaacaagcacaataggatcttccatgtcaattgggtatggattgggtgatgtttttggacgcccataagaccattacctccctgcatgtgtatttggtgtgccantttaccattaatggantggataatgtcccntatgaatgtttccacctttaacaagtgatncagnaacaggactccttacttttnggttgaangcaattcttgctaaagattnaccagggancattaagtatcctnanccccatgctccataatatcctaattatgcatataattattcctaacncctccaaggnccncgtttcccaatttccanngaccatagtncanatccanacnattccaaagnantgtanaacactctgattgcactacaccaatattcaaccncattgaanaccagctcaatttaacagttctatttctgctacttccgnattcccaccnacatngattc

SEQ ID NO: 89554 - DNA, 623 bp, Triticum aestivum
  unsure (1)..(623): unsure at all n locations
  Clone ID: PAT_TA_89554
actgataattcttgtgaagtgatggaaggacctagtgagacatattgtggggaagcagatgtttctgacaaggaggcacagacggagcagtttggattttatttaacaaatgaacgggatgatgttcagcgcacaaaaatagaaatgaatgatcttgatttacttgaggcaaaaccaaaccggctacatgtaagtgtcaattggcaacatagtgcttcaaaaacaatatgatgtctcaatgcttaacaatctaccccgagatacacaagctggaggtttattcccaaaaggaaccgaaattccnttcactacatgtttgtccaagagcctttcctaaaagaggagcattgggggccaaaggacatttgtactgccctttgctgcaaaagcatcaacaagcgatgaagaattaattccctggagctactgaattccnggcatccacctgaaaatttccanataccaatncncaagaataacncnaaattgtnatccccataangattggactgcacattatacaccgagaagacacatcaacattacctgngcatacacacatggattgagngctnccacactcacagagaggangcaatttntagttancaaatngcataaca

SEQ ID NO: 89555 - DNA, 642 bp, Triticum aestivum
  unsure (1)..(642): unsure at all n locations
  Clone ID: PAT_TA_89555
gttacttggtagtagtacatcggtgagttctctgaagcacctccacccgccgccggtgagtaaactgctgccttgtttgttttacgttgttgacacgaagcttggagcaggcgccgctgagattgatgacggcttatgctatgaagaaatccctcctcttgctgctgctcctgaactcctgctcaccgtcgtgctccggcaccggcaccggctccagctccgacgacgagcccgacgtccgctgcctcaagacttcctgcgctctgtgggtgatccccggcggcgaactgacatcctccgtgggatttccgacaacgccacaaagggctacatctgcggntcaaccggcgtgactnctggnccgcccgacaagaaangtcctgtctccncgcctccaagccctttccccggggcctgcggactgcccaacataacggcggnccctcaactgtccacaaatttccccgacggtcccggnggaactcgctgcaatcccgttcanaactccttaactcncctanaangntctgggnccnttccccggcanggaagatggttcccnaaaccttactgggaaacanccacggaaatccttgnnctttagntctacgatcanattccgaaccttcggcaaccttttnn

SEQ ID NO: 89556 - DNA, 626 bp, Triticum aestivum
  unsure (1)..(626): unsure at all n locations
  Clone ID: PAT_TA_89556
agttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttgggactgatggacttaccatcttgatcgttacaaaggacgatgctatcacatcnagcctgttgctgggggaaagacagccaatgggtctgttatgtagcttatccattaaacctatttngaaagggtcccttactaacattttactcccatgtaagtaacttatttngttcnaaccctactgctcnactttgggaggtntacatccccctacttatccaaacttccaaggcccccaangtaccaatttaaaagaaattgacataggcctccttaatgggattacattaacaaatgggattacccaaaataggaaactgtagatgncactgnggctgttacaagtgtaaactaccnacatttcccngnaactttgntttgcacntttaacagcaacggat

SEQ ID NO: 89557 - DNA, 648 bp, Triticum aestivum
  unsure (1)..(648): unsure at all n locations
  Clone ID: PAT_TA_89557
gggtgctgcaacgagctcaacgccgcctacgccgccgacggctacgcccgcgcgcgcgacggcggggtcggcgcctgcgcggtcaccttcaccgtcggcgggctcagcgccatcaacgccgtcgccggcgccttcagcgagaacctccccgtcatctgcatcgtcgggggccccaacagcaacgactacggcagcaaccggatcctccaccacaccatccggcatccccgatttcacgcaaggaactccgctgcttccaagaactcacctgttatcaagctgtnggtgaacaactttngaggatgcacatggaacagattgacactgccattccaactggcactgaaggaaacaacctgtttacatcaacatcaactgcaactcccatcgatcccgcatcctactttaaccgcacctgtcctttcttctctcccccaaaatgttaaacaaatgacttgggacaacaatggaacgctgngttttctgaanaacaanaaaccnntcttttgggggcaaaatanggnggcaaacancaagctctaaactggtgatcangcgtttcngtgaacatcctntgaangggttcaaaaacatccnattatgannacgggggngnanccccttcngcgaatgtggnacnaccnattt

SEQ ID NO: 89558 - DNA, 630 bp, Triticum aestivum
  unsure (1)..(630): unsure at all n locations
  Clone ID: PAT_TA_89558
accagttcccctccccatccatccgaacgcccgcacgccccagcacctctcaccatgactcaggaagacgcgcatgcgcccgtgaacttctggggcgagcacccggcgatggaggcggagtactacgcagcctccggcgcggagggcgatcctcctacttcaccacgcccggacgacgcgggcgcgcgccgctcttcacgccgtcctggcgccccggttgctgggtgggggcgttnagcgcgcggcccgagggcgtccgtattcatgggccaatgggtaacggaaacacatttactggactttccaagcacggcgtcttcctngccgctccngttncnctgtttngcgccgactcccccggcaacgccgtcccaacggctgcaagcttctcccgattttaagtcccgtttccactcctccttcttcggtcctttcggnggnccaaganacccggtgcnttncctnttcgggancaanngcgggcactctgcgtcnactcggaacnccgagatggcggggcttctgtggnccattcaggttcgntgntcgccctgccgttcggntttactcgtncgtcgccattcatctgcagggactanaaatcntaggcccaagcctntccccaacatn

SEQ ID NO: 89559 - DNA, 498 bp, Triticum aestivum
  unsure (1)..(498): unsure at all n locations
  Clone ID: PAT_TA_89559
ctgaagtaaggaagctgacacataaagttggacaaaccgagggagaaaagaaagaaaaagaagatcaaatttctcgctgcgaagcttacattgatggaatggagtcaaaattgcaagtttgccagcaatatattcgtactctgggaaacatcacttcaagaagagatggctcggcatgccccactgtatgggtgtcggcgtggaagctttgtcactgggaggagctttgagaccctttgcaaacatccaacgagcagatctgagacagttccatacaatcaagggaaaggaaaggcaacaccatctccttgagcgtcccctggcttgttcccctcctccttccatggtgtttggncgccttcctcattgattcacactcctcccatacactaatggcgnggntacccaatggaaacgggacattaacaatgcggtgggccctggtnaatcnaactaaccacaaatcaactgcaancggagcccaanatccatttggtg

SEQ ID NO: 89560 - DNA, 583 bp, Triticum aestivum
  unsure (1)..(583): unsure at all n locations
  Clone ID: PAT_TA_89560
accgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgaagccccgaaatgtggcgctgcgcggatatgaaatccaacgtcgacgnaacctgcggtgggacctgcaagaagtactgatcggttcatgccggcatgatatgttccgcctaaaataaataaaactcaaggcgaagataacagcgtcatcttcctatcctgtgtgtgtggcaacatgctatacagtatgtctctctcgtcgcgtgtttcncncccaaaaaantgggtgctgtgttaactaccggaaatcncgttaataacacttatgatgtcntgtgcaananatagtcctgtcaaccattaaagggggccggaccaatccccaaatgatctttacccc

SEQ ID NO: 89561 - DNA, 586 bp, Triticum aestivum
  unsure (1)..(586): unsure at all n locations
  Clone ID: PAT_TA_89561
tctgcagctacagctcctcttcgacacacgtcttttttcaggacacacatcaattccatatacacatacacctgcccacttctagctagcttgctttcagaatccagatacacatacaccagccggcgtccagctagctcacttgcgagctgtagtacgtcgctgcatattccaatggagtgcgagaatgggcaagtcgccgccaacggcgatggcttgtgcgtggcgcagccggcgcgggccgacccactgaactgggggaaggcagcggaggagctctcagggagccatttcgatgcggtgaagcggatggtagaagagtaccgtaagccggtggtgaccatggagggtgccagcctgaccatcgcgatggtcgccgccgtggctgccggcagcgacacaaggtcgagctcgacaatccgcccgcgggcgcgtcaaggagagcancgactgggtcatgaacancatgatgaacggaacgacagttacgtgtcacaacggcttcgggcaactctcacggaggacaaaggagggcgngctctcaaaggagtcatcgatccttaagcngacctnggacggacgacgg

SEQ ID NO: 89562 - DNA, 428 bp, Triticum aestivum
  Clone ID: PAT_TA_89562
tttttttttttttttagcagcccaatcacatacgtccatatatgaaggacttgatcattgtacagtcgatttcttgttcatttcgtactactattcaaagcccgcaaggatgaaggagaggaggcatcgtttctttgtctgcatgccgtcgggagcttcgaagcaaccgcgcctgcaccggagctttctccacaaactgaatcagtgggcacgcgcgctgttccatcctttgcccgcatacaatacaagagctatctccttccggaattgggtcccggccgggctagccatcgacgacggcgacgccgtggtggagtgagtcgtctctcgtgagcacgtccgtggcccagcagcttgcctccccaaggtggggcatcctgcagctcgcaagtcggcatcggcggctccactcacgagaaggggggggg

SEQ ID NO: 89563 - DNA, 416 bp, Triticum aestivum
  unsure (1)..(416): unsure at all n locations
  Clone ID: PAT_TA_89563
gatgtttctaggacaagcagtttatggcccaattattaattgtattttcttctcgtataatgcaggattacaaggtgagacaatcccagagatcattgcaagattaaagcgggatataattccgaccatcaaaagtgggctcatttattggcctctttgtgacttcatcactttcaagtttatccctgttcatttacagccgctagtaagcaattcctttgcgtttctttggaccatctacctaacatacatggccggcttaaagaaaccaagcgtggaggtgatcacgaactcttaatcataatcaaatgactgagttccgccagttatcctgaaaggaatcctcangggaattactaggaactatgacgggggcgtcantatcaccactacncaattaagctttaaaggtttaa

SEQ ID NO: 89564 - DNA, 482 bp, Triticum aestivum
  unsure (1)..(482): unsure at all n locations
  Clone ID: PAT_TA_89564
aaactccattcccctcccctgttttctttactcccctcccctgcttcctccccacttccactcctcgtttggatctccgggtccgagatcgaatcccaggaattcccgatcctcatagccccgccatgcgctcccgacaaccccagcgcgctcccctcccagctccctgatcccatccgcctcccaagcccgccggcgttgacgccaattggcgccggacggacggcatggactccggcgccaacagcgtcggctccgtcgggngaagtcgccaccgccgccgctctcaccgcccggccgcccggcccgccaagggccgcggccttcggccggtggngccgtancccccggcggggaacaangaacgannaagggcgggctcccccgcnggncccgttgntgcctcaagtcgccncggccggcngggncctgctaacgcttgangtggacttggcggnanctccaatnacgacgctccccgt

SEQ ID NO: 89565 - DNA, 589 bp, Triticum aestivum
  unsure (1)..(589): unsure at all n locations
  Clone ID: PAT_TA_89565
ggcatgcagatcttcgtcaagaccctgaccggcaagaccatcaccctggaggttgagtcctctgacaccatcgacaacgtcaaggccaagatccaggacaaggagggcattcccccggaccagcagcgtctcatttttgctggcaagcagctcgaggatggccgcacgctcgctgactacaacatccagaaggaatccacactccacctggtgctcaggctccgtggtggcatgcagatcttcgtcaagaccctgaccggcaagaccatcaccctggaggtcgagtcctctgacaccatcgacaacgtcaaggccaagattcaagacaaggagggcatcccaacggaccaacagcgtctcatcnttgctggcaagcagctngaggatggcccacttggcggactacaacatccagaaggatccacactnaattggnctccgtctgcccgtggcaataactcctggcatggtttgcttccgtcccnggtnaaaatcnntttccncgggtcncaatggatccggccgttccttnatctaatncttgttgaacaaancgtatcatgtaccttgtacncacttcgcggggggg

SEQ ID NO: 89566 - DNA, 624 bp, Triticum aestivum
  unsure (1)..(624): unsure at all n locations
  Clone ID: PAT_TA_89566
ttttttttttttttttttttttttttttggatgcaaaccagtgacccactgacagagacatttattcacataccactcaccaagcaaccaaaaacaggcatggaaattctcaagcaagcatgtcaagtgggatagcagtgaggcaacacagcactcaaccaagcaccccactgcttttccttccccaaacggaaccacaagcaaagcagagatgcaacggcccccaaaagaagcaacaccttttgccagctttgcccttgcccggtcagcttcgcaccatctatcatctatctatcatccatctagtggagtggagcacccaaaaacggaggcctcaagatacnaaaccaaagcaaagcaagatttctgttgnnatatnatcttaataagacgcgaaaacanntccaatctanaacccacttttaaccnctcacccaagaactcganacaaacacatantacttattccncaaacaccaaataccgncggacaacaaagcgacanaacggcacaggcaccncnctggtatggggcctgcganacaccttgtcttgcaaagntcctttccctctcggnatccgatatacactataggnggntcttaactaacaacngaatagnng

SEQ ID NO: 89567 - DNA, 511 bp, Triticum aestivum
  unsure (1)..(511): unsure at all n locations
  Clone ID: PAT_TA_89567
gcacaataaacaagaggtacaactcgcttcatcgtggcctgtgtttgttgtcaagatcaatagccctcgacctgttaattctcattgtcatgatctatgaactcgaacatttgctagtttgctatttgctctacgcataatccaccttccagctttccacgatatcacgcgtgcagcacttttagttgtagttgttccacaatcaactgctaatagattattgcagttattgtacttagttacttatgacatgccatctttttttttctctgtctcaaaaatatgttgtagcataagtgcataacttgtcctacctcaatttgcangatcggggccggnccttcggatctccgtanctttgatatcnacaaccatttaaccgtgtnaacttgggaaggntcnagaaccntcctgggananaangtggatgcncctnttaaanacaaacgcgananattggacaanatcacattgngcncncaaanctggccagggttagggggcttggcac

SEQ ID NO: 89568 - DNA, 563 bp, Triticum aestivum
  unsure (1)..(563): unsure at all n locations
  Clone ID: PAT_TA_89568
ccgctactcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaacctctctgccaagcttgaaggggatgacctagatgttttcaagaagaatgttgagtctgccacaaagtatcntcctagcaagctcaaggaccttcanttcnttgttggcaaaacatcatgatatngcggcgtggtgttncctactacaaggagggactgcnatcaacttccgtacttcanatggctgaaagaggca

SEQ ID NO: 89569 - DNA, 357 bp, Triticum aestivum
  unsure (1)..(357): unsure at all n locations
  Clone ID: PAT_TA_89569
ggctcctgctgcgaccatccgaggtgccgcccgcgcgctgctcgtcgtggcggtgctggtgctggccgcgcggggcgcgagcgcggngctctcgtgctccacggtgtanaacacgcngatgccgtgcctcgggtacgtgcantcaggcngggtngttccgctgntcnttctgcggggggatcaagaagctggtgtccacngngcgctccacccntcgancgncgcagcatctgnanctgcctcaanaacgtccgtccngcgncgcgggcgggccntacgtcanccgtttcncngngctgccgggaatantgcanangtccccgntggcccttttaactgcaactcnaattgatgccg

SEQ ID NO: 89570 - DNA, 564 bp, Triticum aestivum
  unsure (1)..(564): unsure at all n locations
  Clone ID: PAT_TA_89570
gtgaagactctcaccggcaagaccatcacccttgaggtcgagtcgtctgacacgatcaacaatgtcaaggccaagatccaggacaaggagggaatccctccggaccagcagcgcctcatctttgctggcaagcagctagaggatggccgcaccctggctgactacaacatccagaaggagtccaccctccacctggtgctccgcctccgcggaggcatgcagatctttgtcaagaccctcaccggcaagaccatcaccttggaggtggagtcctcggacaccatcgacaatgtgaaggcgaagattcaggacaaggagggcattcccccggaccagcagcgtctgatttttgccggcaagcagctcgaggatggccgcacactgggctgactacaacatccagaaggagtccaacctccaactgggtgctcaagctccgtggaggcatgcagatcttcgtcaagacctgacggcaagacatcaccttggaggtggatcctcggacacatcgacaatgtgaagnaaagatcaagataagagggatcccccggacaacaacgctaa

SEQ ID NO: 89571 - DNA, 543 bp, Triticum aestivum
  unsure (1)..(543): unsure at all n locations
  Clone ID: PAT_TA_89571
ccttgattaatttccaagcaaagaaagaaataattccacattttctaacctccttcaagcatcagatcaactatctgtttcatcatccttccttgattgatttccaagcaaagaaaggaagaattccaaactttcattttgtgtagtaataaataaaaaaatgaattctggtacagaactctggctggcgtttgtactgtcccaacagagtgctacttcgcgctcaagtcgtggaacgcgcagcaggcgggggcggcggcggtgctgatcacggacacggtggacgagcagctgctgaccatggacacccccgaggcctccccggacagtcggtacctggacaagctcaacatcccgtcggcgctggtgaaccgcgccttcggggagtcgctgaagcggatggcggagaaggcgacgacaaggggaagtacttgtggtgaaactggactggcgcantcgatccgcaaccggacnacncctggagtacaactctggacaacacaacaacaatgcggccctgtcnataacagncgctctccggac

SEQ ID NO: 89572 - DNA, 486 bp, Triticum aestivum
  unsure (1)..(486): unsure at all n locations
  Clone ID: PAT_TA_89572
cggagcagcagccaaagcccgaggcgagcaaagaaagagttcagagaggaagtgagctagcctagctaggtgattccttcactggcctccaaacaaattcatcacctcgtcggcgccatggacgccttggagagaggcgagcgcgcgccgctcctgcctaagagtcacggcccaaaggttcaagaggatgatagcctgcagctgcaggtgccgctcctcaagcacaagaagcgcggcggcagcaaggcacccgcagtgattctattgttcgaatgcctggagagcacggggttcaatggcatctccaccaacctggtgatgtatctggagaacgtcctccacggnaacaacctcgccaagcgcctccaacgtcgcaactggttcggaacaagtactcaaccccgtcttcgggcatatcgccgatccntctgggnaantacaanacatctcgtctcctcgnggcaacttctcggatgangcncgcnc

SEQ ID NO: 89573 - DNA, 489 bp, Triticum aestivum
  unsure (1)..(489): unsure at all n locations
  Clone ID: PAT_TA_89573
gtttggaagggtgtacaagggggtccttcccttgtccaaatcagagatcgccgtgaagagagtgtcacatgattcgaagcagggcatgaaggagttcatcgcggaggtcgtcagcctcggtcgcctccagcaccgcaaccttgtgcagctgctgggatactgcaggcgcaaaggtgagctcctcctcgtctacgagaacatgtcaaacgggagccttgacaagtacctgcatgccaacgactgcttgttggattggactacgangttccggatcatcaaaggtatatcctctggcttantctaactccaacaagaatgggagaaagtggtgatacatcgagacatcaanggcaacaatgttctcctccacaacnagatgaacgtccgattaagcgacttcggctaaccaaggtgtncgacacggtcccggccccggtccgactccganccgcaaactaccaagtgatnngnacaataggntacatactc

SEQ ID NO: 89574 - DNA, 177 bp, Triticum aestivum
  unsure (1)..(177): unsure at all n locations
  Clone ID: PAT_TA_89574
cgctgtacttgcatccttccctgcccccttcccctcctcccctccaagtccagaaatccgttccnctctccccctctcttctgnacccgacacgctcctctaaatnagttccccctcngtgcggttacatctnnacggnagccaagccannatggggtctccngatcctatccgnaa

SEQ ID NO: 89575 - DNA, 499 bp, Triticum aestivum
  unsure (1)..(499): unsure at all n locations
  Clone ID: PAT_TA_89575
cttcgctatagttgcccacatgttcaacggtttctctgagctagctttggccaccataaagttgccggtcttcttcaagcaaagagattacctcttcttccctgcatgggcttacgccataccaacctggatcctcaagataccgatatcttgcgtcgaggtcgccatcacagtattcttgggttactacgtcattgggttcgatccagatgttggaagactgttcaagcagtacttgctgctgttgtttgtcaaccagatggctgcaggattgttcangtttatcgcaacattgggcaggaccatggttgttgcaaatacactgggcatcctttgcacttcttgtgctgctccgtgctcaatggatcgtcctgtcgcatcatgatgtgaanaaatggtggntctggggctacnggatgtcactcctcaatacgccatgaatgctattgctgtaaacnantccttgggggaaaatgggaaacggttcccaagggtcaaa

SEQ ID NO: 89576 - DNA, 307 bp, Triticum aestivum
  unsure (1)..(307): unsure at all n locations
  Clone ID: PAT_TA_89576
agaaccccgatgccatcatctccggggagtggcccgagaacttctccctcctcagctacgacgacctccgcgcatacctccagtcacagcancagnagcaacaacgacaaccatcccatgccggcnntnaggttcttctncttgcgnatcttgtggncccggcaatcccccccttnaccttcttcttccgggnggattttgtacccctttaatcccctcncttganaancttcctctncgggngatnttggantcccgngnaacccccccccttganaaagcttcttcttttgaccccttngctaac

SEQ ID NO: 89577 - DNA, 469 bp, Triticum aestivum
  unsure (1)..(469): unsure at all n locations
  Clone ID: PAT_TA_89577
ccgtcgtcgtccttaattgttcctgcgtctccccccttccttccaaacagcggtgacctccaccacctccaccaccacccaagagccgagcgaggagaagagagaagaggagatcgaccatggctgcggacggcgggaggtgggtgggcctggcggtggacttctcggangggaaccgcgcggcgctgcantgggcggcggacaacctgctccgcgccgggcgaanaaacttgctcctccctgcaagtcctcaaaggancccgactacgaacaaggcgaaaacctcctcctggaaggctccggntcnccnttgattcccctctcggagtttctcaaccntnaattgcaaanaattatgggtgtnaaacctgattcttaaacctgggcatcncaanacttttncgaacanaagangttncgttggtttcaaantccttttggaattccccaaaaactttccaancaacaa

SEQ ID NO: 89578 - DNA, 353 bp, Triticum aestivum
  unsure (1)..(353): unsure at all n locations
  Clone ID: PAT_TA_89578
tttctacctaagcttagctagctaccttgaggaaatggccgcggcgacggnaatggtcatcatgctggcggcgctggcgatcctcgcgccgtccgcgcgggggctcnaccgggccgagttcccgcccgggttcctcttcggggcccgcnangtcttcttacaaaatnaangggcncntacctgagggacggnaaagggcctaanaancnggaattttttcacccaaacccattctngggaaaancancnatggncggaacggaaacgtggcggntgacactacaacctttacatggaaaactgganattanccatnatcggggtgtnaacccnaaaaatcccantcacagggg

SEQ ID NO: 89579 - DNA, 468 bp, Triticum aestivum
  unsure (1)..(468): unsure at all n locations
  Clone ID: PAT_TA_89579
gtcaaacaagaaacaaacctcatctttctccctcctctcccctcttcgaatcatcgccggagcacgaattggccatagtttctggattcgacgatgaaatcgccattgcgcaagtttcggggcctcgccctcccccaccaccacaaggagaagaaggaccaacggccgccgcccgccaagctcgacaacctcgtcgacgccgcccaggagatggaggaaatgagaacttgttatgatagcttgctttcggctgcagctgcaacaacaaatagtgtatatgagtttgcagaagctatggaagaaatgggaacttgcttactttgagaaaactgcattggattgcatgatgatgacagtggnaggtgctgatgatctaggaaaggtcaatttaactacaaaanttgtggataactaacggacaaatntcctaaattcaatcacaaacccttnaggtcncttcnaaggngg

SEQ ID NO: 89580 - DNA, 608 bp, Triticum aestivum
  unsure (1)..(608): unsure at all n locations
  Clone ID: PAT_TA_89580
agagagttcacctgcttattgtatattgttttaaatatttgttggtgtaagaaacaaagtaaagtaatcaagtggtgtaaggaaatggcctctcccggtcccggcacggcgtctaccgtcacgtcgtcgtcggccggctcggaggcgacacgggcgccgcctgcggcgctgacggaggagaggaaccgcaagcgcaaggagtcgaaccggctatccgcgcagcggtcgcgcgcgcgcaaactgctgcangtggacgagctggaggcggangcggcagcgctgcgcgcccggaactgcgccgtggcagcggctgcacangangccgcgcgccggtgcgcggtcgttcaggccgagaacnagctcctgcatgcgccggctctgngagctgggcgcgcgcctcgagtccctcgccgaagctgatcaagtacatggacgccgccgncgccatgggtgcttcctcaatcccgctcgncggngtcaacggcaacacctngcccaacnaccgatcttgnaaacggnttgnatgaactaccctactacgctanagattcacatgtgggtcaagtannacncgtgtgtcaancgncantagtctntcttccncaact

SEQ ID NO: 89581 - DNA, 634 bp, Triticum aestivum
  unsure (1)..(634): unsure at all n locations
  Clone ID: PAT_TA_89581
atgcctgcctttacatttcctgaagtgtttgatgcatcactaatttcatgatatgtgaatctaggcgaccaaggttctggcccagctcaactggactgggagcagcggttggctatctcactagctgctgcgcgtggtgtgcaggctatccacttagctgggccatcaagctgccatggcaacatcaagtcttccaacatcctgctcaccggaactcacaacgcatgtgtgtccggagcatgggcctggataacacttgggtatttattacaatgcctcccggctactgtgcaccccgaggcaaccccgcaataagtggggctccccaagaaacctgacgtcctaacagttccggcatccctaataactgggagttctcaanccgcaantctccaactgaggaaagaatttcaaggatgacaagggagtaaattngcacggtggtgtgttccaattataccggaggantgggcggcggaggatcnacntggaccccaacaagggggcagaaggtggaaagaggatgcatgggcgactatcaaccgggcaaatgtncatcaagatacgancanggctnaagtctntgtctgaacggttnagaattcgcagccaatgctgcaagacccaaacatgg

SEQ ID NO: 89582 - DNA, 233 bp, Triticum aestivum
  unsure (1)..(233): unsure at all n locations
  Clone ID: PAT_TA_89582
gaaagacacgaagaagcagagaganagagagagagagagcaangtaagctggagctaagctangatggggttgctgctgctgcttcaggtgctcgttgccgccgccgnggcgagagccccggcggngcangcgtggggcaaggaggggcactacatgacctgcaagattgccgacngtttcctgattagcnaggcgtcggcggcggtganggagctcctgccntcgtgggtca

SEQ ID NO: 89583 - DNA, 586 bp, Triticum aestivum
  unsure (1)..(586): unsure at all n locations
  Clone ID: PAT_TA_89583
aacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagcccccgaaatgtgggcgctgcgcggatatgaaatccaccgtcgacggcacctgcggtggaccctgcaagaantactgatcggntcatgccggcatgatatttcccgcctaaaataaaataaaactcaaggcaaataannacgtaacctgcctagctgtgtgtgtggcaacatgcttatacaattagtctctctcgtcgctgtgttttctctctcgaaaaaattggtgttgctggtgttcaactatccggatatcccccgtgaataacactgtatgatgtcctggtgcaataatatgagtcccttgtcaaccattaaaaaaa

SEQ ID NO: 89584 - DNA, 549 bp, Triticum aestivum
  unsure (1)..(549): unsure at all n locations
  Clone ID: PAT_TA_89584
gcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgttgaacgccgactatttccccaagtgctgcaacaactgcaggtccttctccggggtcgacgtctgcgacgacgcccaccccaagtgccccaagggctgctcggcgtgccgcgtggtgtcgacgagcccgaaatgttgcgctgcgcggatatgaaatccaccgtcgacggcacctgcngtgggcctgcaagaattactggttcggtcaagccaacatgatattttccgcctaaaatgaaataaaactcagacgagatnagcaactcatcgtgcctangcnttttgttttggcaacaatattttacaattagcctgtctctccccgggttttcncccnccagaaaattggngttgctggtgttaaanatccggatnccccctgaanaataagatgtcctttgggggaaaaaaaaaaaa

SEQ ID NO: 89585 - DNA, 626 bp, Triticum aestivum
  unsure (1)..(626): unsure at all n locations
  Clone ID: PAT_TA_89585
ccattccgccccactccccccatcccccccgacacaggcgcatcctcctctccctccccgcctctgccccgaacccgcgtgggcgctgccgcgcccccgcgccccgggcccgattgctccctcctcgtggtgggcgccgctccgatccgcccgatccgcgctgctcctgaggctccggcggcgagcggaggcgagcgctggcggcggcggggcggtgatggactccgaggacgacatgcacgacgccaacgactcangcggacgacgacttctacagcggcggggaggctgggctcgccgccagcgatgacggcgacggcgactacgacttcgccgaccacgactccgacnactcccccgagctcctctctcancgggcaagcagcaanaattactgcatattgagtgaanctggtataanagcancggcaagaggatgacatnaataaggtttcaactgntctcncaatttcaangtcggagcatgtgttcntcttcgcagctataactgggtgtaataangtgnataacnatggtcnttgatgnagactttcnaaggtgntggnttcggcnaacgaatnaatcantacagnaanggatgtgnattnttgantgcccancacnat

SEQ ID NO: 89586 - DNA, 490 bp, Triticum aestivum
  unsure (1)..(490): unsure at all n locations
  Clone ID: PAT_TA_89586
cgcccaccccgacggctccgttgtgtacgtggcgttcggcagcttcaccgtctttgacccgcggcagttccgtgagctcgccaaggggctggagctcaccggncggccgttcttgtgggtggtgcgcccggacttcacgaccggcggcctgagcaangcgtggttcgatgagttcacgaaccgagccgctgtcaacggcaggggcatgatcgttagctggtgtccccagcagcaggtcctcgcacaccgcgcggtggcgtgctttgtgtcccactgcggttggaactcgacatggagggggtcanaaatggncgtgcccatcctgtgctggncgtacntcntcgaccagttcgcgaaccgcgagctacatctgcgatatctggangancggactggccgtgacncccggtgaagatggcgtcnngacgaacgangaggtnatcgccaaattgggattgggtatccgtncccagggaattncagngagggc

SEQ ID NO: 89587 - DNA, 474 bp, Triticum aestivum
  unsure (1)..(474): unsure at all n locations
  Clone ID: PAT_TA_89587
ccgcctcctgcacgcttctcctccgctccccgccccgcctcgagcagctcaggaacgcgcgcagccatggcgacggngaccgagaccttcgccttccangccgagatcaaccagctcctctcgctcatcatcaacaccttctactccaacaaggagatcttcctccgcgagctcatctccaactcctccgatgccttggacaagatcaggttcgagagcctcacggacaagagcaagctcnatgcncagcccgagctcttcatccacatcatccccgacaaggcgaccaacacgctcacgatcntcgacagcggcattggcatgaccaagtcngacctcgtcaacaacctcgggacatcgccaggtcggggaccaaggagttatggagggccttcgccgccggggncgaacgtntcaatgattgggcaanttggngtcggtttcactccgccaacctcntcgccgagaggntnt

SEQ ID NO: 89588 - DNA, 159 bp, Triticum aestivum
  unsure (1)..(159): unsure at all n locations
  Clone ID: PAT_TA_89588
agacaacttataccacacaaaagcccaagaaagtaaattatggagatnaagagctcaacatgcatgggcacgcaaggaaattccggtcaagtgatttttggtaacngganctcaaatncatnccttccaagaggaaatgtttaaaaaccttaatgatgc

SEQ ID NO: 89589 - DNA, 231 bp, Triticum aestivum
  unsure (1)..(231): unsure at all n locations
  Clone ID: PAT_TA_89589
ttgacgctgttccaatctctcttttttattgttgggaatgaatcaatacaaggacacccttcctattaaggattacanaaaacanaccctaanacctaaactctctctctctctctctcttttctctcacatntaatacattctacaaaaaatctccttnaatgctggcttgctggggttgccaaattgnagnggtnacaaagcaaaaanccccaaaaannanccccactg

SEQ ID NO: 89590 - DNA, 372 bp, Triticum aestivum
  unsure (1)..(372): unsure at all n locations
  Clone ID: PAT_TA_89590
acaatggcggtttccacacgcatggcactcttgatcgcagtttgcttcctcggttgctacgtgttcgtcccgtccttggctgcctccggcgacttcctccagtgcctctcgtccagcatccccagcgancgcgtgttcacgccggattcgccgtcgttcacttccgtcctgngtgtcgtccatccggaaccccaagttcttcatcccgacganngtgaggccgctctgcatcgtgacgcccatcaacgcgtcncacntccaanncgcggtgctctgccggcgncgtcacnacgttcngcntcgncttacgcaacnggtggggacaactnacaagggctctctaccggtcaagcgnccaaagntttcncgtgg

SEQ ID NO: 89591 - DNA, 320 bp, Triticum aestivum
  unsure (1)..(320): unsure at all n locations
  Clone ID: PAT_TA_89591
caccgcacgagtgaagtgagagctttgcacgaaaacttcatcagaaaccatgaagggcaccaagctcgcggngatnctgatcctccaagccgtcctggtcatgggactcctctcacacgtgaacgccgantttttccccnaatgctgcaanaattgaagggccctttccgggggtcaanntttggaaaaaancccaaccccaatgtntccccaaggggttgccccggntttccccntggtntccaannaccccccaaaatgngggccctgcccggntttnaaatcccacgttnaagggacaccttggggggggnccctgc

SEQ ID NO: 89592 - DNA, 519 bp, Triticum aestivum
  unsure (1)..(519): unsure at all n locations
  Clone ID: PAT_TA_89592
agctcgaagttttttttttttttttttactaatacattcctggtccaaacgcaactggagcacaacataacttaacaagggaaatcaacaactaaacaacngttggcaatttggtgcccttttcctaaggncaattcaattccaananttaatataatatncaaangggcancantanttactantccgngggaacaaacacaagcaatggatcactggnaaggcaaagaaancgtangatttncnccaatcttgnancttgngatcccaacctaaccaaaggctggnggatnaaacccggtgngccaaaggtcccncgggntgtccgggtaaatnggnggggntctccgggtaaccaaagggtctccnangaaanccacgcaangggggtctccnccccntttggcntngggaangccaaggtcaaanaccnttngcaacccctcaaanaatntaatgccnctgggggntnccgntgccggtggnaaaaccnccanaangaatggggtcctccgcncc

SEQ ID NO: 89593 - DNA, 268 bp, Triticum aestivum
  unsure (1)..(268): unsure at all n locations
  Clone ID: PAT_TA_89593
cgaaaagctcccctgttccctgcccctgctccgcccctcctcgtccccggcctccgctccgctctcggtaattggatggcctcgcctacgacgccgacgaagtccaccggcgcccaggaggaagccgcggcccgccagtcgctcancggnntttccnattcaatcccnggngncggaaaagggcctnaancntcaaattnccccaacaggccgnaatggnnaaanggcaagnnctaacaaanggggngggccnagaaaatttnaattt

SEQ ID NO: 89594 - DNA, 253 bp, Triticum aestivum
  unsure (1)..(253): unsure at all n locations
  Clone ID: PAT_TA_89594
ggcngcagnncttcagnacgattagggtnanaacgaggaaaggtccactacgaggagaggatttcacgttgctgcangcaatgntcaacgcanatttttggctnctatttttctcccttcngttggggncaggtncagnnccaacggtcctggnnaatcttgggcaatttgagtcagtcattgnggttttgaggattctcacatttttgtntcaatgattagcatttgnnacttccctgggacnttntctccc

SEQ ID NO: 89595 - DNA, 410 bp, Triticum aestivum
  unsure (1)..(410): unsure at all n locations
  Clone ID: PAT_TA_89595
cgacattccattgcagctttccctagggatctatggacctagaagggcaatttatattaaaccattcaagatactctacctctataattcaagcaatgccctgcataccaagccggaaaatgggatannagctgccgtgtcccaacgtccgggacccaatggaaaggtgcgataaatgttcaaaatattcaaccaacaagtcttccaaaccaatagcnatttggggtanccaaaaataagtccncgataatcaaatcctagaagtcccaaagtttttaaagncccgaggnttaaggacttttcaacaanatataaccccccgtaaagtttgaaccaaagggttaaagtcnaggntggtttantgnccccantttncnaaagncgntccaaaaaattccaggaacccccaa

SEQ ID NO: 89596 - DNA, 297 bp, Triticum aestivum
  unsure (1)..(297): unsure at all n locations
  Clone ID: PAT_TA_89596
cgcaaccccaccgccgccgccatggtgaagtactcgagggatccgtccaacccgaccaagtcggccaaggcctgtggcaaggatctcaaaggtccaactttaaagaacacaacgcgaaacaagcgtttggctccttccgcaagggatgccttttnggcaaaggctnaagangggaacctnganggattttcctccgccaaaaagcaaaccaatccccttccggaganaatgcaaaaggtttggtcctaatngccaagttaaaaaacnncaagcaaattggcaagggccccgggcttg

SEQ ID NO: 89597 - DNA, 306 bp, Triticum aestivum
  unsure (1)..(306): unsure at all n locations
  Clone ID: PAT_TA_89597
tcgagtttttttttttttttttttgaaaatcaaacacaaatatatttatatgnctaatatagcatattcaatacatattangagtagtcatgaacacatatatatccaacacatgtttccanttgcaagcaattaaccaaagtggtggnatggagcatccaactgctagtacctctgctcaaaaaccttttatagcatagcatttcttgtcccctagtatgcaccaaatgaaagggtccatgggccttntctcaaggcatgttctttttcagggggggggccccggnncccaaattcnnccttata

SEQ ID NO: 89598 - DNA, 237 bp, Triticum aestivum
  unsure (1)..(237): unsure at all n locations
  Clone ID: PAT_TA_89598
ctgtttgcgtgtagaaccattcttgagcctgaatggtactacttttcttgttttntgncttttttgctcttatgaaaaancctttgttcatttnaacatatacatgctagagcacaactcaanaaggatcacctttngaatcatgctaacntacnaagttggnaatnactttggatcaacttcggnccttccngctnctgaaaantgcaagggggccttgttgccccatgttcggca

SEQ ID NO: 89599 - DNA, 633 bp, Triticum aestivum
  unsure (1)..(633): unsure at all n locations
  Clone ID: PAT_TA_89599
ccgcgcccctcgattccacccacagcagcacgcggcacgcacccgagacgctcgtacgggccggcgcaccctagccgggccgcgatgcccacggctaacgtgcgcgcggcgcagcctagcgccgaccgcaggttaagtacgctggtgcgccacctgctgccttcttccccacgaacatcagcagcgaccgccacctccgccgactcctccctccaacctttccccaccatggcgtcgccctccgtcttccgccgggatcgcgcagggccggaaggaccccatcctccggggtgacggtcgcgttacaacaaggatcccaaccccgtcaagtcaactccggcgtccggcgctagacccgaaggaaggaaaccatggtgctgatgtggcangccgccgagcagagctgttcaaaacatcaactgttaagganattgccgttactggttgggagttcaacaagttgagtgctaacttacttcggtgctgacatctgctatcaagganaataggtggtactgtgcatgctnacaagaacggtccctacatggaagngaattcttcaaggacatataagcaaattanatccagcaactggggatacaaanctncttactgctnaggnagnttcgtccn

SEQ ID NO: 89600 - DNA, 545 bp, Triticum aestivum
  unsure (1)..(545): unsure at all n locations
  Clone ID: PAT_TA_89600
tagaggtatcttgttagaacaaaaagaagacaaacaaagtaatggaatcttctcacatatgtttcttgcaacagaagttcccatgcaaacagtaccgttgcttttaggcgatgcagacaaaaccataacatgtgcagttaacaaaagatgaacaaattaacagtaattaattaagcagcacaatctttcattgttgccacagcccacaggtagactccggtctccgggcatactgctggagagtttgtgcgtctaagaataaagaacacccttaaaccactaagttaatgaaattaatttatatcctaactggacatatgctaatcaaactatccgagctaancagcgttgggtnataggcagattcccccnggggccaactggtgagcgagccgtggcaantccggnacaacgccctctccccnggcatcgnctcancctggggcaaaggtgcgctttccncccgcgcccaaggaggacccaaggccgacccgaagcgccgcccggcagaggagacacaccgcganggcgccccnnggggaagg

SEQ ID NO: 89601 - DNA, 198 bp, Triticum aestivum
  Clone ID: PAT_TA_89601
ctagtctcgagtttttttttttttttttttgacaatgcagaaccttcttcttttagatgaacaccggagaactttttacaagctctgttttttaggggtgaactttctacaagctcattacatccgtaactcttctcttctatacacttgcttgtcttcataacgactgttttctatgcatttgacggcattatacgc

SEQ ID NO: 89602 - DNA, 618 bp, Triticum aestivum
  unsure (1)..(618): unsure at all n locations
  Clone ID: PAT_TA_89602
gcaaggcggagcagaagctcatcgtcgtcgtgctctccgtcgaccacaccccgccgggcctcctgccgccgccccctcctccctccatgccaccgtcgtccgcgccgcccatgcccagcccgatgtcgccgccttccatgacgccgccgtccgccgcgcccatgcccagcccgatgtcgcctccttccatgacgccgccgtccgccgcgcccatgcccagtccgatgttgcctccttccatgacaccgccgtccgccgcgccgatgcccaacccggtgtcgccgcttccatgacaccgccgtccgccgcgccgatgcccaacccgatggtcctcctttccatgacacaacatccgccgcgccgatgccganccgattctcccctttcaatgaacggcgttcgggcgaaccgatccacccncgtctccgacagtgtcccggggaacccggancgcacggcgacgacatcagtcgtnnccggtaactggagggttatcccggggcctggntcgaacaacaccgccgggccggccccacgggnaatcacacccggaaccggtgncgtaagaagctatggaacttnaaagatggnacaagcccnacgnggccttcttnaagt

SEQ ID NO: 89603 - DNA, 653 bp, Triticum aestivum
  unsure (1)..(653): unsure at all n locations
  Clone ID: PAT_TA_89603
agcagcaggaggagcttgcaggaacaatggcggcccagggtcttctctctgggaggcagctgcttgggaggcctctgcagtcttccatctccaggtcgtcttcctcccggaagtccgccttcgtcgtcagggcatcgtccagcccccctgccaagcaaaatgacaacaggcagctgtggttcgcgtccaagcagtccctcacctacctgggacggcacgctgcccggtgactttggcttcgaccccttggggctgtccgacccggagggcaccggcgggttcatcgagcccaggtggctggcctacggcgaagattttcaacggccggacggcgatgatgggcgtgggtgggatgatcgccccgggaggcctgggaaggtggggcctggtgcccccggagacgcgattccgtgggtcaaggccggcgcgattccgccagcgggnactacaatactgggccgaccctaacgtctcgtgttcagatggcctcaccgctcncngagaacggnggtcaagacngganaaccggctcatgggaacatactctggctcaaaatactccgtgtcgggaccgctaccggnggccatttancgtcggttggacanacananggataggntcagtaggatanagggctccatgccctccgatt

SEQ ID NO: 89604 - DNA, 597 bp, Triticum aestivum
  unsure (1)..(597): unsure at all n locations
  Clone ID: PAT_TA_89604
gagaccagccccgtcagggcaaccttgtagaaactcggcgccacgggctagaaactcggcgcctgcacgttgtggagtaccgggagtagggcaaattgcgactaccgtcatggcatcggcgctgctgagcatacggcacctggcacccgagtcggcgtatcggctcgcgagacagtagctcaacataccgccaagacgagggacatggggccgttagcccaagccgagcaacctagacactcccgattgaacaggcccgcgcttgcggtgggacgcagcccgatgcggacgccctgcactgggtgtgttgtccccgnaagattaacatctccaaaagcaanacaccctaagtgttacattcgtccaacgtacnnactggnccccgtaggtccggagacttacacacttgnccccgtaaggtcngaatgcgttaccggaggtacctntgcaactccnggaaaaacgggcacacacacacgtgaagatgcaacatggtggtcatctgccgaagtctcctgcctaaggttacatattgcnctnacgnttgactccaacgttctaacaagacgtattcagtattttntgttcattcgcata

SEQ ID NO: 89605 - DNA, 616 bp, Triticum aestivum
  unsure (1)..(616): unsure at all n locations
  Clone ID: PAT_TA_89605
atcgcacccctcctccctcctcccaatctccttgctgccgccgccacctcctccccgtcccggcccctccccctcctcctcgaccacgcctcgtcggagagagagagaggcgtcgcccccagcgactacggttgttcccccctcctccctcctccttcgcgcctcgcccacggcgcgccgccccggcgcgctgccgctgctatttattccctccaaatcaccattgcccacagcagcaaggaatcaagatcaaatcccctcccctcccatccactcctcccccgcgggcaacagagatccaagcagatncgcctaattccatggggacgccggcaacgccccgtcccgcaagcgcatcgaggcacgtctcaagaagcgcgcgacgaangcttcaaccgctgcgatgtgcaacaagaagtaccatcgtctcancgacttaaaagtgaactcgatcaanataggctaactcgagcttnantctnactctccaagcactcngttggcngcggcngagtggganttgggttaattcatataggtgaaaattaantaacggtgtcgcccatantgantttgaagtccagtnttactcgcggcaaataaaacacntttnggg

SEQ ID NO: 89606 - DNA, 646 bp, Triticum aestivum
  unsure (1)..(646): unsure at all n locations
  Clone ID: PAT_TA_89606
aactagtctcgcgttttttttttttttttttttaaaaaagaaaaaaaatatttttcatatattttaatgtaagatcttacgaatataacatcgacggcaacatataactaagtctaaatcgactgatatttagctttggtaactccataaacatgagggagctttactttgctttcaagcaatacttttttcttgggaaccagcgcattgttgtcccatcgacgaccacgactgccctcgttctgaattaccaagtatcccgttttcngttaagatgctagagaccatctcatacccaccggatctcctcctcctggtgaaaggaagcaacgcgctgcctccaagccgctggctgcaagaagaccagcacggcagcatcccgctccgnacggtatggatgaagtcccacgcnacgccgaagangccccccnaaggctggcgtacangccggaggactaagctccggtcntaaactgccgctaacacgtcntanactgtggaacaaccgggtcaaggggacccgcgtaaaacacggganattctcggatccnganctgcaacanccttnagatgattgaggacaggaacctcaatacagccacgtcanacaggccnccaatctgcggtcncccatggacaaaangnc

SEQ ID NO: 89607 - DNA, 629 bp, Triticum aestivum
  unsure (1)..(629): unsure at all n locations
  Clone ID: PAT_TA_89607
ggggaggccaccgacgcgccgccgctcccctgaggccaccgccgccgcacgaggccgcaccacccggagcgccttcgcctcgccgcctctccggctcacctcccctcgctccgctttcccccatcccgattctggatcggggcaccaagtccgccggcgccccaccgccacacgccgctcgcctccccgtcatcccgccgtctccgaccgcctccaagacggcttccccgacctccgcgtcctccccttcttcctctacaccgagccacgaggacccggaaagccccgtgacgccgccccgctgctcgacgccggagcctcctcgccggactgcctccccatcgcgcgccgttcaaantcttcctcccccgagcccactgcccgtgccctatgctccctactaacaagaccgacctgctgctgacaattcgactacggattgacgaccctctctcttgccaganaacaaatgctanantaaggagcagaccaacgtcaacgagancctatacacggagtgcctatantgaacccgctgagantcaagagtattagaggtccaagaagaggctaactctccattgtancanttggaacatctangaaccgntactagtgnacaaantgtt

SEQ ID NO: 89608 - DNA, 425 bp, Triticum aestivum
  unsure (1)..(425): unsure at all n locations
  Clone ID: PAT_TA_89608
caccgcttgtcgccgtccaacctcctcccccatgaggccggccccgaggcaccccgcctccgcctcctcctcgccccagcagcactagcagccgacgatccgccccgcccgcgcgcgcccccagccggccgccgccatgctgttcgcgcgccgngacatcgaggccgcgggcgccggcgcctgccaggacggctcgccggncgccaanaagggcaagccggagtcggccgccgcggccgcagccgtggcgcnccccacgctgacgcggnccgaggcgctcgnggncgccgcagtgctcgcgctcntcggtcnccgggatcatctgcatcttcctcnccgcggccccgncgcgagttcngncaagatcctccgcctctctcgcagctcgacngagtgcgnctctcaggacaatctntgtgtatgaa

SEQ ID NO: 89609 - DNA, 380 bp, Triticum aestivum
  unsure (1)..(380): unsure at all n locations
  Clone ID: PAT_TA_89609
acgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccacccaagtgccccaagggctgctccgcgtgccgcgtggtgtcaacaaccccgaaatgtggcgctgcnccgatatnaaatccaacgttcaacggaactgccgttggccctgcaanaattatngttcggtcaagcaacatgatatnttcgcctaaaatgaattaaactcaaacaaaatacaactcacctgccta

SEQ ID NO: 89610 - DNA, 639 bp, Triticum aestivum
  unsure (1)..(639): unsure at all n locations
  Clone ID: PAT_TA_89610
ctcgagttttttttttttttttttttgtttgccactaacgcttatttattcgggtacacatcactagattctaactgctttacatatagctctttggcgtgacgcattttcctctttttctgtagcgtaggtagaaagcaaccaatccaataactgtaaacaagattattcctacatttaacaaagagtacgtgttcttctcggtgtcacctgagctcaaagtcacccggattttagcactttctggagtattgttggnattancttctccctctccgtcttggaactcggnatatccaaactcatcttcttctgctacaggcaattctccacatttagctattttgatacttctttgggcctttcacaatttttgggaaaatcctcgattgctcaactactccgtagccttcaataactnctcaaaaacgacagttaacgtcaagataacaagggtggaggggtaanaagatnagagcatggnancttcancgtggcaaaaaganaaaccttcgagaggtttaactnaagttcgcgggaantnacccnaatnantcactgacggaaccttggaaancccctgganagaatctgtgacgggganatgtctaatgaaancccntttcggttnantcaaat

SEQ ID NO: 89611 - DNA, 500 bp, Triticum aestivum
  unsure (1)..(500): unsure at all n locations
  Clone ID: PAT_TA_89611
atgaaagtagaaattctgtcatttcaaaaaaacctaaacaaaaatagtcctatattgactgaaataggatagagtcaaagaaattaccaaaataaagagtgaattacagtacaaatatatcatattatttattttacaacaaacaatcatccaattatttatctttcttcaggtgttaacaatcaaatggcaatgatgctgcctgccccggccgcggctgcggccgcggctccgcccgcttcatcttggcgagctcgaccagctccgtccgggactcccgcatggacagcttgggcactccagcgcgcccgaacgtccaacangctgcaagagcgggacctacgggtacgaaanactcntacggnaaaggctccgtccataattcacganaancccaaccancaagactnaaantaccgagtntccccgcnnaaaagtccaaccttggggancctnaaggccctcaaagnatcaacgcgcanngctgtcancaatcggct

SEQ ID NO: 89612 - DNA, 542 bp, Triticum aestivum
  unsure (1)..(542): unsure at all n locations
  Clone ID: PAT_TA_89612
gtaatccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgaagaagggcgtcggcaagagcggcaagccgctgcactacaagggcaagcgccttccaccgcgtggatccccgacttcatgtgccagggcggcgactcaccaaggggcaacggcaccggaggcgatccatctacggcgagaattcgccgaacgagaattctccacaagcacaccaacccgggttctctccatggcaacgccgggccaacacaaacggtcccattcttcatctgnacntccctgcaatnggtccacgnaanacttngcttcngcnagncctccagggatggactcctaaagaacaccaaaaggngggtccccaacggaactgtccaaacaagtctcatc

SEQ ID NO: 89613 - DNA, 613 bp, Triticum aestivum
  unsure (1)..(613): unsure at all n locations
  Clone ID: PAT_TA_89613
ctgctctcaaccatcttggaattgacagtaagaacttaccagtaccttccttctctgtagcaacttttttctggagtaacttttttgctcactattctttcatgtttatgcagaaggtgtgccaaaaaggatactaatgttgagaaactcactagggaaaatgttgcaagtcgtctacaggatcactttatatcatgttggaccaccttgggaattccgtagacttttatcgtcgaagggtgtactcacagaacacaatgagtgggattggtgcttttccacacttctgtccatagcagtggggatatgttttcctgcactggctccggctaacctcctaatgtatgtgtcctgcactgtgcagctacctccnaagcactaccaaatgttcaatcnccttccngtacaaanggactngatcnaattaataagaatggactgtgaatgtgttgctttccaanataatggactgctcaattttgatcggcanacgtgttttgggccatccgtttgcaaacttaacgtcaacttgggcaaccaagaattctgggtccgttagncccatggtgacaagagtcangtaanggcncaggtantggtcacaaaacgtctc

SEQ ID NO: 89614 - DNA, 664 bp, Triticum aestivum
  unsure (1)..(664): unsure at all n locations
  Clone ID: PAT_TA_89614
ggaagttgtaggcgcacctgcacctgcactttgtgcatctccagtggccgcaccatcatctccaccagctgcacctgcactttgtgcatctccagtggcggcaccggcgttaccatcatttgcacctccatctagttctcctgctgcagtgcctgaagataaatcctgtgaactgacggcaaatacagtcacaatgtccaataaagatatccctgggggcggagggccaaggcttacaacgatgaaaccccaataaattaagtcaacttgatggtgatcgcattgggtcccttggccaacgtccttggctgaactacttcaacatgaaaatcctggtcctgggggatccnagaagactgacaaatagtanaatttattgctactgaaaagaaaacatagccaaggacttngagaagactgagcttgagattgatcaatgggatgtgaacttaaacagtgagtactgaatcaagaaacaagntcttgaagatcanaaatcctcaacttctagnggaatcaaaatctagcaagctgcgaataaagtcnagcaagctagacacaaagtcngcaanctgaatcgtgganacactcctaaganagggngtaccctgaactcgtgacagactatctaagngtactagttttnagccgtcatgacgatcac

SEQ ID NO: 89615 - DNA, 590 bp, Triticum aestivum
  unsure (1)..(590): unsure at all n locations
  Clone ID: PAT_TA_89615
gatatttaaaaaaaatgtgagggtttaccactggcgatcaatgccatatccagcttgttgtctactgggaaaacaaaagaagagtggtatcaggttcgaagctctatttgttatgcgcaaggaaaaaattctgacattgatgccatgaattacatattatctttgagttatttggaccttccccatcacctaagatattgcctattgtatttgactatgtttcctgaagattatcgggttgaaatgggggcacttaagtacacagctggattctgagggttgattcctggtgaatatcaagaaatcttgtggaattaggatatgcatatttagtaagagcttacaaacagaattttaatagaatcatccgcatcaatatgatgggaaagnacgttctacgatcaaaaggcacctgattcccgntcnagtccgcgaaanattctgtcctgcaaataccccaaacagttnaaatcacggtcccgttggaataaacacagctccaaatanntaccanccatctgggtttggaacgggaatctcttgaatcatccggttgcacaaaattccgnttgaacacataanataaaccc

SEQ ID NO: 89616 - DNA, 236 bp, Triticum aestivum
  unsure (1)..(236): unsure at all n locations
  Clone ID: PAT_TA_89616
caaacnccaagtcggcgcctccctttctccccttcctacgggttcnngtccncctcttcantcttcacccntgcccnggntcgcagatctcgccattccctgccacgccgccggccgcccgcgcgccccgttccggcggnaggtcnncatctctcccacagccgtctcnggagagccggaggggcctgcgcctatacgacngacggcanngctcttncntccccctgctgcgccgg

SEQ ID NO: 89617 - DNA, 617 bp, Triticum aestivum
  unsure (1)..(617): unsure at all n locations
  Clone ID: PAT_TA_89617
atcggtatgaacttctcatcataggttcatctcctgagagagctaagtttcatgtagtaatctataaggaaagcttggacatatctcttttcacacgcgatcttatttacttgaaagataagttatacactcttggtaataatttgatgagtaggccatttcaataatctatttgtttcaaggcattgggtagattggtggtacaactggaaganttcttatgctaatacttggcagtttccgacacaccccggaacaatgganacatgtttaccaaccacattcccacacaggagtgtcctttttcaaaaacaaagataccctggatgcatgacaaagttgtagcgttaaccnccaaaaattatgcttccggtagtaatgcataacactataaacctaaagtgggtactcactgctcccgnataagcttcncatggatacctaccaagctggattatagacacattatcccgttgnaagcaacncncgnccaaatctgncctaaattggcaaatacggggtncaagccattaggtcaccggncanaaaacaagcagattggacgngganaataancacttgnctcgaaaaagggggccggncattnctaagngcnt

SEQ ID NO: 89618 - DNA, 652 bp, Triticum aestivum
  unsure (1)..(652): unsure at all n locations
  Clone ID: PAT_TA_89618
ctgaaaattgcacaagctggcttctgtcttgtttccagactggagatagcccaaaccaacctcatcctgctgatccaatgacggtgccactgctgtccggcaacacaaccacagtaactgaatctcaatctagcacatcacatgtttatcatagtcaaggcacagttgtaaaaccagagcatccgacagccgaatcaccttccgggagaaccaagctgatccttccagttttaccaaaggatccatcgttacctgggtatagcgactcccggtggtgcaaccacaacgacaactggaaactaacgaaccatatgttcaagcatanccatgggacacagcagctggacatccgaccatcttccccaacatccaagaaaccaccactacagtttggaagacaacgaaactacaactacanccacatcaagaaaagataccacatctcctaaaacacaacggganacctaacgcatcactcaaaatcacctctacaagatattcaagcaagacttacgaatggtgaccggtaaatgcctatggtgggcttcatggtcaaccanctcaaatnnctcaagattcacggaacgnaagatggnantncagcatcaatcnaacagattagtcntacccatggaaattcatnaggttnccg

SEQ ID NO: 89619 - DNA, 529 bp, Triticum aestivum
  unsure (1)..(529): unsure at all n locations
  Clone ID: PAT_TA_89619
ctccactttcctctccatctcactcactctctccctccgccgccggcgcagcgtcctccccgcgactccgatggccagcaagtgggtcaggcccgaggtgtacccgctgttcgcggcgacgggcgtggccatcggcatctgcgcctttagcctccttccgcaacatcaccggcaacccagaancaagggtcaacaagatggggaagggcagcgggagtgcttngagaaccatgaggagggcnaggcgctacgcccgacacggcttcaagagcctatgtgcaggacaagaccccgaagatnatgccaaggaacaaacaantccttcaaccaacccaaaaatggaacactttatcctgtcctgtggactccgcaatttataactggttgtggcaaantgcaaactatttcnaanattcnataatgttgttgcctccaatattcaanannatccgtcaattactcttattgaaagacatgtgattttggatggttgcnanaatgtnatggtggatggtctaaaaaaaaaaaa

SEQ ID NO: 89620 - DNA, 511 bp, Triticum aestivum
  unsure (1)..(511): unsure at all n locations
  Clone ID: PAT_TA_89620
ctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtgggaccctgcaaagaagtactgatcggttcaagccggcatgatatgttccgcctaaaataaaataaaagtcaagcgagatgagcaacgtcatcgtgcctatccgtgtgtgtgtggcaaaaatgcttatacaatantcgcncttcgcnctgngtttccccccnagaaaaattgngttgcntgntgtcaactatccggatatcnccgtgaanaananttaatgatgtgctggtgcaa

SEQ ID NO: 89621 - DNA, 187 bp, Triticum aestivum
  unsure (1)..(187): unsure at all n locations
  Clone ID: PAT_TA_89621
cagactgcctcttcttgctcagcctcggacncaatggncgccgttggtcttctcggcgtgtgtccanctccggnngcccggtgggncggcnagacaggcgggggtttcaccggcnntctggtanntggggctggcgngcccgctcncgctcccttcgnncggttccgtctgcccgntntgancggtg

SEQ ID NO: 89622 - DNA, 409 bp, Triticum aestivum
  unsure (1)..(409): unsure at all n locations
  Clone ID: PAT_TA_89622
attcaagagttatagggagggacttatgtcaccacaaacagaaactaaagcaggtgttggatttaaagctggtgttaaagattataaattgacttactacaccccagagtatgaaactaaggatactgatatcttggnagcattccgaagtangtctcagcctgggggttccgcccgangaagcaggggctgcantacctgcccgatncttcnacgggnacatggganaanggttttggnctggatggccttacaantcttgatcgttaaaanggaccntgccttcaaatcgnaccctgttgctggggaaaanacccaangnttctgtaanntccctaccattacccctnttngaaaagggttccgttacaaaatgttactcccattgnnggnacctatttggtttaaa

SEQ ID NO: 89623 - DNA, 373 bp, Triticum aestivum
  unsure (1)..(373): unsure at all n locations
  Clone ID: PAT_TA_89623
accgcacgagtgaagtgagagctttgcacgaaaacttcatcagaaaccatgaagggcaccaagctcgcggngatcctgatcctccaggccgtcctggtcatgggactcctctcacacgtgaacgccgattttttccccaagtgctgnaacaactgcaggtccntctcngggggtcgactctgccacnacgcccaacccnaagtgttcccaaggctngttcggcnttnccgcgtggtnntccatgaancccngaatgttgngncncccccgntatnaattcaccngtcnacngcancttgccgntggncctgcnangaagtacngatcggttcatnccggcattacntttccccctaaaatnanattaaagctc

SEQ ID NO: 89624 - DNA, 369 bp, Triticum aestivum
  unsure (1)..(369): unsure at all n locations
  Clone ID: PAT_TA_89624
gttttttttttttttttttttttttttttttagacaagtaaagagtcctcatgatgatgtattgaacattcccaaggggagaaattacataggcgaaattacataacggttgtgacaaaagagcacaaccatcatcaaaacctggttcacccaatgactaagtaggaagggagattcaggccagaagatgacactcctactgcactgacttcatcttcagaaaacaggtccaacctggcgcatgtgccgaatgttgttctgcctgacgaatttcctcaagtttctgctcccatgctaatggcaanatcnggtctcacangtccnantgccatttccagtgaatcgggacttcaaatattcaacngnttt

SEQ ID NO: 89625 - DNA, 593 bp, Triticum aestivum
  unsure (1)..(593): unsure at all n locations
  Clone ID: PAT_TA_89625
ccggatccgccggccatggcgacccccaacccgccgccgccccagcaggacgaagccctcctcctccgccgattccaaggcgaagaaaggactactcgacaagcgattctggaagcggaagaagtcccccaaccgcctcgtggtcnacgaagccancaatgacgacaactccgtcgtcgccctcnaacccgacaccatggagaagntcaactcttccgcggnganaacgttctcctcaagggaaaaaagaggaaggcaccatctgcaatgttcttgccgatgaacatntnattanccccaanttnaaantgacaaaactttcaggaaaaaatttnaantgaaacttgggaacntggggttgtttacaaatgccccggatnttaaaaacgggaaacggtgcananacttccaattgnnaaanaatttaagggatttaagnaantttttttcnccttctttaaacaaaantcctnaancttacgtcccttttaaaaggaaacntttcctttaagggnggaaaaaaaattgggtcaaattttaaaatgcccccaaatatttatnttnnccaaaatnnattttccaaggggancctt

SEQ ID NO: 89626 - DNA, 289 bp, Triticum aestivum
  unsure (1)..(289): unsure at all n locations
  Clone ID: PAT_TA_89626
aggangtggnggaggcgcacctcgggttcgtccccggggaggcgctggaggtgaacttcacgctggaggtgcancanatcccggacgatacggtnagcacggcganccancggnaccggatcctgcggctggtgaaggggctgcngcccacggtgctgacgctggtggancatgagtccaccaccaacacngcgcngttcncgcactggttcgccagnnacctcgactctacngcggtcatcttccagtnatcgacctgaannctgccnatggacnacanggancgggt

SEQ ID NO: 89627 - DNA, 374 bp, Triticum aestivum
  Clone ID: PAT_TA_89627
tggatcccccgggctgcaggaattcggcacgaggcagaaagtaacagaatttctttggttccagccaacagtgcagtacaatctacagcaacaagggaacagcagaatgagaccggcaccaggaactcattttcctctggcgaaatttcggtaccggcatgatctttgctggattatttgcggtggagatttttatcatcatctgttctctggtaacaaatgatcaatcatgtagacagtccgatggaaaagtcgagctgacctgtagcctcccctattatgtgctagcaccaagaaatctcccagtttgtacaaagaggtctctttccgatgtgagcatccgggtccggggtcttaactgagcaaaaaggatg

SEQ ID NO: 89628 - DNA, 358 bp, Triticum aestivum
  unsure (1)..(358): unsure at all n locations
  Clone ID: PAT_TA_89628
gcgagctcctccctcccctccgacccacgccacgccgccgccaataacgaccaactcacgtgccctatccttctccttctcccccctttcgttcgtctcctaaaccgccnccagcatggacgccaagaagaggtcnncgcccgccccctcngncgacgatagccgggccgcccgcggccaacggntacttcagctccgtcttctccgcaccggcntcnccctgcggcaantccaagagacgnnaaggcanatggacctgtnaaatcatacngancgatnagananttctctngatccatgaagttnacancctcatanggagcaagaccgncgaaagtgctaatttgatgctgctaan

SEQ ID NO: 89629 - DNA, 410 bp, Triticum aestivum
  unsure (1)..(410): unsure at all n locations
  Clone ID: PAT_TA_89629
cgacctcccctactccatccagctcctctctctcacngcacgntccacagaatcgccacatagaaaatcnagntgtttnaggcggagggcgcggcaccgcgtgttcgacttcttcagggacgcctgccgcgccatcccctccatcaaggaggaggccgcggcccgccagtcgctcatcgggatctcccagtccaccccggcancaggggaggccctcancgtcaagtccnncaatttcattgacggtcaaatncnggaggattccggagaaaaacgaanccatatccaaaatnttgcggaatcacatctgccaagaaaatgcanaattccccgcaaaaggctnggactaaacttatccnggaatgatcctttggcctaattccaaaacgattctgttcaaactgtcaana

SEQ ID NO: 89630 - DNA, 507 bp, Triticum aestivum
  unsure (1)..(507): unsure at all n locations
  Clone ID: PAT_TA_89630
cagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggccttctccggggtcgacgtctgcgacgacgcccaccccaagtgccccaagggctgctccggctgccgcgtggggtccaacgagcccccgaaattgtggcgctgcgccggttatgaaatccaccgttcgacggcacctgcggtgngcccttgcaagaantactgatnggntcatgcaacatatatnttccgcctaaaatgaaataaagctcaagccanattacaacgttancntgccnagcnttttntttgtgggcaacaatatgtntaccaatatgccttcttcctcntgtgttcccccnccaanaanttgggntcttttntnaaan

SEQ ID NO: 89631 - DNA, 481 bp, Triticum aestivum
  unsure (1)..(481): unsure at all n locations
  Clone ID: PAT_TA_89631
atcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttgggctgctgggtagggagaatttgctgcggtccatctgggtggtggtggtgtggctgtttcaactgctgcccctgctgctgggaggtgctgctgcccctgcagctgatcnaaagaaagaagaaagtcnttggagaagaagagagtggatgatgacatgggttcatccnttcgacaanttgtggggacttgtgtccgaanatcnaccttgggcaaggaacnaatcnatgatntttaaccttaattaactgattgtga

SEQ ID NO: 89632 - DNA, 488 bp, Triticum aestivum
  unsure (1)..(488): unsure at all n locations
  Clone ID: PAT_TA_89632
gtaaatcttgagcttgacaatttcattggctgcgaccgacttcccccccttggctgtctagaaaagctacgttcattgacactacgacagatgcctgatctcaagacagtgcatcaggatatttccgggggcagcaattgtttgccgatgctacaaaccctcaagatagggagcatgcctaatcttgaaaggtggactaccgcgcatgctcctgcagcacatgctgctcatgtgaggatcttacctgatcttcaaactactcaaggttttggactgtccaaagcttaatttgtgccatttccntccaatctgctcaaagtgcattatcagtgtgactaatgacgtaataatgccggagcaccatgatgatcctgctccccggggacatcccacatcaananatctgcttcnatttacatggtagatcacagacccaatacttaaancctgaattacnacanttaaggtgtcaaatatagcaattggag

SEQ ID NO: 89633 - DNA, 481 bp, Triticum aestivum
  unsure (1)..(481): unsure at all n locations
  Clone ID: PAT_TA_89633
ctgatctttgctggcaagcagctggaggacggccgcaccctggccgactacaacatccagaaagagtccacccttcacctggtgctccgcctccgtggtggtatgcagatttttgtgaagaccctcaccggcaagaccatcactctggaggttgagagctccgacaccattgacaatgttaaggccaagatccaggacaaggagggcattcccccggaccagcagcgcctgatctttgctggcaagcagctggaggacggccgcacctcgccgactacaacatccaagaagganccacccttcaactggtgctccgctccgtgggnggtatgcaaattttcgngaagacctcaacgggcaagacataaccttgaggttganactccgacacatcnaaacgtcaaggcaanntccaggcaaggagggattcccccggacaacaaccctgttttcnctngnaacaacngaggacggcgcacct

SEQ ID NO: 89634 - DNA, 480 bp, Triticum aestivum
  unsure (1)..(480): unsure at all n locations
  Clone ID: PAT_TA_89634
cttatcggtggcagtactacaagcgagtgacacaagttcttgcaccgatcagatccaacttctgcgcaagatgctggacaagctgtgggacgacgtggtggccgggcctcgcccggagacgggcctcgacaagctccgccgcgccgccgccacccaacccctcgccatcaacacagctgcaggggaggcgattaagcagtcgccgtcgatgccgacgacccccgaccacccggtgacgccgtcggccgtcgaacgcccgcccgcgtggcggancgttgtngcggagcgttttccaaccccggggagcaacttggccaccaaaaacctccggggcaactcttncgacggcccgcagccaactccccaacctctacacnggttttnnaggacgagacnagaccaagngaacacgctaataagacccacggcaanattttannagaattttgcnacccncatgttgcgcctttgggtaacaaa

SEQ ID NO: 89635 - DNA, 490 bp, Triticum aestivum
  unsure (1)..(490): unsure at all n locations
  Clone ID: PAT_TA_89635
ggcatccccccggaccagcagcgcctgatctttgccggcaagcagctcgaggatggccgcacccttgcggattacaacatccagaaggagtccaccctccacttggtgctcaggctccgtggtggcatgcagatatttgtgaagaccctcaccggcaagaccatcaccctggaggtggagtcatctgacaccatccgacaacgtgaaggcgaaagattcaaggacaaggagggcattccccccggaccaagcagcgctcatctttggctgggtaagcacttttaggatggccncaccttngggcggactacaacattcaagaaggancaaccttcacttggggtcctctccgttgggtggcnattaantcctggcatggactnttttgncccctggntcaananctcctctccgtgtccttaaganccggccangtccgtccttgcctgaangctttgttccaaaccgtacaatgagcatgttaccttgg

SEQ ID NO: 89636 - DNA, 473 bp, Triticum aestivum
  unsure (1)..(473): unsure at all n locations
  Clone ID: PAT_TA_89636
gtcttatccctaacagaagtaattttaactaatcatgatataaagagacatgtcatgcccccttgaactttgacccggatgcccatgacactagacggcatgtctatggggcaatatacatccttccttggatgggattatttgtggcggaggatattttagattaccaggatcacagggaactccaacttaagtttggatnaacaccagtgtgctaaccttttatagctgtnatttaataatcttacaaaagggatgcaaatttgtnacattttgatgtaacctttttccgtgttgctctgtttaaccttaatgttgtactctatttatctgtttattctgctngttccacaatatntgtccgcnacattttttcctcaangcgtattgatnatttatttgcatacctcctcaacaaaagtaanatgctttacantactatacaattggcagtttagacataaaacttgttt

SEQ ID NO: 89637 - DNA, 490 bp, Triticum aestivum
  unsure (1)..(490): unsure at all n locations
  Clone ID: PAT_TA_89637
ccacggtacgcagtgttgcgatccttgctctcatatgctgttccttgtcatgcccggcagcggcccgagttgctcttgacggtggccgagaacaagggatacctccgccggtggccgggaacccggtgcaagttccaagtcctgggattccttcctccgccaccgccgcctgggagcctgtgaacacccgtgtcctttaaacccctaatgatgcgacgccatttcgacccgtttttcnggaacccngtgactccaattccttcngtgcctaatccgccgccgccantttcntttggccggaacaactngtgaccccaattgcttnattcccnatcctccgctgccgccatncaagtcccggttacacacaatgtttntcnatacctatcaagccctgccatncccgagaataacggaccgacacaaaacgnaaganactgcacagtttttaanaaatcngttatnccctgganacntcgcncnatattat

SEQ ID NO: 89638 - DNA, 324 bp, Triticum aestivum
  unsure (1)..(324): unsure at all n locations
  Clone ID: PAT_TA_89638
tagctcgagtttttttttttttttttttatactataaactataataattttattacagatatatgtacatgacatttacaccatgagttcgacataggatttacaaggtcatgcatgcatggtacgtgacgcatgtacagggcagggcaaccgtaccctgccgagatacacacacatcacacttacgtacacgcggcacgcactgacgcgcatatagactaataggagtggttgattaattnattaattnatccaacccgccatcaagggaaccggttaatccccngtanaattccttaaccccnggaaaacntttaaccgtaa

SEQ ID NO: 89639 - DNA, 445 bp, Triticum aestivum
  unsure (1)..(445): unsure at all n locations
  Clone ID: PAT_TA_89639
gccgtttttctccccccaccttccgcgtcccccctctccacctagcaagctccggccgtccgcccgcgcccgtcccgtccgtccacgagcgagccggccgggcgccgccgccgacgccgatgaagaagccgggcaagctcgcgctgccctcccaaggaactccaccatcggcaattcctgacgcaaagcgggaccttcaaggacggcgacctgctcctcaacaaggacggctccgcatctcccgcaagagcgaggaagggaagtcctcctatcagcctttggatatancataatttgacataacaatttaaatccancaagnttnggaaaagganaacggaactncaattgngcccaaaatgncggcatttttttcccccaaggtttaaaccaaattcaggnnacataccaagcaatgccaagantnnaaaaactttttaacatn

SEQ ID NO: 89640 - DNA, 489 bp, Triticum aestivum
  unsure (1)..(489): unsure at all n locations
  Clone ID: PAT_TA_89640
aacaagctcgcggatcatatcaactgcacaatcaagttcgtcgcagcgatacaaatgacacatgtagcaatcgctagataacaacccgtccatagttttacaaatgatcaagaaaataaaataaaggcaaggggcattcacatcaaaatccacgcaaggcagcacaggaaaaacagcactgctttgggcccccaaccgtatgcagcagagcatatactacaggcatgagcatcgcccaacagagaattcccantcnaacctgcgtcctcctgttgctgcccgtctcagcaacgaaacaaagcgaaaaagggaaaaaccttgattgactccggggaaccagcattgccatcacactgcttatttttgcctaactcccacatggatagaatgaacaggcccatggcattttnaacctcantcccacgtgtcgactcacgtnancacaaaggangtnccccnttgggtctccctccaanaaaanaanccctn

SEQ ID NO: 89641 - DNA, 511 bp, Triticum aestivum
  unsure (1)..(511): unsure at all n locations
  Clone ID: PAT_TA_89641
aagtcataaacccaagtcggactcgccttcctcctcccccaactactcctcctcgcctccgcgcatcgcaccgcaccgggggtcacctgagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggaaatgtgacagctggagcggatggtgttgctaacatcaatgttactgactggcatatcccccttactggacaaatcaantgttggcctgctgtttctcaatggtgacctatatctggcaaggtggcataactgacaagacatggnaacctgggccgt

SEQ ID NO: 89642 - DNA, 520 bp, Triticum aestivum
  unsure (1)..(520): unsure at all n locations
  Clone ID: PAT_TA_89642
cgagtttttttttttttttttttttttttttttgatcaaacatcaaatacatacttgcgtaataattcgtccggatcaaaagagaaacttacaacggtgcagtgcagcaaaggattacaatcttaagatgtatcgattatttttttaggaaaagtgtacacatatcacaaattcacaatatttgttgggtctacaagatcatagattgtcaatttgtagcaacgctagctagcacacgatgggcttgttggggtgcaggctgaagatccctcctgtgtacccgccgccgccacggccaccgtacctcaccaccggcccgtcgcggccgtagacctcctccccgttcggccctctcggccggcgccgcccgccggccaacaagtacccgcagcagcagcagcagacgacgacaagcgctacacggccgccgccggganggcgacaacaaggcggagcccgcccgcgctccattgctgcggccaccctggatacggcgacagnccgggaacccgaccgagga

SEQ ID NO: 89643 - DNA, 424 bp, Triticum aestivum
  unsure (1)..(424): unsure at all n locations
  Clone ID: PAT_TA_89643
gtgaaatagtcggtcctagcttcgaagcactcatgaaatcgttaccaaacttaccaccaaactacaagcaagctgctgattttgattgggctctccatccaggaggatccacaattctcactggtgtcgaacgaagattaggtctaactcctgaacacatgcggggaagttacgatatttacatgaaccatggcaactcatcatcagccacgatattttcagtcctctcacgatttagagataaagatatggatgaatgtgctccaagtggaaaagtcaaagacttcntggttgcttgcgcctttggacccggtgtcactatcgagacctgtatgctcaaacgtaatcttaaccacgtggcacgacctctgctcaacatcggtgaaattcaccaccagaaactganantgaaggcggccgaant

SEQ ID NO: 89644 - DNA, 428 bp, Triticum aestivum
  unsure (1)..(428): unsure at all n locations
  Clone ID: PAT_TA_89644
tttttttttgcagcatactgtatttaaattcagaaagatcagtcatctgttcacataatctctaacacgtactacgtagttcaaattactctaattagatctccattaggaatacatcccatgcccatagctttccaaatgcacaatgctagtagggtttctgatgcaaaatgacactagaacttagacgcggccaagtacacgcatagccaaaagatattgctgggctgcatgcaaacangaattgctaatgtctttctcgtcagtcaatgatctcctcgtacaggaacttcanggatatctcccgtttaccanncatcntgactatctcancagcattccacatgtgcaagtgnncgttcgcccgcagagattttaagtttagattnacagagccaacaantcaactcnaantgagctaaggtttn

SEQ ID NO: 89645 - DNA, 419 bp, Triticum aestivum
  unsure (1)..(419): unsure at all n locations
  Clone ID: PAT_TA_89645
tanagaagctcttatgtgtgcagtcaccttcaagtaactgaaactttccaaggaggtgtttcaacccggggaggtggaggacttcaattggcaacatcactacctgggttctcctcatgtcaagagtctccaaccattttagcttcgctattttccttggaaccttgtcaatactgtctccgaggctcagatatttgagcaacaacaggtcacatattttgccaacatgttgtgctttcacatcagcacattctttgaggtccaaaacccgcagtancttatactcggcataattcaaattagcttgatacctgggtgacatttgtatcatcagggaatactgccagagtatggagacgagataactcctttggcaaattcagtggccanttgccgcacatttagatggngggaaagcg

SEQ ID NO: 89646 - DNA, 486 bp, Triticum aestivum
  unsure (1)..(486): unsure at all n locations
  Clone ID: PAT_TA_89646
aaatcttctacgtacaattgatgggaagctagcatacttagattttggaatgatgggagaattccgacaagaactccgtgatggatttattgaagcttgtctacatcttgttaatcgggattttgatggtttagcaaaagattttgttactcttggtttgcttcctgcaactgctcagaaagatgaagtgacaaaggcattgacaggtgtatttgaaagtgcagttaacaaaggagttcaaaatataagctttgggagatctgtcagggaatcttggggcaaacaatgtataaattcaantccagatccttcatactctcccttgtaatccgaatccttgctgtcctggaaggattgcaacagcttcaacccaactacaaancttgagcattcatacccatggattgcaagaaaagtctcactgacaancacctaacttcgtcaaatggtcacctactttataaggagggacttccanatgaccgt

SEQ ID NO: 89647 - DNA, 498 bp, Triticum aestivum
  unsure (1)..(498): unsure at all n locations
  Clone ID: PAT_TA_89647
ggcaagtcaaccacgactggccacctcatctacaagcttggaggcattgacaagcgtgtgatcgagaggttcgagaaggaagccgctgagatgaacaagaggtctttcaagtacgcctgggtgcttgacaagctcaaggctgagcgtgagagaggtatcaccattgatattgctctgtggaagttcgagaccaccaagtactcgtgcactgtcattgatgctcctgggtcaccgtgatttcatcaagaacatgatcactgggtacctcccaggctgattgtgctgtgcttatcattgacccaccactggtggtttgangctggtatctccaaaggatgggcaaacccttgagcacctctcccttgcttcatcctggggtgaagcanatgattgctgctgcaacaagatggatgccacatcccaaatatcccaagcccttacgataaatttcaaggancnctcanacctgaagaaggcgttacaacctgacaagntccn

SEQ ID NO: 89648 - DNA, 467 bp, Triticum aestivum
  unsure (1)..(467): unsure at all n locations
  Clone ID: PAT_TA_89648
cacacactcatgcgtcttctacctccgtacatcatacctctgcacatcattacgccatggattcatcaccccttggcgcgtgtttctagctgaagggagcggcgaggccggccggtagcaccgcaacccacgctgctgtccgacaagctacaagcgggtcgcgagggtgctacaaccgctggccacagctgctacaaccaccggccatggatgatgcagcgacggttgcgagatggcatgattgtgcaaccggagatcgcgtcactgttgccggcaaggacgcaaacctcaaagtgggaagctgcaaccggctgcgctgggctggaanctgcaacaatgttatgcnggccgtgaaccggtaacttcaaantncancggcgttgcggtnggccgcgttgttctntaatgacaaacccngnaacaaggttgctnaacntttggcggagggntttaacttctgcggaggg

SEQ ID NO: 89649 - DNA, 479 bp, Triticum aestivum
  unsure (1)..(479): unsure at all n locations
  Clone ID: PAT_TA_89649
cgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagcccgaaatgtggcgcttgcgcggatatgaaatccaccgtccgacggcacctgcggtggacctggcaagaanactgatcgggtcaatgccnggatgatatttccgcctaaaataaataaanctccaggcnanataagnaangtaatctggctaagcctntgtgtnttggcaaanatgcttaancaantngtcggccttcgtcgcggttttcccccccccanaaanttggggttncttggt

SEQ ID NO: 89650 - DNA, 513 bp, Triticum aestivum
  unsure (1)..(513): unsure at all n locations
  Clone ID: PAT_TA_89650
aactatactaaactaaaaacaaagaaaacttttttgcatgattcaaatgaaaaatctttctcaacgattcctattctactaacaagagtagacatgcaaaatttatttgttactgaagagaaaaccgttccagctgttcctgaatagcttccttcaaaaggatttccgcttgctcggtgaatgtcttgctagaagatataatttcttggaattgaggtttaagtatcttttagatgtttacgtaactcatccaagaaattatttacctgttcaattctaacgaatcaagatatcctcttgttccggtataaatagtagctatctgctcttccactggggagaggattgcctggggatgtttaancaatcccttaacgtcgacccttgccaattgatccgactggtttatccgagagcagagngaattttgcaaaggttgtaccctgcgaattgagtagtccaattttaattggccagctactggtcaaggtttaattgancgcggtcctaccc

SEQ ID NO: 89651 - DNA, 532 bp, Triticum aestivum
  unsure (1)..(532): unsure at all n locations
  Clone ID: PAT_TA_89651
cgagttatttggttgctgagtagatgactctgatcagccacattaagtactgatcagtggtctaactgcattagcaacactttactgaaaccaagataatgcccttggaggatatgattatgctccatttcactagttggcaaaagatgatgcatgtctgcagttccgcagggtgattaattctagactgaagaaagcaaggaagtgctcaagaattaccatcctcaagagccagcagcttgtgctcctcctccagcatcttctcctgcggtaaatcacaaaggaggagcatgatcagatttctttgccaataaaaagcagtctttgcaaatcctccttcaaagaaacccccatggtgtacagaaggaaatgcaaagagcagtggtaaattttanggccatacatcctccctgtgcatcttccaatgngccatctgcaacaaaggagacggaccaacatcaggagacagacaacatattccacnaaacaaagatgaacacttgcaantccgattttgtncaccaacatgcat

SEQ ID NO: 89652 - DNA, 519 bp, Triticum aestivum
  unsure (1)..(519): unsure at all n locations
  Clone ID: PAT_TA_89652
cgactatgtgtgggtccacgactaccacctcatggcgcttcccaccttcctccgccgccgcttcaaccgcctccgcatcggcttcttcctccacagcccattcccctcgtcggagatctaccgcaccctgcctgtccgcgaggagatcctaaaggcgctgctcaattgtgatctcattgggttccacactttcgattacgccaggcatttcctctcatgctgtagtaggatgctgggaatccgaataccagtccaagcgtgggtacattgggattgggagtacttggccgcactgttgggatcaaaacatgccaatggggaatcatatggattcaattncaagcggttctgtgctgccggacaggaattggagatttcccgagctgcancacanttntagggnaaacgtgttgcnccgtgttggatgatatgacactttaagggatcaatccgaactcctgccttttagaaanctnaggaccacccaagtggaaggacacattttgggcaatncaaaca

SEQ ID NO: 89653 - DNA, 521 bp, Triticum aestivum
  unsure (1)..(521): unsure at all n locations
  Clone ID: PAT_TA_89653
cttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggtcngttatgtagcttatccattagacctatttgaagagggttccgttactaacatgtttactccattgnnagtaactatttgggttcaaagcctaanngcctacgttggaggtnctacgaatccccctactatcnaaaatttcnangcccgccaanggnaccaanttgaaanagatacttnacaagtagggcccccttttg

SEQ ID NO: 89654 - DNA, 267 bp, Triticum aestivum
  Clone ID: PAT_TA_89654
ctcgcctccaccagccgtggcacccgagctccaacgcctccgcgccgccgggaaacgcaccaggaagggacgccggaggaggatccttccctcgtcgtcctccgcatctcgctcccgtccaacgcgagcacccctagccgtcttcgtagaacttccgcagcatgtcggcgtcaaagcggcggcgggggggctctcgccgcaggcggccgcggcgctccaggagggcatcgggcttgtgttcgggcggttgggacggcgctgcagatg

SEQ ID NO: 89655 - DNA, 529 bp, Triticum aestivum
  unsure (1)..(529): unsure at all n locations
  Clone ID: PAT_TA_89655
cggcaaccaggcacagtacagcagcgcaccggacgtcagtggcaactcatcgccagcagccgccagtgtttgtcgagggtggcggtcaccactcatcatctgctctcaaggcgtataacgcgcacacgacccaaggaacaaatgcagccggcaccatggcatcactgtcggcggcagcggcaggggcgccgccgccggcaatgtttcggtcgacggcctctgtagcctcgctgagctccacgacctcgacagaggaggatggcacatcgctctaccaccaccacctcaaaggacacaacaacccagcagtaatgcaactgcattcttccaacgcacgccacgctgctcaacaccaattcctcggcaatgggcgacatcccgatncgatgactgancccggcgattgggcctacagccaacttcaaacctaacaagccaacggngcactgcaagcctttgcttacttccctancttggagaaatntgggacggaacctctcctaagaactcccaaagttgcacaactcan

SEQ ID NO: 89656 - DNA, 323 bp, Triticum aestivum
  unsure (1)..(323): unsure at all n locations
  Clone ID: PAT_TA_89656
ttctcctccccttccggttcgggttctggttcggttcgggttcggttcgagagagaggccgagtagctancctagtctagggtttcggtagaaaggaagtgacatccatggcggngacngagtaccgctgcttcgtgggcggcctcgcctgggccaccgncgacancaacctcnagcaggccntcagccantacggcnagatcctcgacnccaagatcatcaacgancgccagacggngaggtcccgtgggttcggcttcgtcacgttcggaagcnaccgantcgntgcnctcaanccatcgaggcanangaacggtanggag

SEQ ID NO: 89657 - DNA, 413 bp, Triticum aestivum
  unsure (1)..(413): unsure at all n locations
  Clone ID: PAT_TA_89657
tcgagttttttttttttttttttgattgaaaggtgattctattgattaaccccttaacagggcacttgaatcaaggcatataactacaccaattgcatggtaatcaactgaaatgccagatcaatactatcttatctaaacatgagtataagctctaagaagacagcaagattatcacgtttttcttgtttgacatttgagctaattngaaactaaccaaaacatcaaagagcagtagccaattgntccaaactaactaaccaaacagtnacccgaaataaggtccatgaccaagtnnaacaattntgagcaaatngaacttgtaccaagtntaactncaccaacaacgggacattccngtaccngaaaagcaccacaaattcccaaaaagtncaangggccaacacaagggg

SEQ ID NO: 89658 - DNA, 266 bp, Triticum aestivum
  unsure (1)..(266): unsure at all n locations
  Clone ID: PAT_TA_89658
ggttctggttcggttcgggtccgagagtanctancctantctagggtttccgtagttcgganaggagagaaagggagagatccatggnggacacggantnccgncgcttcnnggncggcctcgcctgngccaccgacgaccacaacctccagnaggncttcagccacgtacggtgagatcctcccacgccaacatnancancgaccgcganacnggcangtcccgtggattcggnntngtcaccttcnagcanctangagccgctt

SEQ ID NO: 89659 - DNA, 564 bp, Triticum aestivum
  unsure (1)..(564): unsure at all n locations
  Clone ID: PAT_TA_89659
tttttttttttttttttgcaatggacatgcccttttttagttcagttcagtacagctgatctatcttctgtatctgcattcaaatattagttgctcaggcaatgctctaaagttacttctgctacaaagcggattgctggagacgaaatagtcagaatgaatcaagaatcagctgtccatatgatgatgatgaagcatatcaaacctttacaaaagaatcagtacagtttgctaaattcagtctcaggtgccgggaccnnangcccgggggaaagtgtgggattccctctcaaagcattgtttgcaatgagtccatcaccctttacgacagatgcccacaggaatggtgcaagagcaaaaccataagcgacgacaacanaacctcngcgatgccgtcanggtaccatgggaatgccatgacaaagacatcccaacatcccaagcagcaatgancacggaagccgtgggagcaggatgcattgatacacgattanaagggagggcaccaacaggtcatggccaacccatganggatnacgggcagggattcaagacggatgttng

SEQ ID NO: 89660 - DNA, 220 bp, Triticum aestivum
  unsure (1)..(220): unsure at all n locations
  Clone ID: PAT_TA_89660
ctagtctcgagtttttttttttttttttttgnacagagaaaacagngntccatttanataaccangaccncttgtttgcacaantanganagatatggggtgaggtccaagcanatccacaagcggcnagcgactaattaacncataggncacttcaggggngnanatttccgtatttcacanctctgantcggncaaccanatgcaagatttgcantcg

SEQ ID NO: 89661 - DNA, 539 bp, Triticum aestivum
  unsure (1)..(539): unsure at all n locations
  Clone ID: PAT_TA_89661
agaaaccctagcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaatttgctgcggttccatctggtggtggtggtgtggctgtttcaagctgctgcccctgctgctgggangtgctgctgcccctgcaactgagtcaaaagaaagaagagaagncntggagaaggaagagagtgatgatgacatgggttnatctgttcgactaattttggggaacttgtgtcngaantncaaccttggccaagaacagntcaatgangtttancttattactaattgtgaanncggaaaaattttgaaagtatnaacccnggttcggttattnggtg

SEQ ID NO: 89662 - DNA, 468 bp, Triticum aestivum
  unsure (1)..(468): unsure at all n locations
  Clone ID: PAT_TA_89662
gtcggagatgtcggacaccgatgagcaccacttcgagtccaaggccgactccggcgcctccaagacctacccgcagcaggctggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggtatntcaancttctcaactgagatgggancactaaggatgacctgaacttccaacngaatnattnctgcttggcaatttnaaacnggtttgctaatggaangnctnatccngccntnattccncatgggtaaaaaaattttgcctttaaggaaccgggg

SEQ ID NO: 89663 - DNA, 471 bp, Triticum aestivum
  unsure (1)..(471): unsure at all n locations
  Clone ID: PAT_TA_89663
gatgaatgctaggtatttttttagaagattggtagtgtttatatgcacattagcgtgatcccatggatcgatcagccagaaatagcgaccactatcaagcgacacgcgcttcgagctaaacaagtcagcatcctaatcgtaagccctactctcatgtacacaaatattacatcactaaacatcttcctttgtttcctgaatctccttgatcaccacactgtcatgtaggtgcgacgagcttcactgctaatcaccctcaccagtcaccactgtggcactgttttccgagcctgggacggccggccaacgcgagagcttgggaagcacgccnaagcttcaagcctcgccggctccacattaatcttcaattgggaccttcgcaatttctcgattcgtcgcggtaccaccctgggccaatgggttccaattgggcggacggatcaggcatcttgggcggcgaaaccggcggca

SEQ ID NO: 89664 - DNA, 452 bp, Triticum aestivum
  unsure (1)..(452): unsure at all n locations
  Clone ID: PAT_TA_89664
gcaccacggagcttcgtcgccaccggcgtcgagctcgccgccccacctccttctgtcgctgggaatggacggatccggtggatcccgtccagatccgcggctctccgcaggtcccgacgcaccgcgccgccccactcgccggacctcttcacgccgccggcctcccctgcctccgcgcgtgagcgcgaggacgacgccatcggtcgtcgccgaccacatgggccacaaaccgccaaggcccagctctgccagccaccggcctcgctcgcctctccatcagccctgaccacaccgcggcccagcgtcaccagtgcccaccagattcagccgacctacgtgagcctccccagctgcagcccacttctccaccgaagccggccaagtgccgtgttccggtatgttncgatggtnaggatccttcgacgctcccgttgtcttcttaanggactcgt

SEQ ID NO: 89665 - DNA, 317 bp, Triticum aestivum
  unsure (1)..(317): unsure at all n locations
  Clone ID: PAT_TA_89665
gttcccggtccggtcccgttccgttcgttagggtttagtagtagcggggaagaggaaggaatggcgggcgtctagtaccgctgcttcgtcggcggnctcncctgggccaccgacgaccagtccctccagaacgccttctccaagtacggngacgtcatcgactccaagatcatcactgacagggagacgggccgatcccgcgggttcgggttcgtcancttcngcntcttntctangcgatgcnccangcgatngangccatgaacngccagganctgnacngccgtaacattacttcaangaggancagtcccgtc

SEQ ID NO: 89666 - DNA, 316 bp, Triticum aestivum
  unsure (1)..(316): unsure at all n locations
  Clone ID: PAT_TA_89666
ggctagcgaaaccaaggagttgaccagaagaacacaaaggatttccaagaggatcgtgcagtgcaacaagggatcaatgacgttgtgcgccgatttcgatgcgctccgggcgtcggcggcggacgtgcggatcgtcacgtcggacggacagagtatcgcggctcattcctgcgttcttgcctcggcgtcgccggtactgggagcgcatgatcgacagggcgccggcgcgggtgggggcgccgattgcaccatccgcgtcctccggcgtctcctttcgacgccgtccngcgccttcctccatttcctcctactcccc

SEQ ID NO: 89667 - DNA, 298 bp, Triticum aestivum
  unsure (1)..(298): unsure at all n locations
  Clone ID: PAT_TA_89667
aaaagacccagcaccatcggcgcaggcggccgggcgatttagatttgctttccccccttcgcctcctgcgacagatcggggatggccgcgcggtctcgggcgcgccgcctccngccgctgctaacttncgccgcctncggaanggcctnggntncctggttcaactnacaattttccnnccggttnantattaatcccaaanngggnaatttgatnatgatnaagangcaacaaattttcnacntggatacntnaagcctgaaatttnaanntggaanccccgaaaattttttcaaaa

SEQ ID NO: 89668 - DNA, 445 bp, Triticum aestivum
  unsure (1)..(445): unsure at all n locations
  Clone ID: PAT_TA_89668
ctccgaccgcgtgctctacctcggcccgctctccggcgacccgccgagctacctcaccggcgagttccccggcgactacggctgggacaccgcgggcctgtcggccgaccccgagaccttcgccaagaaccgggagctggaggtgatccactgccgttgggccatgctcggcgcgctcggctgcgtcttcccggagctgctccgccccgcaacggcgtcaattcggcgaggcttgtggtcaaggccggtcccagattttcaagcgagggcggctccgactacctcggaacccagctgggtgcatcgcaaagatcctttccatctgggctgcaagttggtgctgatggggccgtttgaggtacgcgttngccggcggccgctggcgaatttntngaccgtctaccccggcgganttcacccctngctcgccnnagaccccagcttt

SEQ ID NO: 89669 - DNA, 466 bp, Triticum aestivum
  unsure (1)..(466): unsure at all n locations
  Clone ID: PAT_TA_89669
ctctctctgtttgctctcgcgtccgccgcgcccatcctcgtccgcgcctgcgcccggcccgtgctcgctcgctcgccgcctccctcgcctcgatccaccgcgccggcggcatggcggatcagctcaccgacgaccagatcgccgagttcaaggaggccttcagcctcttcgacaaggacggagatggttgcatcaccaccaaggagctgggaacattatgcgttcgctggggcagaaccaacgggaggctgactccaagacatgatcaatgaatcgatgctgatggcaacggacattgattcccaagagtcctcaacctgatggccgcaagatgaagaactgatcanaggangantcaaggagcttcaggtgttcgacaagacaaacggttcanctccnctgctnactccgccatttatgacaactccgttagaactacgacnagaagtgacaaatnncgttaacc

SEQ ID NO: 89670 - DNA, 454 bp, Triticum aestivum
  unsure (1)..(454): unsure at all n locations
  Clone ID: PAT_TA_89670
gtcgtttctctatatgggacggttgctcgaaggatttggtgttggcgtcatatcatatacggtgcctgtatacatagcagagatatctcctcagagcacaagaggagcccttggctctgtgaaccagttgtctatcacccttggtatcttcttgggcctatgtgctaggcatgtttgttccttgggaggttgctggcagtactagggaccttgccttgtacattgttnattcctgggctattcttcatccccggatctccaagatggctggcaaagattaacttnacggatgatttccgaactctcctcaanttttgagggtttccgagaccgacataacagcggaagtnaatgatataaagagagtgttacanctgcaaacaaaangtacgtcgttttcaaagagctgaatcaaaagaataccaatcccttactaataagacgggctgctagt

SEQ ID NO: 89671 - DNA, 448 bp, Triticum aestivum
  unsure (1)..(448): unsure at all n locations
  Clone ID: PAT_TA_89671
ccagcacgatgtggtcaagggcgacccgttgagctacgacgaggcgcctacctcgtcgatcacagagctgcgtcgagcagaaacagaagaaggagactcaaggcgcaagaganagccggcggccaagcgggcacggtgcaccaacgccaagacccttggggggcggaatgggtcaagtgttccccaggaaagangaaangaaaagagaaggatgcntcctanactaatccgcaccgtntttaanttaattttanctcaactgggattggtgcgttaaccttggatccactagcgtccntgactnccaccctnccttggnttccggtcccnactgatttcaatnatttttcccnagttccngtggaattgcncacaagtgttgtccttgccttgcccccttngctaaaccccggaagggtccntttcttttgaantccggtttcaattc

SEQ ID NO: 89672 - DNA, 158 bp, Triticum aestivum
  unsure (1)..(158): unsure at all n locations
  Clone ID: PAT_TA_89672
ctcaaanaaagccctgctgcgcctgctccgatcgccgcgaggaaccagcgagagaccccggagccagaggaggagganaanatgagctantataaccagcatccacccgtcggcgccccgccgccgcanggctacggggacaangcnggctacacacc

SEQ ID NO: 89673 - DNA, 483 bp, Triticum aestivum
  unsure (1)..(483): unsure at all n locations
  Clone ID: PAT_TA_89673
atccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtgggagaacttccgcgcgctctgcaccggcgagaagggcgtccggcaagagcggcaagcactgcactacaagggcagtcgttcacgcgttgattccccgacttcaatttcccanggcggngacttcaccaaagggcaacggnacccgcggcganccatnctacggngagganttgcccaaccagnatttnntccacaagaaancaagccggggatcttttccatggcnaggcggcccaaaacnacgncccatttttcatctnacntcccctgcatttgttnaacggaaannttncttcggcaagcctccaangcatgac

SEQ ID NO: 89674 - DNA, 329 bp, Triticum aestivum
  unsure (1)..(329): unsure at all n locations
  Clone ID: PAT_TA_89674
agagagacctagtctcgagttttttttttttttttttagttcaagcaagtacataataccaccaaaatgtgaccaaccatcaggatacatccaataaaaggtttttagctgacataattccatacaaaaatttattctcagaagaagaggctttgaacaccctctggggcaaaccactctcccctgtacctcaagcctctcattacttggngctgtgcangtnacggtgaagnccaacacccggtnctgttncccacccgttgccgtnccaagaganaagctttacaaantttccctttaaaagaanccccggctttgaaccaaaattc

SEQ ID NO: 89675 - DNA, 484 bp, Triticum aestivum
  unsure (1)..(484): unsure at all n locations
  Clone ID: PAT_TA_89675
gcggtggcggcctctcaccccgtctccgccatgatggagctcggggaaggcctctgcaagctccgccgcctgcgcctcgaggacgacgacgacnaccaagggcccttctctcgattccgggatgaggtcgccgccgtgctcagcttcctctaccgcacccagaaggagcttgcggcatgtaacgacgagctgtgcttggccatggatggctccgcgacctccgtaccagctgctcggcgactccgcttccgggcagcggctgtaccggcagggagtcgacgccggacggcgtccccgagcatcctcttctccggccgcgcatccggcgactactcgcttctccatgcacggtgaacttccntcgctacacccacgggagcacatctcaacggcgcttcancgcgcgcacgatatcctacttgttcattttggtggtaactcgtatccatccttctgnatactttctaaattgtccnaatcggan

SEQ ID NO: 89676 - DNA, 552 bp, Triticum aestivum
  unsure (1)..(552): unsure at all n locations
  Clone ID: PAT_TA_89676
atcacccttgaggtcgagtcgtctgacacgatcgacaatgtgaaggccaagatccaggacaaggagggaatccccccggaccagcagcgcctcatctttgccggcaagcagctcgaggatggccgcaccctggctgactacaacatccagaaggagtccaccctccacctggtgctccgcctccgtggaggcatgcagatctttgtcaagaccctcactggcaagaccatcacgctggaggtggagtcctcggacaccatcgacaatgtgaagaccaagatccaggacaaggagggcatccccccggaccagcagcgcctcatctttgccgggcaagcagctggaggatggccgcaccctggctggactataacatccagaaaganctacctccaactgggtgctcaagntccgtnngangcatgcaaattttcgtcaagacctcaaccgggaaagacatcacttggaggtggancctcggacacatcnacatgttaaggaaagtcaagataaggagggatcctccggacaacangctcatctcgccggaag

SEQ ID NO: 89677 - DNA, 552 bp, Triticum aestivum
  unsure (1)..(552): unsure at all n locations
  Clone ID: PAT_TA_89677
gtcatgatgatgactactatattggtgaccatcataatgcttctgatatggcaggtcaacatcattgtcgttctatgctttctcaccctcttcctgggcctggagctatttttcttttcttctgtattgggcagtgtagcagatggcagttgggttcttttggtgtttgcggctgtactgtatctggtaatgtacatatggaactatgggaccaagttgaagtacgaaactgaggttaagcaaaaactttcgatggatttaatgatggatctaggctgcaatctcggtacagtcagagcgcctggaattggattgctttataatgaactggtgangggggttcctgcaactttggtcacttcctgaccacaatgccagccattcattcgatgatcatttttggtctgcatcaagtgggttcctgttccctgtcgttcctcaagaatgaaaaggttctctttcgcngggtctgcccaaagaactacaaatgttcgctgcaatgcnagtatggggacaaanattaccaagagaacccaaacattgaacagtctg

SEQ ID NO: 89678 - DNA, 549 bp, Triticum aestivum
  unsure (1)..(549): unsure at all n locations
  Clone ID: PAT_TA_89678
atttttgctggcaagcagctcgaggatggccgcacgctcgctgactacaacatccagaaggaatccacactccacctggtgctcaggctccgtggtggcatgcagatcttcgtcaagaccctgaccggcaagaccatcaccctggaggtcgagtcctctgacaccatcgacaacgtcaaggccaagatccaggacaaggagggcatcccaccggaccagcagcgtctcatctttgctggcaagcagcttgaggatggccgcactttggcggactacaacatccaagaaggagtccacacttcacttggtgctccgtctgcgcggtgggcaataagtcctgggcatggatctgcttctgtctctggggttcacaagtctcgttgtcctcggtgtcctccaatggagtctggccgtgtccgttgatcctgaacgtctttgtttgtatacatatacgggatcatgttacgtttgtatccgcaaattctgctngggtgcggaactttgatgaactaagaataangagcctggatccgtcaanaatctgtttgn

SEQ ID NO: 89679 - DNA, 545 bp, Triticum aestivum
  unsure (1)..(545): unsure at all n locations
  Clone ID: PAT_TA_89679
ggagacaggcagacatgtccacatgctcacacatgagataaggagcacccttgacaggcacactattttgagaactacgcttgttgagttgggaaggactcttgggttagctgaatgtgccctgtggatgccatcccgctctggaacagcccttcacctgtcccatacaatccataacagcgctcctattggcttagttgttcctatcaatcttccagttgtttcaaaggtttttaataagtaatccgtgcagaaagcattccacatacttccccattgggcttcaaataaaggcagacacaagcaggtatgttgccaccagaggtccgtagctgtcccgagttccactggctgcaccttacaatttccgaaataaatgattggcctgagctatccgcaaaaagttcncataatggttttgatgctgcctccagacagtgcaagaaatgggntncccatgattgggnttgttgaaattgttgccgntcaagggggaattgcacgtccaagcgcaatttggaanatcatgagggccgtgatnaacn

SEQ ID NO: 89680 - DNA, 410 bp, Triticum aestivum
  unsure (1)..(410): unsure at all n locations
  Clone ID: PAT_TA_89680
cgacgctgaacatctcctccttgcccgccctgccgcccaccgggcccaagccacggtccagggtgctggagatcgtgctgcccatagcgtcggcgacggtggttctggccgtcggcatcgccgcttacatcttagtccgacggcgactcaggtacgcggaggtccgggaggactgggaggtcgccttcggaccccagcccttctcctacaaggacctgtaccaggcgaccaaggggttcagcgagaccaacctcctcggcgcgggaggctttggaagcgtctacaagggcgtgtcctcaagcccgacatggacacggagtgncgtcaaaccggttttccancaantccaaggaagggaatgaaggattcntncccgagggtccccaacaatcnnccnggttgaacaaccg

SEQ ID NO: 89681 - DNA, 531 bp, Triticum aestivum
  unsure (1)..(531): unsure at all n locations
  Clone ID: PAT_TA_89681
ccgtcccgtccccagccaacctcccatccccgtctcgcgtcgcagcggcagttccactccctcgccatgggcaagattaagatcggaatcaacggtttcggaaggatcgggaggctcgtcgccagggtcgccctccagagcgacgatgtcgagctcgtcgccgtcaacgacccctttatcaccaccgagtacatgacctacatgttcaagtacgacaccgttcacggccactggaagcacagtgacatcaagctcaaggacgacaagacgctgctctttgggcgaagaagccagttaccgtcttcggcgtcaggaaccctgaggagatccgtggggtgaggctgggtgccgattactttgtggatccaacggtgtcctcactgacaaggacaaggccgctgctcacttgaaggtgggtgccaagaagtggncaactctgcccaaacaaagatccctangtttgtgttggngncaatgaggaaattcactcaaacttaacatgtctcaatgctactgcacactactgccttg

SEQ ID NO: 89682 - DNA, 545 bp, Triticum aestivum
  unsure (1)..(545): unsure at all n locations
  Clone ID: PAT_TA_89682
ccgtctttcactttattgcttactaaatctgtcccacacttatgtattagcatcgatctattacatctttttaatcaatgactacgattagaaaaaatatcatagttgttccacattgttgcacacatacatccttgaccttacaataaaatatcatcactttatttaaaacatactaacaaaatcaaattactagtactacttttacgcaaaaaaaatttactactacgacttatcatcttcatgtaatgttaggagagtctgaacaacagattccatggtcgacctctttcttgtatcttcctccaaacaagaaacgaccaatttattaatgttctagcctgcacatagctgaattgcccacccaatttgcagtccacaaattcatcgattcaaagattcatcacttccntccagtttatccggcaagcattgtcacaagctccctgagcacatgtgcactccgcatccggaacggangncaacccgatatctgctccaagataaaagtcaaggaagcagacccgtagcttacacgtcgactt

SEQ ID NO: 89683 - DNA, 539 bp, Triticum aestivum
  unsure (1)..(539): unsure at all n locations
  Clone ID: PAT_TA_89683
gtcacctccatcctcgccgcccaccccaccgagcccgtgcgctcattcagcacgtacaggctctccttccgccgccaggacgaggacgccgtcgacggctggctccgggatctggccaaccgcggcatcgaaaaactcgttctctacttcaacgagaagcggcagcagaaggtcccggaatccctcttcgcctgcgcatccctgaagcgcctcaaggtgattaacggcaccttccctgacgccaccgaggccgccgcatccctcgccgtcctcgccaagatcgacctgtccgacgtcaagatctccgaggactcgctgaactccctgctctcgaactgcagggcgctgggagcgcctgaaagatcacttccatcagcaagtgcgancgctccatattcgatntccggagcctcaaagncctgaacacantggcgacttcnangnagtcttcaatggacgacgctcccgactggagcaagtctccggtatacctgaaagcaatcgncatatcaagattgngacgtccaaagcngggtttt

SEQ ID NO: 89684 - DNA, 441 bp, Triticum aestivum
  unsure (1)..(441): unsure at all n locations
  Clone ID: PAT_TA_89684
ttaattcaanagttatagggagggacttatgtcaccacaaacanaaactanagcaggtgttggntttanagctggngttaaagattataaattgacttactacaccccattagtatnaaactaangatactgatatcttggcagcattccgagtaagtcctcagcctgtggttccgcccgaagaagcaagggctgcagtagctgccgaatcttctactggnacatggncanctgtttggnctganggacttaccagtcttgatcgttacaaangactatgctatcacatcnagcctgttgcngnggaagacaggccaatgngtctgttatgtaancttatccattanncctatntgaaganggnccgttaccaacangttnacctccattgtaggtaacgtatttngtttcanatncctacgtgctctancttttngaggt

SEQ ID NO: 89685 - DNA, 552 bp, Triticum aestivum
  unsure (1)..(552): unsure at all n locations
  Clone ID: PAT_TA_89685
gtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaaagacagccaatggatctgttatgtagcttatccattagacctatttgaagagggtcccgttactaacatgtttacttccaatggtaagtaacgtattggtttcaaaagcctaacgtgctccnacttgggaggatctaacgaattcccctactaattcaaaaactttccnaaaggcccgcctcaatggtnccaagttnaaaaganataattngaacaantaggcctcctttatgggatgtnctaattaaaccaaattgggattaccccaaaaatnn

SEQ ID NO: 89686 - DNA, 442 bp, Triticum aestivum
  Clone ID: PAT_TA_89686
acaaaacaacccttttattatcaaaacaaagctggaaagttacatggcttatttgcagagttgtggttacactagagccgacgcacctcaggtcaaataagaagatgaatgaacatagtactaaagaatggtgacacagaaccaaagaagcaaccataagaaacaaaattgtgagtagtatctctgatctaggctagctataataactagtatctaaaactgcgtctatactagcttcaatagcagcagcctgggtagtaggtgccgcgagatgaaaaacacttgggccttgtgcttggggagagtgagagacacttgcggtgtgttgaaaacccatgaactgctgcctcctgatttccgggcttgggattcgggagacggcggccggtgggggtggaaaaggccaatgttatgcaaccggggagacagctgatcttgccgg

SEQ ID NO: 89687 - DNA, 390 bp, Triticum aestivum
  unsure (1)..(390): unsure at all n locations
  Clone ID: PAT_TA_89687
cttgctagtgcgaccgagctctggagctaggtatcctatggttccaaccacatgtgtggtttgtgggttggcgccgcggtcatacaaccttgccagtccgaagtcgccgagtcgaccattcatctcactgtcgaggagcacattactggctttaatgtcccggtgtatgattactttctcacactcctcatggaggtagagcaaccccgaagcaattcccttgatgatccggaaccttttgtcccaatctagaaccggcttctcaccatcgccatacaagtgcctatcaaggctcccatttgacatgtactcgtataccaagagcaattcanctttagcctggcaataacaatgtaactgaccanatgcaatgttgtagtccgccaatng

SEQ ID NO: 89688 - DNA, 393 bp, Triticum aestivum
  Clone ID: PAT_TA_89688
tttttttagaaaggaaaacctgccgtaatagacatattgaattaatgttcgactatatgccttattaccccgacttccaaccttcatcgttatgtctcctttgattctctcttcgtcgcaaacaactgaagatgttgacgcaccttgtgaattttataagtcacaatgatgtgcaatactatctgagtaaaggccttaaatgccaggttgcaacattaatgcgcagtttttggctagtagaactctaagggggaagaatactcaaatacctatcgcaattattccagcaaaatttcccatagggcattctctttgaaatagtcatggtgtataatgttgaccaaccacaaatcttcataaactccctccagaaattctcgactcattttacca

SEQ ID NO: 89689 - DNA, 487 bp, Triticum aestivum
  unsure (1)..(487): unsure at all n locations
  Clone ID: PAT_TA_89689
cctgtctcgtcctcgtcccccgtcccccgtcccctcgtcggcgcccgatctaagtcaagatgagtcgtggcgggagtgctggaggtggtcaaagttctctgggttacctgtttggagatggtgagcctgcaaagcctgctgcagcaccagctgcgaagccagcacctgctgagaaaccagcactgggcagctgccgatgtaaccaagcagattccagctggcattccaggtagccgggcgaacaactactaccgtgcagattgccagaacacgggcaacttccttacggactccttcaaccaagttcatgctgctcccggcggttgtcctccctntggtactnttttggcgggaagtgatctccgtttatgatgcttcgattaatggcctgtactctgttatccatgttggtgaaaactggaatgtttnggttcaacatttacaactgcgtcnatttatcctgtccgtatggtattttccaagcnac

SEQ ID NO: 89690 - DNA, 489 bp, Triticum aestivum
  unsure (1)..(489): unsure at all n locations
  Clone ID: PAT_TA_89690
gagaactagtctcgagtttttttttttttttttatcaggcattattttctttcttttatttgagagaaaaagtatcagtcactctttttccatctctagcttgttctctttagagcaactcttgcaccgtcccctcctgctccggcatcaaccattctactccctccgttcggaattacatgtcgtagaaatggatgtatttagatgtattttaattctaagatatatccatttccgagacaagtaattcgggaacgtagggagtatgtctttagagctctccttctccccctttccctccgtcaggccgacaaagaccggagtggggacttccaaggcatctttccttcataaccaagtacagctacggcaagcagacacgcgcaaccggcaccctgatgctttggcgaaatcgcttgctctttgcataatttggacacatactttaattttgtcagcggtataatgccaaggaacantcctcacatg

SEQ ID NO: 89691 - DNA, 510 bp, Triticum aestivum
  unsure (1)..(510): unsure at all n locations
  Clone ID: PAT_TA_89691
gctgccgctgcgtctcgtctccaccaccccacttgcccccggactcaggaggatcgtcggagatgtcggacaccgatnagcaccacttcgagtccaaggccgactccggcgcctccaagacctacccgcagcaggccggcgccatccgcaagggtggacacatcgtcatcaaggcccgtccctgcaaggttgttgaggtctccacctccaagactggggaagcatggtcacgcaaagtgtcactttgttnccattgacatcttttatgggaaagaagctttgaggatatcgttncttcatcccacaactgtgactcccccaagttttaccgcccaagattatcaactnatttacataacttatnatngtatttcagcttccttacttaagagtgggaacacgaaaggagacctgaacttcccacttatnatttctgcttggccagtttaagactggtttgcttatngaagacttatcctncccgtnattccgccagggttaaaaaaatct

SEQ ID NO: 89692 - DNA, 496 bp, Triticum aestivum
  unsure (1)..(496): unsure at all n locations
  Clone ID: PAT_TA_89692
attccccatccccattcgagcagaccaggcgctgcaagacctaattttacctctgaatcgagctcgcggccggccggccggcgtcgtggactccagtccagatcgatctcgcttgcctcctccccgcagtccgcacctcgcgcaatggcctccagatcgagctcctctcctagggtttgagtcgcctcactcaaccaagccgctcttccgcttcacgccgtaatcccacgggagcacgcagaatcgaaggaacacgcccgcgttgccgccgttgctcgccgttgctcgccgccgccggaccctccttctctggcgcgtccagtctccgaggttcactgggactcgacggagcacgatgtccggacagganaggcgcgacctgctcgaggacctgcccgaggagatcatcaacaagatatcgtcctgttggggtcaaaggactcggcgctgtcggttgtgaacactatgggcatgcaaatcacactgnatcatgccg

SEQ ID NO: 89693 - DNA, 503 bp, Triticum aestivum
  unsure (1)..(503): unsure at all n locations
  Clone ID: PAT_TA_89693
attctacaaaaaagcactgacttttatgtgtaaagaaagaaatggaaatctataagttcatacagggacatatatatggtgaacttgcgtccagcacacgagcatttgcttccaccactaaaggcatttgtatccggcacatgagctacatgagctacatgctcaacagttgcacactgccgccatggacatgcacaaatgatattaagtagaagtttgttagttcagttttttattgatttaccttgtttaagtaatagtgcagcaataaaggtgtagttgtacagagtttaagttgctatatggggaacccataggcatttattttggtttacattcagcttgtgtgttcctttcatctgtagcttaatgtgcataaaagngtagtctataacaagggcaaaantactgggtcaacaaaaacgaaatgctagttctcttttaagtgattttaattctcccccgcgctctttgtgatgctctggcaaaagatgacatagtng

SEQ ID NO: 89694 - DNA, 494 bp, Triticum aestivum
  unsure (1)..(494): unsure at all n locations
  Clone ID: PAT_TA_89694
cgacctcctactccaacgagctcttctctctcacggctgctccacaatttcatcagtcagtcgccacatcaaaaatccagctgacacagtaaagaccaccggtctgtactctgtactcgagcccttctctctcgcaacagctccatcgagacttcaagatacagtgttgatcaaaccaatggccgccaaaggcagcgatggtatttgcgtggcccagccgcggagtgctgacccgctcaactgggggaaggcggcagaggagctgtcggggagccatctggacgccgtcaagcggatggtggaggagtaccgcangccggtggtgggttatggagggcgccagcttgaccatcgcccaagtcgcggcggtngccgcngccgacgtgccagggtgaactcaagatccgcccgcggancgtcaaggagagcagcgactgggtcatgacaacatggcgaacggacgacactatgggtcacacggtncggngcactcc

SEQ ID NO: 89695 - DNA, 510 bp, Triticum aestivum
  unsure (1)..(510): unsure at all n locations
  Clone ID: PAT_TA_89695
atttattcgagatctggtgtgcgcttagcagtttacatagactgaccgtactccaccagatgaaaatatgaaactccccgtcccacctctgcagcccctcaaatcacgttaatctaaccatctaaccaactcgcaaaaaaggaaactcaacctaattgtgtccctcgcccctctccctgcctttcatcgccagccctgcactgcatcgacgcctccctgcacggcgacttgatccctgcatcggatcgtcgccgcctgccctgcaancggntcgtccgccgccctgcactgcatcgacgcctccctncccaggtcccttgtcgcccttgattnagacgntccanttgggcnggcgcccttctnaacctacaatcaaatatcacagatttgggcaaggctacaacaagactattatgcacatctgctccagtttggagcttcaagnagcccatcagtttggcaagtttgattccgcgggcaaatgggaaccaactacaagatcaactcacc

SEQ ID NO: 89696 - DNA, 509 bp, Triticum aestivum
  unsure (1)..(509): unsure at all n locations
  Clone ID: PAT_TA_89696
ccgggatggtgggcatgtacggaggggcgcccatgggccacccggtcgcgggccacatggtccccgccgccgtcggcacgccggtcatgttcccgccgaggccgggccatccgccctacgccatgcccgtcggctacccggctccgcatcagtgagcatgccatgcttgctctggttcgtgtgcgcgcggggcacgccggcatgcgcctgatcaagcgcctcgacgaaccgcacacacaagcatttcttccttgttctttcttgattgattcgttttgcgttgccgtccgttcctcatctgagtgcaaggatgacgccggcgaataagtaanaatgtanttgctgactggtgcaantgctaccttatatacgatcacagacccgggaaaggtcaagantgttaatgttattagcaacggccccccgatgttaactttcaanaatgccacactgcgactgggagacgattccattnaccggatgttaaaaaaanaaaaaaaanggggggc

SEQ ID NO: 89697 - DNA, 510 bp, Triticum aestivum
  unsure (1)..(510): unsure at all n locations
  Clone ID: PAT_TA_89697
cagcgccggaaccattatattgcagtcgaggcccgcggacggcgtcggtgccgtggcgttgagatcgccaggcaccttgagatatatgcttccggggaacgccggcgaggtgtagccgttaaacaggaggcctttggggtagcacctgccctggccatccgtccggtaggagaaggcgatgcaggaacatgtattcaagcaagatggtcttgcagtattgggaacgtgacggactgggttgaaccccgaggtcgtaaccgtagaatccggtgtaggcaccttgaccaacttngaaccgctcccggcgccacggtccgctgcaatttggcggtgaacccgggcgcgcaangacaccgggagggacggtggtactcgcagatggcgttcttgcccgcacaacccgttggacgggacacgctgcttcaacgccgccaagtgacgtccatcctccggcggctccaagctttcatctcaagttccttcctgctcnaaggtaanctctcttggggc

SEQ ID NO: 89698 - DNA, 461 bp, Triticum aestivum
  unsure (1)..(461): unsure at all n locations
  Clone ID: PAT_TA_89698
gaaatctcgagttttttttttttttttttttagaagaaaaagtgactggcctaaaagtaaattttaggtgacttacatatagcaaaactgttctagattactgcaagaaacagtgtctctacattgttaagtagaactgctaatctaagctactgcaccagaaggtaggtcgtgctccaagaatactacagttgattgagattcatgtcgaagcagaaattgtcaacatcagctgtactggtggtcaccagcgtgctccagccttggatagttgtcggcttgtccgatacttgcggtgttggctgccgacggtgcatgccggcgggcgccgcttgaccgttgccggaagtattgangggccggcgatcgaaagacttaatgccccgtgctgatgttagancggnacacgctgattcgttcctgaacctgaaagnccgtcctccggtgtccgtcgtcntgtc

SEQ ID NO: 89699 - DNA, 418 bp, Triticum aestivum
  unsure (1)..(418): unsure at all n locations
  Clone ID: PAT_TA_89699
gtaaaggtctagagttcacgccagtccaaacatcatcatagtaatcatggtgtccctctatgaatcaagtattccagtcttcatcaagaatcttaaggttcttgcggccctactcgccaagggctccgctcattcaggcgttactgaaaaacagctactggaaagccgtcttatttcaagacatgggaaacctcatctaccanattcaaagagttccggatacctccaagggctcgccctttngcgccgcttaggttganctgtcccccttgaggacaaagagaccaccatggnaagaattacaaactccgaattgagccgttacaaccacgatttttgaaagcgtgaaagagtgtactttnttggcaaaaaatcaaaagntatataccttncaaccgaccaaggacttaaattacgg

SEQ ID NO: 89700 - DNA, 421 bp, Triticum aestivum
  unsure (1)..(421): unsure at all n locations
  Clone ID: PAT_TA_89700
atcccacctcacatcccatctccccacacgctcgaaccaccagcagcagcagcacccatggcacccaaggcggcggagaagaagcccgcggagaagacgacggcggggaagaagcccaaggcggagaagcgggcgccggcgtccaaggaggccggcggcgaggggaagacgaggggcaggaagaagggcagcaaggccaagaaagagcgttggagaccttcaagatttacatcttcaaggtgctgaagcaagtgcacccggacgttgggatctcctccaaaggcatttcatcaataatccttcatcaaacgaattcttcnagaagttccccggganttcggcaaacttggccgctncaacaaagaanccacatcacttccgggagtttnaaacttcgttcggctctcctcccccggggaat

SEQ ID NO: 89701 - DNA, 484 bp, Triticum aestivum
  unsure (1)..(484): unsure at all n locations
  Clone ID: PAT_TA_89701
cgtgccacctgcccccgcccaccttcgttggcgcgcccttccctgccccagaccggcgatctggacggactgccccgccacccagctgccggcgcggatctttgcacacgaccctcctcgcgtggctgccgccacggatccggtcgcgtcgtccaccatcggccgcatctcccttcccttcctcagctaccagatcgagctcgtgtccaccccccacgactcccagcagacgccctcccgcaccgcccagcctatggatccaggccgcgctggcctccccgcggtgcgctgccgccggattcaaggccgcgccgatctctcgcgccgcctgacgccgtattcangtgcagatgccccttcctctcctcccaagccggcacctgcaagacgccctccctgtcaacangcggctctctccctgcaaaatcctccggggaggcaatacagtcatcccggcggtcattgattttcnaaactactgaat

SEQ ID NO: 89702 - DNA, 517 bp, Triticum aestivum
  unsure (1)..(517): unsure at all n locations
  Clone ID: PAT_TA_89702
tattctcctgatttcttcgccttccctttcctgctccgctgccccagccctttcccgatccccttttcccattcctccaagcggccggattccggccagattcctctccgcagcttcttctccttccaattaatcccttccttcctcacatgctccagcctccgccctcctctagctcgttttttgccctctctcctaccttttctccagccttctccttccccgacttttccttgcccaaggctccttcccgatccgtctagcttgcttccttctttagcctgatctcctgcggtncttcaacggatggcgctgggttccctcggtctcgatncgggtggatttgggaaaggattgagaaaggcggacgatgaaattggncngtactcaacgggttaagaagcgatgcctgaaaanttccgggctaaagtagaacgttcctcgaatccggnnantgggggtttgctggtacggcggaagctcanaagggggtgtggttgtnaanttggccggggat

SEQ ID NO: 89703 - DNA, 493 bp, Triticum aestivum
  unsure (1)..(493): unsure at all n locations
  Clone ID: PAT_TA_89703
cttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatgggacaactgtttgggactgatggacttaccatccttgatccgttacaaaggacgatgctatcacatcgagcctgttgctggggaagacaaccatggtncngttangtacttatccattagactattngaanaggtcccgttacnaacatgttaattccattggnngnaactatttggttcnaaaccctacntgcncaacnttgggggntntacaatcccccacttatcaaaanttccaaggccgctcatggatcaagtnnaagaaa

SEQ ID NO: 89704 - DNA, 408 bp, Triticum aestivum
  unsure (1)..(408): unsure at all n locations
  Clone ID: PAT_TA_89704
aaaatgcgattacgaacaaaatagtggagagtgcatcaaagctcgaccatttcctaggaggccttccaaaggaaattaatgttgatagagtcgctgctatgaatgtgacatttgttaatgatccacgcttcattannttcctctgttgagtttgatatagatggactatttattccatctgataaaactgctcctcaagagtgatataaatttcggtgataccaaacttgcaccancccttgggcagctcctccaaacatgctgtgggtttcattgggacnaagatgttttcaactccgtttcaactctccnacttcnaaggctggttaactacaacattttggtgncaaggtcccgattaattcctttttgacactgctanctggagtttttggatcccaaggtgtc

SEQ ID NO: 89705 - DNA, 489 bp, Triticum aestivum
  unsure (1)..(489): unsure at all n locations
  Clone ID: PAT_TA_89705
gtggtgggtgaccaagttcgcgccgctgctcaagaagctgtccaactacgaggtgatcaacttcgacaaggaggaggaggtgcactgcttccccggaggccagctcgggctgtaccgcgaccgcgacctcatcatcggcccgcacccgacccgcaacccgcacaactacaccatggtggactacaaccggttcctccgccgcgcgttcggcctgccgcgggacgccccggcggtgctcggcgagaagatggcgtcaagcccaagatgctcaagatngaacgcaaggggaaccccaagtgctcaacctgcgcgccntgnaagcctctgcnaangactccgttcaaggtaacnnttgcggaaggccgggccaanttcgcncttcncccaaaaggtcaagcccccaacttgtcctaattgnaacgggncccggctgacaacaantttcctgccaacgggggccttctgncaatntttcttgggaaaatgann

SEQ ID NO: 89706 - DNA, 486 bp, Triticum aestivum
  unsure (1)..(486): unsure at all n locations
  Clone ID: PAT_TA_89706
gtgacacaagttcttgcaccgatcagatccaacttctgcgcaagatgctggacaagctgtgggacgacgtggtggccgggcctcgcccggagacgggcctcgacaagctccgccgcgccgccgccacccaacccctcgccatcaacacagctgcaggggaggcgattaagcagtcgccgtcgatgccgacgaccccgaccacgccggtgacgccgtcgtcgtcgacgccgccgcgtggcggcagcgtgtggcggagcgttttccaccccgggagcaacctggccaccaaaagctcggcgccaacctcttcgaccgcccgcagccaactcccccaccgtctacgactgggctttacagcgacgagaccaggacaaggagcaacaccgcttaataagagcgacggcaaagatttaagacaggaantctgcaagccnccttttgctgtcnttgggtatctanctgcanacgtngtnctgtctgaggtgn

SEQ ID NO: 89707 - DNA, 516 bp, Triticum aestivum
  unsure (1)..(516): unsure at all n locations
  Clone ID: PAT_TA_89707
ctacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaaagacagccaatgggatctgttatgttacttatccattagacctatttnaagaaggttcccgtttctaacaagtttacttccattgtaggtaacgtattttggtttcaaaagccctacttgtncaacntttggaggatctaacaattcccccctacttntccaaaactttccaaaggcccgctcaaggtacccaagttgaaagaataatttnacaattaggncctnctttaatggganttctnattaaccaaaattgggatatccgcaaaaatatggtnaacntngttngaatngccacttgggggnnt

SEQ ID NO: 89708 - DNA, 502 bp, Triticum aestivum
  unsure (1)..(502): unsure at all n locations
  Clone ID: PAT_TA_89708
aatcccctcccctcccgcgtcccgacgagcaccagcggccagacatggacgcctcagccaccggagccgggcgaaaggggaagaaggggcgcggccgggcgcaaggccggcgggcccaggaagaagtcggtgacgaggtccgtcaaggccgggctccagttccccgtcggccgcatcgggcggtacctcaagaacggccggtacgcgaagcgcgtcggcacgggcgcccccgtctacctcgcggccgtcctcgagtacctggcgcggagctgctggagctcgccgggaacgccgccaaggacaacaagaatcccgcatcgtgcccaaggcacctgctgctggccgtnaggaacgacaangagctcggcaagtgctggcggcgtcacatcgccaaggcggctnctgccaacatcaacccgttctgtcccaanaagangngganaaggaccaanttnccaanaaacgcaattcccaanaggcnacaanaagntttancaacaca

SEQ ID NO: 89709 - DNA, 281 bp, Triticum aestivum
  unsure (1)..(281): unsure at all n locations
  Clone ID: PAT_TA_89709
cccgccgccacccgccccccctctcgatccttccgtctccgcccccaccccacccaccttcccgttttaagcgtgcgtgcgccctcgcccccctcccccggttccttcgctgcttcgctcccgcttcctantcctcntcctctcctcaatcnccgcnccgcncctcggatctgcncgccggangagcccgccgnccnactccatggctcggccgctcggcctgngtctcnccctctcnctctcntctccatgtnancaccntgcttnctcttgcnanatcc

SEQ ID NO: 89710 - DNA, 503 bp, Triticum aestivum
  unsure (1)..(503): unsure at all n locations
  Clone ID: PAT_TA_89710
gcacagcttggtcctgttggttgggaagttgcatcgaagcgaattgaacaggtcattccccctggaacagcatttggtcgcgggtgggtaggagatagcgaatcaccaaactcatttcaagccacctgtaccaacttcatctccgataccaacaccaccaccaagcagcacagcggcatcgagtgagcaagaaaactgtagatgatcctgcaagcgcaagccattcaacagggctcatgcagatgctgtgtcacatgcgtctgccaataacgctcaagaggatncgatctcaaagcaattaccaagccgcatgtggttcgtttgacgcaagtccaagtanaccgaggtgaaatcccttnaactgnaagacaaccatatgttntnaagaacggccaccatcaccaaacgtgaatggtttnaagctgttccaagncaacatgtttgcactacgccaactggtcccgaaccggngcaaaccatatggcgacgataaanacaactcn

SEQ ID NO: 89711 - DNA, 542 bp, Triticum aestivum
  unsure (1)..(542): unsure at all n locations
  Clone ID: PAT_TA_89711
cacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaaccaccgtcgacggcacctgcggtgggacctgcaagaanactgatcggtcatgccggcatgatatgttccgcctaaaataaaataaaagtcaagcgagatgacagcgtcatcgtgcctatgcgtgtgttttgtgggcaacaatgcttatacagtantcncnctcgtcgctgtgtttctctctccnagaaatttgngttcttgttgttcaactatccggatacctccgtngataacactttatgatgtgctggtgcaataatagagtccctggcc

SEQ ID NO: 89712 - DNA, 534 bp, Triticum aestivum
  unsure (1)..(534): unsure at all n locations
  Clone ID: PAT_TA_89712
gcaaatcttcgtgaagaccctcaccgggaagaccatcactctggaggttgagagctccgacaccatcgacaacgtcaaggccaagatccaggacaaggagggcattcccccggaccagcagcgcctgatctttgctggcaagcagctggaggatggccgtaccctcgccgactacaatatccagaaggagtccaccctccaccttgtgctgcgcctgcgtggtggcatgcagatcttccgtgaagaccctcaccggcaagaccatcaccctggaggtttgagagtccgacacaatccgacaatgtcaaggccaagatccaaggacaaggagggattcccccgggaccagcagcgcctgatctttgctggcaagcagtggaggatggtcccacctcngcagactacaacatccagaagganccacctccaactggtancctcttcgcngtggcattatgccctgtctttgactgctggttancctggtcntccngtgggcggtgccttcgtcaataaaatgtttctcnttcgtgt

SEQ ID NO: 89713 - DNA, 527 bp, Triticum aestivum
  unsure (1)..(527): unsure at all n locations
  Clone ID: PAT_TA_89713
ctccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgagaagggcgtcggcaagagcggcaagccactgcactacaagggcagctcgttccaccgcgtgatccccgacttcatgtgccaagggcggcgactcaccaaagggcaacggcaccggcggcgatccatctacggcgagaattcgccgacgagaattcgtccacaagcacaccaagccgggatctctccaagggcaacgcgggcccaacacaacgtccaattcttnatctgaacgtccccctgcaattngtcnacggaanacttgcttcggnagncctccaaggatggactcntcaanaatcagaaggnggtccccaacggactgtcaaacaatctcatc

SEQ ID NO: 89714 - DNA, 526 bp, Triticum aestivum
  unsure (1)..(526): unsure at all n locations
  Clone ID: PAT_TA_89714
ctgcgacgaggcgggccgtgcccggggtctggatgcggcgcctcggccggatctggccctgtggcagcgagggccgcgggcggccacctctgccgggtcctccctgcctggtggaggtgggagatggtggtgcgtgctggtggtcggggacggcggctgcgactttggcggcggctcggcccgatctgacttctcagcggtgcgggcctcggaaggcttgggctgcgggcagccgcctcgaccggggccatgtcggctggttggggtggcggcgcagtagcggtggttcggccccctctcctgatgcttggggtgcttgnagctgtngtccggaggcgttgccggaggttggagcacggtggctcaacgctcctcgtctttgggctggcacgtgttnggggcctccgggggttggcaagggtgctccggtttttcttgccnanggggtggcaacgcggcccggcccggtncanaaatggnaagtggtgcggcttnccggnaacgccgtgcttccctgcccgttaac

SEQ ID NO: 89715 - DNA, 503 bp, Triticum aestivum
  unsure (1)..(503): unsure at all n locations
  Clone ID: PAT_TA_89715
gtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaaanttgctgcggttccatctggtggtgggggnttggctgtttcaagctgctgcccctgctgctggaggtgctgctgcccctgcagctgagtcaaagaaagaagagaagcgntgggagaagaagagagtgatgattacatgggttcatcctgttcgactaagttgtgggggacttgtgtctgaanatctatccttgggcaagaaactagancnatgattttaanctttattaactaattgtgaacactggcaaacaattttttatn

SEQ ID NO: 89716 - DNA, 492 bp, Triticum aestivum
  unsure (1)..(492): unsure at all n locations
  Clone ID: PAT_TA_89716
ccccatccgatctcgccgggaaacctccgatccaagcgaagccaaggctttctcgtcctcctcctcaagatgcagatctttgtgaagaccctgaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctgggctgactacaacatccagaaggagccacactccaccttgtgctcaggtccgttgtggcatgcagattttcgtcaagacctgaccggcaagaccatcacctggagtcgancctctgacacatcgacaacgtgaaggcaagattcaagacaaggaaggatcccccggacaacactctcactttgctggnaanagtcgaggatggcgcaccttgctgactacaaatcagaaggancananccacttgtgtcaagtcg

SEQ ID NO: 89717 - DNA, 481 bp, Triticum aestivum
  unsure (1)..(481): unsure at all n locations
  Clone ID: PAT_TA_89717
cctcgaccgaccgaacgacaaggccctctcatcctcctcctccaagatgcagatcttcgtgaagactctcaccggcaagaccatcacccttgaggtcgagtcgtctgacacgatcaacaatgtcaaggccaagatccaggacaaggagggaatccctccggaccagcagcgcctcatctttgctggcaagcagctagaggatggccgcaccctgggctgactacaacatccagaagganccaccctccacctgggtgctccgcctccgccgggaggcatgcagtttttgtcaagacctcaccggcaagacatcacttggagtggancctccggacacatcgacaagtnaagggaaaattcaagncaaggaaggatcccccggacaacaacgtcngattttggcggcaanaatcaggatgcgacatggtnactacaaatcaanagancaacccactggggnaagccttgagaanantttctn

SEQ ID NO: 89718 - DNA, 486 bp, Triticum aestivum
  unsure (1)..(486): unsure at all n locations
  Clone ID: PAT_TA_89718
cacacaagaagctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaaggccgccggcgccaccctcctcgtctccgccaccgccacccacaaggcgagctccggcggcatggatggncggncggagaacggcggctgcggctgcacccagtgcaagtgcggcaccaagctgcggtgctcctgctgcagctgctaatttgattatccgaccatatgcatgcaccgtccgtgcttcatcatcgattatatccatttactactaccataccatttaaccgcaactgattcgaaggcttatctatcacctgactngatcaacatcaagtgccatccatgattgtaaacaggccccctaataattcccctgattaaaaaaaaaaaa

SEQ ID NO: 89719 - DNA, 486 bp, Triticum aestivum
  unsure (1)..(486): unsure at all n locations
  Clone ID: PAT_TA_89719
gtcattgatgcccctggtcaccgtgacttcatcaagaacatgatcaccggtacctcccaggctgactgtgctgttctcatcatcgactccaccactggtggttttgaggctggtatctccaaggatggccagacacgtgagcacgccctccttgctttcactcttggagtgaagcagatgatctgctgctgcaacaagatggacgccaccactcccaattaccaaaaggcgccgttatgaagaaattgtcaaggaggctcttcctaccttaaagaagtcggtacaacccttacaaggtcccttcgtccccatctctggttttgagggtgacaacatgattaagaagtccaccaacttnactggtacaanggccaaccttcttgagngcttgacaanttaacgacccaagagccttaagacaaccctcctcttccctccaagactttacaaattgggggatntgacttccgtttgccttttaaacgg

SEQ ID NO: 89720 - DNA, 485 bp, Triticum aestivum
  unsure (1)..(485): unsure at all n locations
  Clone ID: PAT_TA_89720
ctccgtcttctatcttccagctgtctttccaacattcctttgtgccgcttctcttcgccacgctgctcccgctccagttcgacactgtctacctcttcaaccttattccatccatctccctttgtcttcatccaacctctcgtcaagtctctacgactattccatctcgcaccgatccacatttagtcaatttattttctcaacttcattccgcgggcatcatgaaatctgcancttctccttagctgccgccgcctcgctgccatagctccggccaaccccaccgcacancatccgacacatggctcagcacacaagcgtgacggtaacacaccgtcgtctgggcaacaagccagaggcaagtatcgattcacaacacgtttggtaacaactggctgaaaccgaaccgatcgangttaaccgttccgcgttgtggccctggctaaccacgaaccatcaatntaactgaccacggggttcttctg

SEQ ID NO: 89721 - DNA, 503 bp, Triticum aestivum
  unsure (1)..(503): unsure at all n locations
  Clone ID: PAT_TA_89721
aagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccaagctgcggctgctcctgctgcagctgctagatccatcatccgatcatgcatgcaccgtgccgtgcgtgcacatcgatcgtatccatctactactaccatacatgttaccgcaactgatcgaaggctttangttcgcactgactgcatcaacatcaaggtgccatccatgattgtaaacangccccctaaataaactccctggattactaaaagggggggcccgtaccattccccta

SEQ ID NO: 89722 - DNA, 509 bp, Triticum aestivum
  unsure (1)..(509): unsure at all n locations
  Clone ID: PAT_TA_89722
ctctatcgtccatggactgctctagttccaaagagacgccaccgcacaaggcgtggtggaccggcgagacggtggcggtggtgacgggggccaaccgtggcattgggcacgcgctggccgcgcgcctggcggagcaggggctgtccgtggtgctcacggcgcgggacgaggcccgcggggaggccgccgccgccgagctccgcgccaggggtctcccgtccgtgcggttccgccgcctcgacgtcaccgactccgcctctgtcgccgccttcgcctcctggatccgcgacgatgtcggcggcctcgacattctggtgaacaatgccggggtatcttcaacgagnttacaccaactcggtggagcatgctgagacggtcctcangaccaacttttanggagccaaaatgctcatcgangcgctcctgcccttttccgtcgatcctctgggacaagcggatctgaacctcagtccaacttggcntctcatgnanctatcatgctgttagtn

SEQ ID NO: 89723 - DNA, 490 bp, Triticum aestivum
  unsure (1)..(490): unsure at all n locations
  Clone ID: PAT_TA_89723
ctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctctactgcctcgagcatggcattcagcctgatggccatgatgcccggtgacaagaccgttnggggaggtgatgatgctttcaacaccttcttcagcgagactgggggctgggaagcacgtcccccgtgctgtcttcgtagatttccgatcccactgtgattgatgagtgaagactgggcgctnacgccagtcttccacctngagcaacttatcatganaagaagatgtgnnaaaattcccccgtngcattacacattnncaangaatgttatcgtgccttgaccnttcaaggaactttcaaacnctgcactgggctccaaggatccttgtctcaagctttng

SEQ ID NO: 89724 - DNA, 484 bp, Triticum aestivum
  unsure (1)..(484): unsure at all n locations
  Clone ID: PAT_TA_89724
gggggagccagcggggaccacgcagctagccgccggcggcgggaactttctcccgtctgtcgacctcatgggggatatcaggcatgagcaacccactcgcggccgagctgagcaggcagtgagagcgacgagggagatcgacgccgacgacgatgagggcggtggcgatcgcgagccccggcgggccggaggtgctggaggagcgcgaggtggaggacctcgcggcgccgggggacggcgaggtgctcctcgggttggccgccgccggcgtcaaccgcaccgacacggtccagcggcagggcggtaccggcgccgtccggcgcctcgccctacccgggtcnagtgctccggtccatcctcgccctcggggcaacgtcaaccgcgctgggcctccgcgacaagtgtgcgcgctgcttaacggcggcgggtacccgagaatgtgnntnccggcggnctgctctccgntgcngagggtgtcgctgan

SEQ ID NO: 89725 - DNA, 481 bp, Triticum aestivum
  unsure (1)..(481): unsure at all n locations
  Clone ID: PAT_TA_89725
cttaattcaagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttgggactgatggacttaccaagtcttggatcgttacaaaggacgatgctatcacatcgagcctgttgctggggaagacagccaatggatctgttatgtacttaaccattagacctanttnnaagaaggtcccttactaacatgttacttccattgtnnggtaacgtattggntcaaaagccctaagtgctcnacgtttggaagatctacnaatcccctacttatcaaaaactttcaanggccgc

SEQ ID NO: 89726 - DNA, 481 bp, Triticum aestivum
  unsure (1)..(481): unsure at all n locations
  Clone ID: PAT_TA_89726
ggtgatcaccgtgaagacgggcatggagtagaagaggagccagaggaggaggaggagacggccggcggctttcccgaggtgaagcggttggtgaacagccacacgctggccgacacgaagaagctgcagctggacggcggcgcgcggctgcggccgcgacgcnaggaggaggacggggacagctgccggttcggcgcgtcgacgctgacgagcgagtcgacgtccaagagctcggtggagtggcagagctcgacggtgacgaccggcaaggacgcctactcggacctcttctcgtcgtcgtcgcgccggagctcggcgaggtgggagtcctacacgctcttccgcaagtacgacgaggacatggtctacttccaacgcgtcggcgccanaagctcaccgagacanatcnttaagtccatnaagtgccaaccgcgtccatgtccaacgtatnacgcacaagctgtcatggcggcccaaggct

SEQ ID NO: 89727 - DNA, 442 bp, Triticum aestivum
  unsure (1)..(442): unsure at all n locations
  Clone ID: PAT_TA_89727
gtgcatcaataccttgcagagctgctccatgttcaaaggggccaaggctgaggccaggaggggcagagccagcggcggcgggagcttcgggtgccgggcgtccacattcatggatggaagcgggctccggctcgggctcgacgagaaccccgacgccatcatctccggggagtggccgaagaactctcccttctcagctacaacnactccgcgcgtacttcatcccagcaacagcaacaacagcatcgccttcccangctccnattaagnaacgggggccgctnctgcgccaaggcatttcnaccccgttctnatngcacagcggacaagccttgtgaggttnaaacacttcaacttgtgtcaagctcccgttttcaaaagccttgcaaatcgtcnggtcacctcnaagcattccttanggtcaaaaggtcaaaanntttat

SEQ ID NO: 89728 - DNA, 474 bp, Triticum aestivum
  unsure (1)..(474): unsure at all n locations
  Clone ID: PAT_TA_89728
aacaaatcagttttgtacatatcattacatcgccatgaggatggaagcttctaccctggaactggagcagcagacgaggtgggagttctggatggtaaaggattctcggtaaatataccttggagctgtggtggcgttggagacaatgactacatctttgcttttcagcatgtggtgcttccaatagctacagaatttgccccaagacatcaccattatatctgcaggtttggatgcancaagggtgatnctttgggttgttgtgatgtcaccctgccngataccccaagatgactccatgttaactgcttgctcaanaagaaaatgttgggtatactttanggaagatacatcctccgtccaaatcctcatctgcaactgaagttgtcaaagtcccactcccgggacgtccaaattatngacaaatgcaacaacacatccaaaggaggcatcagacgtcctanaantctggaa

SEQ ID NO: 89729 - DNA, 452 bp, Triticum aestivum
  unsure (1)..(452): unsure at all n locations
  Clone ID: PAT_TA_89729
gaagagaactggtctcgagtttttttttttctttcatgttcctttccgtgtgcaggttctttgttgattttgttggatgtgtgtgctgtttaccaacaaggagcttcagaagggttgctcaccaatgaactagaagattgttttgtcctgggcactcacatgattaaggaagaaatgggtantcctggatgtgctatgcantcaaaaggtgagtcatccnatttcctttcttcaanncttaccngaaagattatctcccggttcccttgcattttcaagttgggtccttaaggtaaagttccaactaacttaaaanccggttcancancnttgccnttnngtaaaactgaacggggatttccccgtccttaaaatttttaaaaaaaatttnaatcccngccnattctaacgaatcaccggnaatgtttacattaaattttcacaagggcaan

SEQ ID NO: 89730 - DNA, 454 bp, Triticum aestivum
  unsure (1)..(454): unsure at all n locations
  Clone ID: PAT_TA_89730
ccatggtttcctggccgccagtgcaccaataatagggttgccgtgctcccttcgcccatatatatccaccctcccgctttgcagctgcactgatctcacccacctcttccccccgccaagagcagcagcgaactgtgaattctagctctgtagcagctcaagatcgggcttgctagaaaaagcattttgagtctcttcccaaccatacaggctacagcaacaccatggcggcatcagtagcctgcgccttcttcttcgacgcccgagccggtgggcgagccgggcatcccggcgctggacgccttccgcgtctgcgccaagcccgctggnaccgacacgactctcaagttacaagggggacacncctatgcaacaaggattccggacnacaaatnactcgaccctttccgccaagcaagcgccggaggtgcacgnctctcnggagaaatccggg

SEQ ID NO: 89731 - DNA, 396 bp, Triticum aestivum
  unsure (1)..(396): unsure at all n locations
  Clone ID: PAT_TA_89731
cacccattcccctcgccgccgccgccactccgccgccgccgccgccgagatgggtcgcgtgatccgcgctcagcgtaagggtgcgggctccgtcttcaagtcccacacccaccaccgcaagggccccgcccgcttcaggtcgctcgacttcggcgagcgcaacgggtacctcaagggcgtcgtcaccgatntcatccacgacccggggcgtggtgcgccgcttgccaaggtgaccttccgccacccgtttaaggtacaagcaccanaaggagtcttccgtcgccnccnagggtatgtacaccggnanttngtctacggcggacgccgcgcnacctctcctttggtaantcctcccgcttcgctcgtgccttagggaggttcntntnaacgtncaag

SEQ ID NO: 89732 - DNA, 238 bp, Triticum aestivum
  unsure (1)..(238): unsure at all n locations
  Clone ID: PAT_TA_89732
cgggagcgcaaccctgaaccgactgccggtccacctcacgtccggccggttcgtcgccgtgtctccgacgccacttccctccctccctccctcntcnanccggatnnggctcnccggcaccgcccatggcgtcctcctcggncctgctnacgggggaacgcctcgtcgtcttccncttcgccgcgcgcgncncgctcgccgcnacggacggcctcgcggcgccgatcgcgctcgncgc

SEQ ID NO: 89733 - DNA, 189 bp, Triticum aestivum
  unsure (1)..(189): unsure at all n locations
  Clone ID: PAT_TA_89733
cagaagccgacgcgcacaggcagcagagccagaccacgcgagcgcagccaaaggaaggaaaatggccacggccctctccctcggcggtgccggcgccggngccgcngggnanctcctccgcaggcgccccgcctccgtggccaggtgctgcgccncgcnccgncgcanctccccctcgcgccgccgggt

SEQ ID NO: 89734 - DNA, 513 bp, Triticum aestivum
  unsure (1)..(513): unsure at all n locations
  Clone ID: PAT_TA_89734
ctcacttccaacccactaatcttcctcaacctatctaccgtgaggacataagacttgttgctccctctgaggaccacacatcaaaagatagacgagaaaagccaaacaataaggtctttgcccaagactcagcacatcagattccagaaaaagaacaaagtacacccgaagagccaaccgaaagaccaccatccaacaagatgggttactatgacgatggccactgcgaatccggaggttctgctgagcctgctttcactcacaacactgtgacgattccatgtcaccatattcgcgttgggtgatctacttatactccaaggcaggccgtgccaggtcatacgtatttcaacctctgggggcaactgggacaacaccgctatcctggtgtagatttaatcacaaagcaacttcatgaggagcctcccttantctaaccaagtcctaatgttgtcggtcaanactatgctccggccaatcttcaaacaatacagagntctcgatttacaggag

SEQ ID NO: 89735 - DNA, 464 bp, Triticum aestivum
  unsure (1)..(464): unsure at all n locations
  Clone ID: PAT_TA_89735
cacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtgggtgtcgacgagccccgaaatgtggcgctgcgcggatatgaaatccaccgtcgacggcacctgcggtgggaccctgcaagaagtactgatcggttcatgccggcatatgatatgttcccgcctaaaatttaaataaaaactccggacganattaacaacgtcatcgtgcccaatgcgtgtgtgtgtggaccaacaaatattttacaagtatgtcgngtcttcgtcncgggttttctc

SEQ ID NO: 89736 - DNA, 532 bp, Triticum aestivum
  unsure (1)..(532): unsure at all n locations
  Clone ID: PAT_TA_89736
gatcaagctcatctttcttgaactgatttctggaaagacaggagatccacggtgagtacttctgatcttataatctttttgttggcagtcgagtcgttgttgctagccgtgattttcaccgactcaaaaatctagccaatgttctcaggttgattaccacggctgcttgttcctcatagttaaagtggcttacagatgctcttcttgcatcatcgatagctgcgtgttgggttccttttggacattcatccaaatgcatgcctgatgcatcatgacagctctatgtttactgtttatttgcttcaaacttattgtacgtagtactaatgcaaccaagcgcgtgttgagttttgaggaggggatatgtgtatgcttgctctgtttcataacatttccctgttagctgacattcctgttttgcaacgttttcccactaagcaagggcggtcctgagattctggggctccggggcgagattagnatcaanggccttaatataacatcaaaagaaatcatatatgtaatgtgaacc

SEQ ID NO: 89737 - DNA, 552 bp, Triticum aestivum
  unsure (1)..(552): unsure at all n locations
  Clone ID: PAT_TA_89737
ctcgtgccgcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgncgtctgcgacgacgcccaccccaagtgtccccaagggctgctcggcgtgccgcgtggtgtcgacnaagccccgaaaanttggcgctgcgcggatataaattcaacgttcgaacgggaacctgcggtgggaccctgcaaagaagtactgatcgggttcatgccggcatgatatgttccncctaaaataaataaaactcangcgagatgagcagcgtcatccgtgcctagcctgtgtgtgtggccaacaatgcttatacaattatgtcgtctcttcgtcgctgtgttttctctctccgagaaaaanttgggttgcttgttgttcactatccggatacctccggtgaataaacagc

SEQ ID NO: 89738 - DNA, 497 bp, Triticum aestivum
  unsure (1)..(497): unsure at all n locations
  Clone ID: PAT_TA_89738
ctctctaatcgttgaagatcaatcgtatcacacgctaagagtttattacaattctagcaggggactactgaaccgaagctcaaacaattttacttgaacgaaccaatggtcgatnaaggttngaanttctcgggtctgaaccctgaacctggaacttcaangatttaaagcggctagaaatncgggaggccctggggnaaagggttgcaaccanaggganaaanttgaatggnctncnttgaccgccnggggnangccgcctcaatcgtcaactggtcgtantactcctcccgggctgaaagaacgcactcggcgcccggggccgtcgaccaggcacggcaacgccccatgcaggaacgcgtcgccctccgacctgatccaaccggccgccgtctcttctctgtcaacagcttctctgggcatgtacttgaagacgtcttcctaagtctccttcgntatgttgcactgagacanaaccgagcttnacgccggggcan

SEQ ID NO: 89739 - DNA, 480 bp, Triticum aestivum
  unsure (1)..(480): unsure at all n locations
  Clone ID: PAT_TA_89739
ggatccgacctccacctacccgtggcccctgcaacccaccgcccccaccccaccctatccaactaccttcatcagtaccgccggactcgatgcgtgccccatgccgccccggatcctaccgaccgtcgccgacatctctgctccactccggcgcccaacgcccagtccgccgcgcccgggaatggatccggccagctccgcctttggcgctcctccggcgaccacggtgctctctcgacgcctgacttccttaccgtgcgccgccccttctagcacctgatgcctggccatgggtcctctctttaccaagctctcactgtttcctaccttgctggccccgggacaacgtgaagctctctcgggcggattcatcagctactgaatcccgcgccgggcgaatggattggccgcctcccccggaacaacccaagcgggattcgggccgctngcccgggggccaanttcccttctctccccggg

SEQ ID NO: 89740 - DNA, 489 bp, Triticum aestivum
  unsure (1)..(489): unsure at all n locations
  Clone ID: PAT_TA_89740
tgaaaatttcaaggtttcatcagcggtgatccagtggaggatccgccattcgactatactcctcacagccctttcatggctaccactttaccagctatagggatttattgcatacatagtgtaacataatacacagaagaagcgaatatcgagtgaaccaatctgataagatatgcttgaatcacttttgtagaaagacatatgtttgtactggcttagcatctaactataaattaagaattttcctggagttggcgggcttctaacaggctctgcccctagagaagctccacccttggttatgtatcatgcatcgttgatgatgatctccatagacgatatgatgggcatgatgatgagcctagtgaatggataagtcaggggtattacataactcagatagtacttttatttagattagatggcttaactcatgtggtaagttttgaattatgcttctgttccttcccaattgagcttgtgttcang

SEQ ID NO: 89741 - DNA, 466 bp, Triticum aestivum
  unsure (1)..(466): unsure at all n locations
  Clone ID: PAT_TA_89741
gcattattcaggaccaatttcttgcgaatttacaccaggattgaagagcaccacgagagaaaaatggccggacaatctgatggcgttggcgtaactgactagctcctctgcctgtggaagcatttgagcctcccgcagagcatcaccaggacaagaaccaccttcccctggtcgctccaccacccggagaagctgtacggcatgtcctggcagacgctttgcttctccgggtgcggcagcctcgcgcagctgtaaccgatggacagtcctacgttcctatacgcgcttatgacctcgaagatcatgttgaatgtggagaaattgaaganggtcngcggagagcgatctcctctcggtgatgcaagacaagcattatcagcaccgcgggtgcaagctagtgggtgaaaacagcattttattcagtgacagtcntctctgtttgcccatccttgggttctgtgatgcc

SEQ ID NO: 89742 - DNA, 486 bp, Triticum aestivum
  unsure (1)..(486): unsure at all n locations
  Clone ID: PAT_TA_89742
ctgaccttagcgacgcaggcagcggagaacagatctccctcgccacacatccatccatggcggctgtgtactcccagtcccaggccaacggcgtcgacatggccgacatacaagacctcaccaacataagccacatgctgctctcactgcttccgtttgcttcgccgccggaggtagcgcagctggcggttgcgctctgggtgctgggctccacaacccttgtcctggccctgaccatcctcttccacctgccgcccgcgggacccgtctttggccgctgtgctgcaagcctactacgccattctcggggtcgtcctcctcgtcgccgtgccggtggagctggtgaccgcgctctgcctgcgccacaagccgcganggccgcctcctcgccttcgcctcctaactcctgccctgcgctcangtatcctcctcctcgtcatctcggnatgctatcctttaagacaaaantcaaatcttggngtncat

SEQ ID NO: 89743 - DNA, 474 bp, Triticum aestivum
  unsure (1)..(474): unsure at all n locations
  Clone ID: PAT_TA_89743
gttcaatcatgtcacgaagaacgccgaatccagctgcagagcgggctgctcagaatgcccaaacgatcaagagtctcttaaaattagagggtaataaaatatgtgccgactgcaaaaggaacaagcacccgagatgggcttcttggaaccttgggattttcatttgcataagatgctctggcattcatcgaggtatgggaacgcatataagtcgggtcaagtccgttgatctcgatgcatggacaaatgagcaactagaaagtgtcttgaaatggggaaactcgagagcgaataagtactgggaatcgaagcttgctgctggtcatgtcccatctgactccaagattgaaaacttcatccggactaagtacgaaacgaaaagtgggtaatggaaggacaattccaagattcatctgctcctgangcagatgaagatgaggatgtgcaatgaggcttattaaagaaaacaagatn

SEQ ID NO: 89744 - DNA, 500 bp, Triticum aestivum
  Clone ID: PAT_TA_89744
tttttttattagttctatgtttaaaaatccagcctatttggtaaaaatcagtgcgtcatacatgaaggtgaggtcctaccacttcagtaaacatcggtgcacaaaacatgaaggagaggtcctaccacttctctagtaccaggattcttggcacccactacaaaatgacacccagttgtccctcaaaactcaagttgcgcaagaactcggtcaggatctcaagcaaaagcatttgcagaacccaagcaactgcggccgcccgaaaattgatgatcacacattcttcccatcttcccatcaagcagtcttctgttttgccgccgtgttggaaagatgagatagggtcctatggccgacgaacacaaggaacacaccgaggaagctgaggtacttcagagttgtgaaaagttcagcttaacccaaaagagaacatagagcaacagtactgctgcgattccgacatggaagagtgatgcgaatgcagcaagtcctggcaagga

SEQ ID NO: 89745 - DNA, 451 bp, Triticum aestivum
  unsure (1)..(451): unsure at all n locations
  Clone ID: PAT_TA_89745
tagcagcttaaggaactagcttgcagctagcgatccatggctcgtctcaacagcaaggctgtggcggccgccgtggtcctggcggcggtggtgctgatgatggccggcagggaggcctcggcggcgctntcgtgcgggcaggtggactccaagctcgcgccgtgcgtggcgtagtgaacggggaagggcgtcctcgattaagcaaggagtgctgctccggcgtgcaagggctgaacggcctggcccgcagcagcccggacgcaaagatagcgtgcaagttcctcaaagacctcgccaccagcatcaatcnatcaacatgggccagtctccggcgtnccccgcaattcggcgtccgcctgcccttcccaatcacattccacaactgcaacatttccactatttatatataccttccaactgcagcaatgaccccttgcgttgacttattcac

SEQ ID NO: 89746 - DNA, 457 bp, Triticum aestivum
  unsure (1)..(457): unsure at all n locations
  Clone ID: PAT_TA_89746
ctacttcagcactcaggccccatcgagatctgttagctacttttggtttttgtgcaaggtcacggcagcggcagctttcatcaacatcatgtggtcgtttgtctaccacacctatctcgttcagattccgtacaccagccgcacccccatctttcagcttgagactgtgccctataccaaccggattcattttgtcattcgctccccccaagacgaccgcgaagtatgcgganccttgttttgctttgtcaggaagaacactcaacccaattccttancactcnaccccgacagttccgtgtcaatcttanaanaggcactctcctgctgttaancgtggccttnaatcaagaccgngatgtggccttggttnatgaaccncttggaaacatttaacttgganccaagcatgcatttanacaagaacangcaattntgcaatcacatcacaacagga

SEQ ID NO: 89747 - DNA, 260 bp, Triticum aestivum
  unsure (1)..(260): unsure at all n locations
  Clone ID: PAT_TA_89747
actcccttcccttccatcccagacgcccatagccccgacggccgccggccggcaagaaggcgtcgtccgcaccgtcgcccatggggccccagcaggaccggtcggcgtccaaggcgctcgccaacggcacggcggttgcgcccgagaggaaaggacggcaaggtgggtgcactacaaggaagtgccagcgcaacacgcccgcccggcatccgcggntacccgtttggaacggctgccgccgatttnatggcgtccgcccg

SEQ ID NO: 89748 - DNA, 400 bp, Triticum aestivum
  unsure (1)..(400): unsure at all n locations
  Clone ID: PAT_TA_89748
gggcagaacgaggtactgaaccgtcaggtcgtcaaatctgattcagcaactatcaagattccggaactggactttgaaattcctccggaagctcaacgtggaacactttcaacagtggaagggattattatgcgagctgtggaggagttgcaggcacttcaagatgaaagaaaggtgaacctttgggcctgtatgcttatagtccaggcttatagttntttaatttcaattgatcacttaagtgatatgctnacatcttctttgggagcttcaagaaagcgggtcctcaaaaaagcttgaactattgattaattttttaaataaaattgagttcccttggattaaggaaaaactgcgtttacctttgttccttgataatcctcctgggaaanacttcatc

SEQ ID NO: 89749 - DNA, 414 bp, Triticum aestivum
  unsure (1)..(414): unsure at all n locations
  Clone ID: PAT_TA_89749
tccaggaggggcnnggctggacgccaatncgaactaggtgggatcgccccgaggctgcatgaattcncggacgatgcganggcctagccnccantnccacacacagnccgcccgccgccgccgccatgccgcngttccggngctnnacggatctgncngtgganctnctctnccgnangcggnganagcctcgacctcaagtgctacgccagcgggacggggcccctgcacggcctggggatncgcgntctcgccggcgtccccgtcgntnctcgtcgtcctcgacgacgcccgggtgctgcccgtccggccgggtcgctncccangcanngcttcttcgaagctcaangaacatcctctcgggggggnccatgcctccgntccaagaangggtggctcgcctntccgtttgcc

SEQ ID NO: 89750 - DNA, 435 bp, Triticum aestivum
  unsure (1)..(435): unsure at all n locations
  Clone ID: PAT_TA_89750
gcctcgtgtcccctccgccattcccccgccgcatctggagcgacctcccaccgaataaacccccaaaacctagccgccgtcgcccccggccgccgccgccgtcggcgccgccgcagccatgaacgccttccggttcctgggggacatgacccacctcttctcggtcatcgtcctcctcctcaagatttacgccaacaatcatgctcaagggtgtcgangaagaccangagctgtacctggcggtgttccgtggcgcgctacctcnactcttcaacgactaatctcgctctanactccgtcatgaaatngtcttcatcacaacttcgccgcatctctggaaatcgcgcaacgcaaggtcgccnactaagacggacaaaacttcgcactcttcttctngcgcgcttggttgcctcactnaagacgtnacctcgggaa

SEQ ID NO: 89751 - DNA, 472 bp, Triticum aestivum
  unsure (1)..(472): unsure at all n locations
  Clone ID: PAT_TA_89751
aaaagaagccaacaccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaggccgccgggcgccaccctcctcgttcgccgccaccgccacccacaaggcgagctccggcgggatggagattgcggcggagaatggccggctgcngctgcaccaatgcaaagtgcggcaccagcttccgctgtcctgctgcagctgctagattattgattatcgattnatgcatgcaccgcgcgcatcatcanactatgattcgattcaacccatccatcttgtacaatttacctncttattnaangtctttngtagtagttaagcactngcaacatgagcaacaangtgatcccatcatttaaccgaccctaaatnaactccgtggtta

SEQ ID NO: 89752 - DNA, 328 bp, Triticum aestivum
  unsure (1)..(328): unsure at all n locations
  Clone ID: PAT_TA_89752
cggctacctccccggccggatggccccccttctggcgttctacggcgtcatgtcgctggcgttcgtcgccctcgccgcgttctggttcctgcggtacgcccggttctggcgggaggtggtgccgctccagaatttcgtgacggtcgtcatcgcgctcgggatggtggagggtgaccacgtggtacttggacctcgccgattcggcgatccggatccggccggcggngacgacttctgggcggcacttccgggcggttcgccgcacggtgtcccgcctgctgatctctcgtcccccaagggtacggcttgtgcggccatctangaggga

SEQ ID NO: 89753 - DNA, 271 bp, Triticum aestivum
  unsure (1)..(271): unsure at all n locations
  Clone ID: PAT_TA_89753
ccaatccccaacgcgagagcaaagcaacagcagctcccctcccctctagtaggtgtccccgcggctcgctcctcccccaccccccgcccccgcccccgcgcacgctaccccaccatggaggcgccgccggggccggagcccatgatgctggacgcgccgcccccgctcgccgccgccgtcccggcccacgcggccgccgagaaggcgaggacgganggcggctaccctgtcaccggccacatcatctcnancaccatcggcgggaanaacg

SEQ ID NO: 89754 - DNA, 485 bp, Triticum aestivum
  unsure (1)..(485): unsure at all n locations
  Clone ID: PAT_TA_89754
gttaaaccactaccacgcaccagaccattttattttttcgcgaatatgcaaagcttgcatatcatttcatcgatagatggagcagaagcatagcacagattagatacctcacattacatacactagcaggcgcaaacatgatggcccgacacgaggaggagggaagtgctcatccccaaagtcctacgcaaggctaactctccgggatgacgtatcctatcgcggtggcgtcggctcgagcacaacatcgggcatcctcttggatggattgcatcacgcgattggcaagtgagcgtgagtgatcgaaaatacattcaaaggaaacgggcaacgcttctgctgctgctgccgcctcgtgtantcctcgaacgcggcacgganggcaaaactggggcgcgcgagcgtagggcgacgccngcgaatggcacgccttcgggcgacggatcccgtcaagcaacaacaaccggcangccggctnccaagtt

SEQ ID NO: 89755 - DNA, 481 bp, Triticum aestivum
  unsure (1)..(481): unsure at all n locations
  Clone ID: PAT_TA_89755
gagaggtgaggcggcagctcaccgacgacgcctgggatggtgacctgcaggtggccaagcgcggcgctcaggagctccggcgtggaggcgagctggctcctctgtcctcgccggagtcgcggcggggcggagacgaggcgggcgacagcagggaggagctcctcccggacccagaattaggacacggcgcgccggcnacgaggttggctgatctgtcctcgccggagtcgtgacgcgaggagaagttccaccggtngtgcangggccggacctggccnaaatcaggccggaggctgccgacgcgtttcgagaagaggcgggggagaagcggaggcttgccggacgagctcggcgtcagcatcaacacgctcgtttgggaatgcggcgagcggcaacaagctngattgagaaaggcggcgtgcancaaanaagcggagntcaacaacaacacctngtccgggantnngcaaggccanaagca

SEQ ID NO: 89756 - DNA, 473 bp, Triticum aestivum
  unsure (1)..(473): unsure at all n locations
  Clone ID: PAT_TA_89756
gggaaccaaaccaacgcaaaccccaaatccccaatccgagctgccctcttccccttagatngcggcngtctggatngcgtttgcggtnatnctngtcgctgctgctcaagtngcggtngctgccccngttacggngcccggcttcctccgggntcccaaaaactacggacttntgtcccaattaggctnaagaagtttntccactatcaaacaatctccccaagagttaacttaatctgttttcnangaaagttggtgtccaanttngtgtgtttaaaaganggtcctcaaaanaatgtttattttcaattcnttttcctgggtnaaagcttncatcaacaaacatctcttaaagataacaatccattctgcttnacggaaaaactaaagctntcctcttaagctctnatttccaaagggattccttaagtttccaagttcngacaacaaacaattagaataattttttttgg

SEQ ID NO: 89757 - DNA, 470 bp, Triticum aestivum
  unsure (1)..(470): unsure at all n locations
  Clone ID: PAT_TA_89757
tccagccagccaaccaatcacccccatccccctccccatctcgcgtggattaatggatctccgccccgccccgctctccctctagctgctgcttctgctgctcgctactccgcgtccgccccgcccgactcgcggagccgcgccgacggacatggggctccgcgggaaganggccgccgccgctgctgctgctgcttctcggcctggtggtggccacggccttggcggcggactccgcctccgcctccgaaggcgacgccgattcgctctaaaaagcttgcttcgaaagatgtcaaaggaccggnancctgaaagagatctgtcaaacaatgtgtcctgccgaccgatgacaacctgctgacaaggaatggtacnccataacctttnncctgcaatggaaggattggactgcaaancgaatgccatacattgatatggaaagaaacaggaaaggaaaaantnggtaaggc

SEQ ID NO: 89758 - DNA, 387 bp, Triticum aestivum
  unsure (1)..(387): unsure at all n locations
  Clone ID: PAT_TA_89758
ctcactgtgccgtccttgtgagggtgagcagcagcagtaccagctacgctagctagctaggagtacatcgtgcggcggccatggcgagcagcagcagcagcctggccggtctgctgctcaccgccgtgctgtgcctgcagctgccggtcanaagccgcgcgcagttccgcntggggttctacaanacnacctgccccaannccaagcaatcttcgggaagggccgtnacgggcgcgccttcgcnanaaactcnggntccccncggtnanaccccnccacatttanaaaagcgnttctcaagngggtgattnccccngtnctgtttntttaacccgggggnaggaccccnagngtgntgncccgcccaaaanaccagctcgnggtntt

SEQ ID NO: 89759 - DNA, 454 bp, Triticum aestivum
  unsure (1)..(454): unsure at all n locations
  Clone ID: PAT_TA_89759
gtttcagctaagatatctgaaggtttctacattcccaagctcaatagatctgcctgctgaagttcgcgggcttgttcatttggagaccctggaaatatctggtggtgcacgaagcatcccgtcagatattgtttgcttgccacggttgtctcgtctgatccttccgattcaaccatgtcctcctcaagggatttccaacataaaatcattgcgtgcactacactgtangaatatctcgcttgaggatattaagggcttggtaagcttaccacctaagaattttaaggatttatactattngttgcggtaagttttatcttggtacccttaattgaaagtccatggcctaaanacttaaggtcagtcttttctctaacacattccggcccgatttatcattacccaccctctttccntncaagaanttaaggnattgnaataagttaccggccga

SEQ ID NO: 89760 - DNA, 242 bp, Triticum aestivum
  unsure (1)..(242): unsure at all n locations
  Clone ID: PAT_TA_89760
gtctcctccaactccgaccaccaccgccttagcaccccccccccccnncccccccctctctctctccggcagacctctnagccttagctttccgatgggtcgcanantcaagaaggccggcaantccaantcnaanaagggnaagggaacnaagaaggntgatgcttcatcgtctgctgccgntncggtggcttctggtccggnaaaggtntggaaaccaggtgtanataattggtaggagg

SEQ ID NO: 89761 - DNA, 444 bp, Triticum aestivum
  unsure (1)..(444): unsure at all n locations
  Clone ID: PAT_TA_89761
acacactacagagcccaagcagcaacaacacacgcnagcagagattaacagctagatacacnaagccntgcaagtgcatgctatctncggacggncagcaaacgcaaacacacttntccaccgagnaaacngaaacagccaaacccttctcgtcacccgcgtctacnacgtntccattgccncggggcgtttgggctaaagcacttcggcgnacttgccacttccccccggctcgggcggcgggnaagtttggcctggacnttgcaatgcgccnanaagctccttctctccgcgaaatggccnacattgggccttnttcggttctttattaggcccagcccgaaggttaaaacccctggcttttaacaacnccctgtataccttttcnaaaaattcgggtcccactcaagtttncaaccgctggggccccttaattggcccncc

SEQ ID NO: 89762 - DNA, 468 bp, Triticum aestivum
  unsure (1)..(468): unsure at all n locations
  Clone ID: PAT_TA_89762
ctcagatctcctcccctcgatcccaagcaatccaccaatccgcctaccatcctcttgcctcccgccctgaatctgacgctccgatctcggcgctaacgaagcaggcggatcttcccggctccgcccgcccaaatctcgccaggaagaaccgagatttccctgcgccggcggcgggcggcgttcgccaatgccggccgggtccacgtgaggtctctccggctggaaagggcngggggccggggatcttcgccccgatttgagcgcggtccggtnttnctggaggagcgctagattgggcgtgaatctncattttttaccctnatcttggctgcggcggaaggattctttgccgccttcattcgtccatcgctccgggcgggcgcgcggggacatggtgaatcaactacncgggtccgctnacgcacgcctcaactcaatcgccacctctcgccgccaaaatcgggctcg

SEQ ID NO: 89763 - DNA, 477 bp, Triticum aestivum
  unsure (1)..(477): unsure at all n locations
  Clone ID: PAT_TA_89763
aaagtgtccttgtgatcgggtagagaaactgaaggtaaatattacagctatttatgaacgaatacaaagatttcacagcctagagaaagttgatacctacaccaaactgaaggcctttccttcctttttcccccttccgtgcaactagtggcaagctgaagttaagctcaaaccttgcaactggatgcgcatataccatccccacgccagctgcaatactaggcagtccgtttcctagttctgctagagtatcacgtacgtctcctacaaacattttcctggcctaattcaccttttgatgcgctgtctgaaagggcaaganctaccagcatttgcaaaaactggagtccgagaagtgatcttttccggnacgagnaatggaataagaattgttgatccggcgnatatacntcgctccaacatacttcccancccngaggcctaaactgacancttaaancncttacactgttgggc

SEQ ID NO: 89764 - DNA, 486 bp, Triticum aestivum
  unsure (1)..(486): unsure at all n locations
  Clone ID: PAT_TA_89764
cattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcnacgtctgcgacgacgcccaccccaagtgccccaagggctgctcggcgtgccgcgtggtgtcgacgagccccngaaatgtgggcgctgcgcgggatattaaatccaccgtcgacngcacctgcggtggggcctgcaagaantactgatncggtcatgccaacatgatattttccgcctaaaatganataaaaactcaanacnagatgagcagcgtcatcgtgcctatcntgtgtgtgtgggcaacaaatatgtatacaatatgctgtctccntcctgtgttttctctcncnanaaaaa

SEQ ID NO: 89765 - DNA, 478 bp, Triticum aestivum
  unsure (1)..(478): unsure at all n locations
  Clone ID: PAT_TA_89765
ggttctgctgcgaagatngtggcgcccatggtgatcgcgtcggcggggctcgggatgctngcgggcgtggcgattgcaaaccggacgaccggggacgggctgccggcggcgtccagatnggacgcgcggccacgctnctccacgtgcagcggcaccggccgggaggagtgcctctgcagccnttngtccgaccgcgacntctgccgcgggaacttctnccggtccccggcgcaagccgttccccaacttccggaaggcttggaaccgggcnggaattccggggcnaacaanctncaaananacaaaacttcccaacggcaaagggtncacccngnacaaaaaaggggtttaaaantttccccganggaaacccaattgcaatttggccgaaanacaaaantttcccttnagaatttaaaantttttttanaaaanttanagtcctttatcaaaaaatttgttggggggccgttcccat

SEQ ID NO: 89766 - DNA, 518 bp, Triticum aestivum
  unsure (1)..(518): unsure at all n locations
  Clone ID: PAT_TA_89766
cgcaatcataacggtagcgacgcagacggtgagactggagaagaatccgaaggcaagccgacgaacacccccccacagtcgtaacggtcgatgcatcgcggaagtcgtggctggagtgaaaaccgacaagtttgctcaagcaaggcggtagcccttgggtgccgtttgtcaaggtagccgagagcgtaggtggtggagccgtggtcgaggtagccgtgcgaagaacgccgcagtcgatgtcnagtccgggtagcccgttccaaagatgtccctttgaagccgccggcgcaaagagcgccaanttatcctggggcattgttggaaattaatgtgcnccggtaaaagacgtttttacaagcttcccnccagtttgccaaacccggggaaactnctnaacaaaggaccttccgtttttccaanacgggcgantgtggcataatacattnccgagtaactaactacaatgggcacggtgccctncaaagacaacccactcaactataacaggcccaaggtan

SEQ ID NO: 89767 - DNA, 508 bp, Triticum aestivum
  unsure (1)..(508): unsure at all n locations
  Clone ID: PAT_TA_89767
gcagctggagtagctgtgagaggcatacggaaatattaaaaaagaagggggagggaatccactactggcctagctatttgagcaaaacgtatgtgggaagagcggagataggagggacaattccactcactggccaaccacagcgccttcctcctctctcccctccctccgctcaagaaatctaccaagaagcaggagctcctcttcgtcttccggccgtcgtcttcctcctccgtattcaaatttccggagcaagaattggtnggggggtaaccaaatccttgcatggatgcaaccaactggcccaaggggctaaggctggtgaacccatggaggagatctgatgggaacacaaacgcgaacaacaagtcaanggtcaaatccgatcaaccggngcagtccttctccgngcctggggttggggaccataagggcggaccccggcatgnattgnggtcccgaactgggcngtacaagancggnggcncgcccaaaagaaagnattann

SEQ ID NO: 89768 - DNA, 542 bp, Triticum aestivum
  unsure (1)..(542): unsure at all n locations
  Clone ID: PAT_TA_89768
ccaagtcggactcgccttcctcctccccaactactcctctcctccgcgcatcgcatcgcancgggggtcacctgagatcacatacacaatggtaaggctgtggctgtgcttaccggcagtgagggtgtcaagggcaccatcttcttcacccaggagggagatggcccgaccaccgtgacgggaagcgtcactggactcaaggaagggtccacggcttccacgtgcacgctcttggtgacaccaccaacggctgcatgtcaactgggaccacacttcaacccttcttgtcatgtgcatggggaccagaagatnaatccgccatgcttgtnatcttgggaatgtgacaactngagcggatgtgtttcctacancaatntttctgactgcaaatccccttactggacaaatcaattntttgcctgctgtttcctcaacgttacctaatnatcttggcagggtggacattacttacaaganactggaaacctggtcgcgtgttgctgcggatcacgggctcaaggctaaatttctctcaccggcaa

SEQ ID NO: 89769 - DNA, 541 bp, Triticum aestivum
  unsure (1)..(541): unsure at all n locations
  Clone ID: PAT_TA_89769
cctaagctctagctagcagctagctatataccaaccatatatactatttcctcgtgatcagttcgttcatcagcgatcaaccgacgatnagggagctgatccggcggctgagcttctcagaccgggtgagcgacggcagtggcggcgtgccgcgcgggtgcgtgccggtgctggttgtgggcgacggcnacgagaagtgcgagcggtcgtgggtgcgggtgggaggtcctgcggcacccgtcgcttgcagcgcttctngagaatggcggcgccaggattccgggtacaagcaggaaggcacctcccgtgtcccctgcgccgttcaccatttnaggcaggcctcactaccgcgccctctcccaagaactactgataataaattattccctgcttattaatccagcaanaccgaccccgatngatngattgactcctgggnctttangacgatctttgnccattttgatctcctaacaattatctccncgaactttctcacttcaatttgattctctgttgggaatacatgaatgtgcctcaa

SEQ ID NO: 89770 - DNA, 492 bp, Triticum aestivum
  unsure (1)..(492): unsure at all n locations
  Clone ID: PAT_TA_89770
cggtctcctccgacagacccgccaccaccgccggccttctcccccagacacgccgcacccaccggcctcctcctgcagacccgccgccgcaagcctcctcccgcaaccccgccggcggccccctcccaaatccggcttgactacccaccgtagaccgcacctgccccatcccgcggccacccccggatcctcgcgacgccgccgtcccaacattcctgcgcgccgccgccgcctcctggatcccggagctccgcgactcggtcattcctaccatctccgccttcctccagctagctagcctcgccggcgccggcgccggctgcagccccagattcccaccactggggcccgccagcggacgccgcgctcccccaccgccgccagccgccggcgcggtactcatccccggttcctccattctagccatgtgcgggcgttaaacgaactggctcgattccgtcaaccctctttggngaacaacgggaacgacag

SEQ ID NO: 89771 - DNA, 495 bp, Triticum aestivum
  unsure (1)..(495): unsure at all n locations
  Clone ID: PAT_TA_89771
ctcgcatccccgaacaaccaatccctccgctcccctcgagccccgctcccctcctctcctgccctcccctgcgttgccgcctcctccccttctcccctgctctccactacgccgcctcctccgccctttcacttttctctcccgcggcggcgacgatctgcaggcaaaaggcgacgccnacggtgctcgattcgatctgcaggagagagagaaganagaagggagagagagagaaggaaggagaggagggagaactccgttnccgccacgtgccgtgcttctggatngagcgctgcctgaccaagggataagagtatgagctgcttaagcaagtncggcgcttgtgcactgcttgcgaagcggtngtcgacggtccgtcnacgtctccttggcagaagaattattctaactcatcggnntcagcttatcaacaagaggacggactccggaaggaancccttctaangngccagggccggcaggataacttngtng

SEQ ID NO: 89772 - DNA, 346 bp, Triticum aestivum
  unsure (1)..(346): unsure at all n locations
  Clone ID: PAT_TA_89772
catgaactcgctccaatccttcctcgccgtcgcgcccgtcaagccggccgcggccgccgcgaggctcccgtcgtcccggcgggcgcgcgtctccgcctgcctcgcgaccccggtgcccgcgccgacnacccccgcggnggcggngtcngcgnggngggagctgtccgcggcganccgggccgtcatggcggacgaggncaagtacatcgtcggtacctataancgcgccnaggtcgtcttcgtggcggggcncggntgnaagctctacgacatcgncggncgngagtactcnacatngccgccggnatcnccgncaacgtcttccngtacgganagcccgaagtgg

SEQ ID NO: 89773 - DNA, 532 bp, Triticum aestivum
  unsure (1)..(532): unsure at all n locations
  Clone ID: PAT_TA_89773
gaaaactccattcccctcccctgttttctttactcccctccccctgcttcctccccacttccactcctcggttggatctccgggtccgagatcgaatcccgggaattcccgatcctcatagccccgccatgcgctcccgacaaccccagcgcgcccccctcccagctccctgatcccatccgcctcccagggccgccgccgttgacgccaattggcgccggacggacggcatggactccggcgccaacagcgtgggctccgtcggcgagtcgccgccgccgggtatcctctcctgggtcgcccgggttgccaaagggccgcggctccgccggtggcgccgttatcccccgccgagaacacgacgacgaaggcggtcccccgcgggccctcgcgcttnnagccggccgccgcactggngctgaaggtggacctgggcaactccataangcgttcccgtncggngccgangcgcctaagggaagcaagaggcgcggcgccgagtggataccatcccgtcgtcaatcaatcctgc

SEQ ID NO: 89774 - DNA, 540 bp, Triticum aestivum
  unsure (1)..(540): unsure at all n locations
  Clone ID: PAT_TA_89774
ttttttttaaccaaaacacaaccacaccaatttcacgattaccattacaaagcaaatcccacaattatcagaaagttttcaagacactcaacatctgacagttactgacaccaacattggagagtcgactgacaaccatagataagagcaaaaatactgaagacagcatagattttagcatacagtgcgattagcacttgactctttcagccaatgtgcaaaagncaaggaagtggatcagaactccctccttggnagtaaggggacancaaggcggcatcnncaagnatggccccngccaacaaagnactgnagggcttggancctggcnaagaanaacnttggggggggtcaaaaatttcntggacgcatccaggggancccctnaanncttgggaaaaaggtcttggnntttcnctccaagngggananaaanggtctttgnnaaanagggttgccctgaanangggggngnaaaangtanccccttaaggggggccanaaacncctntatcacaaccccnnnaggggatggccatt

SEQ ID NO: 89775 - DNA, 195 bp, Triticum aestivum
  Clone ID: PAT_TA_89775
tttttttttcattgaaacgtatatgcatatagaaaaagtcagaaaggtataaacattacacacgtacgcacccgacagggagagcctctctcatgtcatcatccaaacactgcctgacacgactaggaattagttcatcacagcggcggcttagtctattatctcctctccgatgatcagcttttgaaggggggg

SEQ ID NO: 89776 - DNA, 169 bp, Triticum aestivum
  Clone ID: PAT_TA_89776
gttcacaggagctgcatatcaaggtcctagtagggtagatgcccaagcttgtaggagtagctgtttcatctgggattaattgttcatgtacgttgttgagtcgtactacgggaccactgttgctgttctaataggaatcaccaattggccgtgctctaaaaaaaaaaaa

SEQ ID NO: 89777 - DNA, 541 bp, Triticum aestivum
  unsure (1)..(541): unsure at all n locations
  Clone ID: PAT_TA_89777
ctcatcttcgctggcaagcagctcgaggatggccgcaccctggctgactacaacatccagaaggaatccacactccacctggtgctcagactccgtggtggcatgcagatcttcgtcaagaccctgaccggcaagaccatcaccctggaggttgagtcctctgacaccatcgacaacgtcaaggccaagatccaggacaaggagggcattcccccggaccaagcagcgtctcatttttgctggcaagcagtcgaggatggccgcacgctcgctgactacaacatccagaangaatccacactccacctgggtgctcaagtccgttggtggcatgcagtnttccgtcnaagacccttaccgggcaagaccatcacctggagtcganccctcctgacacatcgacaacgtccaaggcaaagttcanggacaaggaggnatcccaaccggacaacagntccancttttctgggnaacacttgaggatggccnatttggggggctacaacaccagaagnnccacatnacttggggctcctcnggn

SEQ ID NO: 89778 - DNA, 169 bp, Triticum aestivum
  unsure (1)..(169): unsure at all n locations
  Clone ID: PAT_TA_89778
ccacccagggccaggggtcaggcactgttccactggtgagtgatggcgatggtcacggctgacgcctccgccgccgccgacgccgccaccaagcagccagaagccgacaaggattacagctcctacaacggcgcctccaccgcgggtgtnggcggagggggccgcccgg

SEQ ID NO: 89779 - DNA, 541 bp, Triticum aestivum
  unsure (1)..(541): unsure at all n locations
  Clone ID: PAT_TA_89779
acaaaactcaccaccttgaacctctttgaaaataatctttcaggcaatattccaagagaattaggttatttggtaaacttagaagattttgatcttagtgaaaacacactttcaggttccatcccaaacagcttaggaaatttgacaaaattcaccaccttgcatctttttcagaacctgctttctgggcaaattccacgggaactaagttacctggttatcttaagaggacttagaccttagcaacaacacactctcaggttccattccaagaaatttaggtaatttaactgagctcactatcttacatctttggggtcaacagactctccggccaaattccaagagaattaggtaccttggtgaacttaagagaacttggatcttaagcaacaacacactctcangccctatcccaataattatagggaacttgacaaaccacttatttgccctttcaagaacaacttctggnaaaatccacgaagactacgttncaagggnactacaagnctgggtnttagccaaacaaccccaggtc

SEQ ID NO: 89780 - DNA, 536 bp, Triticum aestivum
  unsure (1)..(536): unsure at all n locations
  Clone ID: PAT_TA_89780
gcggcgaccgtcggagccaggggcccgctcgccggcgccggcggccctgggagagacgacgacgacggttcggcctaccagcggcggttcgccatcgagtcccccttcttcaccgccgcgagaggtatctgcggtcttgcccccaccccacctcacgcatcctcggcttccttctctcccggatctccctcgcatccgtatatttccattgggtcgcctgggatttgagtgatccgtgatgctagattgacatcgtctttgattgatctcttagggtgctgcaatccattccgatctctgtgcctaactgttgactattgattgctatgacgtccgtangatcattcctagcggatcagatctgtgggatgccatagttaccgtgcgaagctnagcgattaattacgtgcatattttaacctgttgggtggnttgataattttgaccacttgtgcttgcaaacaacttngaatgaatgcccaatngggtaaaccgcctanttcaaaatgaaaggattgcaaccngctancgatatt

SEQ ID NO: 89781 - DNA, 547 bp, Triticum aestivum
  unsure (1)..(547): unsure at all n locations
  Clone ID: PAT_TA_89781
tatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgattcaacaagttggttcatcttcccgtngagcacaacgcatctcctggggtactacgatgggcgggtattggacaatgtggaactgcctatttcgggngcactggacccacacaagtgattaacgaagtggaggagtccaagaaggatacctgacgcgtatttccgcatcatcngatccacaacatcgtcaagggcatggctcaactcatcgcctnaaacaacnggctcgaagatccggaaggctaaacantatcacga

SEQ ID NO: 89782 - DNA, 335 bp, Triticum aestivum
  unsure (1)..(335): unsure at all n locations
  Clone ID: PAT_TA_89782
accagtccacaccgcagcagcacgagtgagctcgagaccgagaggggaatagaggangnagcgatacagtactacaggcaaccatggaggtggtgaccggcagcancggcgggaggctgaacccgtgggcggngcccttcgtgccggggagctggtgccgccccgcccccgtgcaggcggccgcngcggagntcnaggacttctcgcccnngtggtgacgcctcntcncctcctcgccgtccttccgcnncagctggctccgcgactacggcnanntgtggctgctgnacnccgacgaatgnccagatgacagcgacgccttcttcctccgcccc

SEQ ID NO: 89783 - DNA, 518 bp, Triticum aestivum
  unsure (1)..(518): unsure at all n locations
  Clone ID: PAT_TA_89783
aagtcactcacacaccaccccacgagccggcaaaactagctaggaacgtcgtccggccacctcgttctactctctgggcgcaatcgagagaatatgtcggaagaactggcgatgctgggacgatctagggtacgcggagattcgtcgcagtcttaccaacaaaccattattgactctagcccgcaaatgtcgattgatgatttgttgaaggaaattaatggagccaatggcatgccggtgctcttccgtcccttcctccgatgggcggctagtggccgtgccagtacccgtgaatggctccaaaactggccttgcaaatccgcgaccacgatgantctggcaaaaagaagcagcaggtttcctgcctgggtacngcnacnggttcactaattgcaacgtaacttaacgcanggtaacccactggtggttctggggcaaggcaaggtggcaacgggggaaccatttgcgtgcaattctaagnggacccatattggggaacaaaggatgcctctctcnca

SEQ ID NO: 89784 - DNA, 480 bp, Triticum aestivum
  unsure (1)..(480): unsure at all n locations
  Clone ID: PAT_TA_89784
ggaaacctccgatccaagcgaagccaaggctttctcgtcctcctcctcaagatgcagatctttgtgaagaccctgaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctgggctgactacaacatccagaaggagtccacactccaccttgtgctcaagctccgtggtggcatgcagttcttccgtcaagaccctgaccggcaagaccatcaccctgggaggtccgancctctgacaccatcgacaacgtgaaggcaagttcaaggacaaggagggattccccggacaacaacgtctcaccttgctggaaacantcaagatggccnacctgctgactacaacatcagaanggntcanatcaacttgtgctc

SEQ ID NO: 89785 - DNA, 542 bp, Triticum aestivum
  unsure (1)..(542): unsure at all n locations
  Clone ID: PAT_TA_89785
gccgaatgcgacgccgaaatcaccgccggtagcctgagggtctcatgccgccgccactcgcccctttctctgtaggtcgccgacgcaaccctggatccctggatcgtcccctcgttcccaccangctcgaggaggcccaaggaggcaggcatgaggagcgctcagccgcaggcgccatgggcagatttagccggggccgtcggcagccatccctccctccggnggncatgaagaattgaagangtttgagcgcaaggaccgtgcgtggctccccgcgccatgaantaactgtcctcctcatctgctaacaaccaacangganccattcaaanaagtttgccgggaactccgttantgtccacacctccaaggtttatgcatncaatttcaantttccttaaaancacngttatnattgtaacgggttcaaatntcnaaaaaaggaatttttnnacccnattctccccgnngggttaaaaaccnataaanccnagatttactttcaataacggngttanatgatcgatngaaaaaaagtatgc

SEQ ID NO: 89786 - DNA, 539 bp, Triticum aestivum
  unsure (1)..(539): unsure at all n locations
  Clone ID: PAT_TA_89786
ccggcatgtacgataatagtaaatttttaatgtgtattactccctgcgtcccaaaattcttgtcttatatttgtctagatacggatgtatctaataataaaatgtgacttgatacattcgtatttagacaaatctacgacaaaaattttgggacagagggagtacttcattattaataattggtccaccttgcaaccttacaaagtgtcttggggctcgtgttgcagccggctaccaacgaagagcccgcttttctcctctttcctcttttctctcctccaactaaacaaaaatattttattttattctttatagcctgcttatgtcatcttattgtatttgctccgtacgtgaaagatacatgcatgcattctggtgtcattaatcccattgatgatgtgtcgacgtgtatgtgcaaggggtccacatggcaagccatgcggaacgtgatcatctccatctacaancgtcgaaccngggaacccaacccggcaancaaccnaaatnaccagggggnaantttttgcccgggaaagnnn

SEQ ID NO: 89787 - DNA, 539 bp, Triticum aestivum
  unsure (1)..(539): unsure at all n locations
  Clone ID: PAT_TA_89787
cggcaagctaccggacagcatgagcaagtttgccaaccttactgatctgttgatgtcaggcaaccagctaactggttccataccaacatcagtcaacgtgttgcagaagctcaattctctcaacttgagcggcaaccggatgtctggcaccattccaccttccagtatcgggttgcttccatcgctgacgatccttgatttgtccggcaatgaaatcaccggtgtcataccgcccgacttcaacaacctgaaactcaacaacctcaacatgtcgtcaaaccaagctcaccgggtgggtgccgctctcgctgcagagcgcggcatacgagaccagttcctcggcaaccacgggtctgtgctangaaaggtcccggagtagacctccccgaaatgcggcaatgcccgtgacgantctcncaagggttgatcntcctcttctccaatgctcgccggnattgttctcntccggaagcgtggggatcncnagcctgtcttccggcggcggaaggacaacaaggaggtgncnnctggaagatanc

SEQ ID NO: 89788 - DNA, 170 bp, Triticum aestivum
  Clone ID: PAT_TA_89788
ctacagttagctgtttatttttttatctttgcaacagttagctgtaaccgaatgattaaggtgttttggtgattgctcccaagtattactccaccaaaatatcgacactaaggtgttcatgtgtaacgacccttgaagcaatgtctctcaagttttgcaaaaaaaaaaaa

SEQ ID NO: 89789 - DNA, 434 bp, Triticum aestivum
  unsure (1)..(434): unsure at all n locations
  Clone ID: PAT_TA_89789
ggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaagatccaggacaaggagggcatccccccggaccagcagcgtctcatctttgctggcaagcagtccgaggatggccgcaccctttgcggactacaacatccagaaggagccatctccactgggtgtcaagtccgttgtggtatgcagttctttggtccaagacctcaaccggcaagaccatcaccttgaggtttgantcctccaaacaccaatttaaatgttgaaggcaaaatttcaagacnagggaggattccccccgggcaacangcctgttnttttcccggaacacttcaggatgc

SEQ ID NO: 89790 - DNA, 205 bp, Triticum aestivum
  Clone ID: PAT_TA_89790
tataagtacaatatagtagcaaaatgttcgatcactgagaggttgatgtggtgcaaagattggcatttagtttcaagagatccttttaagcaaggtgttttgatggtatgtatgctttagatactacttttctaacattcaagaaaaaatactacatttctaagaaaaagagtgaattcttgatttccaagaaagagtaacgagg

SEQ ID NO: 89791 - DNA, 533 bp, Triticum aestivum
  unsure (1)..(533): unsure at all n locations
  Clone ID: PAT_TA_89791
gagagacactcactttgctttctccgccgcacgccgccggccgccttgtgtggagcagggcgcacgccgccggctgccttctctcgagcaggacgcatcctctcccgccacgacgtctctgcccccctcccccttcccgcaccaccaccaccaccaccaccacagcctcaccccgtctcctatccccacgacggcctcgcctcgccggctcttatccccaccacggcctcgccccgccacctcctctcaccaccgcggacttgtctcgccgccaacccgtggnttttcctaaatttgatctgccgccgcatcaaactggcgnaaagnaaatttaaatgccaaattgcttgncaanantcggangaagancttgaattgnccaattcaaannnttcaattaaaantcctnccggaagggttnaattccgaaggttcggttgtnagacttacaaatgntcattggaaanttcgttcccanttgaaggnncttggaaaaantgaaatttnggnaaatangntgcaaacnctntcaa

SEQ ID NO: 89792 - DNA, 414 bp, Triticum aestivum
  unsure (1)..(414): unsure at all n locations
  Clone ID: PAT_TA_89792
ctctgttacaacttgctaaaagggttagaatgttattggtgttgcaaaaatatcaggcgctctcaactgaaataagaagtgtgtagcgcaagttcaggtataactactgcaagagttcaaaaatctcaacgaacaaagctctaaccaaagttcaagaattgtttccttcataaattagttttcttttgggttaatttgttgttctgggcatacagacatagaatctcaatgacctagcggaagtcgttccgacgccgcagctttgagaggtnccgtcctaagttttcccaacctcccctggacgtcatgnccttctccttccagtatatccagttcaaatcnggnggtcttcaantcaacgtagtgtgcatatcacttcacctgcanggatattattcccctgcccctggcaac

SEQ ID NO: 89793 - DNA, 579 bp, Triticum aestivum
  unsure (1)..(579): unsure at all n locations
  Clone ID: PAT_TA_89793
agatgatgactgaacaatttttcatgaattttccaacctgaattggttacagaggttgggaaaagaggagtctaggctctgatgaacacatgttctttcgcagaaaccaattcaactagaccaggactatgtttattaagtcctccagtgtttattggaattagatgacacatggtatgccagctaacaagcaactgaagcaagaagattttgtaatttcttgggaaagaatgacccctgaacctaggatggcgaaggatccaatatgtccaagaccaatgagggaattgcaagacttcatattccanttatttaagggcttgcctactttcaagtgtcctagattacaggaaaatgttcctccaagtgtctacttgaagtaanttccttatagaagtanccanttgatcccttccaaatagttgttgcctggaanttgtggtncgactaaatancattctcaaaaanggggggnccgggacctatnccccctanaggganccttttacccccccaanggcgtcttttaaaacccngnangggaaaccccgggnttccatttancccttgaaaaanccc

SEQ ID NO: 89794 - DNA, 287 bp, Triticum aestivum
  unsure (1)..(287): unsure at all n locations
  Clone ID: PAT_TA_89794
gcggatatgaaatccaccgtcgacggcacctgcggtggaccctgcaggaagtactgatcggttcatgccggcatgatatgttccgcctaaaataaaataaaagctcaggcgagatgagcagcgtcatcgtgcctatgcgtgtgtgtgtggccaacaatgcttataccagtatgtcgtctcttccgtcgctgtgttttctctctcgagaaaaattggtgttgcttgttgttcagctatccggaatacctccgtgaataaacagctgtatgaattgtgcttgnctgcaa

SEQ ID NO: 89795 - DNA, 481 bp, Triticum aestivum
  unsure (1)..(481): unsure at all n locations
  Clone ID: PAT_TA_89795
ctcttcctctgcccacaaaaccctagccgtcgcctcacagctcgccgccgacgcagcgagctcttcctccaccgccgcaaccatggcgacccanatcagcaagaagaagaagtttgtgagcgatggcgttttctacgccgagctgaacgagatgctnacccgggagcttgccgaggacggctactccggcgtggaggtacgcgtgacgccnattcgcacggagattatcatcagggccacgcggacgcanaacgtgcttggtgagaagggccgcangatcagggagctcacctccgtcgtccagaancgcttcaacttcccggagaacggctttaactttacgccnagaagtcgtccaccgtggctctgcgccatccgcccaagccgagtcactccgcttcaagctctcggtngcttccgtccgcaaggcaagctaggtgttttcgctntgtttgganagtggtgcttaggttgtgagtcn

SEQ ID NO: 89796 - DNA, 220 bp, Triticum aestivum
  unsure (1)..(220): unsure at all n locations
  Clone ID: PAT_TA_89796
gcccaaggtggtgaggggcgatccggccaggaagggcgaggccgccgccaagaccagcgcgccggcggccgcgccgccgccgccgcagccccatcaccaccaccaccaccacgtcgcctccaccatcagcgtcagcgacagctccctcaagttcacccacgtcctctacaacctctcgcccggcgagctgtacgagcaggcccancaattncaaaaaggg

SEQ ID NO: 89797 - DNA, 483 bp, Triticum aestivum
  unsure (1)..(483): unsure at all n locations
  Clone ID: PAT_TA_89797
cctctcctccccgcgccgccgccttccggctgtcgcccgtcgctcaggagctcctgtagagccaggccctcgctcgtggatccttccccgaccccgatcccccgttctgtcgcttgctcgccggacgccctccagcccctccgcgccgtggccccgctcccattatctggtcgcctggagattttggancgggggggagacctgatgcatgatttatttcaggtttatcgatccgagtacaaaatagtataacttttctataacagaagggaaaagcagggtaggaggaagtagattgtagagacgcctggggtagtcaggctgggagaaagatacaaacgctgcaatatattacttcacccaatatatccaatttctgtagttctgcctantcttaattgtacttgaacttcggtgttgaaactgaattattataagttcncnggacnctgattcangggantaaatgttaaaaaaaaaaaa

SEQ ID NO: 89798 - DNA, 498 bp, Triticum aestivum
  unsure (1)..(498): unsure at all n locations
  Clone ID: PAT_TA_89798
aaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccagggcggcgacttcaccaaggggcaacggcaccggaggcgagtccatctacggcgagaattcgccgacgagaattcgtccacaagcacaccaagcccgggattctctccatgggcaaacgccgggcccaacaccaacggtcccaattcttcatctgcaccgtcccctgcaantggtcgacggaaacacgggtcttcggcgagtcgtccanggatggactctcaagaaatcgagaagnggg

SEQ ID NO: 89799 - DNA, 484 bp, Triticum aestivum
  unsure (1)..(484): unsure at all n locations
  Clone ID: PAT_TA_89799
gcggcccgggcgaggcaatctgtcgtagcctcgggaaccagacgaagcgcgggtggctcgcagcggagaagaagccggcccggcatggtttgatgcttgtccggttcgtggccattcttgatgaatcctaatccatgtctcccttgaagtctgattccgggtcgataaggcgggtgttaagagcgtgacgaggctgtagagcctgtccagcgcagccgccactcgaagtggatgcaagcgggggcatcttgcgggatgcagagcggagagaaccaactccaacggcggctcggaataagccatgaaggcaacttggagtggaggatggctcggaacggcacggtggctcccgcgcggcggagaccaagcggcgatctgttcatggagtcntcggagccccaatccgtctccgggttgtgacccttcttttttttcctttttccttttttttgacttgactttgtataattttccctcnatagct

SEQ ID NO: 89800 - DNA, 484 bp, Triticum aestivum
  unsure (1)..(484): unsure at all n locations
  Clone ID: PAT_TA_89800
tagcancttaaggaactagcttgcagctagcgatncatggctcgtctcaacagcaaggctgtggcggccgccgtggtcctggcggcngtggtgctgatgatggccggcagggaggcctcggcggcgctntcgtgcgggcaggtngactccaagctcgcgccgtgcgtggcgtactgacggggagggcgtcctcgattagcaaggagtgctgctccggcgtgcangggctgaacggcctggcccgcagcaacccggaccgcaagatacgtggaagttcctnaagagctcgccaccagcancaagttcatcnacatgggncaagttcccggcttgcccgnaagttcggntcggcttgcctttcccanaacaagtcaacaactcaacattcacagtttaattnataaccttccaatttaancaagaccccttcctngaacttaattccaccttaatgantgctaaacaattttaacctccaaaaata

SEQ ID NO: 89801 - DNA, 452 bp, Triticum aestivum
  unsure (1)..(452): unsure at all n locations
  Clone ID: PAT_TA_89801
ggtctacannttcatgcacaanggnnccttggnccancatatatttggnatgtnatccctatcatccaatttattttataacgacatgcntctttgtnttccgagtatatatgtgcacanntttanctacaggtaagtgangtgcttgtttttttttaccgtaattgatttaaaagctattcngatttgattnagacaanaatatnaatcttattttatctgaaagtttgttgtttcancatttggcagacagaataaaagggccantactacactgnnctaaganacncanaatantcacanggttagtagaggggcttgtttacctgcacaagcaccccatgctagctattgnccatnnggacttgacaccaaatnatantatcntggaatgtgacatgaccctgaatatttctgantttggntcanctaanaccctgagnccanacgtt

SEQ ID NO: 89802 - DNA, 289 bp, Triticum aestivum
  unsure (1)..(289): unsure at all n locations
  Clone ID: PAT_TA_89802
cgccggtgccaatggncgtctttttcaggaaccacaccacggnntgcggntgnggntgggagganttggcgtcgtctgcgaagcggtaccatgtggcgangacgaacttggtcgggtcggagtcgagggcgcgaaagccgaaggcgannncgccggacgggntggtgatgtaccggggcggcttcaaggcgtctcccgcggtcaggttattggtttgcgccatggccacaggcaccagacngacttgttgcacaagcaaggaaaccaaagtggcgaggcggtnagagac

SEQ ID NO: 89803 - DNA, 521 bp, Triticum aestivum
  unsure (1)..(521): unsure at all n locations
  Clone ID: PAT_TA_89803
tatggtcgtccacgtcgcaacccgacacgctcggggtccattgagtccgtgcaggaggcacaactcacgacagtcgggggaaacctggcaaacaagtctgttgggaagagcgacaaggagtccactaccttggaagaagccactccaggtagtgcggtgtccgacaagtcatccccgggaagggggttcccgggtagcttgatgtctgacacgacaaccccgagaagggagttcctgggtagtgtgacgtcaggagctacgaccccaacaacattgacgcccaagagcgaggtggttcttgggcagtttgtgtccccgcctacagcgcggtcggacatgttcgacaccaacaacgttggcgatncacacaggtcgcgacgcctaaggggatcttcttggcgaacctgcangacgancacaacacctcgagaagacgggaaatcngacaangnacttggtcntgttcaaattctaagagttgtgccaaaaagtcccggatnatgggcgtcaaacccctcaaa

SEQ ID NO: 89804 - DNA, 481 bp, Triticum aestivum
  Clone ID: PAT_TA_89804
atttctcagatgtgatgcaattgacgctgaccttctgtctagaaagctgagattgggctagtcttgggtttgacctaatgtttcatttttacgcacggcttacgacatcaggtatattatgcagttcacgctctttgtccatcttcaacgttctgacagagcttaattaatatataattatctcgaccatgatttagcctcagttactatacacttcatacaatttgactcgcaaattgtgttctgaaggttactgaatcgtcaggcttaattttatgtttccatgatcaacccctcgaacaaggcttgattctgatcagtctttcagtagttaatgactgcgtaagacctttttttaattagggttatctcataccgattagacatggcccttacttcgactgtcactgcaaggacaattctcggtgccatgtattggatgccaaattgggtctcaacgaaagattataaatcaagggcc

SEQ ID NO: 89805 - DNA, 490 bp, Triticum aestivum
  Clone ID: PAT_TA_89805
gcatcacccactgcagctgcccaggaagagtccatcatactctctgcgcagatcagtcttgctccagctcccgtggcgacctcagtttcctgagtagcagatccctggacagggctgcatccccccaagaatctccttgagaggttttgcccagtctactagataacccactatcaaatgcccagcctgtttcacagaaatccagttttttctgttaaatactaaggcatttctgcaaatccaaagtccacacagaactgcagaagaaactatgtttaagagcatgaactttttgttccatagacaagagcagcaagtgacttaaaatcaacaatatcaacctttgaaaatttgtttaacatcacttcatatagctctagcaatgatgcactcaaaaaacaggtgatatactgattcagtctcagtacaagtgaatacactcccaagaaggtttgggctaaggctccttttccctaaaatcccgaagatt

SEQ ID NO: 89806 - DNA, 510 bp, Triticum aestivum
  unsure (1)..(510): unsure at all n locations
  Clone ID: PAT_TA_89806
agaactacattactcttcccattccatcagctctcgcaacagctactgaaaagtataattttgcgcaatttaacataggtgagccttgcaagcactacttagatgagtttagtcaccacgttacgttgtgtggggcaacacagttaggctctacaacataatgttcgtgcactgcgaaagatcatccgcagcaccaccacgcctaataactactatgtgtgccacatgacagaaacatttgcaacacaaggcaaaagaatggtaatcctttgcaattattctgttttgtttcatattgcatggtataaaatgatagtgactaacctttacaattgttttcagtactttaatgtccacttttctacgggttcccttttcccacacatgaatgctgaccacggtgaacttccaatcacaactgggagacggaacaaccaccgtcacggtccgctttatcaagggagttgacaaaangggcaacaacactaaaagggtgggagcgacttcntt

SEQ ID NO: 89807 - DNA, 576 bp, Triticum aestivum
  unsure (1)..(576): unsure at all n locations
  Clone ID: PAT_TA_89807
gaagctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgagctccggcggcatggagatggcggcggagaacggcggctgcggctgcacccagtgcaagtgcggcaccagctgcggctgctcctgctgcagctgctagatcgatcatcgaccatatgcatgcaccgtgccgtgcgtgcatcatcgatcatatcgatctactactaccataccatgtaaccgcaacctgatcganggctttatctatcactgactgatcagnatcagtcatgcatgattgtaacggcccccaaataaattccctgataacnaaanggggggccggtaccaatcgcctanangatctataccngccanggcgtctttnacncgnactggaaaactgngtaccactaacgctgagaaacccttccagtgggtaaa

SEQ ID NO: 89808 - DNA, 572 bp, Triticum aestivum
  unsure (1)..(572): unsure at all n locations
  Clone ID: PAT_TA_89808
agtctgcgacgcaagcaacaggcctggtgccagccgggcgtgagcggggttaccttgcctacccctgcccagccacgggatttacgggggctgccaccgaccccgcgtgggccccggctgccagcggcagcggccgtgaccgccacgggctcccaccgcagccgcggtccggatcggggacggcgccatcgccgtcggcatcggcatcggcgcatctctccagaccggcgacgacgacggtgaaggccatcgccggacgcgcccggctcccgacaactgggcgatccggctcccgcgccgctcgccggcgaaggtgccccgatctccgcatgcattaagcagcgaccagcggacagtcgatcggatcgacgggagagagagagagagagagacgangagtacaagtggtccgggggggccggtaccaatcgcctatatgatctataccgcgctactggctcgtttacactctgactggaaaactgggtaccaactatcgcttcanaatcccttccaactggtatancaaaagcccacnattgcctccacattccactatgcaanggacccct

SEQ ID NO: 89809 - DNA, 572 bp, Triticum aestivum
  unsure (1)..(572): unsure at all n locations
  Clone ID: PAT_TA_89809
ggcgagggcgccgcaatgtcgccgccttcctcctccggtgttggcggcggcaagcggtggcggaaagcgcgggagggatccggaggaggacgtgtacgtggacaacctccactcccacaagcggtacctcagcgagataatggcgtccagcctgaacgggctgtctgttggagattcgcttgccgacaacatcatggagtcccctgcgaggtcggagagttcctcttgtgtcagggacgaaataatctcccaatactcaccaatgtcagaagactcagatgactaccggtacttcgacacacaactaaaccccaacgggagtcaaggcgatgcaatggcaacccatcaactagtccaattcatctcctcatcgttcaaaaacgcaagcggttcctacnanaanccattccccccagggcccccaaancgtngntggcccaccccgagnnggcctaaaatnangcgttccgtctcaccaatgaattgcacgggcanactgagggaacccncacgagtcgtgaaataggtgaaggtccatgcaagaccgnatcgagccgaaganaganattcaa

SEQ ID NO: 89810 - DNA, 583 bp, Triticum aestivum
  unsure (1)..(583): unsure at all n locations
  Clone ID: PAT_TA_89810
ggaaattcctcgaccgattgaaagccaaggccctctcgtcctccttcaagatgcagatcttcgtgaagaccctcaccggcaagaccatcaccctcgaggtcgagtcgtctgacacgatcgataatgtcaaggccaagatccaggacaaggagggaatccctccggaccagcagcgcctcatctttgccggcaagcagctggaggatggccgcaccctggctgactacaacattcanaangagtccaccctccacctggtgctcaggcttcgtggaggcatgcagattttcgtcaagaccctcaccggcaagaccatcaccttggaggtggagtcctcggacacatcgacaacgtgaaggcaagatcaaggacaaggagggatcctccggacaacagcgcctcatcttcgctggaagcacttgagatggcgcacctggctgactacacatcagaaggatcaccctcactggtgctaagctctnnaggatcagatttttcanacgtaacggaagacatacccngagtgatctcgaacacnaaattgaaggcagatagatagaggatccccgacanagnttatctt

SEQ ID NO: 89811 - DNA, 585 bp, Triticum aestivum
  unsure (1)..(585): unsure at all n locations
  Clone ID: PAT_TA_89811
cagcctcttcgccggcgatgaccgcgtgtccccagacgcagaccccgtccccgcgagcatgaatcccccgaaccccgtcccggcgcgcatgaatcccccgaaccccaccccgctcctctccctgcgccccagcaaccccgccgtccccctcccccgccgccaccggcgcccccactcgccccgcccggcggccgccaacaccaccggcgccgcctcgccgcaggaatggttccgcccgcgccgcccggccgactccgacccttccacctccggcgggcgcgtcgcggcgcgcgacccgggcgtgcgcgtcaaggccaaggacggcgccgaggagaagaagggggagcgtaagangaggtggtgggaccgctggtccagggacaaggagagtactggtcgacgactgagccgtcccgatccttgacatccggggacgagccattccggaagagtcgacgccgctaagtgcgagtgaaatcgataatgaagatggttgtacantggacgggaatgcngantcanggtcggatgtactactaggaanagggaagggacatctnacttgtgcgtcctgattgcanttcn

SEQ ID NO: 89812 - DNA, 586 bp, Triticum aestivum
  unsure (1)..(586): unsure at all n locations
  Clone ID: PAT_TA_89812
acagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaactgcctatttcgggtgcactgacccacacaggtgatcaacgangtggaggangtcaagaaggatacctgaccgtattccgcatcatcggatcgacaacatgntaagtgcatgcgtcagctcatcgcctcaagcaccgggctcaagatccggaaggctaaacactcatacaaggcatttaatgcatgcagtttgtaaccnaattcttggtttctccantacttctaatgtc

SEQ ID NO: 89813 - DNA, 575 bp, Triticum aestivum
  unsure (1)..(575): unsure at all n locations
  Clone ID: PAT_TA_89813
tccgagagtagctagcctagtctagggtttccgtagttcggagaggagagaaagggagagatccatggcggagacggagtaccgctgcttcgtgggcggcctcgcctgggccaccgacgaccacaacctccagcaggccttcagccagtacggcgagatcctcgacgccaagatcatcaacgaccgcgagacgggcaggtcccgtggcttcggcttcgtcacgttcggcagcgaggagtcgatgcgccaggccatcgaggagatgaacggcaaggagctcgacgggcgcaacatcaccgtcaacgaggcccagtcccgccggtccggcggtgggggcggcggcggcggctacggcggccagcgcggcggtagcggaggtacgcggcggcggcggtggctacggcggcaggcggtggcggctacggcaggaagcggtggcggctacggcaggcggtggtggtacgcggcagcgcggtggcgcggctacgcgcggcgcgcggctacgcgcgcgtggtggtacgcggcaacttgtggcgtactcggggcagtgaggaacnaccgcgggcctcagtatn

SEQ ID NO: 89814 - DNA, 570 bp, Triticum aestivum
  Clone ID: PAT_TA_89814
aaatcagcagcctcgcgtgcccacgaccaggtccatgtccaacgcagcagaagcaggcgctccatttccttctctagccaagtagcagacgcagcgctcccattccttctccctcggcaagcaccacgccggtgcacctgatcccagagcgcagccatgtcctccctgtacaagcagctgggcctgggcgccgccggctcgccgctcacggcctcccacctcctcatgctcgtcctcggcgccggcttcctcgccttcaccgtcttcgtcgtccaccccaacgacttccgcctccagtccttcttctccggcggctgccccggctccccgccccacgacgccgtcctcttgccggtcaagcacgccgacgccaccacgccggccaaggcgccggtcgagcacccggcgtgcgcgtgctgatcggcatccagacgatgccgggcaagtacgagcggcggaactgctgcggaccgtcaccgctgcagctgaggagacccgcctcgcggcgcgtggactcgcttctctcgcaagtcactccgcgtcacgcgtctgtggcctgaatatcctagg

SEQ ID NO: 89815 - DNA, 212 bp, Triticum aestivum
  unsure (1)..(212): unsure at all n locations
  Clone ID: PAT_TA_89815
gtctcgagttttttttttttttttttatttcgtttcttttttatttataccttctcttctttatctttagttttatctacttatcaatagtatctaccggctcgaactcgaatttgatcgccttccatacttcacaagctgcgggctagtttnaggacncattttgcaaagccggcccggaaaaattnaatnacttncgcnaacaagattgc

SEQ ID NO: 89816 - DNA, 558 bp, Triticum aestivum
  unsure (1)..(558): unsure at all n locations
  Clone ID: PAT_TA_89816
ttttaacttcatctcatgccatacttgggaaattaacggagttcgcgacaaatctcaccaccagtcgatcagaaaccacgatccaagacgatcgacgaagcaaaacagggcagaaagacaccaaacatcaccacatcaacaaggcgtctctcacactcgcgccggccatcctccatgagcactactactaccactactcgtctcgatccgtctaccacgagcactaccactacgactactcgactcgcctccctactcgatcttcacctgggaacacgtccttgcgctcctcctccttcagcctgggcacggtcaccctgagcacgccgttcttcatctcggcttgatcttgtccatcttgaacgcgtcggcgggaccttgatgcggcggtgtactcggaccgcggatcgcgtcgccgtcccaggntccttgtcgcctcgccttgataacangcgttcggtcggccanacttcagtgctcctcccagccggatcggacttgaggaacaggtctcgtcacttcacaccagcgtcgagccgcacgcccgnatggagaana

SEQ ID NO: 89817 - DNA, 532 bp, Triticum aestivum
  unsure (1)..(532): unsure at all n locations
  Clone ID: PAT_TA_89817
tagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaattcgagaccctgtcctacttgccaccgctcagcacggaggcctcctcaagcaagcgactacctgatccgctccaagtgggtgccttgcctcgattcaacaaggtgggttcatctcccgtgaacacaacgcaccctgggnacatgatggcgntactggacaatgtggaactgcctatttcgggtgaacgacccacacaatgataacaagtggaggaggcaagaaggatacctgacgntattccnataacggatcgaaantcgcaagtcatgcgtaactcacgcctnaancacgggtcaagatccgnaggctaangtatagaaggcattta

SEQ ID NO: 89818 - DNA, 561 bp, Triticum aestivum
  unsure (1)..(561): unsure at all n locations
  Clone ID: PAT_TA_89818
ctcgtgtccaccgccacgctctccgccgcgtcctactcctccgtctgccccaagcccggacacgctgacgaccgctacaccgacggcaacgaaatcctcttactcaccagcttcttccagatctccaccggttacttctccgagggcgcggacagcttgttctccgccaccgacgatgatgacctctacggcagctatcgctcgttttcccttttcccccacggcgcctcccacaccagcgaccaggctctcgtgcacctcacagctgccaccctcaccctcaccggccccgcatccgcacctacggcaggcctggacgccgccgcaattacaccgacaccgggtccatctccttcgtcctcgacggttctatcctccgcctcactcgaactctgcatggccgggaaggnaccgagtcgccgccgacggtctccaanactacccgactcgtcctccgctcgcgtcccgacgtcctcctcacgatccttcgtgacggantcnaaagttcggctcggggcatcanctctctcgtacgccgaggggaaactacagtagctcgng

SEQ ID NO: 89819 - DNA, 578 bp, Triticum aestivum
  unsure (1)..(578): unsure at all n locations
  Clone ID: PAT_TA_89819
caccgatgaccatggaggcggagcgcggggccggcgaggaggaggacgagccgcggcgccctcttctcccaccttcgtcgccagcggcggagcaccagcagcagtaccggcacctggggcggagcagctcgtcggcgctgcgcgatggcggaggagggtgggcggaggtcagcgccaccgaggtcaagtccgccgcctccttctcccccaactactaccccccggcgcccagtcctcaccacgacgccgtctacccgccgtccatccacaacgccgtcctctcccaatccccgtcaactgctgccactcntcngcatacgcatggtttggcgattgttcctcaagggccgtacccgtacggcggtgattaccanccttctcagggcgtccggaggatttctggatgaggtgaggtccggnantctaatcgaccatttgggatcattttttgggnaccggtttncngaangaaanttcatcnataaggangctgtacgtancttggacttgaaccttcatcnncagggacacattttaaaggaacccttatgggggaattnntgaagaaaggtcttctt

SEQ ID NO: 89820 - DNA, 537 bp, Triticum aestivum
  unsure (1)..(537): unsure at all n locations
  Clone ID: PAT_TA_89820
gtttttttttttttttttttgactataagttgcaaaatccacaagagatacgcatataagcgttgcagcatatccgttgtacacttgcagctcacggccatantgtcgtacatagattgcaacagatcttatatgttgccatgtacgtgttgtaaattatatctgttataagactgcaaatatacataattaaaaactaaaattaactagagacgctggtacacataaggaacgtggcgccaaaatctgtgctgaccgttcgagcaangtgagtactaggcgccagtgcgccggcccaactttgggccggtcgtaccagcagcgtcctatcagcgtccgattgaacaactcatagccgtacgattcnttccttttctttcaacaagngtctcttcctttanaaaaaactccatcatgctgcatggatnacgatgcgccaaccagaaatacgccccgatgnntcgctgtaancgcctcctgctggtctctnntcgctgcggcgcatcnttgcgcngcgnnccatgtggaacagaacaa

SEQ ID NO: 89821 - DNA, 230 bp, Triticum aestivum
  unsure (1)..(230): unsure at all n locations
  Clone ID: PAT_TA_89821
caaatcagatcatcgcacccccggagaatctgtcnctcccganaaagagncacgcagcgcagcgtaagggcgggcggaacaatggaggnnaacggtatcagcggtnngaccnccgaggccncngctcgccnccctcngcangtcgcgatactggtgacgcccggnatgggccacntgatnncgctcgccganctggncaagntcctgnatgcccttganngcgtcacagg

SEQ ID NO: 89822 - DNA, 592 bp, Triticum aestivum
  unsure (1)..(592): unsure at all n locations
  Clone ID: PAT_TA_89822
catacaataacaagcagagagtgacaatgcacacaaccgtaataataggtcacaggaaaacagcacgtctcttacatattagtgctaaacaaaagtaacattgccaacactccagtactaaatccagccagcatattggtcgcaccgcatcatcttaagcatcctccgtctctactcgatatcgccagatgcgtggcccaggtaagagatcccgaaagcaagtgagattcacccctgcagatatatttagttagaaagccgatgtggatgtaaaatctttgcttctgcggttttagaataggacccactaaccgtaattgatcagtacagatggcacaaaatgacaagcaaactaattcatgattggngaanctcacagccagcttataccagttttggggtaaacatatngaanctangtnttataaattccaaagatctgtntatgcatagcacatanaaccacgaccagcaggagacatcatcactatancgtcattgaanaacaccantcgataganatatttcaggttacacattccaagatgtcattaatangcattcaattgggtaacaattaggttcatttagg

SEQ ID NO: 89823 - DNA, 590 bp, Triticum aestivum
  unsure (1)..(590): unsure at all n locations
  Clone ID: PAT_TA_89823
aaggcgttgtctaatatcacttgtattatcttctccctcaactatgttcttccatattatctgtcaagtttgtgccgtccttctccgttaccagatcagtctcctcaattcagaccgctgacatgtatccaacctcactgctctccatcttggtctcactgttcctcttccatcaacgggtacatgccgagtgtgagccggtggcgtgcgggaacttcaccatcaagtacccgttctggctcggcacgcgcagccgacccccgccggagccctactgcggccacccatccttcgagctctggtgcatcggcagcaacaccacggcttccatgagcggatccccatccacgtccacagcatcgactacgggcccaatccttcgtcgtcgtccacagcagatcgccgcgggcatggacggcgtgtgccttgccgacttaacgtctcgtcagctcgcctcagccgttaagatagccaacaacgtgcctggctctgttaacgcaacggacgagcacccggagnataccaaagcacgcggctgaaagccactcctactggnggactcgtcggaacgcgcgggatcgacgggangg

SEQ ID NO: 89824 - DNA, 591 bp, Triticum aestivum
  unsure (1)..(591): unsure at all n locations
  Clone ID: PAT_TA_89824
caaattccatgcggtgatggatgcaacagagcccagcctcctctagggtttgcgtccgccatcgaggtgataaccggcggctatggcggcgatggcgacttgcgggacaaaggaaggattgcaagaccatcgttctggaggatgggtgagactttatgcagaggggcttcaacatgctcatcaacatcctcgagggccagagcccgagcacaactccgaagactacatgatgcagctgaccacgttagtgattgctggctttgctgcattggtcaattttaaattcagttaaacaaggaaaacaagatcagaatttctgctactacacttccttggtattggcgcttgggggtccacagttcatcgattgttcttatacttttggtatgctcattcattctcattgcatgaattgtatacaaaaggatgtatgatcaagatgactaagaaacaaaactgaatttgtcangctgcatcgtgtctcagtactctttgtatacaatgacnagtggaatttcccatgattaaaaaagggggccgtaccaatcccatatatctataccgnccanggctcgttaactctacggaaac

SEQ ID NO: 89825 - DNA, 177 bp, Triticum aestivum
  unsure (1)..(177): unsure at all n locations
  Clone ID: PAT_TA_89825
nctccctcaccccctctcgcccctctcatgcatgagaggtcgccggggccatcgctagccgccacncgcctcccctcccccgnctccctgcncctgctcctgctcatctcgctgtccntgctcgncgngtggttcacaccgncggtggngccgcaaggactactaggggtgctccct

SEQ ID NO: 89826 - DNA, 560 bp, Triticum aestivum
  unsure (1)..(560): unsure at all n locations
  Clone ID: PAT_TA_89826
tctgcctcttccccatcggccgataggcgcaagcgccccagcgccgccgcccgaccgccggcgctggtgagggcatccttcatccctcggtctaaatcctctgtcgttattcctccttgtccaccagctcgggccctcgggtctctcccccattaccccccaaaaccgaccccgaaaagccgaaaccctcgcctcaccccaccgcagcaatggccggagaagacgccgccgtttccgcgggcactgcggcgccgcacaatccgcccaagaaggaggtgtacgacgaagacgatgaaaacgacgtgccgctggcgttctctcgaggcaagaagaaagcgagcgcggcgancgccaccaagtcaagaaggaggaggacgacgatgataaattccgcttgcgcgtcgggccaaaaaangacatgggggtgcaaagaaaggagaaaaagagataaagggaagggaagaggaggatacaagaggaggagaggagacaacgacgacangatttgagatgataactccggttcgcgggaaagaagaaatgagaaggagaaacactca

SEQ ID NO: 89827 - DNA, 403 bp, Triticum aestivum
  unsure (1)..(403): unsure at all n locations
  Clone ID: PAT_TA_89827
gtactccttgaggtagtacacttggtcaagctctagtccatcagcagcagtcatatcacgtcctcttatacctcatttctgttcctctgaacgatttactcgtctgaaaaccccatcttttgctaaataatcaacccgtcgatttacacaacaattgtgctcacttaaatgatcgaaatcgcctgccgctggcctcaaatccccagtttcaaccaagctggggcatacttcaaatcttaatttcaaatgaaatacattttaaatgattagtgagatagggattcctgaaaaaggaagagatgccagacctgtcactgttggtcattgctagtggcaaaatgcacgatccttcccgacctgcacccacgcaaaanatttgaccaacaatatttgtagaaaagaa

SEQ ID NO: 89828 - DNA, 420 bp, Triticum aestivum
  unsure (1)..(420): unsure at all n locations
  Clone ID: PAT_TA_89828
atagtccaccaccgcgtgccctacggctgccgccgctacctcgcgtcaccgccgacgcctcaattccgccccacgaccaccccacttaccctccctccctcccgcccctcgccccagcaccacgcggcacccaaaacaccccagcctctaacgcgcgtcgctgccatcgccgttaccgcccttcctcgtcgcgacatcgcgttcctgctatctccacccggcctgcaatttttggccattangttttgagtaacactgggcagaaatggagaatgtgcagtatgccgaagaactcgtgagggagtttcttgtctttaggggtttcacgaanangctgcaagcttanaggcagaattgtccacngagattngnaggaactttgaagtagcangatctagattaangtctagtntnatccaa

SEQ ID NO: 89829 - DNA, 467 bp, Triticum aestivum
  unsure (1)..(467): unsure at all n locations
  Clone ID: PAT_TA_89829
gcggtggccagtcatggccgcatacggtggggctgtcggcgggagcatacgcaaggttacggagggagctgcggcgcaggggagggggaaacgagggggtggccggggcggctgcaagcgtgccggatgcggtggtggccattcatggccgcgcgctgtggggctgatggcggtggcgcgtgcaaggttggggagggagatgtggcgcccggggagggaaagccgagcgaaagtcgagcgagccgttccttgtcctccgctcnatttggaggtaccgcctagttccgaanaaanggggaatangccattctccagaatcggtgggttcccgttcctttgacaaaccaaacactgaaatggctctggggacggtaccgaccattacatttcacttgaccccaacaaaaacaccttaattgatttacccaaaattccttttggcaaaaactgggggnnaaaggtttccc

SEQ ID NO: 89830 - DNA, 564 bp, Triticum aestivum
  unsure (1)..(564): unsure at all n locations
  Clone ID: PAT_TA_89830
ctgcttcgtgccgagtgaaggtaagctgttgatgcgagtgagggtgtgctcgccatggctctcacagacgaccacgacgagtatgccaagctcgtccgggggatgaacccgccgagggttgtgatcgacaacgaagcctccgacgacgcaaccgtcatccgggtggacagcgtcaacagccacggcaccctcctcgccgtcgtccaggtcatcgccgacctcaacctcgtcatccgcaaggcctacttctcctccgacggcagctggttcatggacgtgttcaatgtcaccgaccgtgacgggaacaaggttcttgacacgccaaccatctcctacatccagacgacctggaagccgaggattgctactacccggaggctcgcaacacggtgggcatcgtgccgtcggaggagtacactcgatcgaccacnggggaccgaccgccgggcctgctctccgagtgtcgcgtgctcccggatcagncgcgtccggaacccgacttggacgcanacagccgtccggcgtctnagtacgacgggcaancccggcgggcatcagacaggg

SEQ ID NO: 89831 - DNA, 365 bp, Triticum aestivum
  unsure (1)..(365): unsure at all n locations
  Clone ID: PAT_TA_89831
ctcagtcctcggttcccggcccggttcggttcgttagggtttagtagtggggaagnaggaggaagaatggcggacgtcgagtaccgctgcttcgtcggcggcctcgcctgggccaccgacgaccagtccctccagaacgccttctccaagtacggcgacgtcatcgactccaagatcatcactgacagggagacgggccgttcccgcgggttcgggttcgtcaccttcgcgtcngacnaggcgatgcnccatnttntcgangccatgaactgnnagganctgtanggncgcaacatcaccgtcaacgangccagtcccgccgctcnggcggtaggcggcggcngcttanntgnggaggaggtngc

SEQ ID NO: 89832 - DNA, 508 bp, Triticum aestivum
  unsure (1)..(508): unsure at all n locations
  Clone ID: PAT_TA_89832
acaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaaccaccgtcgacggcacctgcggtggaccctgcaagaantactgatcggtcatgccggcatatgatatntccgcctaaaataaataaaactcggacgagatgacagcncacctcctagctgtgtgtgtgaccaacaaattgtatacattantctnctcctcgctttttctctctcngagaaaattgtttctgttttaactatcggaatacccgtgaataacactgtatgatgtcgtggtgc

SEQ ID NO: 89833 - DNA, 212 bp, Triticum aestivum
  unsure (1)..(212): unsure at all n locations
  Clone ID: PAT_TA_89833
ctctcctccacctcctcccccctcatccatggcgatggcgacctctcacttgcncgactaaacagacangcaagctcacgcaagcgcgcacccagacgcactganagncggacanatgggtcannaagacaaggaanangcgcnggtantcantatccactcgtccggcatcnncatgtcnaccatggacaacttcctgntcgangacctgg

SEQ ID NO: 89834 - DNA, 544 bp, Triticum aestivum
  unsure (1)..(544): unsure at all n locations
  Clone ID: PAT_TA_89834
cggcaagccccccaagggcgtcaagaccaactggatcatgcacgagtaccgcctcgccgacgtcgaccgctccgccgccgcccgcaagaagtccaacaacgctctcagggtaaccaccttgcctgcctgcccaccgcccccgtcccctctctgtcagtctgcgctgatgcttggctgtctcgtttaatcccttcctattttagcattagcgagagatttaccgtgcatttagtatagaaatcaagcgagagatctttcttgaaatagcaagctgtattttagctttagaaaatcaattgggcaggttaggtgcgtcgtggcatgcgaaaaagaacaagggaaaagggcaaattgcagcacgctcaattgtccctttcgtcacacctgtatttggaacgacgtgcggaaanattgcggcgncgcatggcgtcatggtcacgcaccagggatggagacacgggccgnctatngccgcctcccatctccgtcactaagtaacnacttagtactttcannaaaaatctgccntgatcancgcggcgtt

SEQ ID NO: 89835 - DNA, 243 bp, Triticum aestivum
  unsure (1)..(243): unsure at all n locations
  Clone ID: PAT_TA_89835
ctagtctcgagtttttttttttttttttttataatcaaaggtttggaacctataatnacaactaaaangaaacaagaacagagctgctaanttcagtcnccgcnaaaagcganagctttgttccaaaaccctttttatctacttcagtttcttatatatatatatatatatatatatatatatatatatatatatatatatatatattatacncngaanaaanacccttcntttggcnacnac

SEQ ID NO: 89836 - DNA, 566 bp, Triticum aestivum
  unsure (1)..(566): unsure at all n locations
  Clone ID: PAT_TA_89836
ctcgtgccgcaggctttgaccccatcgcccctccgtcctcttcgtctccggtaggccaggtagttaacagctccagcagccatgggaaaggagaagatccacatcagcattgtggtcattggccatgtcgactctggcaagtcaaccacgactggccacctcatctacaagcttggaggcattgacaagcgtgtgattgagaggtttgagaaggaagccgctgagatgaacaagaggtctttcaagtatgcctgggtgcttgacaagctcaaggctgagcgtgagaggggtatcaccattgatattgctctgtggaaatcgagaccaccaagtaccctgcactgtcattgatgctcctggtcaccgtgattcatcaagaacatgatcaccgggactcccaggctgatgtgctgtgcttacattgactccacacggtggtttgaggtggatctcaangatggcaaccgtgacacctctcntgctnaccctgggtgaacaatatcgctgctnacaagatggtgcacacccagtatcaagccgtataaaanttaagaatcctcaacnag

SEQ ID NO: 89837 - DNA, 511 bp, Triticum aestivum
  unsure (1)..(511): unsure at all n locations
  Clone ID: PAT_TA_89837
ccaaattcgtcttcctcctctcgccaatggctcacctaccaccacactcgctcttcctcctcttcctcgccgtccatgtcttcgncgcatcccatggcncccctcttccgccatctagtgcttacaatgattctgtgtgctcggagtcnatcaagtgtggcggcgttgacatcanatatccattctatctgtcgaacgcaactcaagcancacccgnttacanatcccantacgcatgcgggtanaccgatttgaagatcttctgccaaggcganggggcaaccgcnatcccaatccttcanctcggtcaagacgcnttacacaactacaccgttcggncatcatctacgataatcacgccatcattctcagggacactgangcctcaataccggcggcaagtgccccacagtcagccanaactgtcatcggcaaggatggtgaattacacggctcnggaggagncacctctcntcgcgctcccacatagggcgtantgcactgatctcgc

SEQ ID NO: 89838 - DNA, 504 bp, Triticum aestivum
  unsure (1)..(504): unsure at all n locations
  Clone ID: PAT_TA_89838
gataaactcgagttcgatcatcaccaaccatgtcgtgctgcggaggcaactgcgggtgcggatccggctgcaagtgcggcaacggctgcggagggtgcaagatgtaccctgagatggacganggagtgaacaccgcctcccagaccctcatcatgggcgttgccccctccaagggcaccccgtcgttcgaggccgccgccgagaacggagggtgcaagtgcggccccaactgcacctgcaacccgtgcacctgcaagtgatccatgaagcctcaatcaaatcagatnaaggagatggatggatggacctgatgaangagcaatatanttatcatgaatcncaagctgtgtttctttaaattgcaaccagataagacagatntanntacctancanctantaatggttaccgncccttgtgcttgaccgttgctgttaagctctgtctgnaacccttccaacntcaatcctccgagntaaaanananttggttaaaaaaaaaaaa

SEQ ID NO: 89839 - DNA, 557 bp, Triticum aestivum
  unsure (1)..(557): unsure at all n locations
  Clone ID: PAT_TA_89839
aataggcacgcacggctagggtttatccagccacccgccgccgccgccgccccgcccgacccgaccgctccccgcggccgcccgaccggggcttaccctcctcccctcacccccaccgaggcgcccgggcgatggacgcggcggngctcgacgacgtgatccggcggctcctgtaggcgcgcggcggccggacggtgcgccccgcgcagctctccgacgcggagatccgccgcctctgcnccgccgccaaggacgtcttcctcagccanncnaacctcctcnagctcgangnccccatcaaagtctgcggggacatccatggcaatattctgatcntcttcgantattgagtatggtggtttccancggtggcgaactantgtttctgggtgactatgttgatcgtggaaaatagtantgaaacgattgnntctcntgcntacagattagtaccggaanntcttttccttagggaaacatgatttgctcnanaaanatcttgnttctttnaatgnaataggtnatntcgcctgnaggtttcnangtttacnctcctt

SEQ ID NO: 89840 - DNA, 504 bp, Triticum aestivum
  unsure (1)..(504): unsure at all n locations
  Clone ID: PAT_TA_89840
tccgcccacgccaatcctcctaaatccaccgccgccgatccgccgtgatggaccgcagcagcagcagcaatagcggcggcggcggcggacacaacccgcacctcggcgtcaacaagcacggccggaacatccgcaaagcaacgccgccgccgcctcctcagcagccgccccgcccgccgcacccccagccgcaggtatacaacatcagcaagaaccagttccgcgacatggtccagcagctcaccgccggcacncttcccctccgccgcctcagcaccaccaccgcccccctccgccgctccagcagcagcaccaacagaatccaagcccgcctccatgcgcctccaangtcgcnnggcccnccatctncaccccgtcgcgnggcccctccgtccgcaacaccacanatnccancctaacanaacccgccttcatgccccgnaccncaaaanccatnctccgcgggccgctgggcgancccgtcntgctaatgnntcncaaatc

SEQ ID NO: 89841 - DNA, 225 bp, Triticum aestivum
  unsure (1)..(225): unsure at all n locations
  Clone ID: PAT_TA_89841
ttttttttttttttttttttttttttttttttttttttttttttttttttaanatcttaaagtcncaatattatacanacatagccgtgacantaggntnagatatgttcacnagggctcancttgngnagccatcaccacgcaaganancacaangggggacccataatttcaaancccgcgagatggaaaacccagtaaatnanactcacgttnntatcacca

SEQ ID NO: 89842 - DNA, 191 bp, Triticum aestivum
  unsure (1)..(191): unsure at all n locations
  Clone ID: PAT_TA_89842
gcagctactagnctactaggtgctcagcgcacgcatgtctccttcntctgtgccagcngncgccgtggcgangtcgacccgcctcgtcctggtntacggcacnngccactgtgagatggtcctggtacaaggtctccaccctcctccgcaccgcgntanaccgcgttncatcgccggncatcgngagcctg

SEQ ID NO: 89843 - DNA, 185 bp, Triticum aestivum
  unsure (1)..(185): unsure at all n locations
  Clone ID: PAT_TA_89843
cacgggcccggcttcngttcgtgtggggagagcttccagcgtctcctnatgggggtacaagtacgagggtanccggcgggcgtngccgccagggcccgcccctntncantccgccacnctcgcgggcacggantcctncgctgcatcanccnagcccanttcctctcntgnnagcatccnnatga

SEQ ID NO: 89844 - DNA, 304 bp, Triticum aestivum
  unsure (1)..(304): unsure at all n locations
  Clone ID: PAT_TA_89844
attcaagagttatagggagggacttatgtcaccacaaacagaaactaaagcaggtgttggatttaaagctggtgttaaagattataaattgacttactacaccccagagtatgaaactaaggatactgatatcttggcagcattccgagtnagtcctcacctggggtccgnccnaatgaaacaaggggccgcaattaccnngcgnatcctccantggnaaatgnanaangtttggncnganggcttaccagtcttgntcgttanaagggacntnctanaaatcnagncngttgnctggggaaaa

SEQ ID NO: 89845 - DNA, 540 bp, Triticum aestivum
  unsure (1)..(540): unsure at all n locations
  Clone ID: PAT_TA_89845
caggaacggaaccaacgaatccccagccaatctcgtctccgatcgaccccaggctcgtcgaatcctcctcccccgccgcctcaagatgcagatctttgtgaagaccctcaccggcaagaccatcaccctcgaggttgagagctccgacaccatcgacaacgtcaaggccaagatccaggacaaggagggcattcccccggaccagcagcgccttatctttgctggcaagcagctggaggatggccgcacccttgctgactacaacatccaagaaggagtccaccctccaccttgtcctgcggctgcgtggtggcatgcagtcttcgtcaagacctcactggcaagaccatcaccttgaggttgagagctccgacaccattgacaacgtcaagccaagatccaaggacaaggagggcattcctccggacaacagcgcctcatctttgctggaagcagctggaggatggtcgcacctcgctgactacaacatcagaaggatcacctcaactttctgcgttgcntgtggatcaatctcgtaaa

SEQ ID NO: 89846 - DNA, 560 bp, Triticum aestivum
  unsure (1)..(560): unsure at all n locations
  Clone ID: PAT_TA_89846
ctcgtcctcccaccttccccgatccctaacctcctggatcccatcgccggcaacagcccgacctccgctgccggagccgcccaacacatagattcaccaaacaaaacggcactcgctcgaatcctgccctcgcgccgccccactcgccgggatccggtctcagcgtcgaccactcccctgccacagtatccggccgctgcgccgcccacgacccggatccggccatcaccttcgccgtccccacatccgacgtccagcacctgctcctcccttgttccttcttgcgctggccggctccgttcagagcaaagccgtggccaatggtgcgacgccactaccccgagcagcaaccacttccacgcttcatggtcgggtcatccccgccgcacctgttgagtccctggatctctcctccattgcgggtggttctgcacgcgagatctcggacacgggcgacaaccgtggtctcaaacgccggcgatgagccagcggagacaggtgctgccgaccctgcttctatctctcaaggatcgtctcangaccgcttgagggngtcatgn

SEQ ID NO: 89847 - DNA, 568 bp, Triticum aestivum
  unsure (1)..(568): unsure at all n locations
  Clone ID: PAT_TA_89847
aagagttatagggagggacttatgtcaccacaaacagaaactaaagcaggtgttggatttaaagctggtgttaaagattataaattgacttactacaccccanagtatgaaactaaggatactgatatcttggcagcattccgagtaantcctcagcctggggttccgcccgaagaagcangggctgcagtagctgccgaatcttctactggtacatggacaactgtttggactgatggacttaccagtcttgatcgttacaaaggacgatgctatcacatcgagcctgttgctggggaagacagcaatggatcngttnntcgcttancattacacctnttgacganggttccnttantaacatgtttacttccantgtangtaactatttggntcacagcccnacgtctctacgtttggatgatcacaatcccctacntattcanaacttcatgnccgcntcatgtaccaanttgaagantatttnacattgtgtcgccttactggattcattaagcntnattgngttnccgcacanatangacncgtgtatagntcactggggntt

SEQ ID NO: 89848 - DNA, 571 bp, Triticum aestivum
  unsure (1)..(571): unsure at all n locations
  Clone ID: PAT_TA_89848
gcgcgcgcgcgcgaaccccgtgtctccgcccatgccctcgcggcggctctgatccggccgtcgtcgccccacatgcagcaccgctcgccggcggccgcctcagcctccgcctcccccggggcggtggcggcggnggnggcggccatggcgcccggcgtgggcggggtcgagccggccgtggcgctcgaccaggtcccgcgctggagcgaccccgaccagcgcttccactcgccctcctcccccaccgcggccggatccgaggcccccgcctcctccttcctctccttcnccgacccgctcnacgcggccgcggggggcggtggccacggcgcgtgccgcttcccgtcgaccccgaggtcanctccatggatctacctctggcggggccaccctggnactcnacgtcgacgccgtcgtcaactcacatngacagcttggacangcgcatagtagncctgggntnatgctgctgnngngccggagctcgctaagatntgcaacttggtggtgccgctnggattgcnatgtgacaanngttatcgccgcaggaatatcatcannggnctaaata

SEQ ID NO: 89849 - DNA, 210 bp, Triticum aestivum
  unsure (1)..(210): unsure at all n locations
  Clone ID: PAT_TA_89849
atctttacatttcactacaaaggaatntantcantcanggatcaaatgaaaatnccacgggctgtgataggntccaatcaancaatctcatcanaaacctatcagncaganagcancactcatcttacatanatntntaaacattgtcatgtttgccttaacaccggatatccacngancnaggatttgagatcatcngnangtgtaagc

SEQ ID NO: 89850 - DNA, 605 bp, Triticum aestivum
  unsure (1)..(605): unsure at all n locations
  Clone ID: PAT_TA_89850
gcgaccccgtcctctgctattctcgatatcgaacgcaaagtcacaaccttaacccgtagcggtgagctgccggtggataactttggcgtgccgctggcgggtagcctgattccgtggatcgacaaacagctcgataacggtcagagccgcgaagagtggaaagggcaggcggaaaccaacaagatcctcaacacatcttccgtaattccggtagatggtttatgtgtgcgtgtcggggcattgcgctgccacagccaggcattcactattaaattgaaaaaagatgtgtctattccgaccgtgggagaatgcnggctgcgcacatccgtgggcgaaagtcgtccgaacgatcgggaaatcactatcgttgagctaacccangtgccgttaccggacgctgacacgccgtaggccgctgggtaagctgaatatgggacaaagtctgtaaccttacgtggcgacanctctgtgggggcccggacngtcatcgntctcngnatggggaacttatcataatctgggggatcccccngtanntatcagggnagcaaantcagattacggggtnnatgnattgnatctagggnngaaangttcaagctncg

SEQ ID NO: 89851 - DNA, 314 bp, Triticum aestivum
  unsure (1)..(314): unsure at all n locations
  Clone ID: PAT_TA_89851
nccatcagtagcagcggnagccgcacatcagcagcttgctctgttccatccggcagcaatggcggccaccaccaccatggngctctcctcccccgcgatcaagctcgccggagcctcctacgccctcggcggaggcggccgcatcaccatgcgcaaggccgcgcccaaggcctccgnctccaacagcccgtggtacggncccggncgcgtgctctacctcnncccgctctccggcgagnccccgagntacntcaangtgcgagttcccggggcgactacngntgggnaancgcgggggtctcngncggcncggg

SEQ ID NO: 89852 - DNA, 479 bp, Triticum aestivum
  unsure (1)..(479): unsure at all n locations
  Clone ID: PAT_TA_89852
ccgcggccaaggccaagccggtgtcgtccggcagcccgtggtacggctccgaccgcgtgctctacctcggcccgctctccggcgaccccccgagctacctcaccggtgagttccccggcgactacgggtgggacaccgcggggctgtcggtcgaccccgagaccttcgccaagaaccgggagctggaggtgatccactgccggtgggccatgctgggcgctctcggntgcgtcttccccgagctgctcgcccgcaacggcgtcaagttcggngaggccgtgtggttcaaggccggctcccagatcttcaacgagggcgggctcgactacctcgggaaacccagctccgtccacgcgcagagcatccttgccatctgggcctgcaggtcgtgctcatgggcgccgtcgagggtacggcgtcnccggngggacgctcggnaagatngtcgnccgctctaacccggggaagttcacccctgg

SEQ ID NO: 89853 - DNA, 233 bp, Triticum aestivum
  unsure (1)..(233): unsure at all n locations
  Clone ID: PAT_TA_89853
ttttttttttttttttttttttttttttttttttttttttttttttttttttttttttaangaaaaatccaaacttcatttccaaattatttgacaccganccaatcanaattacccccacanatcaaatttgcnacgcgncngaanaaacnccaaaannaaatttttttncttcattgcaaaacaaaagccangtaaaaagtaaanaatttnctttaaggcacctngacaaa

SEQ ID NO: 89854 - DNA, 542 bp, Triticum aestivum
  unsure (1)..(542): unsure at all n locations
  Clone ID: PAT_TA_89854
gtcgcggaggaccggtcgggagctgtagcatcgggtgtggccatgctggaagcttggccgtgcatacaactgtcaggctcgccggggagcagccacaggtcaagccgaagggcttcgacacacgcggtcgcgcgccgacaatgacacgcgctgctgaggacggcatgcaacgtcacgctgcgatgccgcgccgggatagcgggtncgtnggcctagggcctccgccgcgcgagttaggtcaagccgaaagggcttctcaacacgccgtcgtacgccgacaacgacgtgcgctgctcatgacgccacgcaacgtcgcgntgcgatgtcgtgctgggaacgagcanntcnttggcngagggcctccaacgcgcgggttanacgccgcctccgttgtgagtaacggtgtcccccgnctgggtaaacttgngaaangccaatgtttgaagncaagtacagtacgttggtggttccgcntgcangtcaagccatgntgtttncggtcttntccatctncaaagcagaantcctcgngaggaatctca

SEQ ID NO: 89855 - DNA, 548 bp, Triticum aestivum
  unsure (1)..(548): unsure at all n locations
  Clone ID: PAT_TA_89855
gaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaacttccgcgcgctctgcaccggcgaagaagggcgtcggcaagagcggcaagccactgcactacaagggcagtcgtttcaaccgcgtgtcccgacntnatgttccaaanggcgggggattnaacaaagggnaacgggaaccgggggganttcatctnacggggaaaaantnccnggcgaanaaatttgttcanaaagnaancaaagcccggggttttctcccaatgngaaangggggnccaaaanaaaaggnnccnattttttaatngaacgntccnngaattgctcnangnaaaaatnggctncgnaaaggttnccaggaatgntncnaagaaaancaaaagngggnccccaaggaactttcaanaanttgttcc

SEQ ID NO: 89856 - DNA, 496 bp, Triticum aestivum
  unsure (1)..(496): unsure at all n locations
  Clone ID: PAT_TA_89856
agaagtctccgattgaagcgaagcgaagccaaggctctctcctcctcctcctaagatgcagatcttcgtgaagacccttaccggcaagaccatcacccttgaggtcgagtcctctgacaccatcgacaacgtcaaggcaaagatccaggacaaggagggcatccccccggaccaagcagcgtctcatctttgctggcaagcagctcgaggatggccgcacccttgccggactacaacatccagaangagtccaccctccaactggttctcaaggctccgtggnggtaatgcagatatttgtcaangacctcaatggcanaacatcacctcgaggtttgagtcctcnagacancattgataatgngaagggcaagattcaagacaaagggggnatcccaccgggacaagnagcgtctcatcnttgntggcaagcaatcgaggatggcncaccttggaagcnacanatcagaagggncaatctcanatngngctcagg

SEQ ID NO: 89857 - DNA, 321 bp, Triticum aestivum
  unsure (1)..(321): unsure at all n locations
  Clone ID: PAT_TA_89857
cccagaactccagatcgacctcgcgattacgtttctttccacgcgtgcgcgcacatccatggcggttgccgccggaggaggggtggtgctgagcctgcgcggcccgtcgtcttcggcgtggccggcggtggggcggcggcgtagggcgtcgtcgtcagcggcggtgaggtgcggggcgacgcgggaaaagaggccgncggagaccccgggcgtgnctctggagggagggaccactaccgaacactgcggntggtgccggngggtcancagggggagangncaagaagtncttcnancgtctcgcnctgcantngcanccgg

SEQ ID NO: 89858 - DNA, 615 bp, Triticum aestivum
  unsure (1)..(615): unsure at all n locations
  Clone ID: PAT_TA_89858
gcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggaagtgcctgcctctggatcctcatcctgaggaacagactgaaatatgctctcacctaccgtgaagtgcaatctatccttatgcagcgtcatattatggttgatggaaaaggccgcactgacaagacctaccctgctggtttcatggacatcatttccattcccnaagactggtgaagaactacaggttctgtatgacaccaaggtcccttccgccttcatcctgtcaggncgaaggatgctaagtcaagtccgcaagncagtctgtccagtttggcaagaaaggnatcccatactcaacactaggatggcgnacanccngtaccaaaccatcatcaaggcaatgcacaanaagttgactggagacaacagnggntgctcacaagttgacncggaantggcatgggatggnggcgaaacnggntttggtgnnaanacaggaaacaaaggactct

SEQ ID NO: 89859 - DNA, 621 bp, Triticum aestivum
  unsure (1)..(621): unsure at all n locations
  Clone ID: PAT_TA_89859
cgctgccgctgcgtctcgtctccaccaccccacttgcccccggactcaggaggatcgtcggagatgtcggacaccgatgagcaccacttcgagtccaaggccgactccggcgcctccaagacctacccgcagcaggctggcgccatccgcaagggtgggacacatcgtcatcaaggcccgtccctgcaagttgttgaggtctccacctccaagactgggaagcatggtcacgcaaagtgtcactttggttgccattgacactttaatggaaagaagttggaggatatcgttccttcatcccacaactgtgactcccccatgtttgaccgccaaagattatcaagctgattgacataactggatgatggtatgtcaaccttctcactggagagngggaacactaaaggagacctgnanttccactggatgatgttctgcttgggcaagttcaagacggatttgctgatgggnaagactgtctgtcntgattccgcatgggtgaagacantntgcgctggtgaaggatcggtggnggagtacantgtgctggtgctactnnaactggancaangctcggtgtnngtaaatataggatcagtncngtgngaanagtgtcaattt

SEQ ID NO: 89860 - DNA, 586 bp, Triticum aestivum
  unsure (1)..(586): unsure at all n locations
  Clone ID: PAT_TA_89860
tatccaacgccgcccttcagcgcccacccatccgcctgcccgcccgacaacgcccgattgaattgttgctgccaagatctgcctcaatgtggtttacatcattgcggcgacgacatcgtcgatcttcgactccggcggctacatccagaaggactaccacaattctcgcggctgggatcctctactctcatctccctactatgaatcctgactgattctcttcctcctccctgtgtcttcctctctgaattgggtagtaggtattaagtcgttgcaagttagttaacaaccagtggtgaatctaaggataagaatgggagggtgcgctgaaacattancattgggctaaactgggacgagtatgattatanccngaattattgcatgggaaaacatacaagtcccccgaatatttatcccccggaagtngggtggngcaaaatccaacgcattggaagtaatccgcacnctngaagnattgnggaaggtggntgctttcccctcttgggggaaacttnacttaaccccggttttggcanaaccccgttagacggaaaaggggactaancgnntgggcgggaaaatt

SEQ ID NO: 89861 - DNA, 286 bp, Triticum aestivum
  unsure (1)..(286): unsure at all n locations
  Clone ID: PAT_TA_89861
gttcgggttctggttcggttcgggttcggttcgagagagaggccgagtanctagcctagtctagggtttcggtagagaggaagtgagatccatggcggagacggagtaccgctgcttcgtgggcggcctcgcctgggccaccgacgacaacaacctccagcaaggccttcagccagtacggcgagatcctcgacgccaagntcancaangaccgcgagacggggangtctcgtgggntcggcttcatcacgttcggnagtcaggattcgatgcgncaaggccatcg

SEQ ID NO: 89862 - DNA, 353 bp, Triticum aestivum
  unsure (1)..(353): unsure at all n locations
  Clone ID: PAT_TA_89862
gttttttttttttttttttttttttttttatcgcaagggtgntctcatttcacacataaccagcagggagacatgcatcatgcacataatagaatcttgcggctgcagcaagacaggcttgctgaatgctgatcaggccgctgcagatcaagcgaagcaagacgacacatccctgaatttctacagcaatttaaaagggcacccgatccaggccaaggagtagcatgaccacnacactatctaggagtagttatacttctacatcttgctggtggtggtgctgaagcncctgcngntcgngcccatctccctgggcnaagttccgggagcacgtacttctggatnttgccggt

SEQ ID NO: 89863 - DNA, 166 bp, Triticum aestivum
  unsure (1)..(166): unsure at all n locations
  Clone ID: PAT_TA_89863
cttagatttatcgagcaatgcttttgctggtgaaattcctacctcaagttgtaattcttcactaaggtccctgcacctatcagacaacaactttacaggttgttttccagctgtgttgaanaacttcaagaanccttgnanatttgggttctcgggaggcataata

SEQ ID NO: 89864 - DNA, 532 bp, Triticum aestivum
  unsure (1)..(532): unsure at all n locations
  Clone ID: PAT_TA_89864
gggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaagggctgcagtagctgccgaatcttctactggtacatggacaactgtttggnctgatggacttaccaatcntgatccttacaaaggacgatgctatcacatcgagcctgttgctggggaaaacagccaatggatttgttatgtnncttatccattanaccaatttaanaggtcccnttacnaacangnttactccaatgnaaggaacgtatttggntcaaaagccctacgngctcnacgtttgnggntntaacaaatccccnactantcaaaactttcaaaggccgctcaagggatccannttaagagnaanttgacaatatggccccctaatgggagngcataaacccaattggtntcccaaaat

SEQ ID NO: 89865 - DNA, 439 bp, Triticum aestivum
  unsure (1)..(439): unsure at all n locations
  Clone ID: PAT_TA_89865
ctccgccgacccacttcactcatcagcttcacgcaggccagatccagcctcgcgtgtcctcccctacgcccgcctcatggccgccgacacggcggccgcacgcgccctcctcctcttcctcgccgtcgccgtcgcggcgctcctccgcaccggcgaggcctcggtgcacgagtacagcggcctcagcttcctcaacaagggcaatgccttcatcctccacgccgggagcgagggcctctacgcccccgtctcccccgccaatgccaccgccgatgnggaggacgacnaangccgccgcgccgccttcatacggtttgncaagattacttttagganggcangangagactaatgatctgtgaaagaaactantcatctaaggtcaaataantggctttgaatagnagatcgtgaatgattgcgggtnaagatntggagg

SEQ ID NO: 89866 - DNA, 461 bp, Triticum aestivum
  unsure (1)..(461): unsure at all n locations
  Clone ID: PAT_TA_89866
gtctcgagtttttttttttttttttttttttttttatataaaggagcacacatttgcgaacctttttttaaattttgatggagtttactagcagctacagtcaggtgacatcctatataaaatttacaaaaaatttattgctctgaactacactaagaagtattttgacaattgncagtctagactggtagcagatttctacagccgaaaaacatagcatgatacatcattattcttactaacccacccagtgtttaatgtcactgctacaacgaattgggaagcatcacgagcatgaggagagtgtatgacctcnacctaacgtggtttcactttancctgctcccngnataatngctgggnaagatccntcaagtacttccaaatctcggggctcggtcatctttccagtagaaaaagntcctccaannaagnaagtctggcccaagncccaacagatg

SEQ ID NO: 89867 - DNA, 272 bp, Triticum aestivum
  unsure (1)..(272): unsure at all n locations
  Clone ID: PAT_TA_89867
tgcgaagaggcttatggagctggttcacggtattccctgcaagatcaacctaatctctttcaatccccatagngggtcananttcaagccgacgcccgatgagagnattatcgagttccgcaacatgttaatccaatccggccttaccgttatggttcggntaagcaagaggcgatgaccagatggctgcctgcgggcagctaggagcgcctggtgactatcanctaccgctgctccgtgttcctgaagaaatttcaggtngccttatgaag

SEQ ID NO: 89868 - DNA, 564 bp, Triticum aestivum
  unsure (1)..(564): unsure at all n locations
  Clone ID: PAT_TA_89868
cgctcgcccgcccgcgccgccgccgccgcctccttccgcaggagctccctccccgcaggcgcgatggtgtacatcaagaaccagaagacaagggcgtactccaagcgtttccaagtcaagttcaagagaaggcgccaggggaagaccgactacagggccaggctgaggctcacaaaccaggacaagaaacanatacaatacccccaagtaccgttttgttgtgcgatttaccaacaaggatgtcactgcacaaattgtgtatgctacaattgctggggatatccgtgatgggcgctgcctatcccatggagttgcctcgctatgggcttgaaggtgggctggaccaacttatgctgcagcctactgcactgggctccttttgggtcgtccgtgtggtcaaagaccgtggnctcgatgnaggagtatgaaagganggtntaggcacggntgangattcncggtngacttctganaaaggnngtttcccgnggncttggagttggctnatnnggccacacgggaacntggttggggccttaagggattttggtggggcttgatcca

SEQ ID NO: 89869 - DNA, 527 bp, Triticum aestivum
  unsure (1)..(527): unsure at all n locations
  Clone ID: PAT_TA_89869
gcggcaccgtggctccaggcggcgccggcggaggaggcggctgggtggatcagctccccgggttcaactcgtcatcatcgggcaacatcctgtgactgtgaggccagccgcgccatggccgcgcatgcatgcatggcggaatggaggcgatctctctgcaaaaggtagctctatatatacaagctccgaattgaagcttaattttagcgatggcttccgatcgatcgagaaagagaaaagaaacaatggagttgtggtgggcgcatgcaagatcattgctgatcgatcaaaattagtttattccactctcgagtggagtcctagctatatctatctccaatgcatgctgtccttggtaccgtcttaattaggtctttcttgggnacccctaatggtttaaggngctgggtttccnaaatcctgngggtcccttaatcccggnttgncaatggtangcatggtaattgggacaaggttaccanagttnggntcaattaggggtcagggtgganaggtgnaacctagga

SEQ ID NO: 89870 - DNA, 594 bp, Triticum aestivum
  unsure (1)..(594): unsure at all n locations
  Clone ID: PAT_TA_89870
gagattcgtatatgcatcactgctgcgtctccttgtcttgaagtttgtcttgagcatgtcagcaagtaaggatgtgcttgcacttgcttcccttgaggttgatctatccagcattgaacccggcagcacagtgactgtcaagtggcgtggaaagccagtcttcatcaggcgacggacagatgatgacatcaagctggccaacacntnggatgttgcatccttgcgccacccagagcaagacgctgagcgtgtgaagaaccagagtggtgnttgttattggggtctgcaccatcttgggtgcattccccttccccaatctgggagacttgggtggtggttctgcccgtgccatgggtcccactatgacactctgggaaganccgcaaagggcctgnccccgttcaacttnnangtgccacctacantcctggnangatacaagatntcaataggtaagacctanacaanactacggcatatatctcgaaagagtgatcccggtgcncgtaatttgttcaangggntagatttttgttaaggcanccaaggntcaaggtactacgagtcatncagcgaaaatgtcccaatgcacgg

SEQ ID NO: 89871 - DNA, 269 bp, Triticum aestivum
  unsure (1)..(269): unsure at all n locations
  Clone ID: PAT_TA_89871
tgcctcctgcgcctccacttccatcgcctcccaagatcgcagatctgctccggtgagaatccgtcgccatgtcttccagcgaggtcgcctgcacccttgccgccctcatcctccacgatgacgggatcccatcaattctgagaagatcgcgacggtgggtgaaaggttgcgggatcnaggttttaaggctannnggcccgcnttcttcgcaaggtcctggaggaaggagggacggtccattgaacttaacccttcccgtcgggttcttg

SEQ ID NO: 89872 - DNA, 330 bp, Triticum aestivum
  unsure (1)..(330): unsure at all n locations
  Clone ID: PAT_TA_89872
gggacttatgtcaccacaaacagaaactaaagcaggtgttggatttaaagctggtgttaaagattataaattgacttactacaccccagagtatgaaactaagggatactgatatcttggcagcattccgagtaaagtcctcagcctggggttccgcccgaagaaacaaggggctgcagtaagctgccgatctcctactgggacatggacaactgtttggactgatgggacttacaatncttgatcgttcaaaaggagatgccatcnaaaatccangcctgttgctgggaaaanacanccaatggntccngtaaggtnnccttaaccaat

SEQ ID NO: 89873 - DNA, 397 bp, Triticum aestivum
  unsure (1)..(397): unsure at all n locations
  Clone ID: PAT_TA_89873
tatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttgggactgatggacttaccatcttgatcgttacaaaggaccgatgctatcacatcgagcctgttgctgggaaagacagccaatggttctgttaagtacttancattagcctatttgaagaggttccgttacnacatgttacttcattgtnngtaactatttggttncaaagccta

SEQ ID NO: 89874 - DNA, 336 bp, Triticum aestivum
  unsure (1)..(336): unsure at all n locations
  Clone ID: PAT_TA_89874
tgacacagaaaatctaacgcaacttttcatagtaattctgctctctctctcccagatgattattgtgtttaagcaacacagccaacttagtagtactatgtatttatttctccgacaagtattttcggacggtatgtatttatttcttcgactattttgggacggatggagtatgtatttgtgtatgcatggacggatggagtatgtatttgtgcatgcatgtggcagcgttcttaatctagattcccagtcagagcttgggatggngtcctctgggaanggtgcacacgatgangccgtagggatccantgtnaggaaagcctcanctccggggc

SEQ ID NO: 89875 - DNA, 351 bp, Triticum aestivum
  unsure (1)..(351): unsure at all n locations
  Clone ID: PAT_TA_89875
tcacgatncaaccagccgcaaatctccccagacactcgaccaccgcgccccgcccgccggacgccgcggccggnggcctcgatnccaangcnccaaccggctcgggacgcccccgncaatcaggcgtcgcccgcaatcagccgtcnccgctcttcctcngtcngggacaccgggttccccgtccgcaagtctcngaccgcctcngccggcgcggatcnctgggtccaacgggggggnattggtacaaagcnggngncagtttcnggnaaaaangcatgggttcctngngcggggtcatgtcnggtacgaaggangaggaaggatccgggcctaananggttgcatcttgca

SEQ ID NO: 89876 - DNA, 552 bp, Triticum aestivum
  unsure (1)..(552): unsure at all n locations
  Clone ID: PAT_TA_89876
ctcatctgatcacccatagctagctagctagcagcttaaggaactagcttgcagctaccgatcgatggctcgtctcaacagcaaggctgtggtggggccgccgtggtcctggcggcggtggtgctgatgatggccggcagggaaggcctcggcggcgctgtccgtgcgggcaggtgggactccaagctccgcgccgtgcgtggcgtacntaacggggaangggcgtcctccgattaagcaaggagtgctgctcccggcgtgcangggctgaaccggcatggccgcagcactccggaccgcaaagatagcgtgcaaggtgcctcaaagacctcgccaaccaagcatcaaanccancaacatgggcaagnctcccggcgtgcccggnagtgcggcgtcagtgtgccttcccatcaanattcaacaactgcgaactgtcaactagtcaatatatacctcctacgtgcatcatggacnccttgttgganttaagncnagttgatgggtgtcatacatcngtgagtacaaaaataaatantgcctgatggtatcata

SEQ ID NO: 89877 - DNA, 470 bp, Triticum aestivum
  unsure (1)..(470): unsure at all n locations
  Clone ID: PAT_TA_89877
ctcgagtttttttttttttttttttattgatcaatctttgactagctagcacgtactccaaaaaaaaacagctgaaccttaaacagtcgctctgttctacaccagcatgcaatcgaattatactaaaggatgattaacaggaaccgaaaactgattcataataaagggtgtcatatacccccaactgatgtgtaaattaataaattgggacatgttagagccgggcatgaagttgcggaaacatatgaagcaccaaagaaatgacagcctgccattgtcgaattgaccgacaaacacacgcggctgaagagaaagatgcatgcacagtatcaggggtttgctccttgaagcccggttcccggtgtagcatcccatcccangncaaagccaacatggaacatctcgacagccngacctaagatgtatgaancaanctttcngcaagacaactttncaagcaagnaggaaaa

SEQ ID NO: 89878 - DNA, 484 bp, Triticum aestivum
  unsure (1)..(484): unsure at all n locations
  Clone ID: PAT_TA_89878
cctgggcacccaacacgtcactgtagtgagctcaatcgcctcgagcaacaagagatctcaccagctaatccgatcctgcgtccgattcgggccctcgcccgccatggggttcgacaaggaggcgagctcctcctcctccgggctcgacgcggcggcgctgctgccgangcacggcggcgcgggcgtcggcgcgcgcctgtcgtcgnagnccaagaccttcgccaacgtcttcatcgcggtggtcgggtcggncgtgctgngncctcccctacaccttctcccgcacgggctgggcggcngngctccatcntgctcntcgccntggncgggctcacttcnactggatgntgcngntcgtcgcctgccgcngtngcctcgccgantatanccaagatnggtcnttcggngactgggngngtcgtgtaggngcanggccnccanagcgttnnggcatgncgttgtnagcagnaagcttctgngttgg

SEQ ID NO: 89879 - DNA, 315 bp, Triticum aestivum
  unsure (1)..(315): unsure at all n locations
  Clone ID: PAT_TA_89879
gaaaagtgcatgcccggttggcctgtaaaccgtgtggtctagggacgtctgacccgtcgtgccgattcgagggatccgtgttttgatccttctgaattctgatgaagtgttcttcgttttgttgcgctgtttagagttgatgaacgccggnagcatattcgcctacnaaccatagtactagaacttctcggntaaagaagtgggtaagaaaaagtaggagtagtatcttgtcatattcgcctactaaccataaccatagnactagaactttaanttnanagtgtgtgggaaaangatgtagnagtnacttgtcaa

SEQ ID NO: 89880 - DNA, 628 bp, Triticum aestivum
  unsure (1)..(628): unsure at all n locations
  Clone ID: PAT_TA_89880
cacatttcccctgcaagcaattcctcaaccccaacatatgccaccaccacacctcgtcttccatcccatcccatgttgcagagaagacttgccatggccgatcgcagcatgaccctgcagctagcctttgcggccatccttctcctcatcctgtgcggcagcacctgtagctcgctgcagttcgcgtaccaagagttcgaacgccggccagcgaggcccgacttcaagcttcaccccggggcgccaccatctccaaccgctccctgcagatcacnccgacgccggcgacatggccacggtccgggaaagggtcatgttcgccagggaagacctccaagtctgggaaaaaagccgagcgcacggcgtcacctccgttcaagacggagttcgtgtcaacatcgtccccaaggaacggacggggaaaagnatggcttctcctcaacaacaacccggcctgcccancgacnnaacggcggtnggtcnggctgacaanaacggncgacggaaggnggtaccggnctccggccagtnnanccggggggntttggccnctgncggacagtcggntnactaangggnggncctcggaatccgtanaattncacgctccagggncnggcanacntgn

SEQ ID NO: 89881 - DNA, 499 bp, Triticum aestivum
  unsure (1)..(499): unsure at all n locations
  Clone ID: PAT_TA_89881
ggacaccatcgacaatgtgaaggccaagatccaggacaaggagggcatccccccggaccagcagcgcctcatctttgccggcaagcagctggaggatggccgcaccctggctgactataacatccagaaagagtctaccctccacctggtgctcaggctccgtggaggcatgcagattttcgtcaagaccctcaccggcaagaccatcaccttggaggtgggagtcctcggacaccatcgacaatgtgaaggcaaagatccaggataaggagggcatccctccgggaccagcagcgcctcatcttccgccggcaagcagctcgaaggatggccgcacctggcagactatacatccagaagganccacctccactggtgtcaagtcgtgggaggatgcagatttcgtcaagagctcaccggcaagacatcacctggaggtgggancctcgggcacattgacatgtgaagggnaggtcaagacaaggaggatcccccggca

SEQ ID NO: 89882 - DNA, 175 bp, Triticum aestivum
  Clone ID: PAT_TA_89882
ccgcggcaggtttgagcggatgcttgcgatctccgcacgccacgccgcaccggtgggtaccgggggcaccggcacgccgccggcgctgatcctccatgcgccgggaacccgcatgtccggcgggaccgggtactccggcctccgtaaaggaggcgagctcgtctcgtgaaatgca

SEQ ID NO: 89883 - DNA, 561 bp, Triticum aestivum
  unsure (1)..(561): unsure at all n locations
  Clone ID: PAT_TA_89883
gcagatatttgtgaagaccctcaccggcaagaccatcacccttgaggttgagtcatcggacaccatcgacaacgtcaaggcgaagatttaggacaaggagggtatccccccggaccagcagcgcctcatctttgctggcaagcaagtccgagggatggtcgtacccttgctgactacaacatccagaaggagtccactctccacctggtgctccgccttcgtgggtgggtatgcaagatcttccgtcaaacaccctgacggggcaaagaccatcatctggagcntgggagtccttcnggacaccatccgacaacgtngaaggcaaagattcaagacaaggangggcatcccccccgggaccaagcagcgcctcacttcggccgggaagcantcgnaggatggccgatcctngctgactacaacaccagaaggagccacctccaccngggtgtccgcttcgtggnngaagnaaatctcgncaagcctgncggcaangcatatcgaggggggancctcggcacatngaaactgaagnnagntcagggaaggaggcacccccgg

SEQ ID NO: 89884 - DNA, 426 bp, Triticum aestivum
  unsure (1)..(426): unsure at all n locations
  Clone ID: PAT_TA_89884
cccagctcggtttttgggccattctaagccaccatgcctgcctccatcgccttcggtcggttcgatgactccttcagcttggcctctttcaaggcctacatcgccgagttcatctccaccctcatcttcgtcttcgccggcgtcggctctgccatcgcctactccaagtgagcggngggcgcgccgcttgacccatccgggctgatcgccgttggcgatctgccacgggtccgggctgtcgcgncgntccgccgtccggngccaacatctcccgggnggccatgttgaacctgccgtcacttcnggctcgccctcgggcggcaagttaccacctcaaccggatcntctacgggtttcccancctccggngcatcgtcggggctcctcgtccattctgaacggcggggngaccctanaacggtttcg

SEQ ID NO: 89885 - DNA, 624 bp, Triticum aestivum
  unsure (1)..(624): unsure at all n locations
  Clone ID: PAT_TA_89885
gtaactccaggtgaatataccaatgcttgtttgtagatcatacaattttaacttggagacatagtactctgattatgttcttttgttaagcaagtgtgtttattatgagtacttaaatgtgttttgtgcatctcattctctgctgggtctgggttgctgtcaccatggatgcaaatgagtagctcatgtcctgatgatcaaatattaatttggtaagatcttggagataccttgacagatgctaagcaattngactaacacatatttacccttaagttggtcattctaaaagaccaccttgcattccatgatattgattccggaatatttaccttgttcacatgtcattactgagtttaacattaaatccctggaaacattatactgtctgggtnagattcatacgaagaacagtatccaaggattaaaagtaccccaagtgtgggcggcacctccggaaatttgggtaangtcantgcaaccattcntnnatagggaacaattaatcgggccganaactggaaatgtagtggcaggagagcacncaancgtgacagttgaactcnncacacattttttagtcagaccnttgtgccttancgactatnnatanccgcatgtggg

SEQ ID NO: 89886 - DNA, 590 bp, Triticum aestivum
  unsure (1)..(590): unsure at all n locations
  Clone ID: PAT_TA_89886
caaaccctaccccgccgccgccgtcgccgccgcagcgcgcggaggcgacctcgcaccgccgccaagatgcagatcttcgtgaagaccctgacgggcaagaccatcacgctggaggtggagtcctcggacaccatcgacaacgtcaaggccaagatccaggacaaggagggcatcccgcccggaccagcagcgcctcatcttcgccggtaagcagtcgaggacggccggcaccctcgcccgactacaacatccagaagganccacctccactgggtgtccgcctccgccggnggcgccaagaagcgcaagaaagaagactacaccaagcccaaagaagangaagacaanacaagaaggtgaantcgcctcctccanttctacaggtcgnannacgcaacgggaaggtgacagtcaagaaggatngcccaaangccatggggccggacttcaatggnacattnnacgcatacgcgnaagtgggtcactanttanacagnagtanaaggggtncgttgtcgnctttactactacgngacgatcattanaggtccgnttgctttaacngaactgggtnaagntcngaattacga

SEQ ID NO: 89887 - DNA, 628 bp, Triticum aestivum
  unsure (1)..(628): unsure at all n locations
  Clone ID: PAT_TA_89887
atcaagtcagacaacattatagttcccaaatattccgaatttgcaacattgcaaatacaaatagtcttacatgaaagatacaaatatgtaggcatgtagaaactataacactaagtaactctacgacgttcctttgccatgaaatcttcaactatgtcttcctcgcttactttcaagaacacatctcgctcaatgaatgttactaaacaattgttcatgagatcatcactcatactatttctcaaacttatttttcaaatagatcattgccgaaaatacctttcaacactccgctgtggccaccggtaagttcaataccatttggataagatggttgaccaatcaatagagacagttttgtttggtccaacaagcatancagagagtcaacaatattacgcacaagttctgacctacancctaactcaatacaaccaataanagacaagttgggattcaagcttacaanccatgctggatatgcctgggggtaagatcagcaagtcaatactngngtgcncataagagnatgatggggggtcaangagcagcantaanaaccattaacnacaacttgcagcctgangatgtaaggtacagnaanccctcaagtacantgtgctcaagg

SEQ ID NO: 89888 - DNA, 305 bp, Triticum aestivum
  unsure (1)..(305): unsure at all n locations
  Clone ID: PAT_TA_89888
atccgtctctctcgtcgcccgcggcggcgggggcggtggcgcgcggccgttgacccgatgacaggaggaggcggagaggacgtccccgcgccgaggcggcgcccccttacggtgctccccctcgncgcgctcatcttctacgangtcncgggcgcgnccgttcgngaatcgnncgactctgtccgcgccggtcggacntngcgcngctcctgctcctcggattcctcaatcctcnnnggtcctctggtcgctccctggnggccctcatcacngncagngctcggtnccgncgttcnncanaatcg

SEQ ID NO: 89889 - DNA, 254 bp, Triticum aestivum
  Clone ID: PAT_TA_89889
gctactcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtccgacggccattgggtccgttcaaaggagcagtttgatgttggacattgggagccatccctcctgctgagtgtgtgatgatgaaggt

SEQ ID NO: 89890 - DNA, 337 bp, Triticum aestivum
  unsure (1)..(337): unsure at all n locations
  Clone ID: PAT_TA_89890
cgtgcgcgtacaaaagccaccagaacgcccaacggtggcgctaaaaacgggaccgtgccgtgccgtgnctccccaattcccgttcccaaaaatatcctccccaccgccaccgccaccggatattccaccccgtcccggnagccaagccnaggcaaangcgccgcagngaatggctccgcctgccgccggnangcnctcggnctccgncgcgccggaagcctcncctgtgggaggccgccaagcgccgtcgcnccnccgtcgtgcgcaggcncttgggcgtgtnatcntctccttggggcntgaggggcgtcgttgtnagtcgtcagcgctcgtgctc

SEQ ID NO: 89891 - DNA, 421 bp, Triticum aestivum
  unsure (1)..(421): unsure at all n locations
  Clone ID: PAT_TA_89891
cgcacgcttctcctccgcctcgagcagctcagggacgcgcgcagccatggcgacggagaccgagaccttcgccttccaggccgagatcaaccagctcctctcgctcatcatcaacaccttctactccaacaaggagatcttcctccgcgagctcatctccaactcctccgatgccttgggacaagatcaggtcgagagcctcacggacaagagcaagtcgatgcgcagcccgagctcttcatccacatcatccccgacaaggcgaccagcacgctcacnttgtcgacagcggattgggatgacaagtcggacttcgtcaacaactccgggacatcgcagttcggggacaagggttnatggaggatcnntgcggggtnacgtntcaagattgggagttcgggtgggttcnatccgctacttg

SEQ ID NO: 89892 - DNA, 495 bp, Triticum aestivum
  unsure (1)..(495): unsure at all n locations
  Clone ID: PAT_TA_89892
gtaccgtctcaacgtcggcggcgaggccgtctctccggccgacgactccggccgcttctaccgcacctgggacaccgacgtcccttacatattcggcgcggccgtcggggtctctttcgagaaggacagcgacgtcaccatccgatacccgccgtccgtgccgccgcacatcgcgcggagggcgtgtacgcgtcggcgaggtccatgnggcccgactgcgcaagatcaacctgaactacancctcacctgggatcctaccgttggacgcgggggttctactacctcctgaggttccacttctgcgaagatccagtacccgatcaccaaggtgaaccagcgctccttcttcatctacatcaacaacagacgggcaaggagcagatgggacgtcatcgatgnncggaggatagggttccggtgtaacggactactagtcgtcacgaccggtccggcaanacgaangtggtccgggtgcaccggactcagaagaagnc

SEQ ID NO: 89893 - DNA, 219 bp, Triticum aestivum
  Clone ID: PAT_TA_89893
gctgatcttagctttgcagatcagcttggaaagaaggagcacagggaattggctagagaagctgtcaggaaatcacttgttctattgaaaaatggcaacactcctaatcaacaattcctgcctctcccaaagaaagctagtaagatcctcgtagctggaagtcacgctagcaatttaggctaccagtgtggtgggatgggtcaattcaatggtgggaag

SEQ ID NO: 89894 - DNA, 455 bp, Triticum aestivum
  unsure (1)..(455): unsure at all n locations
  Clone ID: PAT_TA_89894
cagtttaggtttctcttcgccgagatggtgaacaacacgcccgttctcttcgagtaccagtctgacaccgacgcgtggcagtcatcggaggcggtgctggcaaatggtcccgccgcaccggcaggtcccgacggggacggcacgtacctgtgcgctgcccacgccgggccggactgcgtgatggtgtactcaggcccgggcgtcgacagaccggtcttctttcggccggggttcccgcacaacccgaacgccggcggccacggtgatcggtccacgtgtacggcgacggcangcgttggtggccgatcaacggtgatcgatgagcccagccggatccggtgaagttgggtggcggtgtggactgtatgggtccggccggagtccgggtgactgggancttgggtcaacgtgcnggcgactcacgaaggttcagganccgtagccgtgatacggtg

SEQ ID NO: 89895 - DNA, 402 bp, Triticum aestivum
  unsure (1)..(402): unsure at all n locations
  Clone ID: PAT_TA_89895
aaacgccggctctcccccgctccgtctccctcccccctcctcccccgctccgctccctccgccgccagatcccgtcgagcccccccgcgcccccgcgtcgaagatgagggagtgnatctcgatccacatcgggcaggccggcatccaggtcggnaacgcgtgctgggaactttactgcctcgagcacggcatccagcctgatggccagacgaacggcgacaanancatcggaggtggtgatgacgccttcaacaccttcttcagngagaccggagccggnaagtangtgccccgcgcggtcttcgtcgacctcganccaacgtgantgacgaggtccgcaccaacgtctaccgccagtcttcaaccntagcagtcatcaantggaaggaggacgcgtcaaaa

SEQ ID NO: 89896 - DNA, 374 bp, Triticum aestivum
  unsure (1)..(374): unsure at all n locations
  Clone ID: PAT_TA_89896
ctcgagttttttttttttttttttatttcgtttcttttttatttataccttctcttctttatctttagttttatctacttatcaataggatctaccggntcgaactcgantttgatcgccttccatacntcacaagctgcggntagttcaggactccatttgcaaggntgctcggataatttcattaccttcgcgagcaagatcgntcncttcgctacgagcttgtcacaggnttcnaanggcantcgantagctgntgcaccangatgcatttccccatggangtccnaacagtcctcnagnaaattgtaatagaagaatcatccccaanacgatttcgggcagagctgggatanganaacncatgtntacga

SEQ ID NO: 89897 - DNA, 241 bp, Triticum aestivum
  unsure (1)..(241): unsure at all n locations
  Clone ID: PAT_TA_89897
gcgtgccgctgatggacgcttctcccaccgccgntgcccgccgcgcggnggcgatcgcccgccacctcgctggcctcccctccggtgccgccgccgccgtggcggggctgcagttttccncgtgcctgagctacgcgcccccgaaatcntccgaggccccgncggngttngcgccgatggagcttcgtgcgntcctctacggggcaccannctgcgngancgagactgtgcntacggtgtg

SEQ ID NO: 89898 - DNA, 476 bp, Triticum aestivum
  unsure (1)..(476): unsure at all n locations
  Clone ID: PAT_TA_89898
aaaccctagcctcctcctcctctcgccgccgccgccgccgccgccgccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaangtgaaagctgatccgtgatgaatcatccccttatgcaagctatgcttgcatctcangatgttgctgtaagatgcanggagcttgngaattactgctctgcacattaagctccgtgctactggntggaaacatgacanaaatcnaggtcctgntgctcaagctgcgcttagactcttgcangttctggaatnangattgnacgcattgaggatttacccggttcaactgacagatcccggaggtga

SEQ ID NO: 89899 - DNA, 324 bp, Triticum aestivum
  unsure (1)..(324): unsure at all n locations
  Clone ID: PAT_TA_89899
ctccccctcctcctcctgctcgccctcctcgggacctcgtcggcggcggcggcgccgggcgtcatccggctgccgcgcgccggggcctgcgccacgccggcggacncagccgtctacgaccgccccgtgatcggcancgncacgcacccgggcaacggngctgccnggaggatcgacaacnncacctccacctcctacatcggcgcctcctacgtcaagttngtngaggtcngtgntgncacgngcnatcaccgctcatctacancgaggccngacgagannctcctcnagaaactcagttntagtanggggngctgtttactg

SEQ ID NO: 89900 - DNA, 518 bp, Triticum aestivum
  unsure (1)..(518): unsure at all n locations
  Clone ID: PAT_TA_89900
caatagcgaagtggagtgaagcgccgcgccgcgccgccacccaaagcaaagcaagaagagaaagcgtcgtgcttgtgccgcgacggccggtgagccgccatggcgcccaagcagaaccagaagaaggaggagcccatctggcggcgcaagcctgttccgccggtcgacggcgcattgcaggccccccaagccgcccagccgcccgtccccgtcccagatccgccgccttcatcgcctgcagtcaccggttcctcatcggcccaccggaaccagccgccgccgtcggggacacagcatcggtcgcagnagggcactccgggccgctctcctcggggcagtcacgcggggggcgtccttccacccgtacatcaagcgtcgcggtcgcggacgccaaccgccgccgtcgacggtgcacgaaaccgccggtcctcgggcattgcggcccccaagtgccancgacctcaccccgttcgccgcttancgcgggggcatggtctcatcggcggcaaaactgcgtc

SEQ ID NO: 89901 - DNA, 650 bp, Triticum aestivum
  unsure (1)..(650): unsure at all n locations
  Clone ID: PAT_TA_89901
ccacttctctgctccctcctctcctcgcgcgcagggcccggcgaaagggaagcaagatgtacaccgccaggaagaagatccagaaggacaagggcgtcgagccctccgagttcgaggacaccgtcgcgcaggctttctttgacctggagaatggcaaccaggagctcaagagcgacctcaaggacctgtacatcaacactgcaatccagatggatgttgttggcaacaggaaggccgtggtgatccatgtgccgtaccgtctgcgcaagcccttcaggaagatccatgtcaggctccgtcagggagctggagaagaatttagcggcaaggatgtggctttgttgcaacaagaagttgtgaggcacccaagaagttctgctgttcaacgccctcgcaccaagacctgacactgttcangatggganctgggaggattcntgtaccagctgagatgtgggaacctgtcagatacgtttggttgtgcaaggcacaagttactggaccaaagagccacacactgatnaacnggaactctctgnntcacgagctttggaaaactgtctnagacctggatgaacgctaaatcagcttatgcccattaacttcntaantttgtnggctgtatgcacaagttcaaaangtttacacgg

SEQ ID NO: 89902 - DNA, 207 bp, Triticum aestivum
  unsure (1)..(207): unsure at all n locations
  Clone ID: PAT_TA_89902
gcaagcgctccctccctcccctcccctcccctcccccgatcgaatcgatcgtgttcnatttcgatccgcgaggggggaatcgatcgggggttcgttccaattccgtcgcgccgcttcttccgatcctcggaggcggnntgcgtcctctttttctttggattcttgggttttctggggacgttgttgngangagangaagttgcaagg

SEQ ID NO: 89903 - DNA, 424 bp, Triticum aestivum
  unsure (1)..(424): unsure at all n locations
  Clone ID: PAT_TA_89903
gagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgangaagcaggggctgcagtanctgccgaatcttctactggtacatggacaactgtttggactgatggacttaccagtcttgatcgttacaaaggacgatgctatcacatcgagcctgttgctggggaacgacagncantggatctgttangtagcttatccattagacctatttgaaganggttccgttactaacatgtttacttccattgtnngtaacgtatttggttcaangncctaactgctctacgtttg

SEQ ID NO: 89904 - DNA, 460 bp, Triticum aestivum
  unsure (1)..(460): unsure at all n locations
  Clone ID: PAT_TA_89904
cacgagccaccccagcctcctcccgcctcttctgcctgaccccggttgcctcaccttcctcccgtgccatcctcgccagccccggtcagctccttaccgatccccgctcatgccacatcacaaccccaacgccgacgagggtagccgtaatcttccaacgcgctggcctccctgcctcgccccgcacagatcnagcgcgcccacaaccaacgccacccacancccccggatccttgcagccacaccgccctggagcctcnccggccctgctcccaccagaggcgttgcaagtgtcgtgctctgcttcnccctgtgatctctcnggngttggatggancggnaggtgctccaccttgcgtctcncanccagatccatcatcggataanctgaaggatggnnaccctcantcaccccncgcacncatgggacgttgtnatctcacnangacatgangtgcag

SEQ ID NO: 89905 - DNA, 514 bp, Triticum aestivum
  unsure (1)..(514): unsure at all n locations
  Clone ID: PAT_TA_89905
accaggtgaaagattttttgggatgcaatcggtggtgcgcccgttcaccgcggtgacaaaggcggtgcgatgctacaaccggtgattttctttgctggaaccagtgattcaatttgctggaacctgtgatccaatttgctagaactaggaagacacaattttttgctgggatctatgatgcaatttgctggaagcggtgagttgttttagttgttggtacgggcgaggtcaatttgctgggaaaacgagatgcagcggcaaacgaactggggagcggcaccatttacagctgcatcggggtataatttttgctgggnacccgccaagaatttttgctaccaccgtatgtgatttttgttggnaccaaccccgtttttgctactaagttcttttgattttgctgaaacaancagaatttttgctacaatcgnacctgattttgttgggacaancccgattttgcactacttcctttgntttgctggacancagacatcgaactgntttcggaaca

SEQ ID NO: 89906 - DNA, 465 bp, Triticum aestivum
  unsure (1)..(465): unsure at all n locations
  Clone ID: PAT_TA_89906
gaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtggagaactccgcgcgctctgcaccggcgagaagggcgtcggcaagagcggcaagcactgcactacaagggcagtccgttccaccgcgtgatccccgacttcatgtgccagggcggcgactcaccaaagggcaacggcaccggcggcganccatctacggcgagaagtcgcgnacgagaantcgtccacaanacaccaanccgggatctctccatgggcaacgcgggcccaacacaaaggtcccantcttcatctcacctcccctgcattgggtcgacggnaanactggctcggcgag

SEQ ID NO: 89907 - DNA, 556 bp, Triticum aestivum
  unsure (1)..(556): unsure at all n locations
  Clone ID: PAT_TA_89907
actaattgcagcatctgaggcttgtgcattattgtactattatcaaggctctttcggctcttgtatttttcgcctgctgcctctagctaaaaactcaccaatgatgagttgcaaaaccttattgcctacattgtttgaacctcgtgagaactgatgcaacatctgaggatgaaaaaatcgccctttacttgaacatgctgcaattaaggatttcttggtagccacaattttaaccatacactaaccgattggatttatttaccttggatcaagtgtgggtccgccaaggcnagtgctccctatcaaaggctggatcctgggcaaagttgggcgcccggaagntgggacttaaagtgggtatgcgggaatgctcctaacaacgtancccaacaatttgccgatttacaacaaccttaatgncctggttcaactgggcctaaaccattgngntttggtactccccggtacaatnatgctgatggngtgaattcnattaccaagaaaaaaaaagggggggccggaccaatcnccaaaggancgataccngccanggcgt

SEQ ID NO: 89908 - DNA, 558 bp, Triticum aestivum
  unsure (1)..(558): unsure at all n locations
  Clone ID: PAT_TA_89908
ccatgccccaagcacgtccatggccgcgtcatcgtcgttcccatggccggagccgtccccgacccgtgaggttatgctctgcagctccgttggcctcgtctgcatcgcctacaaccttcggttcgagctgaagccctccacaacctcgccatctggtcgtcttccccgccacggccacggcgccatcgccgtcgatctccatcaccggcgcctcccggcggttccagactacgagaccgacgctgctgctgcccagctcgactacggagttgacgacccctctctcttgccaagagcaaccaagatgctgngancctggagccaaccgactactacccgggaggtgcctactactgccgtgcacccngctgacgacgatcaggagtaggttaagagganccaaggcaggagcctgcgctctttcgatcngtacccaatttgtgcagccttctaangnancttgtttaacttatgtcgtaccaagnattgttcttccgctgatctcnatgatcgncactttatcgagcaaanaaaaaaaaggggggccggtaccaatcg

SEQ ID NO: 89909 - DNA, 464 bp, Triticum aestivum
  unsure (1)..(464): unsure at all n locations
  Clone ID: PAT_TA_89909
caaatccccaccaatctcgtctccaatcgacccgaggctcgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattcctccagaccagcagcgtctcatcttcgctggggaagcagctggaggatggccgtaccctcgctgactacaacatccagaagganccacctccacctttgtcctgcgtctgcgtggtggcatgcagttttccgtgaaacctcactggaaagactatcaccttnaggtttgagantctgacacatcgacatgtcaaggcaagtncaagacaaggnggatcccccgggcaanaaccctnatntttntggnaanaactggngatgggccaccncgccgataaacatcaag

SEQ ID NO: 89910 - DNA, 663 bp, Triticum aestivum
  unsure (1)..(663): unsure at all n locations
  Clone ID: PAT_TA_89910
cagtccccctccgatctcaccgagaaatcgacgcgaaggctctctgcccgtcctcaagatgcagatctttgtgaagaccctcaccggcaagaccatcaccctcgaggtcgagtcgtcggacaccatcgacaatgtcaaggccaaaatccaggacaaggagggcatccctccggaccaagcagcgtctcatctttgctgggcaagcagcttgaggatggccgcacccttgctggactacaacatccaagaagganccacctccacctgggtgctcaaggtcccgtgggtggcatgcagttttttgtgaaagacctccaccgggcaagaccatcaccttgangtcgancctccggcactatcngacaacgtcaagntaagtncaagacaaggaggnaccctcccggacaanactctcatcttcggtgggnaanantcgaggatggcgnaccttgctggatacaacaccaagaagancacctccactgggtgtcaagtccgtgggnggatgaattttntgaaaactcaacgggaagacatcacctggaggtnaatctcgggacaacganactaagggaagtcaagcaagggggaatcccggcaaaaagtcanctngtgaaanactnngtggccacctgngnttaatcaaaggnnaccttnctggcc

SEQ ID NO: 89911 - DNA, 611 bp, Triticum aestivum
  unsure (1)..(611): unsure at all n locations
  Clone ID: PAT_TA_89911
ccatctccgtctagcgtcggcggcagttccactccctcgccatgggcaagattaagatcggaatcaacggtttcggaaggatcgggaggctcgtcgccagggtcgccctccagagcgacgatgtcgagctcgtcgccgtcaacgaccccttcatcaccaccgagtacatgacctacatgttcaagtacgacaccgttcacggccactgggaagcacagcgacatcaagctcaaggacgacaagatctgctctttgggcgagaancantacnctttggcgtcaaggaacctgaggagatccgtggggtgaggctggtgccgattacgttgtgganccacgggtgtcttcaactggacaaggacaagccgctgctcactttgaaggtggtgccaagaaggtggcactctgccccnaanaaaatccctattttgtgtggtgtcaatgagacaanaactcaagcgttaaatgttcaaatgcanctgcacataatgctgctccccaactaagtataatggnaactcggntatgaggttgtgacacggtatcataancanaaaaaactnatggccncacaaganngaagngaaggcnaagttaaanatccaaaaagg

SEQ ID NO: 89912 - DNA, 448 bp, Triticum aestivum
  unsure (1)..(448): unsure at all n locations
  Clone ID: PAT_TA_89912
ggcaggtaagggaggaggagagcggcggcgaagatggtgtcgctgaagctgcataagcgcctggcctcgagcgtcctcaagtgcggcaagggcaaggtctggctcgaccccaatgaggtcaacgagatctccatggccaactcccggcagaacatccggaagctggtaaaggatggtttcatcatcaggaagcctcagaagatccactccaggtctcgtgcaaggagggcacatgaggccaancagaanggccgtcactctggatatggtaagcgtaggggtaccagggatgctaggctccccancaagatcctgtnatgcggaggatgcgcntcctnangcgccttctgcgcaagtaccgtganngccaagangatcgacaagcacatgtttcatgacattacctgnagtcaanggtaacatgttannaacaaganggcctcatgga

SEQ ID NO: 89913 - DNA, 311 bp, Triticum aestivum
  unsure (1)..(311): unsure at all n locations
  Clone ID: PAT_TA_89913
cccccctccacctcctcccccagcgtcgcctcccgttcggaaccccaagctccccccccgccgccggcgaaatggncccgaagcgaggcggcaaggcgccggtgccggcgaagaagaaggcggcggncaaggtggtgaacccgctgttcgagaagangccgaagcagttcggcatcngcggggcgctgccgcccatcaangncctccaccggttcgtnaagtggnncaagggtcgtgcggatccancgccagcgctgcatcctcaancaagngcctcaaggttctccngganctccagtatttcacccgca

SEQ ID NO: 89914 - DNA, 586 bp, Triticum aestivum
  unsure (1)..(586): unsure at all n locations
  Clone ID: PAT_TA_89914
gagaccaccaagtactcctgcactgtcattgatgctcctggtcaccgtgacttcatcaagaacatgatcactgggacctcccaggctgattgtgctgtgcttatcattgactccaccactggtggttttgaggctggtatctccaaggatggccagacccgtgagcacgctctccttgctttcactcttggtgtgaagcagatgatctgctgctgcaacaagatggatgccaccactcccaagtactccgaaggccgttatgaagaaatgtcaaaggaatctcttcatacctgaagaagtcggttacaacctgacaaggtcccttcgtcccnactccgggntccgagggcgacaacatgattnnagaggccacnaacttnactggnacaaaggcccaccttccttnaggccctggacaagtttaatgagccaaagagccctcggaaanccctgctctcccctcaaagagtgtanaaattgtggattgggatgtccantgggggttttaaacngntcatcaaancaagcatggttgcacttggccnanggcttacaatanggaatcgttnatnacanagcccctgag

SEQ ID NO: 89915 - DNA, 667 bp, Triticum aestivum
  unsure (1)..(667): unsure at all n locations
  Clone ID: PAT_TA_89915
aaaaaattggtgaaggacgaccagatcagttctcaaattaaaaacaaaagggagacaaagaaaacagatgtacctagttctcaaaacaaaaacaaaggggaggcaaaggaaacagatgttgccaggccggacgataagattcagaataacaagaaactagggcgtagaagggtggtgccacatgcttcattaccaagatgacttagctgagtccgcttcagcgaccagtgtggttgggacaagaggatgggacctangtactattattatcaataaggcaaagtagctctatctcccgagtccngtgggacgaggcacatcaagtggganttctgcagcaccattccatccgcnagaacataatcancatatccaagggacccnnngagacaagcgggtatangatatacactgtcctcctgagacaacaacttcttganggcctaccngcantgggttctcttccccttgggccanaaacaaggaactacgggtnttggtgccaatgncctaaccacaatcancgntncttggatcngggtaaccatnattggaatnaggaacagnttanggcccatcactggtnggtangtgnatgggtcngaaacccanncaagtnatttngggcagattcnnggnagcagcctggaattanctnatttaactt

SEQ ID NO: 89916 - DNA, 665 bp, Triticum aestivum
  unsure (1)..(665): unsure at all n locations
  Clone ID: PAT_TA_89916
ccggcagacgcgacgcaacagcaggagcgagagagcggggcggggggcgaggatcgaggcccgcaacgtggccgcggggcgcctgcgcctttgcttcgcttcccagggaagtctggtagtagcctaggctagcgtgggcgcggtatataacgagcgcgagatccagatctggagcagccggccccgncccccaccctgctcgccctcaccctcgacgccgccctcctccgcatcggccaccctccgcgacctctcccgcctccccgaccacatactccgtcgacctcttccgcangaacccttaagtgctgggtaagctgacanagagancctcaaantgttcctgggaacgattgttgaggagatatcttgcttgttcantcctcnacattaaagcagcactcaatacnggngctcccaanaagngncctgagaagtctaatactgggtctgcttaatcaagctgattagctnagaagttctctggaantcaagatacnagtgacatgngatttcanatcaaccaactgactcttccttaagggtggagcatttcnccggttgaatatctttnaagtcagnttgcagagattcantcctcagtttattaggttaacagncgaatnatgtgntgnncaatcacaattctgcacatcgtattgact

SEQ ID NO: 89917 - DNA, 531 bp, Triticum aestivum
  unsure (1)..(531): unsure at all n locations
  Clone ID: PAT_TA_89917
aaactcgagggcagtagatcatcaccaaccatgtcgtgctgcggaggcaactgcgggtgcggatccggctgcaagtgcggcaacggctgcggagggtgcaagatgtaccctgagatggacgagggggtgaccaccacctcccagaccctcatcatgggcgtcgccccctccaagggcaccccgtcgttcgaggccgccgccgagaccggagccgacaacggcgggtgcaagtgcggctccaactgcacctgcaacccgtgcacctgcaagtngatccatccaaatcaaggacaaggagattggatggcatggatggcctaatgaangacactagtatattatgcatggtgtgtgctttgtttcccttttaattgccgcngagaataaacggatctacgtatcgtatcgtanggatcnagcnatcaanggcccttntggcttgtaccgtgtngttgaaagggnncgcgnagtcccntttctgtgaccgcctttccaaangtcnaacccgtccgtgctcccgttttccaaaat

SEQ ID NO: 89918 - DNA, 390 bp, Triticum aestivum
  unsure (1)..(390): unsure at all n locations
  Clone ID: PAT_TA_89918
tatatcctcaagaccacaatcaactaactaagtccataaaaaatctcataatccaccataaaatttggttcaagaccacaattgcctaactaaatccaaattgtttcaaatttattaaagagtcatttatccactaatataatgatcaacatgctcacctactagacctaaattcacataatccatcgaacatcttttactaggctcgtcaaaatcacantnaactnactaaatccanccatggccttataatccaccataagaattagggttaaagatgatcanaatganctactanatccaantttttccancctagatgagatanttggttatccaccaatataataatcaccatgctcatctactagacctganatctcantagtc

SEQ ID NO: 89919 - DNA, 468 bp, Triticum aestivum
  unsure (1)..(468): unsure at all n locations
  Clone ID: PAT_TA_89919
attcctctcccctcgcctcctcgtcctccccctcctaggggatcgccggagaggaatcgcgacgagggcttcctcctatcagttaaatcaaagccatggagcacaaggagaccggctgccagtctcgggagggtcccatcctttgcgtcaataactgcggattctttgggcagtgcggcgaccatgaacatgtgctccaagtgccacaaggagatggcgatgaagcaggagcaaggcaagctggctgctcctcttttcgacagatcgtcaacggtggcgatccgcgaaaagaaaccttgctgctggcanacgcggtggagttctcacgttntagcgaagacgcttattacgganagctgctgatatcgccgtcccaaacnaggcggggatggnnaccccaaaggccaanccgggggngaanaacttgaaaaaaaggttnggctgacggttnantgccggggnggaatt

SEQ ID NO: 89920 - DNA, 602 bp, Triticum aestivum
  unsure (1)..(602): unsure at all n locations
  Clone ID: PAT_TA_89920
aggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatacatggttggatgggaaaggccgcactggacaagacctaccctgctgggttcatggacatcatttccattcccaaagactgggtgaagaactacaggttcctttatgacaccaaggtcgcttccgccttcatcctgtcaagggatgaggatgctaattcaantctgcaagncaggtctgtccattcggcaaaaangnatccctacctgaaactanatggccgacatcggtaccagaccatcataaggcaatgcacatcaantcactggnacaacagatgtgactaacaattncctcgnatgtgncangttctggggccaaacgggc

SEQ ID NO: 89921 - DNA, 661 bp, Triticum aestivum
  unsure (1)..(661): unsure at all n locations
  Clone ID: PAT_TA_89921
gagagagagcactagtctcgagtttttttttttttttttttttgatagagcaaccaatcattggagctaaaattataagtaattgaaaagcatacaatcttgcttacataagagatattggaaccacacgcaccagacaataatacaattcagaaatcgctagaacaacgatataagtaacaccgacactaactatgaagtatttatgaattattacgccgaggcgccgtcggaggattgggtcatagctgctagtagtcttgggcatcgggggcaagccaaccacttgtagaccctcaaggatctgggactacttcaatcattgtaagcctattatcttcattatcttgggatgcaccaacatgcaactttgcaaacccttcaacctcctctaaattgaatcaccatgtaattgcggatccatcaaagtctggacatctccctcatgaagcttcctgatggtcgcacangaaagtatcaacatgacactactgcagtgcacgggtactcagctgaattctctccngataaattcagcaacacatacgaagcttaacacaactttgggtacagaacncgtaagcacncgggnaagaaccacagttcncgatgatcaaaancgtaattccttcnaangngcaaccaagtcgaattngaaatg

SEQ ID NO: 89922 - DNA, 355 bp, Triticum aestivum
  unsure (1)..(355): unsure at all n locations
  Clone ID: PAT_TA_89922
ctcctccgccgccgccgccgcttctgccgccatggncgacgagctggacgagctcatcgagttcctctccaacggctcccctcaggtgcgcggcgccgcggcgganatcgtgcgggggctcacgggggacagcgacnggctgcggtccctcgcggcgcgcgccgaccgcgcgctgccggcgctgctccggctgctcgcatccgtgggggccggctgcgcgggcgaggcggnggatgactcgctcgtcaagctcaggccaggacggngaccttgccgcncgcctcgtggtgctcggagccgtcncggtcgccatggacgtgatggtcaagcgctgnngagagnagcccaatgctcg

SEQ ID NO: 89923 - DNA, 664 bp, Triticum aestivum
  unsure (1)..(664): unsure at all n locations
  Clone ID: PAT_TA_89923
acaagaaacacagttgtctacatttgtccatagtacaaaatccaatactggcagtaattgaaacagaaattacaccctttgatctagaacttgctctacgacagccttccaacttttatgtatgaccttgagtagcagattaagtgaacttttcccatacatattccttatgagtggtccttctccagcagcatgtatttggtctcggtgggtggggagccttccattccttctgttcttgtttgttgacgggcacgccgcccctacttctgtggactgacggcgccgacgaagtagagctgaaggagtgaggatcacgagcaacctatggactgaaactcactgcgaatggttcgacaccaacgacatctttgggaagggcaatgacagtcaacatcttatagcctcctattttgataaaatagctaaactattagcaataaaatagctgatatgatggagtaaacagtaagacagttttgggattcctgcactccacaattgattgaaaacagagtaggtcaatttagcaatcaaagatccggaacaaacaacaaagcaacacatgtaatcccaaagcacacaaggggggnccggtaccaatcgccnaaggagctatagncgtcacggcgtcgttanantctgacgggaaaccngngtacca

SEQ ID NO: 89924 - DNA, 447 bp, Triticum aestivum
  unsure (1)..(447): unsure at all n locations
  Clone ID: PAT_TA_89924
gaacccacctacccangtanctcngcanccatgaacatgaactgcngaaggggtcccgctccggcgacgatggtgcgctgcaggcantgcancgccagcgtcgccgcgccgcccggcgcccgtgccntccattgcatgcagtgctgctgtcgttacccgcgtcggcggaggtggccnacagcacggggcgatggtgccggcgatncgccccatcccgggcttcggcnagcggccgcggcaagaagcgctccgtgctggtggggatcanctacaccaacactcnngcctgcgagctcangggccccatcancnacgtcaagtgcatgangtacctcctcaccgancacttcggcntctccaacgactgctcntcatctcacgnttanganagggaccntgcaagcagccgtcaataacaacatccgcatggtaatcatggctggtgca

SEQ ID NO: 89925 - DNA, 636 bp, Triticum aestivum
  unsure (1)..(636): unsure at all n locations
  Clone ID: PAT_TA_89925
tggcgctcgagcataaaggactccatgcgtagtggcgttaccatccaaacagacgaagcagaagaggagctgaaacctcggatcccaccggcgacctgaagatcgatcgatcgccaccgatggccggcgggaggaagcgggagtggatacggaagaagatgacggcggcggccgggagcgggtcgctgctgcgcgtgcgcgcgctgtccacggcgctgcggcagcggaggggccggctgccgcgcgtcgacctcctccggctcttgtacgagagcgtcgtgttccggctgctgtgggtgctccgatccctccgtcgtcctctccaaggctctgcttcctcctcctccgcttcnggttccggtggtaaataacaacttaactgcttgttccaacaagatagaaatgtaaatagtgcacaaatcaatggtcantctcgcttcctggagttgtgtcaatggcaaggcnatttatacaacacattggttttangcatgttggnaatttttctgaaatcacanattaatgcatctaaaaaaagggggccgtaccaatcnccanatatcatancccnacggctcnttaactctacggaaactgngtacactancctgagaancctttnacnggaaacaaggn

SEQ ID NO: 89926 - DNA, 469 bp, Triticum aestivum
  unsure (1)..(469): unsure at all n locations
  Clone ID: PAT_TA_89926
ggcaggtaagggaggaggagagcggcggcgaanatggtgtcgctgaagctgcagaagcgcctggcctcnagcgtcctcaagtgcggcaagggcaangtctggctcgaccccaatgaggtcaacgagatctccatggccaactcccggcagaacatccnaaagctggtaaaggatggtttcatcatcaggaagcctcagaagatccactccaggtctcgtgcaangagggcacatgaggccaagcataanggccgtcactctggatatggtaatcgtatgggtaccatggaggctangctccccaccaanatcctgtggatgcngacgatgcgngtcctgangcgcnttctgcncaagtacngtnagccaagaagattgacaagcacatgtncatgacatgtacctgaagtcaangntnacatgttcaanaanaantaggtcctcatganagtatcacantcaacgntta

SEQ ID NO: 89927 - DNA, 656 bp, Triticum aestivum
  unsure (1)..(656): unsure at all n locations
  Clone ID: PAT_TA_89927
ccgtccaccaaaccgcctccgtcccctgcctgccaaccccaaattccgctctcgaatctttcccgagcatcgaccatgtcggcctactgcggaaagtacaaggatgagctcatccagaacgctgcctacattggcacccctggcaagggtatcctcgctgctgatgagtccacaggcaccatcggcaagcgcttcgccagcatcaatgttgagaacgttgaggacaaccgtcgtgccctccgtgagctcctcttctgcacccctgggtgccctccaagtacctcagcggtgtgatcctcttttgaaggagactctgtaccaagagcaccaagggtggcaagcctttgtcgacatcctcaaagcgggcaattcctccccggatcaaggtggacaagggtacattgactcgctgggacaacgtgagacacaccaaggcttgatgactgggaaacgctgcgccaagtatacaagctggtgccgctcgcaagtgggtgaatctaanatnggggcacngagcatcgangtctcatcgacaaaacgctaaggtcngntccatcatattcaganaatggctgggncaatgcanccaattctgtntggcnatnattacgcgtgctagtacaggcncttcgctgnaggctaaaaaaatcccccag

SEQ ID NO: 89928 - DNA, 636 bp, Triticum aestivum
  unsure (1)..(636): unsure at all n locations
  Clone ID: PAT_TA_89928
atcaatgcttatcgcccagatcatcggcaccgccattggttgtgtcatctcaccgctgacattctatgtgttctacaatgcctttgacataggcaaccaggacagcccctggaaggcgccgtatgctctgatataccgaaacatcgcgattcttggtgtggagggcttctctgctctgcccatgcattgcttgcagctctgctgtggattctttgcctttgcactggtggccaacctgatgagggatttccttccacagaagtatggcaaatgggtccccttgcccatggcaatggggttccccttccttgtcggcgcgagcttcgccatcgacatgtgtgccgggagcttgatagtctacatctgggcacaagattgacaggagcaaagcagcacatatggtgcaacagttgcctccggttaaatgtggggatggacttgggtctccaacttcctgcctgcgttggcaagtacccacaatgtgaaggnattgctcacaactaatggtacatgccgatanggccctgntccactcaaggtgaataanttatgtatataatcanaagggtaaantgnagagganacacttagacanantcattcaatgggntcacgtacgaagtacacgnaaacana

SEQ ID NO: 89929 - DNA, 483 bp, Triticum aestivum
  unsure (1)..(483): unsure at all n locations
  Clone ID: PAT_TA_89929
gaaggcagtgcccgccgccgccgccgccccctcaatccnccggncccgccccncaactccctccgcctctcacgcgcgtcnccggccaccgngcccctgctgtctccaccccntgcgcaatctctctcnactgggttttgagnggaacatggcnangctggtgtcgtcttccctcgtcangnngctcgtncagtcntgccntgcgcccagcanggtgactgtgtcacgaccaactttccaacagttcatgatctactcatcaggaatcaagtngtgattctaacgtnaatgggnggcanaaagtgtaanactantaactgntnatactgatacacatcannatttccagcctacaagcaaaggttctganaatntcttgcangaattgctgctcaagntatnanctaatcaatcaatatctnaatgatnggttacctnaacncccagnnttantcatttaatgntnttaanggtctcananat

SEQ ID NO: 89930 - DNA, 306 bp, Triticum aestivum
  unsure (1)..(306): unsure at all n locations
  Clone ID: PAT_TA_89930
acagtctcgagtttttttttttttttttttttttttttttttttttttttttttttgcacacagaacggattgaatttcatttccatctgaattgaatggcaaagcgactgtgtcgtcgtggtcaactaaatggtgggagatcctagatgcagatgcatgcattattttgaaagtagctcaaattttgtttgaaagtagctcaaattttgttagagcttggttcagtccaagcatacattaatcttatactccctccgtttcaaattactcgtcgcagaaattgatgtanctagaactaaaatata

SEQ ID NO: 89931 - DNA, 588 bp, Triticum aestivum
  unsure (1)..(588): unsure at all n locations
  Clone ID: PAT_TA_89931
gacacaagttcttgcaccgatcagatccaacttctgcgcaagatgctggacaagctgtgggacgacgtggtggccgggcctcgcccggagacgggcctcgacaagctccgccgcgccgccgccacccaacccctcgccatcaacacagctgcaggggaggcgattaagcagtcgccgtcgatgccgacgaccccgaccacgccggtgacccgtcgtcgtcgaacgccgccgcgtggcggcagcgtgtggcggagcgttttccaacccggggagaaacttggccaccaaaacctcggngccaacttcttcgacgcccgcaaccaactccccaccgtctacaactggtttaaaacgacgagacaagacaaganaacacgctnaataagaccgacggcanagatntagacaggaattntgcgacccccatgttgcgctctttggtancnaacccgcanacctacttgcttctaagntnattanttgtctnaactctacactacacaaggtgtaaaaaaaangggggccggtacaattcccnaanggtctatancccnaaggcgtntttaactctacggaaactgngtacac

SEQ ID NO: 89932 - DNA, 634 bp, Triticum aestivum
  unsure (1)..(634): unsure at all n locations
  Clone ID: PAT_TA_89932
atcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctggctgactacaacatccagaaggaatccacactccacctggtgctcagactccgtggtggcatgcagatcttcgtcaagaccctgaccggcaagaccatcaccctggaggttgagtcctctgacaccatcgacaacgtcaagncaagattcaggacaaggagggcatcccccggaccancagcgtctcaattttgctgggaagcagctcaaggatggccgnanctcgctgactacaacatccanaagggatccaantccacctgggctaagctccgttgtggatgaaatntcctcaagacctnacggaagacacacctgaggccagccncnaacancanaactncaggcaagtcaagacaggnggatccacggacaaaggtccaactttctgaaaaactngatgcnncttngggcnaaancaaaagg

SEQ ID NO: 89933 - DNA, 620 bp, Triticum aestivum
  unsure (1)..(620): unsure at all n locations
  Clone ID: PAT_TA_89933
gggatgcagcgccgggctgatctcgctggacctggcgcgcaacgcgctgcggacgcggcggaacgcgacggcgctggtggtgtcgacggagtccatcgcgcccaactggtaccccggcaccgacaagtcgatgatgctgggcaacatgctgttccggtgcggcgggtcggcggtgctgctgagcaacgacccggcgctgcgcgggcgcgccaagatggagctcanctgcctggtgcgctccaacatcgccgccaacgacgacgcgcacgcgtgcgcgcagcaacgggaggacgcngacgggcgcgtcnggatnaacctgagcaangcgctccccaaaggtgccgtcaaggcctcaacgtcaactccgggacgctggcgccgcgcatcctccctgtnaacgaactcncgcggtcgccgccggctcctgctnaggaagtctcctcctcctccgcaagcaacggnggaaaacnaaggccnaaganaaatttaatccggcgtgncaattcngctgnanccggcgganggggtatcaagcgtgaacggacctgggctgacaagggactgaaccgacgganaccttaacgttgggaaaatcgnaaaacttggacttnctaatgnng

SEQ ID NO: 89934 - DNA, 587 bp, Triticum aestivum
  unsure (1)..(587): unsure at all n locations
  Clone ID: PAT_TA_89934
atcgacccgaggctcgtcgaacccttcttccccaccgcctcaagatgcagatcttcgtgaagacactcacgggcaagaccatcacccttgaggtggagtcgtctgacaccatcgacaacgtgaaggccaagatccaggacaaggagggcattcccccggaccagcagcgccttatcttcgctggcaagcagctggaggacggtcgcacccttgccgactacaacatccaagaaggaatccaccctccacctggtgctccgcctgcgtggtggcatgcagatcttcgtgaagaccctcaacggcaagaccatcactctggaggttgatagctccgacaccattnacaacgtcaaggctaagatcaaggacaaaggagggaatcccccggacancagcgccttatcttcgcaagcaagcaacttgaggatggtcgcaacctngcgactacaacatcagaaggatcaacctcaactgggctccgctcctngtggnatcaaatttccnnaaacctcacngcaagatanaaccnnaggtnagagtctgaacatcaaaagtcagacaagtcaggcagggggattcccggcaaa

SEQ ID NO: 89935 - DNA, 616 bp, Triticum aestivum
  unsure (1)..(616): unsure at all n locations
  Clone ID: PAT_TA_89935
cagaccgctgctgagcctggccgacatggccaccgcctcgctcgccgtccgctcggccttcggtgtcgccctggccgccttgatcgcggcgcgtgccgtccggcggcgctcgctggacgcctcgggcggagctgccgggttcgccgtgatggcgctccaccttgcctgcggctataggtacggtgcgctgctgctggctttcttccgtcacctccgtccaaggtgaccaagattggcgaaggaccgcaagcggcgcgttngaggaaggatttcaaaggagggtggccancgcaactggttcaattcctgcgaatagtgcaataacaactgtattgggtancctaattgggcgatatgactgggggcaaagatnaaatgcttggactcaaatggtcaaaagntatnacttggtataataagtgcaataatnggcatattgctnctgcaatggaacacttggcanctcaaaccggttgctaatgatnaaaaccaagntttcacaaccttaacttcanggaagganaatgtggatgnctanangatctctcanaaaagtgncnacatggcgatttgtctttgacgataancgaagtcntnaatnttaannccaaaacnn

SEQ ID NO: 89936 - DNA, 634 bp, Triticum aestivum
  unsure (1)..(634): unsure at all n locations
  Clone ID: PAT_TA_89936
ctcgtacccagcacccgccgtccgcatgtaccaatccctcccctggccccggcgccgccccgcccccatcccctcccctggttctgctccgatgccgatccggtaaacaaccgccggcaggctcctcccgtacggccgccacgtccacgcccaccgccgctgcgctctgtacccaacctcccancatcttctcagcgaccccgcaagccgtcgccggctcgaccccgcgtgtcgtgtgcccgctaccccatcccgtcgcacctccctacccccaccatctctgaccancgccgccgcccattgcactgcagaaccacctgtcgtcgcccattgcactgcagaaccacccgtcgccgcctactgcatcgataggtgagcttctggttcctgattgtgttgtcgtaantgcactcatcctctaaggggtccatcanaactgaagtgatcactcgaatcaaccaatcngttggtaatctaaatncntgatcgtganaacgatttctaanacaatngaancncgtcaattaatcacagaagatgaacctgnatcttccaaaatgtnaaatttggaaaaagganngtaancctcaatgggncgctcaantcgagnggaaanaaacggttnnnggttact

SEQ ID NO: 89937 - DNA, 236 bp, Triticum aestivum
  Clone ID: PAT_TA_89937
tataaagatgccacgcaccaaatcaaactcctgggcttcgaagcaaggctggtcaccaggcttgtccagtcttgtgtactggatttggtcagagttcacgtaactcccggttggctttggttgtacaactttcagaccgttgtttgtatgcgatacgcctaattgacttgttataagaacctttcaccggaaagcaatgtttatggcatcctgatggtttagataaaaaggggggg

SEQ ID NO: 89938 - DNA, 503 bp, Triticum aestivum
  unsure (1)..(503): unsure at all n locations
  Clone ID: PAT_TA_89938
acagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccaaggctggtcggcgttccgcgtggtgtcgacgagccccgaaatgtggcgctgcgccgatatgaaatccaacgtccnacgnanctgcngtggacctgcaagagtactgatccgttcaagccggcatatatgttccgcctaaaataaaataaactcaaggcaaaatanaactcancctgccatcctttttttttngcaacatgctaaacatagtctcnctcctcgcgttttcnccccccanaaantggggttctngttttaactaccggaacnccgt

SEQ ID NO: 89939 - DNA, 621 bp, Triticum aestivum
  unsure (1)..(621): unsure at all n locations
  Clone ID: PAT_TA_89939
cacacaggcgccgctccgcctccatcttcgtcctcctgctacctcaccaacccaacgcagctaatccttcttctccatccacctaaccatccaagcgctgttctcctcttctccgtcgaggtggatggccagccactttccggctggcagcgccagcatgtttgctgcaacggctgaggcggtgccggcctgctcgtctgcgcacgggggccggggcggagtccccgtgccatgctagtggagcccttgcggtgggtggatggttgggggcaacggggccggtgtgcatggctcggttgctcgccagttctgggcggccggccagcacgcgcgaaggcggctgggctntgggcgcctgttccgggaggcgccgtagcatcttgtgggtggggctttcttttgccggtggtcccggatttgnagtgtcnaaatgctccggtgaaaccccaatttctctccngtaactcactcttacaaagcatcacctgtncaaatanttatggaaattactncatctcggtcggtcctctcncatggatataactaaatggaatnactanaaaagggggccggacaatcccnaatatcataccggctanggctctttaactctangaaacc

SEQ ID NO: 89940 - DNA, 422 bp, Triticum aestivum
  unsure (1)..(422): unsure at all n locations
  Clone ID: PAT_TA_89940
gaggcccanacccttcggttccggtgtggcatcggccgccgcngccgangtttcggtgggcncgggatgccgcggcggctgggcgtggaggcccaggccgagggcgcggncggggcagcgcttgagggtcanaggggcgcctancncccacgcggccgcnccggngagcgccgtgcacgctgagccccaccacggcgagcngttccgcncgttcgggctgccccgcgctggattcggttcggacctggaggcgggcatcgacaangtcatctacgcctgccgcttcatggacttcctcgccatctccggatctctcgacggatccgtcctctgcttctcaatggctgcactttgtnatngatgccttcgtggaatacacttgcncagcnatgggnaangtntgcgcatgcnattgnacccat

SEQ ID NO: 89941 - DNA, 654 bp, Triticum aestivum
  unsure (1)..(654): unsure at all n locations
  Clone ID: PAT_TA_89941
gagctctattgcctcgagcatggcattcagcctgatggccagatgcccggtgacaagaccgttgggggaggtgatgatgctttcaacaccttcttcagcgagactggtgctgggaagcacgtcccccgtgctgtcttccgtagatctcgagcccactgtgattgatgaggtgaggactggcgcttaccgccagctcttccaccctgagcagcttatcagtggcaaggaggatgcaagccaacaacttcgcccgtggtcattacaccattgggcaaggagattgttgatctctgcctagatcgtatcangaactttcagacaactgcactggctgcaaggatccttgtcttcaacgctgttggaggtggaactggtctggcttgggtcgcttctcctggagcgtcctctgttgactatggaaagaatcaaacttgggtcaaaatttaccanctcccaaagtctccacttcngttgttgaccatacacatgtctgtcaaccatcatccttgacanacgattctcanccttctganaagaggcatcatactctccgcgcncctnanatgacgccaantaacaactaanagctgtccaagcatnacatgagctccnagttatggccnaagntantaacattcaacactgngccaccag

SEQ ID NO: 89942 - DNA, 665 bp, Triticum aestivum
  unsure (1)..(665): unsure at all n locations
  Clone ID: PAT_TA_89942
gagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatgttccgcctaaaatgaaataaaagctcagacgagatgagcagcgtcatcgtgcctatgcgtgtgtgtgtggccaacaaatatgtatacaattatgccgtgtcttcgtcgctgtgttttctctctcgagaaaaattggtgttgcttggtgtcaaataccggatacctccgtgaataattatgatgtggttgggggcaataatgtgagtccctgtcangcgttaaaaaggggggccggtaccaattccctanangatctataccgcctcaangcgtcnttaaactccgacggaaactggntnccaataacnctngagaacccttccagtgggaa

SEQ ID NO: 89943 - DNA, 569 bp, Triticum aestivum
  unsure (1)..(569): unsure at all n locations
  Clone ID: PAT_TA_89943
tcggctccttcttccttcgagccatgggtaaggagaagactcacatcaacatcgtggtcattggccatgtcgactccggcaagtcgaccaccactggccatctgatctacaagcttggaggtattgacaagcgtgtgatcgagaggttcgagaaggaagccgctgagatgaacaagcggtcgttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaacactgggtggttttgaggctggtatctccaaggatggcagacccgtnaacangcctccntgcttcaatccttggatgaacacatgatctgctctgcaacaaatggtgcacactcccaaatatccaaaggtccttataagaaattgcaaggaatccctcctactnanaggtggtnaacctgnaggtccttc

SEQ ID NO: 89944 - DNA, 634 bp, Triticum aestivum
  unsure (1)..(634): unsure at all n locations
  Clone ID: PAT_TA_89944
cccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgatgaccaggccgtgaaggtggttgacattgttgacaccttccgtcttcaggagcaacctgcttttgacaagaagcagtttatctctcacatgaagcgctacatcaagaactctctgccaagcttgaaggggatgacctagattttcaagaagaatgttgagtctgccacaaagtacttcttaacaagctcaaggacttcanttcttgttggcnaaacatcatgatatgcgctggtgttccctacacaagganggaactgctgatcaacttcctgtacttganatggctgaaaaggcaaggctaacncacgtagctaaactancgncgcatatttgcccgcncaaggtgcaatcaacncaagtntgtcgtacacaaanttatgccgaaattcgaaa

SEQ ID NO: 89945 - DNA, 215 bp, Triticum aestivum
  unsure (1)..(215): unsure at all n locations
  Clone ID: PAT_TA_89945
actggaanctatctacacaagntanatanctgatctgacccatggagcgtctaggaggagcggcggngccgtcgctggngcngccggggttcngcttccaccccacggangagganctgctgnagttctacctcaagcaccatgtcacccganataacaagcancagcacctcaatcgcggcaccgttcgacatnatccccacngtgcacctgta

SEQ ID NO: 89946 - DNA, 643 bp, Triticum aestivum
  unsure (1)..(643): unsure at all n locations
  Clone ID: PAT_TA_89946
gaaatctcaagctcagcacagcaacaatggccgagcagaccttcatcatgatcaagcctgacggcgtccagaggggcctcatcggcgaggtcatcagccgcttcgagaagaagggcttctacctcaaaggtctgaagctccagaacgtggagaagtcgttcgccgagcagcactactccgatctgtcctccaagcccttcttcgctgggctcgtggagtacatcgtctccggcccggtcgtcgctatggtctgggagggcaagagcgtcgtcgccactggacgcaagatcattggcgccaccaaccccctggcctctgagcccggcacatccgtggtgactttgccgtcgacatcggcaagaacgtcatccatggaagcgactcagttgagagtgccaagaaggagatcgccctgtgggtccctgaaggcatgcagagtggaggacaaccagcacactggtntatgaggctaagtgttcatgatgggttgagtgaagttcaataacatctacaaactatcttggttgttanatttgagattgtacctgggaactgttgtttaacgaattaccctgggcttacatcaacntacncggccaaattgaaaaggatgattcattagttaaaaggggccgtncaattc

SEQ ID NO: 89947 - DNA, 154 bp, Triticum aestivum
  unsure (1)..(154): unsure at all n locations
  Clone ID: PAT_TA_89947
actccgcgttggtgctgatgctttcaaaagcctggtcagctgcaaagggcaccgacatcacaaaatcggacgcaaaagacataatgttccatctatacatgactgctgtggccaatctccaaagacagatgccaaaggncatnaagntantgaa

SEQ ID NO: 89948 - DNA, 527 bp, Triticum aestivum
  unsure (1)..(527): unsure at all n locations
  Clone ID: PAT_TA_89948
cgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtccgacgtctgcgacgacgcccaccccaagtgccccaagggctgctcggcgtccgcgtggtgtcgaacgacccccgaaatgttgngctgcgccngatatgaatccaccgttcgacggacctgccgtgggcctgcnagaantactgattnngtcaatgccaacatgtatgttccgcctaaaatgaaataaagntccaagacaaatgacancgtcatcctgcctancgtgtgtntgttggcaacaatattatacaatatgcgtncttcctcgtgtgtttctctcnccaanaaaatggggttgcttgttgtcaaattccggatanctcgtgataatnaagantgtggttggggaa

SEQ ID NO: 89949 - DNA, 302 bp, Triticum aestivum
  unsure (1)..(302): unsure at all n locations
  Clone ID: PAT_TA_89949
gtggacaacagtaccatgaagggtgatggcatggctttcttcctcgcctgttacccatcaaaattgtcaccaaactcacgcgggggaaaccttggcctgattaactccggcgacgatggcaagaaccaggccgccttcggagacgaacggttcgtggcaattggagttcgacacttccaaaacaacctgggaacccaattggcgaacaactttgnaatcgacattaacttctttcnaacctgtaaccggnacaagggtgcgcgacttnancctcnaaaggggccatnannggcaacgttaac

SEQ ID NO: 89950 - DNA, 515 bp, Triticum aestivum
  unsure (1)..(515): unsure at all n locations
  Clone ID: PAT_TA_89950
gtcgaccgcatcggcctcgtctcgtctcccgtccccgcccgctcgccgccgttcgccgaccggcctcgccggcggccttccgtccccgtggtcgttcctcgagaggaataaggcgagatggcaatggcgacgtccgtcggcgtaccctccgcctcctccgttctaccggctgtacaaggacttccgagcaggacccgtcgtctgcgccggagcctccaccgccgattcgagggtcctaccactcttttggcgctacctacacaacggatgttgtgctgccaatctggaggattnaaggtgttcgccaactttatcccaaaggcccaaatttcaanttcaagaaggacttaagncactcaacaaaannttnatcccaanactttgggctaacggnantttaagnggaaaacttccaatatccccaggttnaaaaatttaatntttcaaaaatncacactcctaatccctaagacanacaagcaaganacatgatcactctnaaacaataaagtcga

SEQ ID NO: 89951 - DNA, 478 bp, Triticum aestivum
  unsure (1)..(478): unsure at all n locations
  Clone ID: PAT_TA_89951
caatcatatgacaactttccagaacacaaattccaccctgccacctccatcaccaatggccccactgccaatgatgaatcgaccgcctcaaggatatcctccaagttcccatgaatcatccaaccggttctaagtccaagctatgaatcttccaaccggcaagcatgaancatcgaccaaggttnaaatncaactattantnatccaacaagtttaaaancaaccttatgatcntcaacaagttccaatccactatgagtcgtccacaagttcaaatccactatgatcntcaaccgggtcaatcnactatgatcatccaaccggttcaatcnantatgatcatccatgggctcaatcaactatgatcatgcaccggttnaatcaactanaattttcaccggttaattaatcaactatattttnaggnccacaaggcttanntttnaaacttncntaaaggnggnaaggagntatttaa

SEQ ID NO: 89952 - DNA, 477 bp, Triticum aestivum
  unsure (1)..(477): unsure at all n locations
  Clone ID: PAT_TA_89952
cagcagctgcgcaaaggctcctcaaaccctaaccctagtcctagcttagcttccttcttctcgatctagctagagccatggcgccgaccaagggcgaggggccggccatcggcatcgacctcggcaccacctactccgtgcgtcggcgtgtggcagcacgaccgcgtcgagatcatcgccaacgaccaagggcaaccgcaccacgccctccgtacgtcgccttcaccgactccggagcgtctcatccggcgatgccgccaaagaacaaggtcgccatgaacccatcaacaccntcttccgatgcgaagcgtcttaatcggcagaaggttgcttgatcccctgncccaagagtgacatttagatgtnggccntacaaggttatccctgggccctgcaaacaanctatgatgntatggaattcaagggttnaggcaacatttttcaacttnaagattcttcaaaggccccatcaaaagc

SEQ ID NO: 89953 - DNA, 511 bp, Triticum aestivum
  unsure (1)..(511): unsure at all n locations
  Clone ID: PAT_TA_89953
ggtaatcccaatccccacagaaatccccatctcaaaaccctagccctcatccccgatcccggcgagcgagatggccaacccgagggtgttcttcgacatgaccgtcggcggcgcgccggccgggcgcatcgtgatggagctgtacaaggacgcggtgccgcggacggtggagaacttccgcgcgctgtgcaccggcgagaagggcgtcggcaagagcggcaagccgctgcactacaagggcagcgccttccaccgcgtgattcccgacttcatgtgccaaggcggcgacttaacccgggggcaacggaccggcggcgatccatctacggcgagaattcgccgaacagaattcctccaacaanacaccaanccgggatctctccaatggcaaacgcgggnccaacacaaangtcccaatttttaattgaacgtcccctgattggtcaacggaanactgnctncggnaagcctccaaggatgactctcaananatcaaaagngggtccccaac

SEQ ID NO: 89954 - DNA, 392 bp, Triticum aestivum
  unsure (1)..(392): unsure at all n locations
  Clone ID: PAT_TA_89954
aaactatcctctcctccttccgtactcatctctctctactttctccgcccccagaagcaactcagaccccctccccttcccccaatttcccttctcttccccggcgacgtccccaagcccaccaactccggccagatgaacggccccctcgagtcctccaacccctcccggtgcccccgccccctcccggtgcccccgtacagttgcccgctccgaaccctagccatttcgcaccgcgaggtatccgccctcctgtacctctagtgttaatacttttggttttgggggaggcgtcgccactgggctgcggggtgggtaaatactcngggccaccatggaggagggttctgagcgggcccctcactcaagcgccacccgggcgcaaaacctac

SEQ ID NO: 89955 - DNA, 482 bp, Triticum aestivum
  unsure (1)..(482): unsure at all n locations
  Clone ID: PAT_TA_89955
cccatgcctcccctctacatattagctcttgggcttctcctcttacacactcctcgctgctcctcgtctgcacctgctggtgataccctcactgaaggccaagtgcttgccgtcggcgacaagctcgtctcgacgaacggcaagttcgcgctcggcttcttccagcctgcaacgaccaccattagtaatctcaagaacgccaccagctccagctccagctggtaccttggcatatggttcaataagattccggttttaactgtccgtgtgggtttgctaatcccggaaggagccanccgccattccaacaanaattcaacaaagtnnaagttctcaaagtngacngnaaccttgtcattgtcaacaaaccttgctggatncctnaacggacccttgttttgnccatccaaattgtcaatnagncacaagcaatttcattaacacacactctaatgcgttgttcccttgaacaatgggnaacn

SEQ ID NO: 89956 - DNA, 488 bp, Triticum aestivum
  unsure (1)..(488): unsure at all n locations
  Clone ID: PAT_TA_89956
gtctcgagtttttttttttttttttttttttttttttttttttttaatgttgatgtatcttttatagacatgatcaaaccttaatatgtttaatttagtatgtaggagtacaaattagaactcaaatacttttaaacgcaataaataagttgcgtcgacgtattcttcgactcatatgtcgagaggttgcattttgcgtgggaaatggttagcttctggagacgatgagcgaacggagcgggtgcttcatcacggtggtgaaaatcgagcgtctccgccatgtccaccttcaccccctcaagctgccggccgccacccaactccctcaccatctcgccacgaagtactcggcgtggtgcatgcccagcgtgtaccccgggnnatcctgcggcctgcgccgaaaggancatcctgatctccctgctccccgtgatgtccatccgtgccctcgccgccctccaaagaactctccgggcggaancccggcg

SEQ ID NO: 89957 - DNA, 413 bp, Triticum aestivum
  unsure (1)..(413): unsure at all n locations
  Clone ID: PAT_TA_89957
cttttccgtctgcccccccaactgctccgcactttccttctctccttcctttctcccgatctgagcaacacccagtcgctcgctcgattgatccccacagctccgatcctcgagtggtaaagtagccagattagtcggcgttctgcttcctgctcagcccagattagatttgcttgtcttgttgtttttggtgctggggcgctcgctccaattcggtcaagtttctactcctaagtcctccatgaattgttgcctttcctggngtctagttcaatccgccgcggagtancccgantcacttggtagttgtgtccccttgctcacaaattaaanccttggacttaantttggnctccntggggggaaaaaaaatntccccgtttanctaaaggaaaaaggggatcnaaacttcg

SEQ ID NO: 89958 - DNA, 465 bp, Triticum aestivum
  unsure (1)..(465): unsure at all n locations
  Clone ID: PAT_TA_89958
ctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgancgtctgatctgatggagtccaacaagggtgcgtgtgcgtgtgcgtgtggtttgcttgctcgctctcccatgctctgccatggtgtccntgtgtgtagtgtgtgtcatgttccctgtaatgctnaancatccccac

SEQ ID NO: 89959 - DNA, 451 bp, Triticum aestivum
  unsure (1)..(451): unsure at all n locations
  Clone ID: PAT_TA_89959
cgatcccctggatctggatcggggcaacggccacccccccatcacctaccccgtcgttcccccctcgccaggcgctcgctggaccccgtcggcgccgttccgtcgtctcttccacgccttccccctcgctcaagatcacgcccgaaggccacagacgccacggccaccgccgccccgcctggacctcgccggagccgcctcgccggactggttnctctccgtccccgtcgtctccatctcctccccgcgccccggtgccttgtccctacatcgaacgaccccgagagtgccagcgacccccagttcgactatggtgttgacgactcatccttcttgctagagcaaccagacgttggaggcaagnagccagacgccacatcgacgatgactcctactacactggaggtgctactactacttnagccgccgacgaacangagtnttaagaggt

SEQ ID NO: 89960 - DNA, 461 bp, Triticum aestivum
  unsure (1)..(461): unsure at all n locations
  Clone ID: PAT_TA_89960
caagcactacatgtggccgctcctccactacctgctcccgctcacgccctccacgctcggggggctgcccttcgaccgcgcgctctaccactccttcctctccgccaaccgcgccttcgccgaccgcctcaccgaggtgctcgcccccgacgacgacttcgtctggatccaggactaccacctcctcgccctccccaccttcctccgcaagcgcttcccgcgcgccagggtcggattcttcctccactcgcccttcccctcctccgagatcttccgcaccatccccgtccgcgacgacctgctccgcgccctcctcaacgccgacctcgtcggcttccacaccttcgactacgcgcgccacttcctttcggctgctcccgcctcctcggctcgactacagtcaaagcgcggataatcggcatcgagtataanggcgcacgtcaacgtcaagattctgccgn

SEQ ID NO: 89961 - DNA, 343 bp, Triticum aestivum
  Clone ID: PAT_TA_89961
ttaccatcgagctgcaggggatcccgttgcagcgacatgggttgcaccgacatggcttgggatgcctggctcaccatcaaggaccacttcttggacaacctagagactcgtgccctccacctcgatgtttcttttcgcacctttgtccaaagtgatctctccatcaacaactactgctacaagttcaagggtatgactaatgccctaagggtccttggcgaagtcgtgcccgatcatgcgctcgtcctcaacccccttaaaggtctcaacaagcagttcgagcacatgaagaccttcatcgggcgcaccacgtcgttcccactatttcaagccatccgcaaca

SEQ ID NO: 89962 - DNA, 470 bp, Triticum aestivum
  unsure (1)..(470): unsure at all n locations
  Clone ID: PAT_TA_89962
atcaattttttagcgacttttatccaatatttcctataaaaaatatagtgtaatcatctgttcctaaggaattgcttcaaaatagaaatagctagcatgaactcataattaccaatgttagtatagcactcggatgtgattactttttatgtaatcatctgttcatgaaggaattgcttccaaatagaaatagctagccaaacccttaatacaatggttgtatctacgttctacacaatcctagataccatttctttatcctcctctatctgttttgcaaggttgcaggcttggtcaggggagttcgaggtctcatagtanaacccagaaaagttgagcgcaagcccaagcctgatgggatgagtcagagccaaatctgcaagggctgatgtccagtaaccangagcatcagctttgtcgcgttcatggtgctctccgnaacttctttcctctccgnaacaatcctaagg

SEQ ID NO: 89963 - DNA, 337 bp, Triticum aestivum
  unsure (1)..(337): unsure at all n locations
  Clone ID: PAT_TA_89963
ggacacaaaccgcccgcgtcgcagcctcctctcctccgcctccggtgggcgaaacaatggcgctctccctcgcgcgcagcccgcaccccgccgccgcggcggccctcccgctcccccgcattcaggggcgcatttcccagtacgccccgctcctccactcccctcgccgcgcctaccccggcctccgcctccgcctcccggccgncgccgtcgcggcctcttcgcccccggnggcgctggncgccgancccgcggncgccgcngagggggacnaggagctgggggagacncggntggagctcttcgtcggcaacatgtcgtttaccttctccgacgt

SEQ ID NO: 89964 - DNA, 472 bp, Triticum aestivum
  unsure (1)..(472): unsure at all n locations
  Clone ID: PAT_TA_89964
caagaagctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgagctccggcggcatggagatggcggcggagaacggcggctgcggctgcacccagtgcaagtgcggcaccagctgcggctgctcctgctgcagctgctanatcgatcatcnaccatatgcatgcaacgtgccgtgctgcatcatcgatnattccatntaatactancaatcaantttaccgnacctgatcaaggctttatctatgcaactgaactgcatnacantcaagtgcatnccatgatnttaacagccccctaaataaatttccctgattaat

SEQ ID NO: 89965 - DNA, 497 bp, Triticum aestivum
  unsure (1)..(497): unsure at all n locations
  Clone ID: PAT_TA_89965
caagaccatcacactggaggttgagtcctcggacaccatcgataacgtgaaggccaagatccaggacaaggagggcatccctccggaccagcagcgcctgatctttgctggcaagcagcttgaggatggccgtaccctggctgactacaacatccagaaggagtccacccttcacctgggtgctgaggctccgtggtggcatgcagatatttgtgaagaccctcaccggcaagaccatcaccctgggaggtggagtcatctgacaccatcgacaacgtcaaggcgaagatccaggacaaggagggcattcccccggaccagcagcgtcttatctttgctgggcaaacagctcgaggatggccgcaccttgccggactacaacatccagaaaganccacctccactnggtgctcaagtccgttggtggatgcaaatttttcaagacctgaccggaagacacacctgagnccatctccgacacatnacattnaagcaan

SEQ ID NO: 89966 - DNA, 499 bp, Triticum aestivum
  unsure (1)..(499): unsure at all n locations
  Clone ID: PAT_TA_89966
tcgccctccccgcctacttcttcttcgcctccgccgccagcgacctcgccgtctttctcaacttgccgttcctctaccccggcctgccgtccttcagggacatgggcgacgcgctcgtgcgctgccccggcatgccgccgatccgcgcggttgacatgctggtcacggtgcaggacaaggagagcgacctcaccaaggtccggctgtaccagttcaagcgcatcgcggagtcgaggggcgtgctggtcaacagcttcgactggctggagcccacggcccggaaagcgctcgccgacggcgtctgcgtgcccgaccggccgacgccgaggatctactgtatcgggccattggtcaacagcggcgacgcgagcgcangcggcgagaagcggcacgaatgcctcgcgtggctcgacgcgcaaccggagaagacgtctgtcctccgcttcggaacaanggcgcgtctccgnggcgcaactgaaggagatggtcccnggctatg

SEQ ID NO: 89967 - DNA, 483 bp, Triticum aestivum
  unsure (1)..(483): unsure at all n locations
  Clone ID: PAT_TA_89967
cttcctccgtaccttcccccacccccagccaccaccggtcgtcgcctctcctctccccccccccgccgcccggatcaggaacgatcgcaccgtgcggccgcctcccgccccgcgcgcggatcatcctaccatgctgaggcgctgcgccccataccgaccccacagggccgccgccgcaccgcgcctcccgatccccggcggncacccctacctcgccgtcctctccttcctcttcatcccgacctaagctccaagcctcgccgacaggccggccctcncctgggtgtctctctcggcgccganctgcctgcctgcctgcctggcggaatcgtcatcgctccaatccacccgcgatnagcgaaggaggaggcncanagtacngcggcnggaccggcgccggggcgtccgggnctgtccgttgatnngngggccangtgctcaacgcttgngnaactgtnggaccgnaagcttncgcctcgtann

SEQ ID NO: 89968 - DNA, 515 bp, Triticum aestivum
  unsure (1)..(515): unsure at all n locations
  Clone ID: PAT_TA_89968
ttttttttttaacaacaaatcctgtagttttttcatgtctgacaaacatatggaactacacccataatctggctaatggagagcaattaatcttcataccaatatatcatcacatataactatatacaaagattggacatatgaaagttctgctatccttaaagactgcatgtacatcttgcaaaaaatatacgcttgacagatatacatgtgtcctcgcttcaagctttgtccaaggttctgctagccttaaatgttatatgtacatcctggttgtttaagtaaacatatcaagtattttctaagatgttcaaataacccgagtatccgaacaacagagcagtttgcattcaagacattcagtccgatnatgcanaaaacacactgcttggttgagctgaagagtcgcgaagataacttccaccgcatgcacaaaaagtatggggaaacccaacgctttgcgnactgcgaaaacaacggaaaccagtctaacatacagtnatccccatantttg

SEQ ID NO: 89969 - DNA, 480 bp, Triticum aestivum
  unsure (1)..(480): unsure at all n locations
  Clone ID: PAT_TA_89969
gtctcgagttttttttttttttttttttacgacgatccatgcatgcgtttaatgttcattatttaaaatccattttttcaaaaagattcgaaatccatatatacaccatactgtagctagccaacactcggtgctgcatggactgatgtagtacaagtgtttatcttcatatacaagcttacaactttgtggtgtattacatgggcaaatgaatcatttgtacgaggatccatgctttattcaaaacaaatccgtatatacgtcgtgtactgcagtctgcagctgcatggtattcaggtattgtacgtaaagcttagctgataaaccatacttgatgatgcacngactgactgatgaagtagtacggggtttaagaantgtccatggtcnggtagtaagcgtagtggcaagccgcattgccgccgttccgcgggttangccatgtnaccccctcgcccacgtntccccaatggtctcaca

SEQ ID NO: 89970 - DNA, 497 bp, Triticum aestivum
  unsure (1)..(497): unsure at all n locations
  Clone ID: PAT_TA_89970
ggccagcagcctcgcctccgaccagcagccacctcggatccggccagcagcctcgccttcgacccaattcggacgcccacagcctccaccacctacgcaccatgcccccccaccgggtccgaccgatcccgcaccactcatcctcactgcttcctctgctcgcggctcatcctccctcctctctcggtttctccagggagccgccatcctcccgtgcgagcagcctcgctgcttcctctgcatgcggctcatcctcacttctctctcgatttctccagggagccggatatcctcccggcgaggcttcctccatcctcccgcctgagaaacggcgaccgccctctcaccccaagcaagcggtcgtagccgccttcgccgccgtgccggacggacgaaaggctacaactcggangccggagacgctgccggagcgcatgacgaatggcaatgtgtcagataagacacacaaataaaggattgtgggatgaatccaatnn

SEQ ID NO: 89971 - DNA, 457 bp, Triticum aestivum
  unsure (1)..(457): unsure at all n locations
  Clone ID: PAT_TA_89971
gctgccaggggtagtgcccgatcccttttgcctactccttccctcgccagcgcgccccatcgccggacctcgccgcccgatccaccgctccagagaggccgcgaccccatcggaaccgagcgttgccgagccctcgcgcccgtgaccatcctcgcctgtgcctcctgccctgccggtcgcctccccgccaccatcgcacctcccgacgcgtcccgacctcatgtcctcgccgtggtcccgcgcgccgcccggcgaccctgctgctcatcgggacgagcagaagcccttccatggcggctgacggacccagccagggccgctcccccttcctctgctgctcccgactgcaccgtcaccaagtccaccggaggactttgctgccacatggaggccaagccgcgactcgccgggctcaactcgcccgcgccacagcatgtctagatnnagaggagtcgat

SEQ ID NO: 89972 - DNA, 463 bp, Triticum aestivum
  unsure (1)..(463): unsure at all n locations
  Clone ID: PAT_TA_89972
tcctcgccggcggctccctccaccagccccggccccgccgccgcgatgctccggctccgctcctccgcccgcctgctccgcaagctgtgcgaagcgtcccggccgctggtgcgcggcgaggtccaaagagtgccgccgccgctgccgacgatgacgcggcggctctccggcgcagcctccgccgcgcgctcgacctcgctcctgcacccgctgccggggtcgaancttcccgccctgcctccccgacaagctcgcccgctcccaaccgcatcacacgctcccaacgggttcgcgtcgctccgaagaagtccgggtccaaggcgtcgtttggggtgttcgtggcgttccggtcgattcacgantccccgaatcaacggggcgaccanctgctggagaaactgggttcaaagaaacggggaaccggagcanatcaaattntncaagaagtngaggcaacgggggg

SEQ ID NO: 89973 - DNA, 329 bp, Triticum aestivum
  unsure (1)..(329): unsure at all n locations
  Clone ID: PAT_TA_89973
aacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgaagagcgctgctgctgctgccccaaagaaggctgcggccaaggaggtagaggaggaaagatgaggagggaatctgacaatccaatccggnantcaatgncgacattacnaataaggcancnttaagnccaagncnatnaccatngannagaccatnttttcnaggtgtccccggggnnaaattcgga

SEQ ID NO: 89974 - DNA, 249 bp, Triticum aestivum
  unsure (1)..(249): unsure at all n locations
  Clone ID: PAT_TA_89974
gtcccggggtcgaaccggacggccatccataataatccgaccgagccagccagccggcctcctcctcatcgtcctcctcggctcgcccccctccccgcggcgccgcgaaaccctagcccgcccccaccatggacggntccgcctccaagggtaagcgcaagcgcggccgcaagagcaaggcggnagcggccangccccngccgttncccgtacnccnccnccgccgccgtntgtctccgancaaccccc

SEQ ID NO: 89975 - DNA, 471 bp, Triticum aestivum
  unsure (1)..(471): unsure at all n locations
  Clone ID: PAT_TA_89975
gtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaagttgggttcatcttccgtngagcacaacgcatcccctgggtactacgatggccggtactgggacaatgtggnagctgcctatttcggatgcaccgacccacgcaggtgatcacgaaggttggaaggagtcaaagaaggataccctgaccctaagtccgatcatcngatncgacaaatggtcagtgcatgcgtcacttcatcgccttnaaccacggg

SEQ ID NO: 89976 - DNA, 483 bp, Triticum aestivum
  unsure (1)..(483): unsure at all n locations
  Clone ID: PAT_TA_89976
gcagccgccgccagcagctgcgcaaaggctccacaaaccctaaccctagctccaagcttagcttccatcttctcgatctagctagagccatggcgccgaccaagggcgaggggccggccatcggcatcgacctcggcaccacctactcgtgcgtcggcgtgtggcagcacgaccgggtcgagatcatcgccaacgaccagggcaaccgcaccacgccctcgtacgtcgccttcaccgactccggagcgcctcatcggcgatgccgccaagaaccagtcgccatgaacccatcaacacgtcttcgatgcaanngtcttatcggaagaagttttgctgatcccctgtccagagtgatattaagatttngccgtacaaggttattccctggccaagcaagcaanctatattggtantgcaatacaaggtgaaggaaacaattttaaactgaaaatttcttccatggcctcaanaaanctgaatnng

SEQ ID NO: 89977 - DNA, 471 bp, Triticum aestivum
  unsure (1)..(471): unsure at all n locations
  Clone ID: PAT_TA_89977
ccgtccccagccaacctcccatctccgtctcgcgtcgcggcggcagttccactccctcgccatgggcaagattaagatcggaatcaacggtttcggaaggatcgggaggctcgtcgccagggtagccctccagagcgacgatgtcgagctccgtcgccgtcaacgaccccttcatcaccaccgagtacatgacctacatgttcaaagtacgacaccgttcacggccactgggaanacagtgacatcaagtcaaaggacgacaagactctgctcttttggcgagaagcatttacctccttccngcgtcaagaacctgaggaattccgttgggttgangcttggtgccgatacttgtggganccaaccggttcttcnactgacaaagacaaggcgctccactttaaggtggngccagaaggtggcatctctgcccaaacaaanatccctatnttgtggttgggncaaanaaga

SEQ ID NO: 89978 - DNA, 420 bp, Triticum aestivum
  unsure (1)..(420): unsure at all n locations
  Clone ID: PAT_TA_89978
tgaaaccaaatcataaggtgaacccttgtttcaacaccactttttctactacacatgcaccagttctttcttcatatataatactccctccgtcccataatataagaagggcatttatcttttacattacactagtgtcaaaaaaacgctcttatattacattacgggacagagggagtatcaatcaaaaaaancccaggangggaaggacaagaagaaccgcagagacacgatggtgagtttgcaagaccaaaaccgtgacactcaaaggccgaatcatttgcttgtgttgccttngagagaacccaacaacatggtgactcctccttaatcaactggcttctaaccantgtgagtgtggangggcnagattcggnntancctttatgggannccaccaaaaaaggttanggaaagggg

SEQ ID NO: 89979 - DNA, 481 bp, Triticum aestivum
  unsure (1)..(481): unsure at all n locations
  Clone ID: PAT_TA_89979
gccgccgccagcagctgcgcaaaggctcctcaaaccctaaccctagtcctagcttagcttccttcttctcgatctagctagagccatggcgccgacaaagggcgaaggggccggccatcggcatcgacctcggcaccacctactcgtgcgtcggcgtgtggcagcacgaccgcgtcgagatcatcgccaacgaccagggcaaccgcaccacgccctcgtacgtcgccttcaccgactcggagcgtctcatcggcgatgccgccaagaaccaggtcgccatgaaccccatcaacaccgtcttccgatgcgaagcgtcttatcggcagaagtttgctgatgcccctgtccaagagtgacattaagatgtgggcgtacaagttatccctggncctgcagacaacctatgattgtaatgcaatacaagggtgaggacaacattttcaanctgaagaattctccaatggcctcatcaaatcctgag

SEQ ID NO: 89980 - DNA, 455 bp, Triticum aestivum
  unsure (1)..(455): unsure at all n locations
  Clone ID: PAT_TA_89980
attctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcgggatatgaaatccaccgtcgacggcacctgcggtggaccctgcaagaanactgatcggttcangccgggatgatatttccgcctaaaataaaataaaactcaagcgagatgacancgtcatcgtgcctaagcctgtgtgtgtgggcaacaatgcttatacaatatgtcctctctccct

SEQ ID NO: 89981 - DNA, 390 bp, Triticum aestivum
  unsure (1)..(390): unsure at all n locations
  Clone ID: PAT_TA_89981
tttttatttataccttctcttctttatctttaggttttatctacttatcaatagtatctaccggctcgaactcgantttgatcgccttccatacttcacaagctgcggctagctcaggactccatttgcaagctgctcggataatttcattaccttcgcgagcaagatcgcgcccttcgttacgagcttgtacacaggcttctaaagccactcgattagctgctgcaccaggtgcatttccccaaggatgtcctaaagttcctccaccaaattgtaagacagaatcgtcgccaaagatttcggncagagctggcatatgccanacatgantaccacctgaagctaccggtataacacctgncatggatacccagtcctgaagcggaaaag

SEQ ID NO: 89982 - DNA, 451 bp, Triticum aestivum
  unsure (1)..(451): unsure at all n locations
  Clone ID: PAT_TA_89982
caagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactgggtacatggacaactgtttgggactgatggacttaccaagtcttgatcgttacaaaggacgatgctatcacatcgagcctgttgctggggaaagacagccaatggatctgttatgtagcttatccattagacctattttaaganggttccgttactaacatgttacttccaatggtagnaactatttggttcaaagcctacgtgcccacgtttggagatcacgaatccccctactaatn

SEQ ID NO: 89983 - DNA, 453 bp, Triticum aestivum
  unsure (1)..(453): unsure at all n locations
  Clone ID: PAT_TA_89983
gagaaacaccggcgagcaataataaatggcgtcatagccacgggccttcctccccgaagcggatcacaccaacccaacccccgccgcctcgccgccttcctcctcctcgccgaccgcccgcccgcccgcgacggcacgcgtcaacccgctccccgccgccggtgctcgactgccgcgggtgaggcggagatccatccctctgagctcctactgactcgacgccggtaacgaatcccagctccgcgcacccgattgattcccaacccgtgtctccctccagttccgaggatttgtttcgggggttcaagttcaggttcaagctgagttgctggaccccccatgccacacgtgaacgccaaggtgtcggcggtggcggcgacggggaatgtccgccgtgcctgcgggcgccgcgccccgtcnccnaagaagtnggaggggttggaccccgccctt

SEQ ID NO: 89984 - DNA, 459 bp, Triticum aestivum
  unsure (1)..(459): unsure at all n locations
  Clone ID: PAT_TA_89984
gagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccaatcctgatcgttacaaaggacgatgctatcacatcgagcctgttgctggggaaagacagcaatggatcctgttangtagctatccaatagacctatttgaaaaagggtcccttactaacatgtttactccaatggangnaacntattggttcaaaaccctacgtgcccaacgtttggnggattacgaattccccctacttatncaaaaatttcn

SEQ ID NO: 89985 - DNA, 289 bp, Triticum aestivum
  unsure (1)..(289): unsure at all n locations
  Clone ID: PAT_TA_89985
gagacgacgagacccatcgatcgatcgatccagacgacgacgagtcttctcagcgcgggcacacacacacacacagagcgcgcggcggttgccancatcgagcaaagcaagaaggaggccaccacaccgccacgctcgatcgactccgtcttctttcccgggcttttctccccgggacccgatcgacctattcttaggcgccccgccgaagaataccgcggtgccccnggtttcgctcgcaggnctanggncgctgacgngacgtcgtcatcanacccgcngnaaccat

SEQ ID NO: 89986 - DNA, 273 bp, Triticum aestivum
  unsure (1)..(273): unsure at all n locations
  Clone ID: PAT_TA_89986
ctcgggcggggagcaaaacctaggcgganagtgtcgctagagagaaagcgcacactgcaacagtttccccccanagcgccgccgtcnanagcgaaacnagccggagccgtcgccgtcgagcggccatggcgccgccgcncgtangactccccggagggtttggaggtgcagtgccgcggggtgcggcgagactctggangtgngacccgggcctgaccgagttcancngtccggnttgctctatgccgcantcgctcccggccggtnctcatg

SEQ ID NO: 89987 - DNA, 408 bp, Triticum aestivum
  unsure (1)..(408): unsure at all n locations
  Clone ID: PAT_TA_89987
gccagcagctgcgcaaaggctcctcaaaccctaaccctagtcctagcttagcttccttcttctcgatctagctagagccatggcgccgaccaagggcgaggggccggccatcggcatcgacctcggcaccacctactcgtgcgtcggcgtgtggcaagcacgaccgcgtcgagatcatcgccaacgaccagggcaaccgcaccacgccctcgtacgtcgccttcaccgactcnggagcgtctcatcggcgatgccgccaagaaccaaggtcgccatgaaccccatcaacaccgtcntcgatgcgaagcgtcttatcggcagaaagtttgctnatgcccctntccagagtgacatttagatgtggccgtacaangttattcctggncctgcaaacaancctatgaatgt

SEQ ID NO: 89988 - DNA, 464 bp, Triticum aestivum
  unsure (1)..(464): unsure at all n locations
  Clone ID: PAT_TA_89988
ctcgtgtcggctcggcggctccaggaggaggtgaaattccaaccccgtggtagtagcaagtcggatctcgcccctccctcccggcgcgcaggctgtcgcctttgctgctgtttccttgcgttaatgtctgcgctattcatgaccatggatgatgtgccctatcctatcctaggtactatgtcgactgcttcagcggctaaacggaagggctcgcccggtgaacatgacgattatccccaggcccaaggtcgcaaacgatcgagatattcagtcccggatcttccaaaggtacgcaacgccaagccagcagaacgccgaggaggattccccgatacggatatcattgccagcactctatttcacaaatttgttgaaaccgtgagctangctaantgtaattgtgacaacattattttangactccacttactgttagcccaactcactgtcaatcctgctgctta

SEQ ID NO: 89989 - DNA, 446 bp, Triticum aestivum
  unsure (1)..(446): unsure at all n locations
  Clone ID: PAT_TA_89989
cacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaantactgatcggttcatgccggcatgatatgttccgcctaaaataaaataaaactcaagcgagatgacagcgtcatccgtgcctancgtttgtgtgttggccaacaatgcttatacaattatgtcgcccctcntcgctng

SEQ ID NO: 89990 - DNA, 462 bp, Triticum aestivum
  unsure (1)..(462): unsure at all n locations
  Clone ID: PAT_TA_89990
gatctcgcctcaaagagcaccaaccgcaccatgccggagtgagccggtgccgcatttggttcggggctacggcatgcagtccaaggcatggtcttgggtttacacggccaaccacaacttctgctggtagataatgtaaaaactcccaagcaaaacaatggggtttcctatgtgccccgtgacttcacaacatggaatttgaataagttggcaaaacatggtctccatcatcttaacagacttctttcattttgatgctcctagcaatgaactgaactatgttatacctcatcagcatgcatatgttcgaagtgttaccatcatatgaaaactacaccgcaactggcaattatcgagtggttctgcacttccgttagtgccaagaaaatcccgattaatagacaaaatatctngaaaacaagataagcttcggagcatggcgcnaagaaccgtcattttcgg

SEQ ID NO: 89991 - DNA, 464 bp, Triticum aestivum
  unsure (1)..(464): unsure at all n locations
  Clone ID: PAT_TA_89991
gtctcgagtttttttttttttttttttttatagtgcatagtgtagtttcatagataattttaattatagtcatacatgacacatagtatagcatttaacctctctttcttctttgattcattgccacatcgacatgtttactattcttaagtgcatgatagcagctaataaacctcactatcgccagcctaacccactcgaacgcaccgcgaaattaacactatgctacgtactcgaggagttgtataaaaaattacctggagcagctgcttgggccaggtcgatggagattagcccggcgctncatcccatgccgccnaggttgtanctggcgacttnccgcggagcttanagtggnttgacgaccaatgcggaancgatggcgtcgggtttaaaagctgcagttnacgacaacgaccccatttcctgggcctcaacctntcttgggcancagncgtccatng

SEQ ID NO: 89992 - DNA, 485 bp, Triticum aestivum
  unsure (1)..(485): unsure at all n locations
  Clone ID: PAT_TA_89992
ttttttttttgccagtgaaatgtctttattcccgagtaatattcaatggaatggtgcaattgcactgcagtgtcatggatttggtctgccgctttaacatctcattatcctatagcgatggaaatgaggatcaacaaggcatatagatatagcgaataaatggagaggaagcataagctcagatgatacaggatacagggactaagattctaatacaatgagaatatgtacttgtaaatattagtcaaccagactaccacatggtgatgtcacggcgatgcttcaaattgtgatgtcacggcgcatgtctaccagactaacacatgtgccactctatgtccatcactactgggaatcgtcacgtacgccgagtgccaaagaacactcggcaaanggccaaaaacctcggcaaatccttgccgagaagttgcactccggcaaaaccaaccggtgtacactcttcggcgaaacagatttttgccnng

SEQ ID NO: 89993 - DNA, 469 bp, Triticum aestivum
  unsure (1)..(469): unsure at all n locations
  Clone ID: PAT_TA_89993
attcagtctcctcctttctcttcgtctccctccgtttcgccgtgccggaattcggtttgggcttcctcggttccctctgaacctgttcttcttggactgcttcgcctccatggacagctagctcgtcctgccgtgagagccctgcggattgatggggtgcttcgccttcaagagcggcaagggcctcggcggccggctggcggcggcaagcctccggcggagccgaagccggacgggccgaagcggagcaaggcgtcctcgtccgtcggcgtcgacgccgacgaggagcatccaaggagctgtcggaggagcggggcgcngngccggnttcgcgtgttcgggctggaggaactccggcagcgcaacaaacggcttcancccgcgcgctcaagattggggaagggcggcttcggtccgtcnacggcgccttcttcgctccgccgccngcggccgcgtcgtctcgccgnna

SEQ ID NO: 89994 - DNA, 446 bp, Triticum aestivum
  unsure (1)..(446): unsure at all n locations
  Clone ID: PAT_TA_89994
gccggccggggcacctcctcctcctccgccgccgcgctgattcatccctccctcacttcaagcctctactgccccgccagtctcccaccgtcgcgacgccgcggtcgaggggctagtctgcctttcctggcgccgccggagggagacgaccgcccgcgaccggagcagacgagggaggcacgcgcgaccgggaaggcgctgctttcgctcgagccgtacgccgacgccggtggccactccggtgctgacagcgctcgtgcagcagccctgctgaaaccaaaatggcggcttgccactgggcancgcgggaggtctgcgacgcaaattcacacatgatcaccaagcggcgagctccgcgcgctgcaaccgtcttcaaggtctacggtggaaggcggtcttcgccngtccgtcntgacaattaagtttcnaangacaactcctgtccg

SEQ ID NO: 89995 - DNA, 459 bp, Triticum aestivum
  unsure (1)..(459): unsure at all n locations
  Clone ID: PAT_TA_89995
tttgggtcaggccacatgcaatatattttcctgtatgtaattgtacgtactacttttccaaccttaatttggaaaagaatatttacactgcgtgcactatatgcaccacagccagctcaggcagaaaattcagaagttctgtactgcaacattcagaaccaaccggttccacttcatacatccagcagcttcataacgacggggaggccaaacttaggctgcagagtgaggaaatccgcaggcgcgtggacgtaggtcggggagagagtgaaggagaacttctgcagaaccgtggccattaccgacttggcttcgagcatcgcaaattctgggccgatgcacgccctccggccgattcgagaacgccagcagggcgtgtgggaacttggccgccctccgcgacccctttgcgaacncctccgggttgaactgatccgctcctcaacccaanacttcttg

SEQ ID NO: 89996 - DNA, 467 bp, Triticum aestivum
  unsure (1)..(467): unsure at all n locations
  Clone ID: PAT_TA_89996
cacaagctctcgtcattgctcgcctcattcacagctagctcgtgctgccggccggccggtcatgtcgtcgacgacgcanagcgcggccgtgtcggcgaaatgcgcggcgtgggcgcaggagcggcggccgttcacgcacccgatcgagatcccggcggcctcgggcgcgccggacgagcggaggggccgcgggcgaggaggaggacggcggggaggtggagccgccgcacgtgctcatggcgcggcgcaaggcggcctcctcggtgtgctccgggcangggcggacgctcaagggccgggacctcacgcgcacgcgcgactccgtcctccgcatgaccggcttcatcgagagctagcccctccttgccgcgcgcgcgcgcgcccgcctgtctcgctcgtgggcaacggcgcgcggccggctcaaaggtctccttggttatccantttgttagtaagtaaatanaaan

SEQ ID NO: 89997 - DNA, 475 bp, Triticum aestivum
  unsure (1)..(475): unsure at all n locations
  Clone ID: PAT_TA_89997
aattattttctcttgatgctctaggccttagctgaactcttaacatatgttttttctatttgattccgatctctctgccattacatgggacattgggcatatatcacacattgttttggtagcagttatagttgattattatcaatagtaagctctaaaacatttggaacggctcaagtactatttaaagtgttgcttatgagtgcccccatgaagatacctaccaacaactctgctctgtactgttacttctgtagcacngaatgccatcctaaatcttacnattttgcaaggataatgtccctgaagtatataaacctggtangtttcccttaaattgtttagagaaagataatancgattangttggaactgctcaagccatcctatgttacatgatttgttggatggtcanttattgngatttcncaagttaggcatgggaagttccccaaaaatgggtgtgtgttggttt

SEQ ID NO: 89998 - DNA, 467 bp, Triticum aestivum
  unsure (1)..(467): unsure at all n locations
  Clone ID: PAT_TA_89998
cttcaatcctccagcgaaaccccaccccgccccaccccaccgtcagcatccatggcgcccaaggccgagaagaagccggcggcgaagaagccagtggaggaggagcccgcggcggagaaggccgagaagaccccggccgggaagaagcccaaggccgagaagcggctgccggcgggcaagtcgtcggcggcggccaaggagggcggcaaggcgaagaagaagggcaagaagagcgtggagacgtacaagatctacatcttcaaggtgctgaagcaagtgcaacccgacatcggcatctcctccaagggcatgtccatcatgaactccttcatcaacgacatcttcgagaagctcgccggcgaagccgctaaactggcgaagtacaacaagaagccacatcacgtccgggagattcaaactcgtcgcctcgtcctcccggggagtcgcaaacangcctctccganggn

SEQ ID NO: 89999 - DNA, 367 bp, Triticum aestivum
  unsure (1)..(367): unsure at all n locations
  Clone ID: PAT_TA_89999
tgctcatgcaggcaggtgcgtacatacatacaaagaccctcgatcaggcagcgttacatggtagtagatggtagatagatcatagatatgatgcacgcggcgcatgcatgatcaatgatctagcagctgcagcaggagcagccgcagctggtgccgcacttgcactgggtgcagccgcagccgccgttctccgccgccatctccatcccgccggagctcgccttgtgggtggcagtggcggagacgaagagggtggcgccggcggctcgacctccggggtacatgttgcaaccgccgcagccgttgccgcacttgcaagcgctgccgcanccgcanctcctccgcagcaagacatctcnggcttggg

SEQ ID NO: 90000 - DNA, 466 bp, Triticum aestivum
  unsure (1)..(466): unsure at all n locations
  Clone ID: PAT_TA_90000
ctctccctcacccctccttctccacctccggccgctgccgcggccagcccatcgtggcggcgcgccaacagcacccccaccattacctcgcgccaccagctccacttcgccgccgcaccatccatccaccacactaccagcagcctccatccaccgccacaactcgtgtgcccgatctgacaggcgtctggtcctccgtgcaactccactccttctccatctctctctgctgcctttcttctcttacctctactgctacctgctgtttcgcctcgccttcctcaacttctgctgattctcccatcttcaacctgcaattcttctacgtcctttgtcccttgttgttgtccctctcctcttcaatggctgcgatctctctctcccanatctttgctgctgcccctgttgaaccctccacgctgcttctgctcctccttcttctcccaaaacggttnncgctccaact

SEQ ID NO: 90001 - DNA, 463 bp, Triticum aestivum
  unsure (1)..(463): unsure at all n locations
  Clone ID: PAT_TA_90001
gcccctctccccctccgcctcctcctcctcctctctccccctcgccgtacgtacacgccggacgcagacacgccggccagacgaccgtcgtacgccgtaacacgcacgcgcgcaattttggatcagagtcctctccgatgacaacctcgtcgtcagggagcgtggagacgtcggccaattcgaggcccggctccttctccttcgggagcgcgagcttcactgaaatgctgggcggtccgccgcggccggcggcgcgtccgggtacaaggccctgaccccgccttccctgccgctctcgccttcgctcatgtcgccgtcgtccttcttcaacaangccgccggcatgaactcgccgactcctcgatccccggtgctcctcaactccagtacttcccgtcaaccacgnacgggcgcgttcgggnccaattcaaatngggnggcggangcgccgacccnagcgcgc

SEQ ID NO: 90002 - DNA, 454 bp, Triticum aestivum
  unsure (1)..(454): unsure at all n locations
  Clone ID: PAT_TA_90002
ggacgaggtaagaagaagcagccgcagccgcagcgcgaccccgcgaggaaaccctaccgccgccgcagcaggagcagccatgggtatcgacctcgtcgccggcgggaggaacaagaggaccaagcgcgtcgcgcccaagtccgacnatgtctacctcaagctcctcgtcaagctctaccgtttcctgggtgaggaggaccaagagcaagttcaacgccgtcatcctcaagaggctcttcatgagcaagactaaccgcccgccgctctccatgcgccgcctctccataagaaaggggaaaaggaggagnaanaacattgctgttgttgtttggtacaatcacagatacattcggtttcaagangtccaacattaaggtaaccgctcttaagtcaacagagacagcnanggcaaggttgtcnatctggtnggaattcctcaattttgacaacttgg

SEQ ID NO: 90003 - DNA, 450 bp, Triticum aestivum
  unsure (1)..(450): unsure at all n locations
  Clone ID: PAT_TA_90003
ctcgtgccgaatcggcacgaggatgatcgttccatttggtctgtgctgcctgttctacactccgctgtacttcgtgttcaagcgtgaccgcgagaacgcgaggttggcggccagcgccaaggatctggagctaatgtgatgctccacggtttttttaccagtttgttgtttcagttgcagtattcgttaatgcggttagtttattcagtttggggttgaaatggtgcagttgacagaatacaggtttcaccttcttgagacagattagaagtacaccttcagacacatnaaaagaaatactgagtacaccttcagacagattacaagaaatacacgggtanaaacggtatttaatttgccaattnnagaggatatatntggtccaaaaaattttgtaggtnaataaatggaacttcaagttaatctcaaccgcgcccaagattatttttn

SEQ ID NO: 90004 - DNA, 444 bp, Triticum aestivum
  unsure (1)..(444): unsure at all n locations
  Clone ID: PAT_TA_90004
ccaccgcttcccccgatgccgtcgtcgacgatccggagcatctccatcacagtatctgacgacgacggcgccgcggcgccccggcgtacccgcgccggtcgacggaaggtggtgcgcagcttggggcagcgcgccgtgcggctcgtggcccggtggtggcctatcctcctgctcctcccggccgtcgcgctgctactcttcgaggcctcccggctccgtgcctctccgagccccgccccgccagtatcgagcaaccttggccgcctagacccgaccacgcgcctccgtccatggcgttcgcgaacccttcctgaangtcttaacccgaagagtatagaaaatttggnattcaanaaagctccggacttgatctgtggtcaagaagattatatncaaaacgacattacnacntaatcanacaacctnagggaaanctactnttnt

SEQ ID NO: 90005 - DNA, 273 bp, Triticum aestivum
  Clone ID: PAT_TA_90005
cccctctccgcctcgcagctcccccagatccaaaacccaagcgcgtgcccgcccccggaatccaaaccctagcagcgccgcccgccccctgcctgccatgaggggcctccgggcggacgccggcggcggcggcggtggcgcctcctcctcgtcgacttccaccgcagagaactcgcgcttcgactcggggcagtattccttcttcggcaaggcgccgcttgaggggctggagctcggcggcagcctggcggatgacggggggcctgagggaat

SEQ ID NO: 90006 - DNA, 450 bp, Triticum aestivum
  unsure (1)..(450): unsure at all n locations
  Clone ID: PAT_TA_90006
agcacttcgagcgcctcctcctgtctcgtccccgtcccccgtcccctcgtcggcgcccgatctaagtcaagatgagtcgtggcgggagtgctggtggtggtcaaagttctctgggttacctgtttggagatggcgagcctgcaaagcctgctgcagcaccagctgcgaagcccgcacctgctgagaaaccagcaccggcagctgctgatgtagccaagcagattccagctggcattccaggtagccgggcgaacaactattaccgtgcagatggccaagaacacgggcaactccttacggaccgtccttcaacaaaggtcaatgctgctcctggcggtggtcgtccctgggctactgtttggcggaaatgatgttnatgatggngcctgcttaatgaacgaacgatgaatggcctgtacnccgttaccaagtnggtgaaactggaatgtt

SEQ ID NO: 90007 - DNA, 336 bp, Triticum aestivum
  unsure (1)..(336): unsure at all n locations
  Clone ID: PAT_TA_90007
ggaggcaaagcagagcaacctctgcgtctccgcggatgttgggacagccaaggagctccttgagcttgccgaaaaggttggctctgagatttgcatgctgaaaacccatgtcnatatcttgtcagattttacaccttactttggcaccaagctgcgctcgattgctgagaagcacaactttttgatctttgaaagaccgcaagtttgctnacattggtaacacaataactattcaatatgaaggaggaatattcccncaaattanaaagggctgatattgntnacgccaatgtnattcctggggcctggaattnttaatggttnnaaccttaaggt

SEQ ID NO: 90008 - DNA, 302 bp, Triticum aestivum
  Clone ID: PAT_TA_90008
ttttttttgatcgttaaccaccagagcagtcgatacatttcattcaagttcatcttgagtacacagggcacatatatacctagctagcttgtacacagaaactatatataccatatagtataccatacacatgaatgatctgcaaaagcaagccggaactgcatttatttgccggattcccacgaagagcatccgtcatgggcgtcgccctccatacgagcccgaccagccaccaccataattgttacctcctgctccgttaacatgggtgagatccctagcagcaaccacgccttgcgaga

SEQ ID NO: 90009 - DNA, 442 bp, Triticum aestivum
  unsure (1)..(442): unsure at all n locations
  Clone ID: PAT_TA_90009
cacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcngcgttccgcgtggtgtccaacgaacccccgaaatgtggcgctgcgcnggatatgaaaccaccgtcgacggcacctgcggtggacctgcaagaantactgatcggntcaatgccggcatatgatatttccgcctaaaattaaataaaactccgacgagatgacaacgtcatcntgcctatgccttgtgttttaacaacaaatattntacaattatgtcntgtctcctc

SEQ ID NO: 90010 - DNA, 467 bp, Triticum aestivum
  unsure (1)..(467): unsure at all n locations
  Clone ID: PAT_TA_90010
gggatttgatttgcatccatttattgcacgcaatacgataagtcatcacatagtatcacattacacttgcccaaaacaaaattatcacattactaactgggcctcaaaacatgcaatgttgcaacataaatatggctgtggagtggaaggcacaaagcagaggtcgacccctaatattccctccatcccaaaataaatgactcaactttgtactaattttacaaataagtgactcaactttgtactaagttttattttggggacggagggagtacttgggactggtaatggtatatgctacaatagttccaaaggttgagcttccggcgtacatgccgccttatttggacgcaccaactctcactgtaaacactgcaagcctcagcgaatttaccgaagtcccaagtcgtgaaattgcaaccaagtttggaagatttnacaaatacaaatgcgggcaaggngaatan

SEQ ID NO: 90011 - DNA, 463 bp, Triticum aestivum
  unsure (1)..(463): unsure at all n locations
  Clone ID: PAT_TA_90011
cattcttcctcctagcttgcttccatctctcgttgtctgctcaagcgcagaccagatcggatcagctcagatcacccatcgatnctccaacacgtgaggaatcaattcagtactgaatactgatccatccatcgaccggccatggacagcttgccgaagcgcgacgcccaccacgtgccgctnagcccggtcaccttcctgccacgggcagcggccgtgtacgccgaccgcacctccgtcgtctgcggtggcaccgccttcacctgngcgccagacgcaacaacgctgcgtccgcctgtccgctgcgctncaagcgctcggcgtcnccnggaacgactcctctccgtgctcgcgcccaacaccccgcgctatacaaatgcactttgcggtgccanggcttggggcgttatnnacgcctcaanacccgctcgaaaccccggngtntcccccattcttcgcaagc

SEQ ID NO: 90012 - DNA, 465 bp, Triticum aestivum
  unsure (1)..(465): unsure at all n locations
  Clone ID: PAT_TA_90012
gccgccggcgcctccccgccgccatgctccggctacgaagctgcatcctcacccagctcctctcttctccctacgcctcccatgtctctcctctccaccgcctcctctccgccgcagccgcctccgccgttttccccggcccctggcttcgccgcagaggagtacctcgtctcctcctgcggcctgacccatgcccaggcactcaaggtctccgccaagctgtcccaactcaagtcccccgccaagccgacgccgtcctcgccttcctcgccgggatccggctctcggcggcgncgtcgcaacggcgtntgcaaaggaccgctgttaatctggccgggttgaaaanaacctggncccgtngtccaacgggtcaacggcttcggctctcgcgtctaagtccgcgcangncgtgtcgtcccgggaaattcgtgcaattaacgtctccggtatanatacnactgaatn

SEQ ID NO: 90013 - DNA, 485 bp, Triticum aestivum
  unsure (1)..(485): unsure at all n locations
  Clone ID: PAT_TA_90013
gcttaaggaactagcttgcagctaccgatcgatggctcgtctcaacagcaaggctgtggtggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcangggctgaacggcatggcccgcagcaactcggaccgcaagatancgtgcaagtgcctcaaagancctcgccaacaacatcaaatccatcaacatgggcaaagtctccggcgtgccccgcaattccgggtcaatggtgccctccccatcaacatttcaacaaactgcgacactgtcaactaattcaatatataaccttcctangtncaancatggaccccctntgtttgagcttaaagtcaaattnatggggtgncaaacaanacgn

SEQ ID NO: 90014 - DNA, 472 bp, Triticum aestivum
  unsure (1)..(472): unsure at all n locations
  Clone ID: PAT_TA_90014
gtttgatctgccagttgcttctgatccatccgccgcgccgcagcgacttgcaatcgcggctctcttgattttttttttcgaatttacgtacggccattaggaatcccgcgaggtgctccgttctttttctgtgtttttctctgatggatgctggaattttggatcggcgccgtttccgcgcgattttccgttgttgttttcggttctggaggaatctaggagccaatgctacgatgtgttttctgggcgtgctcgtggtcgctgtgattttttttatctgctgggatttttgggtggntcggtggagcctaaggtctgattaaacatctgttcgtgctccgtgcaactgtggtaaccgcgtgctccgtccaaggcgttctccggggcctcgccgcggtctcnaagntgcgatccgtaaggggcaagatgccacacctgggggtgtgagatggcgcanatcaaacgctcccat

SEQ ID NO: 90015 - DNA, 462 bp, Triticum aestivum
  unsure (1)..(462): unsure at all n locations
  Clone ID: PAT_TA_90015
taatgttagaagatacaacacacctagtccacactagacaattccagagagtacaactgtcatgacacagaagcaaaaaacaccccacataaaagaaatttacaaaaatatccttgagggggttgattgcacagccaaatctttgcctgccaccgtccacaagcaacaccgtcgccggagtaggagacaaacaccgcacgctgaacagccgtcggagcaccatcgcatcactgctttgtgagccgaagaaagcaccgccgcaaacggcagagcacatatcgatgtggagcgtcngccggggttcaaccccgtgcaccttggggcctcaaattcggtgtcttcacccaacaaaattgacgaagaacaccaagatttgcctgcctgcatcccccaaaccagtgccaaaacaagcaatttctgggaaaccatcaacaacacgtanattagcatctacggnataaa

SEQ ID NO: 90016 - DNA, 464 bp, Triticum aestivum
  unsure (1)..(464): unsure at all n locations
  Clone ID: PAT_TA_90016
agagcgcaggagcggggagcagcgagcatggcgagcccgtgggacagcccttcgagcagcctgtggggcacgctggggcaggcctccaacgtggcgcagctggtgggcgtggacgcgctggggctggtctacatggtcgtgcaggccgccctggcggcgcgccgtcaccgggacgcctgcgtgcggctccgcgcagcacgtggagctcgtcggcggcctgctcagggagctggagctcgcggagctgatgcggcgggaggcaacaagcgggccgctggagcagtcggcggcgcgctgcggcggttctacgcctccgtcacggcgtnccaagactgcgggnaactccgccgactgctttctggggcacacggatggccgaacgactcccgcgctgcgcaacacgagatncacatgttnatccgcctcatcccgctanctcctcgtcnanattcgacaaacatctc

SEQ ID NO: 90017 - DNA, 443 bp, Triticum aestivum
  unsure (1)..(443): unsure at all n locations
  Clone ID: PAT_TA_90017
gggtagtagtacgagcgagtgacacaagttcttgcaccgatcagatccaacttctgcgcaagatgctggacaagctgtgggacgacgtggtggccgggcctcgcccggagacgggcctcgacaagctccgcagggcggccgccacccaacctctcgccatcaacacagctgcaggggaggcgattaagcagtcgccgtcgatgccgacgaccccgaccacgccggtgacgcccttctcctncangcccccgcgcnggggnaacttttggcgagcnttttttcaaccccgggagcaactnggcaccaaaanctctgggccaaatctttngaagggccgcaaaccaatcncccacngtnttacactggntttacagcgaacagacaaggacaaggagcaacacgcttnataananctccgcgcaanaanaaaaaggnggtcaaaa

SEQ ID NO: 90018 - DNA, 450 bp, Triticum aestivum
  unsure (1)..(450): unsure at all n locations
  Clone ID: PAT_TA_90018
agtgacacaagttcttgcaccgatcagatccaacttctgcgcaagatgctggacaagctgtgggacgacgtggtggccgggcctcgcccggagacgggcctcgacaagctccgccgcgccgccgccacccaacccctcgccatcaacacagctgcaggggaggcgattaagcagtcgccgtcgatgccgacgaccccgaccacgccgggtgacgccgtcgtcgtcgacgccgccgcgtggcggcagcgtgtggcgggancgtttttcaaccccggggaagcaacctgggccaccaaaagctcggcgccaactcttcgaccgcccgcagccaatcccccacgtctacgactggtttacagcgacnagaccangacaaggagcaacaacgcttaattagaaccgacggcaaagaatttaagacaggaantctgcgacgccccntgtttgtnc

SEQ ID NO: 90019 - DNA, 458 bp, Triticum aestivum
  unsure (1)..(458): unsure at all n locations
  Clone ID: PAT_TA_90019
ctagtctcgagtttttttttttttttttttttttttttttttttttattataattcaaatctccattgataattataccttccattttttcaccaactatttatactgtctcgataccctttcatcaagatggcgggcgcggcaaagcgcgccttgacgttctagtgtaaatgtcataatggactaccacgttttttcagttcaaatctcacgcctctgacggcgcgttactggcactaccatcacaacaccgtgccacaagctccgccaagctccggtagctcgtcccgccaccggccacggccgtcatcgcggcctcgcggaccaccgtagaactcctcctcaacatctcgtctgccatcactgatttaacttctccgcgatntcctcccccttcacaacccatcgtcccttccagctccacgctcgaccanacgccgggccaangggcgcanang

SEQ ID NO: 90020 - DNA, 399 bp, Triticum aestivum
  Clone ID: PAT_TA_90020
ccgcggcggcggcggatgacgacgaggatgtcgccgggagcgtcgacggcgacgaggtggagatggagcccgtggagcccatgccggagccccccgacgacgccggccccgtctgctggcccatgccggacttctgccctctcacgatcgacggggtggtgaaggagtcgttcctggagacccttcggaaggagaaggacgcggaggagctgctcggggaggccgagccggggccgacgcccagcccggactcgcggccgtccagcagcaagcgccagcgcgccgtcgccgggtcgccgtcatccaggagcccgtgcccgtacagcaacctcctccaagtgttcaacaatgcaagcaagactttctgaagaagccggaagaacacatcacattaaaggc

SEQ ID NO: 90021 - DNA, 436 bp, Triticum aestivum
  unsure (1)..(436): unsure at all n locations
  Clone ID: PAT_TA_90021
gaaaagggcaaccaaaaaagttcgctgctcctttctcccacatctcgctttctgcatcctcctcttcccaccctcgctttctgcatcgccgcttccacccnccgaaaatctcccctcaatcccgaccactcgatttccccctgaatcctccccgctgaaccaacccgttgacccgatctctccgtgtttttttttcaattcaattcgtccgccgtcgattctcctctgttcgtcgtctctgacggccgcggcggcggcggttgaccttgttgccgctagggttggttcnggcgcggggacgatggccaagccacggagctcgccggccgccggatccgacgccgcgcgcgtcgaggtcagcggcacaggccanacatacaagcctgcttatcgccttacnttcngggataatcatggtcactananngggcgcang

SEQ ID NO: 90022 - DNA, 437 bp, Triticum aestivum
  unsure (1)..(437): unsure at all n locations
  Clone ID: PAT_TA_90022
aagcaacgcaggctcgtcgtccccgcgcaccagcttcgtcgcggactccctggtcctccccacgcgaaacggcagcctcttcgcctccgccttcgcgctcgtctacgcccacaccttcgtctccttctccgttgccctcctctacgcccatcctctcgccgccgccgtcctcgtccacgtcggcgtgctggccagggagaacgacatctacgacttctacccggcggaaagcgacgaggagatccggggacacgccaagaagcttctcctcctctacctagcgtacctcgccagccaagctcgccacgcgggtcgccgtcgcgctcgccgcctcancgacgtgcgccggggaacggcgtcgcgctcgctgaacgagctctcccgccgggaagaccgcgccacctnggcaacgcggcctcgtcgcgtctcaanttggg

SEQ ID NO: 90023 - DNA, 469 bp, Triticum aestivum
  unsure (1)..(469): unsure at all n locations
  Clone ID: PAT_TA_90023
atcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaagtgcctcaagagcctcgccaccaagcatcaagtccatcaacatgggcaaagtctcccggcgtgcccggcaagtgcggcgtcagcgtgccttcccatcaacatgtcaacaactgcaacattcaactaantcaatatataatccctcctaagtgcatcatggacgcctngcgtgg

SEQ ID NO: 90024 - DNA, 441 bp, Triticum aestivum
  unsure (1)..(441): unsure at all n locations
  Clone ID: PAT_TA_90024
cagcggaggagaaggaagccgcggccgcttgcgcggacgcgtcgctcgccgctccggatcacgccagcccatggccagaagagccacggcaaccagcgcctcgatcccctggcggcaaccgaagggcagcgatgagaccatgacctagggattcgaaggataccccaaatccagtcgcctctgccgccagatcgtcgccacaggggatctccgccgccaccccgacgcaagggcgccgtcctggccgccgcgcgtagactaccaccaccgccgccccagcagctcctgcgaaggcctccaacgcaccagcaatcccagccaccttcggtagctgggtccgccgccaacacggcgaaggccggcggcgaagcccnngggaagggaaggnntctacaacncnaggcttcgccccggtgtcncctgggtcnaacggagtcaaan

SEQ ID NO: 90025 - DNA, 453 bp, Triticum aestivum
  unsure (1)..(453): unsure at all n locations
  Clone ID: PAT_TA_90025
cacatcgagcctgttgctggggaagacagccaatggatctgttatgtagcttatccattagacctatttgaagagggttccgttactaacatgtttacttccattgtaggtaacgtanttggtttcaaagccctacgtgctctacgtttggaggatctacgaatttccccctacttattcaaaaactttccaaggcccgcctcatggtanccaagttgaaaaagagataagtttgaaacaagttanggtcgtccttaattggggaaggtaactatttaaaccaaaattgggattatccgcaaaaaaattatggtanaacgtggtaatgagtggccaacctggggggacttgaattttacaaaagaatgattaaaacctnaaaccacnaaccatttatgcctgganaaaacgttttggccnttggggcnaaacttttntaaacanaaggccgaa

SEQ ID NO: 90026 - DNA, 463 bp, Triticum aestivum
  unsure (1)..(463): unsure at all n locations
  Clone ID: PAT_TA_90026
gaactaatctcgagtttttttttttttttttttaacaatgtaaccaaccagaattctttttttacaacagaatagaagtcgcctattgcctattgctaacacgatctgaaaccagaggcaacgaacggacagctacattgcagcaatcccgcgacggaagttgctaagcctgatctaggcgcgctcccctcggatgcggcgggcgagctggatgtccttgggcatgatggtgacgcgcttggcgtggatggcgcagaggttggtgtcctcgaagagcccgacgangtacgcctcggcgggctcctgggagcgccagcacggcgtggctctggnaacggaggtccgtcntgaaatcctgtgcgattcccgcacaagcgctggaatggaacttgcgggttnancaactccgtgcncttcnggnaacttgcggnttccgcaanngcaacgttncnggccgtaacgg

SEQ ID NO: 90027 - DNA, 507 bp, Triticum aestivum
  unsure (1)..(507): unsure at all n locations
  Clone ID: PAT_TA_90027
ttttttttttttttttttaaggactgtgagcggtacccccaaaatttattgatactgggatttccagtatcgactacaggcagagtatgtatgcctccggtacatagttttttcccgaccttttcgaagtatctcagctcaataccaaagactaaactctgttgcttgcgctttgtatatatgagttttcgcctatcttgaaaaaagtatctactagatatgatccctatcatggtgtccgactcaaggaccgactataacttccaagagaaagtaacagttttggagccgggtccgggtaccgaagatatttnagactgcttggctcctccggttcttgacttgacttggtggtgagcttcaaaaccgcgcactttcancgggctcatctcgtcagccctgttgaaccctggaacacgaattaccaacactgcccatgtcaggataacaacggacagatggcatgtcaatcctcctggatcggggggggccngtancaaatccccn

SEQ ID NO: 90028 - DNA, 535 bp, Triticum aestivum
  unsure (1)..(535): unsure at all n locations
  Clone ID: PAT_TA_90028
ctcgcctctctccgcgcaaccgagccttccgcccacctcctccccatttcgccagcggcgcacccaccaaccacccccacccgccgccatgagggagtgcatctcgatccacatcggccaggccggcatccaggtcgggaacgcgtgctgggagctctactgcctcgagcatggcattcagcctgatggccagatgcccggtgacaagaccgttgggggaggtgatgatgctttcaacaccttcttcagcgagactgggggctgggaaagcacgtcccccgtgctgtcttcgtagatttccgagcccactgtgattgatgangtgaggactgggcgcttaccgccagtcttcaacctggagcagcttatcaangggaaggaggatgctgccaacaantcgcccgtggtcattacaccattggcaaggaattgttatctgtgccttgacgtacaaggaacttnaagcaactgcactggtctcaaaggatcctggctnaaagctgtngaggtggactggtccggcctgggtccttcg

SEQ ID NO: 90029 - DNA, 487 bp, Triticum aestivum
  unsure (1)..(487): unsure at all n locations
  Clone ID: PAT_TA_90029
ccaacccgccgccgccactgccgtcgccgccgcagcgcgcggaggcgaccaccccaccgccgccaagatgcagatcttcgtgaagaccctgacgggcaagaccatcacgctggaggtggagtcctcggacaccatcgacaacgtgaaggccaagatccaggacaaggaggggatcccgccggaccagcagcgcctcatcttcgccggcaagcagctcgaggacggccgcaccctcgccgactacaacatccagaagganccacccttcacctgggtgctccgcctccgtggtgggcgccaagaagcgcaaagaagaagacttacaccaagccaagaanaaaanacaagacaagaagtgaactcgccncctccantctacaagtcgacgacccaccggcaagtnacaagtcaaggaggatgccccaacgcgganncngtgccggacttcatggcaacactngacgcatacgtggaantcggtcactac

SEQ ID NO: 90030 - DNA, 505 bp, Triticum aestivum
  unsure (1)..(505): unsure at all n locations
  Clone ID: PAT_TA_90030
gccgtcgattcgaacctcccccaaatcagcagcagtcgaccggaggcgccgccatggcccgtaccaagcagaccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagatccgcaagtaccaagaagagcacggagctgctgatccgcaagctgcctttccaagcgcctgggtccgcgagatngcgcaaggattcaagacggactcccgcttccagtcccacgccgtgctggcctccaggaggcggccgaggcgtactcgtccggctgttcgangacacaaccgtgcgcatccacccaangctcacatcatccaagaatcagttgcccgcgcaccctngcaagaggctaagttctctccgtnaacacgttnggnnggatagtnatccgtggaattgtccaatncgtn

SEQ ID NO: 90031 - DNA, 521 bp, Triticum aestivum
  unsure (1)..(521): unsure at all n locations
  Clone ID: PAT_TA_90031
gtcgaatcctcctcccccgccgcctcaagatgcagatctttgtgaagacattgactggcaagaccatcacccttgaggtcgagtcgtctgacacaatcgacaatgtcaaggccaagatccaggacaaggagggcatccctccggaccagcagcgtctcattttcgctggcaagcagcttgaggatggcaggacccttgctgactacaacatccaagaaggagtccacccttcaccttgtcctccgccttccgtgggaggcatgcagatcttccgtcaagacgttgactgggaaagaccatcaccttgaggtggagtcgtctgacaccatcgacaactcaaagggnaaatttcaaggacaaggagggatcctccgggacaaacaacgcctcatctttgcccggcaagcaactggaggatggccnacccttgctgatacaaatccagaaggancaacctgcactttctccgccttagggaggatcaatnttcgtcaagacctaacgggaagacatcaactgag

SEQ ID NO: 90032 - DNA, 376 bp, Triticum aestivum
  unsure (1)..(376): unsure at all n locations
  Clone ID: PAT_TA_90032
gcaactccctccctcgccccctcgctcggcggtggttcttcctcctcctcctcctcgtcgtggtcgtcccagcacaacttcctcccaccttcctcgccgcttcgctcccccttcccttctccttcctggcttcttggcttcttcttcttggctcctcccggccggattggaacttcttcttggcgcgctctgctcagggcggttggttgctgcggggtcgccggcagcttccccgtcgcgcacggcggggccgcctgggcccgacctccctccatccgcgagcgatggggaactgcgccagcgccatggacggctcatcccgtgggggctgggggcgccaaggccgccgccgccaatcccgcaaggattntgcgtc

SEQ ID NO: 90033 - DNA, 476 bp, Triticum aestivum
  unsure (1)..(476): unsure at all n locations
  Clone ID: PAT_TA_90033
acaacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagcccgaaatgtggcgctgcgcggatatgaaatccaccgtcgacggcacctgcggtgggcctgcaagaanactgattggtcatccaacangnaaatnttcccctaaaatgaataaagtcagacgaatgacacnctcgtcctagctgttgttggcaaaaanttacaatatgcggtctctcncgngttcncccccaagaaattgggtgctgtt

SEQ ID NO: 90034 - DNA, 497 bp, Triticum aestivum
  unsure (1)..(497): unsure at all n locations
  Clone ID: PAT_TA_90034
atagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtancttaatcnattagacctatttgnagagggttccgttactaacatgtttacttccattgtangtaactatttggttcaaagccctacgtgctctacgtttggaggatctacgaatccccctacttantcaaaaacttccaaggcccgcctcatggtatcaattgacagagataantgaan

SEQ ID NO: 90035 - DNA, 495 bp, Triticum aestivum
  unsure (1)..(495): unsure at all n locations
  Clone ID: PAT_TA_90035
aacgaacgaaaaatccccaaccaatctcgtcgccgatcaaccctaggctcgtcgaatcctcctccccgccgcctcaagatgcagatctttgtgaagacattgactggcaagaccatcacccttgaggtcgagtcgtctgacacaatcgacaatgtcaaggccaagatccaggacaaggagggcatccctccggaccagcagcgtctcattttcgctggcaagcagcttgaggatggcaggacccttggctgactacaacatccaagaagganccacccttcaccttgtcctccgccttcgtggaggcatgcagttttcgtcaagacgttgactgggaaagacatcaccttgangtggagtcctctgacacatcnacaaagtttaanggcaagntcaagacaagganggatcctccggacaacaaggctcacttnccggaacaactgagatggccacctgcngataacncaaaagatcaactgactgtctccccta

SEQ ID NO: 90036 - DNA, 373 bp, Triticum aestivum
  unsure (1)..(373): unsure at all n locations
  Clone ID: PAT_TA_90036
ctctcatgctgattggctttggcttttgatggagggatctcttgccaccaagttgccagccgaggtcaccaggttgctggcccaagcaatgtgtctttgatcgtgccaaaggtactcaggttaccccgtgaaggatgaaaccgggacgtctgtacataattttaagcgggtgatggaagaatttctcgaagcgagcagacatgttgtatcaagtgatgataatctccgtcccattgaaaagaaacgctagttgattggttgcagtagtgattcttttactccggggacagtgtgtgctcacagaatangtcaaatctttggtactgcttaacattttttaagnactaatgtactgtccggtaactcaaaatac

SEQ ID NO: 90037 - DNA, 423 bp, Triticum aestivum
  unsure (1)..(423): unsure at all n locations
  Clone ID: PAT_TA_90037
caacaatcaggattggtaggagcccatccccgccttgctggccctgacctccccccctcctctcccccctctcgctcttcatttaatggcttctctgtcccctcggtcttctgcctccgctcgctcacctgggtactagcggtagtagtagcactaggctggggctgggtgcggcatccgaagagagtcccagagagaggtanagaccgctgcctctgagctgttccttccacctccaagcgagtgttccaagagattggggcacatcaaatatagctaactactacaggnnaaaaggaaggaggggaaaanntttttccctttcttttggnaaactccaatgctngctnggctgggccggtnatcnccttgattctccaacncggcgnccggtctgtcaatcaatcaaccatcctccctttc

SEQ ID NO: 90038 - DNA, 499 bp, Triticum aestivum
  Clone ID: PAT_TA_90038
ctccctccaaaaaccaacatctccaccctccaaacaccgccaccatcaagagcagcccagtcccgccagaaccgcgagatccgatccgagcaccaccagcagcagatttggcgccacggaaccggagctcgcctctgtccttcccgcccgcctgccgtttgatcctccaggtgcgcgagcgctctcggctggtgaaatctttcctccctgctcgatccatgcccggggggtgctccgtccttgcccgcgagatccgtccggcccgtcctggagcagcaggattccctgtggatcctccgtcttggccttcttccccggcgccaagattcgggattccttttcggttctccaacgcgcgtttcccgggagcgccgctgccgggcatggcgtacgcgtcccgtaactgctgtcgttcctgctgctgctgtccaagccggcggtgtacaactgggcgccgcgcctgctgatgccaaagagctcccggggcacccggacgcga

SEQ ID NO: 90039 - DNA, 468 bp, Triticum aestivum
  unsure (1)..(468): unsure at all n locations
  Clone ID: PAT_TA_90039
gccgccggaaagaccaccatcctctacaagctcaagctcggcgagatcgtcaccaccatccccaccatcgggttcaatgttgaaactgtggagtacaagaacatcagcttcactgtctgggatgtcgggggtcaggacaagatcaggccactgtggaggcattacttccaagaacacacagggtctcatctttgttgtggacaagcaacgatagggaccgtgttgttgaagcaagggatgactccacaggatgctgaatgaggattgattacgttgatgctgtgctgctgtgtttgctaacaanaaatttccaaatgccatgaatgctgctgagatcactggataacttggcctgcatcccttcgccaacgacactgngtacatccaaganacttttgcaaacaggggaaggactgtttgaagcctggacggtgtccaacaacattgcaacaaccctantttcttcaa

SEQ ID NO: 90040 - DNA, 501 bp, Triticum aestivum
  unsure (1)..(501): unsure at all n locations
  Clone ID: PAT_TA_90040
atgcttccgcttcttcttcccccatcaatcgcgaaccggataggggatagatagatcgcccccaaatctttgcccggaacaccgcggcggccggccgcttccacccaacgccaccccaccccaccaccaccacccctcgctctccccagattcgggcctccgtggagatttccgggatctttccgccggcgccgtcgcccatggcgtgctgacatggtctgccgcgccgcaagctgccctgcacagttgcttcgattccgacgagccaagaagatgaacggcgcgccgatncccgcgcccgtttttggcnggccgggcgccgacgcccgcggccgccgcgacgcccaaagaagaatgcngtcgccgagatgggcaaggaactcaccgtcnacacggacgacccttcgcnggcctcctccaactcgccgcgangacgagncggacgggctgcncccgccgctggacgcgcgccccgccgcgcggacaagcggctctggtacg

SEQ ID NO: 90041 - DNA, 494 bp, Triticum aestivum
  unsure (1)..(494): unsure at all n locations
  Clone ID: PAT_TA_90041
agagagaagaactagtctcgagtttttttttttttttttttcttgtacatataaactctttccccttaatgaaaagacaggcctcctcctatctttggagggagggtgcaatacaagcttaccatagggtgcaaaaaaaaagaagtaaaggtaaccatcaaatctcggatcgatgggtgctctagattggctaagagcaggctcgtgaaatgaacaaagccctccagcagctcctacactagaatatggggcatccatccaagatccggcggttcacattcaatttccaatttgggcaacctatggtaacttggtattgtatctccaacttaatgggaaaacatatcggattcctataaatttaaccnatacnacggtgtggctgtgcatgcataattgcttaatgggnggnagggatttcngggacaagatgactcnccttccgancaacggnnancaaaaaagtcggcatgtaaaacccccnccgnacccgn

SEQ ID NO: 90042 - DNA, 488 bp, Triticum aestivum
  unsure (1)..(488): unsure at all n locations
  Clone ID: PAT_TA_90042
ctcacatccacagttcctcctcctcggccgttccctcgcctgatcgccttccgtctccgctgccgatggacgccttcgccttctcccccgctccgagccccaacgccgcgccattcccctccgcctccccgtcctcgcgcggccaccgcttctccatccgcggcccgcggcggcggcgcccgctcccggccctccgatncagcgccgccccctcggcctcccaccacgacgtgggtcgtcgtggggcgccgggattcgtcgggctctccatccgcccgcaactcctcctccanaccccgtctccgtcgccgttcgccgacgctgccntccctgccccggcgcaacaagcgcaagcaagggaactgtggatgttgcaccggacgcccgggaacgacacgttggactggcggtgcggacaanacttgggaaagactcncggcnagatggacgctcgcccggcgggccgtnaaactgggtggatnaagaag

SEQ ID NO: 90043 - DNA, 491 bp, Triticum aestivum
  unsure (1)..(491): unsure at all n locations
  Clone ID: PAT_TA_90043
cgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcaagcaaggttgggttcatcttccgtgagcacaacgcatcccctggggtactacgatggccggtactggacatgtggaagctgcctatgttccggatgcancgacgccacgcaagtnatcaacgaggtggaggaagtcaagaanggatacccngaccctattccgcncacggtcncaacatcgtcagngcantgctcnagtcatcgcctcaagcaacggctgcaaggagn

SEQ ID NO: 90044 - DNA, 487 bp, Triticum aestivum
  unsure (1)..(487): unsure at all n locations
  Clone ID: PAT_TA_90044
ccgccgccgccgtcgccgccatggcgctccggctgatcaacccgagcaggaagcccctcctccacgtgccccgcccctcctcctcctccttctcctcctcgtcctcctccaaanaagccctcccttccctcccccgccgccgccgccctccgacgacccccacccgcctccgaaccacggngagggcccccanaggccggccgcctcctcgatcttcctcgacatccgcgagcgcctcaagtcgtcnccggcgccgcccccgcngcgccggattcggccaacccgctccgcccggcngggccgcccgcggccccctccgtcggctcgangacgtcaagcgcatctcaagtccttcgtgccggtcncccgcttatccggcccggtgttgncggcggtannggcggaggngcnaaccnttgtcaanactgntnaagaaaanncgctcccgggggtnccaggaagggngaaccccnncncgggggggaat

SEQ ID NO: 90045 - DNA, 525 bp, Triticum aestivum
  unsure (1)..(525): unsure at all n locations
  Clone ID: PAT_TA_90045
gcaatctggtcctgacattttttacaattaaaattgctatccgaaaagagaaaaaaaaacaaagaaaaaacttgtcatccaaaaaaaaattgtcatgcttgacaactgaagttgccatcctcacatcactaaaatttccataaaaaatgttcggaattgccatgtgtttgtgttacacgtgtggcatttatcagagcctaaactttacacataaattggaatatcaagtatttaaatatgtccngatancctttttaaaaatagaccccgaataatagtagtatcatacctaataccgtaccctacagtcagacggtcaagatgtcaaaaacccctaaccggtagcttaanaaaaatggatcccggagttggttcaataaaaaattaccctaacnattcatccnttttttaaacngaagcccaaaagagnccactttgnttaacgaaccattacaacngggttcaagttacagcaacgcacaancacacacacagcacaacaatggccgggccacattacaattg

SEQ ID NO: 90046 - DNA, 437 bp, Triticum aestivum
  unsure (1)..(437): unsure at all n locations
  Clone ID: PAT_TA_90046
gtacctgagcaccaccagtttgctcatgtcctgggaggtcggcaccgagccggtctacctctggacgctccccatgttccactgcaacggctggaccttcacctggggtatggcggcccgcggcggcgtcaacgtctgcatccgcgagaaccgccccgccgaggtctaccgcgccatcgcccgctacggcgtcacccacatgtgctgcgcgccggtcgtcttcaaatctcctcgaaggttggcgacgcaccgcgcggtcgcgaagccgttaacttcttaacgggggggcccnccgccggccgcccttctggacgcnttcaanaaatcggtttaacgttaancaancctaaggggtcanccagggcaanggnccncccctggcttccaaatggccnccattgggaaaacttgcantttggacgccgccctnaaagccg

SEQ ID NO: 90047 - DNA, 481 bp, Triticum aestivum
  unsure (1)..(481): unsure at all n locations
  Clone ID: PAT_TA_90047
cacaacctcgtattcagatttctagatagacaggatcagattaaccagaagatgatgcaggccaccgttgccttgtcggccgtgctgactgtcgccgtaaggggcaggccnggccgaangangaagagccgccaccgtggccgccggcggcagaaggatgccgggcggtgccgttcgtgcatcggccgccgcggcgccgggaggcggactacagctccagcgtctcggtgttccccatggaaggcctgcgacctggtcngcggcgaagcctgcgacgcgcagatgtaccggaggtggaganggaattactatcctacgaacaaccaaaaacgtttcccggacnaggctncacatttccggcggcnattctgccaagggccctacaaacaacaattactaatcaagaactactacaactacatatgtaaaacccttatctcancaaaggcttcattnnacaagttaataacaaaacatctcn

SEQ ID NO: 90048 - DNA, 401 bp, Triticum aestivum
  unsure (1)..(401): unsure at all n locations
  Clone ID: PAT_TA_90048
cctccccccgcccctccctctctgcaagctaggtctcgtctcgtcagcacgcccgcgccgccgccccctcccgtcgccaccgccggagtgtgacggaactcctcccgtcgccaccgtatccacagcccccggcgcgcgcggangcccggccaagccccangctcgcctctctcngtcgctggctgcgcctccngagggatncccgccaggatttcctngtncaacaaccgaatccngatnccggtgttttcaaccgatttgatcaaggagaatcaaatnaaaagngtncaaggtgaaggaacttaatccccttgangttggatccccttaatccaactaangcaatnaaatggttaattttccctcaaaatggatgcctggaggaaattatnaacggctgt

SEQ ID NO: 90049 - DNA, 526 bp, Triticum aestivum
  unsure (1)..(526): unsure at all n locations
  Clone ID: PAT_TA_90049
cgaggaagcggcccccgaacgcgccgccgcccaaccagcagcagcagcacaagagatcgagcaagcgggcgaggggctcccctctgctgaccctcagctctcacatccacctccgctgggatgaccgctccaggcgggccctccccgccgacgaccagatcggcatcccctggcgcacttccgcccccttcagaanntcccccgccccgcgcccgccgcgccctcgccctcgccctcgccgacgtcgcccccgtccccaagccggattttctccctggggcgacatccctctcctcggtggggtgttgtcctacgaagtctgggaacgcctgcctgaacgganggcgacaggaagttccttgccaaagttcttccnggcggtccgatccnaggaacaatgcgcatttctcaaaagggggaaaatcacacttttggnacccttgtnactgnctctcncttgtcngtcaactnaatcaaaagctatacttaaanggngaacaataanagcnatacaaggatanatcnn

SEQ ID NO: 90050 - DNA, 472 bp, Triticum aestivum
  unsure (1)..(472): unsure at all n locations
  Clone ID: PAT_TA_90050
gttttttttttttttttttttagcgcctttaaagattctgtacgcagaatcactcacaatattgcacgaagaacggatgcgtctgtgtccagaacagaacattccagagaagcattcagtgactcaagcttgattttcaagcagaaagagttcttgaattaccccgaactcccgcacagaaacacaattagcaacgttgcagatgaactaacacgcggctacagcctacagtgacccctacaccactggncatcctcatcccgagtctcgtacgcctggccaagcaagctccagtcaatcctgtggctaaaccctgttgcttcaactggttggtcatcctgacatgaagaatttgctgacagaactcccgggtcngctaagccgtatcncngctgctgcggaggntgcaactgggccctccgttggntccaacaagtctcaagaatccgttctaagtcctttggctgntcaa

SEQ ID NO: 90051 - DNA, 335 bp, Triticum aestivum
  unsure (1)..(335): unsure at all n locations
  Clone ID: PAT_TA_90051
catcaacatgggacccgagcctcctctcctgccaattccttcctagccagccagcacgcggccacaaagctttacctaggcagcggtccatacgggtggacgaatccatacgtttttcaacggtttgtttagcacccggtctccctcctccgcctctgcttccgtccgtctcccgccgccaccaacggtgtctgattgggccgttgggtccgcataattcgctggtatatattcgcggcatgtcgcggttcattgcgtctgaatccctggaagggaaagccaggtanccgttaattgggtaccaaganctccggtttcaacctcgggtccccgga

SEQ ID NO: 90052 - DNA, 458 bp, Triticum aestivum
  unsure (1)..(458): unsure at all n locations
  Clone ID: PAT_TA_90052
aggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactgggacaatgtggaagctgcctatgttcggggtgcaccgacgccacacaatgtacgnaagttggaggaggtcaagaaggagtacctgacctattccgcacatccggatcnacaacatgcgccantgcatgcgtcagttcatcgcctttnaaccaccgggctcgaagatccggcaaggctaaacactcatcacgacaggcatatataaangccatgcantttttcaatccnacatgcttgggtttcctcccn

SEQ ID NO: 90053 - DNA, 522 bp, Triticum aestivum
  unsure (1)..(522): unsure at all n locations
  Clone ID: PAT_TA_90053
gggaccccggaggttggcatggtatcggcttgagggcaagccgattcttatagaggggggattgtcagcgacctgggctcgctgggcccatatccaccatccagcccatgaaggatatgagactacatatacagaggaggctgcttcgtgcaactcggcttgggatnaaacggcggcttcnggccgaggctaagataattcgtggctcctccccttcctcccttccaacttcctgatnctcctccttcccttaaatttcctccctggtaacctaaggttgtactcctnaattcaanggtaattgagtnaatccnctagtttgaccctaaaatctacaacaacgccaagcaaacttcaaggcagataattctgctcctgggtcaatcnggggaaaaatttattcaacaaacacttttcctnaagattnaaaacctaaatgctttctttctganaantccgttctttcaaaatanggaccaccaatacaaggncattactnacacnattctcaaaaaaatcaca

SEQ ID NO: 90054 - DNA, 498 bp, Triticum aestivum
  unsure (1)..(498): unsure at all n locations
  Clone ID: PAT_TA_90054
caggagttagccaagaagatcgaagctagcatgggtcggtcaagtggaagcctcgcagtcgccatgacgacgctagtagcttcggttctcatcccccagcttctccttgcgcccacgcccgtctcgtcgtcgccggccgtcctggtcccgctcctccgaacggccgtcatccgtgcgtccccgctcttgaggaacctggtcaaagctttcttgcaagagcaagcgaagcagggtgtgatgcagctcatctggaaggcggcggggcacctaaaggacaagctgctgggcggcgtgggagccgacgccgcccggctggtcgtcttcgacatatccatcgggacttccccgcgcaaggcgtctccggggtgttggacataactccagctatctgggcgcaatgcgcgccctgcgacgcctgccggacgccaagcttccggccgccgagtaacgtcctttcaaaattcctgcggaagccgactnccncncttctggcnacgn

SEQ ID NO: 90055 - DNA, 518 bp, Triticum aestivum
  unsure (1)..(518): unsure at all n locations
  Clone ID: PAT_TA_90055
atccgcccctcgctgccgctgcatctcgtctccaccaccccacttgcccccggacccaggaggatcgtcggagatgtcggacaccgatgagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggaacactaaggatgacctgaacttccactgatgatgttctgcttggcaaattaanatggnttgctgatggaangactgatccgtcgtattcgcaatggtgaananaatngcctgtaa

SEQ ID NO: 90056 - DNA, 525 bp, Triticum aestivum
  unsure (1)..(525): unsure at all n locations
  Clone ID: PAT_TA_90056
tccatacactaagaagtttgaagcgtgctggttgccactcgcgctgctgctctgcttggaggcgtcgtcgtcgactggaggagcgccgaatcgttgtcctcgagttcgtgcacttcaggaagaagacggctcgaggtgagacgtcacgcatccgtcgtgcggaggtagagctctagagggaccaaggtcgaggtagacactgctcctatcgaggctagcctgccgtagggacgaatcaggtccctagacccttatgagccctaattttcatggagcaaggtgcatcttgccgcttttgcttttgtaaatgaagcccatangtggagggatttggatgatctgtagtcaaaggataccatcaagcaagcggacgcacaagganggtcgccccggagtagagtagangacttgccaactgcatctctctctgacctaaagccaacttggatggatgtgataacgttatcccaacattggnaacatttgtgtcaagttgatctggacaattnaagggttccncnacaa

SEQ ID NO: 90057 - DNA, 513 bp, Triticum aestivum
  unsure (1)..(513): unsure at all n locations
  Clone ID: PAT_TA_90057
cagtaccagcgggagccgcacatcannagcttgctctgttccatccggaancactggcggccaccaccaccatggcgctctcctcccccgngatnaagctcgccggagnctcctacgccctcncgcggcggcggacgcatcaccatgcgcaaggccgcgcccaaggcctccgcctccaacagcccgtggtacggncccgaacgcgtgctctacctcngnccgctctccggtgagcccccgaggtacctcagcggngagttcccgggcnactactggtgggacaccgngggcctctccgtcgaccggngaccttcgccaannaccgcgagctccacgtaatncactgccgctgggccatgctcgtngngctcngctgcgtctcccgaagctgctcgctcgcaanggcgtcangtncggcnaggaatctgggtcaaggngggctccaaantnttcancgaggncggntcgantacnnggtaacctangttggncanggctaaannntcttccatt

SEQ ID NO: 90058 - DNA, 255 bp, Triticum aestivum
  unsure (1)..(255): unsure at all n locations
  Clone ID: PAT_TA_90058
gcgcctccgcccagccggacccctccaccccgggcgaggccgcgtccttccaccgccaccgccgccgccctcgccctcgccagccaatcctctggaacagcgccggaganggggcgccacggcaagcccatccatgacgagccgtccccccgcgccgcgccacctccccgacataaggtttgcctctcgcgccgccctgccatgctaaggcggggaaggangcgacctggtgttacccggaggaagctggggccg

SEQ ID NO: 90059 - DNA, 480 bp, Triticum aestivum
  unsure (1)..(480): unsure at all n locations
  Clone ID: PAT_TA_90059
cacgagtgaagtgagagctttgcacgaaaacttcatcagaaaccatgaagggcaccaagctcgcggcgatcctgatcctccaggccgtcctggtcatgggactcctctcacacgtgaacgccgatnttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatnaaatccaacgtcgacgggaactgcgtggacctgcaagaatactgttggttaatgccggatatatgttcgcnaaataaataaagtaaggaaatacaactctctgccaaccgttttttggcaanatctaaacaatagttgcccttcgccctngtttccccccanaaaaattgggtnctgttntaacttccgaanaccccgtgaanaanacttatgn

SEQ ID NO: 90060 - DNA, 425 bp, Triticum aestivum
  unsure (1)..(425): unsure at all n locations
  Clone ID: PAT_TA_90060
cattccctccattgttcgtcccactggtcctgctgctgctaacatcgacctcgtcgccggccaccgccgcggcagagatcgcggaggcgccgtccgccgttggctgcagcggcagcgcggaggcagcgtcgcgggtggtggcggagagctgcacggacgacatcgtcaggtccttcttcggcgtgcgcggcagcgacgcctgctgccgcgcgctggagacggccggcgccgggtgctaccgcgcggtgttctccggctccccgttcgccgatatctacccgaccatcctcggtaacgtctgcggcctcgccgtggctccagccccggggaacgatcgtactactagtctccagttgtaaccgaattgacnaaacaagatttaatttaagatctctgaataaatcggtacttgtaaaaaaaaaaaa

SEQ ID NO: 90061 - DNA, 434 bp, Triticum aestivum
  unsure (1)..(434): unsure at all n locations
  Clone ID: PAT_TA_90061
caagagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtagctgccgaatcttctactggtacatggacaactgtttggactgatggacttaccagtcttgatcgttacaaaggacgatgctatcacatcgagcctgttgctggggaagacagccaatggatctgttatgtagcttatccattagacctatttnaagaaggttccgttactaacatgtttacttcaatgtaggtaacgtattggttcaaagcctacgtgctctacgtttggaggatcacna

SEQ ID NO: 90062 - DNA, 452 bp, Triticum aestivum
  unsure (1)..(452): unsure at all n locations
  Clone ID: PAT_TA_90062
tcgaccgattgaaagccaaggccctctcgtcctccttcaagatgcagatcttcgtgaagaccctcaccggcaagaccatcaccctcgaggtcgagtcgtctgacacgatcgataatgtcaaggccaagatccaggacaaggagggaatccctccggaccagcagcgcctcatctttgccggcaagcagctggaggatggccgcaccctggctgactacaacattcagaaggagtccaccctccacctggtgctcaggcttcgtggaggcatgcagattttcgtcaagaccctcaccggcaagaccatcaccttggaggtggagtcctcggacaacatcgacaacgtgaangcaaagatcaagacaagganggcatcctccggacaacaaggcctcatcttcgctgnaagcaacttgangatggcgcaacctnggtgatanacatcaagaagg

SEQ ID NO: 90063 - DNA, 177 bp, Triticum aestivum
  unsure (1)..(177): unsure at all n locations
  Clone ID: PAT_TA_90063
gggcgcggggagcggcagcctcgaccccaccccctccaccttcgcgccgcccccgccggcccgcgactacacgcaggacctccccgacnanatcctcacgctcgtcttcgtctcgctcancccggccgagcgcaatgcctgctccctcacctgngcncgntggaangaggtcgaacg

SEQ ID NO: 90064 - DNA, 442 bp, Triticum aestivum
  unsure (1)..(442): unsure at all n locations
  Clone ID: PAT_TA_90064
gccgccgccgccgccaagcaaccagcccccagcacccatcaccggccggcgaagatcaagacgatcctggcgtcngagacgatcgatatcccggaggaggtgacggtnaaggtntcggcgaagatgatctcggtgacgggtccccggggcacgctgacccgcaacttcaagcacctcaacctcnacttccagctgcangagggcgggcggaggctcaaggtggacgcctggttnggcacccgcaagaccatggccgccatccgcaccgccatctcccacgtccagaanctcatcacgggggtcaccaagggcttccgctncaagatgcgcttcgtgtangctcacttcccatcaacgcctccatnacgccgccaaccgcggcatcatattaggaacttctcggcaagaagaagttaggaagtngcatgctcnacgggtcacn

SEQ ID NO: 90065 - DNA, 444 bp, Triticum aestivum
  unsure (1)..(444): unsure at all n locations
  Clone ID: PAT_TA_90065
gccaccatctcggtgggcgcgaccaagacgctcttcatcctcgtggccacgttcctcctcgaccgcgtcgggcggaggccgctgctcctcaccagcgccggcgggatgttggtgtcgctcgtgacgctggcgtcgacgctgcacgtgatcgcccagcgggcctcaccggcggacggggcgacggcgctgtcgggggtgagcatcgcgtcggtgctgacgttcgtggcgtcgttctcgatcgggatggggcccatcgcgtgggtgtacagctcggagatcttcccgctgcggctgcgcgcgcangggtgcgcgctcggcacggcgatnaaccggatnatgagcggagccatcaacatgtccttccactcgctctccacaagatnacgctcgcgggaacttcaactctacgcaacataactgcgccggtggtgttaagtacgctcn

SEQ ID NO: 90066 - DNA, 461 bp, Triticum aestivum
  unsure (1)..(461): unsure at all n locations
  Clone ID: PAT_TA_90066
gtccaatccatcttctctttgccactcttctccgccggagctgctgccaaagtctctgtctttctctgtgtccgtccagtatatgagcatggcggnnacggcggncacggccacggcctggccctccacctcctcctccgtcctcgcccctcgcanccgccaccacgccacccgcancccccgcgccctccgctccggcttccttggncgcgccctcaccctcgccgcncccacagaccgcccctcccccgtctccgtctccgtgcgcgcggcctgggaaggncccctctcctcngcgcgcctcatcatgcatggccgcancgtcaagctgacggagaagctcaaggagcacatcgaggacaangtggggcnnacggtgcacaaccactcgcaactggtgcgggangtggacntgcgcntctcngcacggggggggnactcacaanggcccaagnttccnn

SEQ ID NO: 90067 - DNA, 506 bp, Triticum aestivum
  unsure (1)..(506): unsure at all n locations
  Clone ID: PAT_TA_90067
aaatctcaagcttagcacagaagcaaaacaatggcggagcagaccttcatcatgatcaagcccgacggcgtccagaggggcctcatcggcgaggtcatcagccgcttcgagaagaagggcttctacctcaaaggtttgaagctccagaacgtggagaaagtcgttcgccgagcagcactacgcccatttgtcctccaagccttcttccgcttggctcgtggagtacatcgtctcccggccggttcgtcgctatgtctgggaagggcaagagcgtcctctccaactggacgcaaagattattggcgccacccaaccccctggccccttagcccggnacatccgttggtgacttcgccttcaacttcggcnggaagtcctccaanggaangaccaatttanaatgcnggaaggaattgccctntggtnccttanggatttccaatggaggagaacccgnaaactggnttacaagccnaaaattcnantggttattnagttccaaaaca

SEQ ID NO: 90068 - DNA, 370 bp, Triticum aestivum
  unsure (1)..(370): unsure at all n locations
  Clone ID: PAT_TA_90068
ttttttttttttgacgctgactatggcaggcttgtgccggcctgaacttgtattgaagatcagaggagaaacctacagaacagcgatacaaagttatctgctaattacagggttgttgaacgcaccccaacagaagaaaggctaaattctctcagataaatgaaacaacatcgacccccaatctcggagaaagaatagcttgtacatcattggggcatcgattaagggaacgtatagtttgtagtanggcggtatgcaaagacctccatgccaagagcctcaaatttccctccctgggcaaagggnatgtacaacaaccccccgagatgattccctgcacactgatcttggggacttgccaactttatcc

SEQ ID NO: 90069 - DNA, 501 bp, Triticum aestivum
  unsure (1)..(501): unsure at all n locations
  Clone ID: PAT_TA_90069
tagtctcgagttttttttttttttttttgagtgtgaatatttaaaacttgatttgaggaccacaattttgttatcccatagcaacttacggggccttttgctagtggaaggccaaaatatattttatctcaattattctcaatccagcttgtgcgtaggatcctaagactatatttcaaacccttggttatagcttacgcacaatcttcatcggcctcatcatctcgttgtcttcatgatccaaaatatggcaatggtagacgtagcccggggccagcggtgacgtccaaaggggaaagcgcccgctcttcccaagacgcccgttcgccnacgaccctcccagcggctttgaaccgcaagagcagcgtggcaccgtgctgggccngccttnaacacttcttccaacnagcttctgccgcgggacaactgctccgcctccgggcnaagtgcccccgcacccgcangcaagggtccttcggcgccggccncnatcgcgccccc

SEQ ID NO: 90070 - DNA, 357 bp, Triticum aestivum
  unsure (1)..(357): unsure at all n locations
  Clone ID: PAT_TA_90070
gaccggtcggagacggcgctctcctactccggccaggccgacccacgaccgccgccgattcgtgccgttcttctctcccgttcgtgctgacggcggcgccctttcctctatttccgactgaagaaaacagctccaacctcgtgctctgcgtacctattgaacttcaagattaccatacttgcacactacattgctccatggaggatctcccngaggaactgttgcanagtttctcaaaaggatnaccaagacaagtgatctgattcngttccccttgggtcaaaacggtccanaaaattaggnaatttaaanggggctaacaagttggngngcnttttcncggcnaaaaaccttgga

SEQ ID NO: 90071 - DNA, 310 bp, Triticum aestivum
  unsure (1)..(310): unsure at all n locations
  Clone ID: PAT_TA_90071
catcagccggagcacttcttcctcccctccgttcttctccggctccggtgctctcgtacgcgcgttcgtccgaaaccaccacctcgtcgaccaagaagagatggagatgaagaagatcgcctgcgccgtccttgtcgccgcctccgccancgtggccctcgccgccgacgccccggccatggccccggcccccggcgccgccgtcnccggctccgccgccgcctccgtcccggccgtcggcgccgtgctcggggcaacgtgctctccttcntcncctactacctgcaataagcgcnccccnggccgatat

SEQ ID NO: 90072 - DNA, 476 bp, Triticum aestivum
  unsure (1)..(476): unsure at all n locations
  Clone ID: PAT_TA_90072
catccccgccacgctcttctaccanagcctgcgccgcctcaagcacctgctcaagttccaccaagtacagcctcangttcaagctcgacgccgccangggcaagctccccaattacgtcgtcatcnagcaaaggtactttactgcaaaggagttncccgccaaagacgancaaccgtcgcaagaagtcgccangggccaaaggttgtcaaggaggtctacnaacgctgcgggcgancccgcantggnacgagacggnctcatcatcactatgattacatggnggntctatgacaagttccaacctgtcaaaatgcncaacctgatgggatattggcctgaccctaaaactcaatttgtttggncnggggcncttccaaattctaantnccccgggtttaaanggacgtgntcatgaacaaatggcccaaggaaatcnaaaatnggatnatcancccgganattaaaggtatttttt

SEQ ID NO: 90073 - DNA, 503 bp, Triticum aestivum
  unsure (1)..(503): unsure at all n locations
  Clone ID: PAT_TA_90073
ctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatccgagggcatcaagaattcgagaccctgtcttacctgccaccgctcaacacggaggcctcctcaagcaagtcgactacctgattcgctccaagtgggtgcttgcctccaattcaacaaggttgggttcancttcccgttagcanaaagcanctcctgggtactacaatgggccngtattggcaatgttgnaactgcctaagttcgggtgactgacccacaaagtgatnaacgaggtggaggangtcaagaaggatacctgacncgtatttcgcataacggattcanaaatgctcanggcaanggtangtnaacnccttaaacacgggtgg

SEQ ID NO: 90074 - DNA, 500 bp, Triticum aestivum
  unsure (1)..(500): unsure at all n locations
  Clone ID: PAT_TA_90074
gcagatcttcgtcaagactctgacgggcaagaccatcacgctcgaggtcgagagcagcgacaccatcgacaatgtcaaggccaagatccaggacaaggaggggatcccgccggaccagcagcggctgatcttcgcggggaagcagctggaggacgggcgcacgctggccgactacaacatccagaaggagtcgacgctgcactccgtgctccgcctccgccgggggcatcatccancctcgctccnaggcctcgcccgcaagtncaaccaagagaagatgattctgcccaagtgctacgccaagcttcatccaaaggatgtcaactgccgcaagaanantnttggcaaaacaaccaactttaggccaagaagaagtttaagaactaaactcnctaagctgtcatcncccttcnnttnccggggtaatcaatnnacataaattttccggtaacctttgctgccctcaagtcaggagttnacctgggtaaaccaactganan

SEQ ID NO: 90075 - DNA, 491 bp, Triticum aestivum
  unsure (1)..(491): unsure at all n locations
  Clone ID: PAT_TA_90075
gcgacctcctgtttccgcccaccttctccggctccggcgccggcgaacccaccgcggatcgagcgattcccccgatcaggagaggcgagccgggaggaagagatagcccgggaaggagaggagattgggggctcacgttcaccaagctgttcagccgcctgttcgccaagaaggagatgcggatcctgatggtgggtctcgacgccgccggaaagaccaccatcctctacaagctcaagctcggcgagatngtcaccaacatccccaacatcgggttcaatgttnaaactgtnggagtacaanaacatcaacttcactgtctggaattcnggggtcaagganaannttaaggcantntgngggattatttcnaaaanaaaaggntcaaccttnttttggnaanaancatnggacgtttgtttaagcaaggatnactcanaagatctaatgagataattacttatcttctgctgttttgtaacaacaaaatt

SEQ ID NO: 90076 - DNA, 406 bp, Triticum aestivum
  unsure (1)..(406): unsure at all n locations
  Clone ID: PAT_TA_90076
aacaacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggcctctccgggggtcgacgtctgcgacgacgcccaccccaagtgccccaaagggctgctnccgcttccgcgttgtgtccnaacnagccccnaaatgttgcgcttcgcccgatattaaatccaacgttcaacggacctngcggtnggcccggcaaaattanggtnnggtccagccancatnatattttccccccnaaaaggatataantcccaaccnatttga

SEQ ID NO: 90077 - DNA, 476 bp, Triticum aestivum
  unsure (1)..(476): unsure at all n locations
  Clone ID: PAT_TA_90077
cgcagatacgcctcggcgccggtcgcctccttctgcccggcagcgccagggaaggagctgctggaggaggcggcgacaagtggggcagtggcacgtcgtcgttcttgcggggcaggcaaatggcgtttcttcgcggctcgtctccttgccatctagagcatgcgttcggccgttcaccgcgatgaattctttcaccacaagaactactagtactaattggtctaatatgtaatttccatagagtgggttgtcttaattaatcatgttcggatgcttaatggcgtttngtgccagcctccgttncaccgcactgangcnagtgtagttggtccatgaatgctcctacgcaacttctgggaaacaaaaacatggtanctgtgcctttgttccgtgttctaatggtacnaactgtgtgctgcctttggaagatcaagaatttttttttgcaaggaagncnatanttgaaaaaaaaaaaa

SEQ ID NO: 90078 - DNA, 513 bp, Triticum aestivum
  unsure (1)..(513): unsure at all n locations
  Clone ID: PAT_TA_90078
ctggcactgcttggggttttgcccgtcaactaagcaacacaaaattgcgcatttttatccgggagctcatgctggttctctcgaggtgctctgcgagatatacacaattggagatagaatctggagacaaattgggagtctccgtggggcgccaattgatagaggtatacatgtgaatggttcggtgtattatttgacaaggttccgttatatctcttcatcacgtatcaattgtttgaatcttcaaagtgaaaagttgacgtcttgatgcttcctccacgcaaagacctatggagggattgttctttgtccgagctccgagggaaaactatgtttgttagttgtggatggtgcgcttgaaggatactcntacaatgggacatattaatgctccgataacgatgatnagcagagttggactcatagatacacatacttgcctcctgttgatcaacatgttattcaatccaaagacaacacttttcaatgatccaaaattgggtgcagtggttg

SEQ ID NO: 90079 - DNA, 482 bp, Triticum aestivum
  unsure (1)..(482): unsure at all n locations
  Clone ID: PAT_TA_90079
tggagacgcgtgtctggagttaatccctctctctctccctaatcctcaatcccctctctctccctctgctccaatcgatcccgtcggtcgcggcgccacccttgtccgcagagtcgtcggcgctgtcgatcaagaagcgtcggtgtgcccgtcggccaccagtgagtgcctcagtcgtgtgcctcagtcccgcggcggccgacgtggaggcgggtggcagcagcccgggcggcgacgacatcaactacgtagcgcgtgcgggagctgctccggcaaaagcactgtggtctccctcatcgagcggtctatgagccgtctcgggtcggtcctcctcgacatgcacgacatcaaagggcctagacgccaagtggctgcgcgagcagttcgggtcgtcaacaaggaaacgggctgttcgcaacaacatccgggagaaatctctacggaaagagcgagctacacggacgagttaacaccggngaagt

SEQ ID NO: 90080 - DNA, 201 bp, Triticum aestivum
  unsure (1)..(201): unsure at all n locations
  Clone ID: PAT_TA_90080
gcctgttcggcccaaatccacttctcacacacacacacacacacaaatctcttgcaagcaaacccccacaattcccagccgagaacgcgcggctgggaaagagagggtcgtcgggaggagcagaagaggccgcgattggggggcgaggaccgatcnangtcggcgntngggacatncgtngcggncgcggtcaccatgctg

SEQ ID NO: 90081 - DNA, 582 bp, Triticum aestivum
  unsure (1)..(582): unsure at all n locations
  Clone ID: PAT_TA_90081
tttcaaccaacacagagagctcctctccaaacctctcccttctctccaccaggagactagggttagagagagagagagtgagacaagagcaaaaacaatctctcgccccactgttataccaagtttgcatccatctcatatccctctatatatctttgtatcacgatggcaggcctatccctaagagcacccttggggcattcgccttcggcctcctaggcaacatcatctctttcacaagcctcctgggcccccataccaacattctaccgggatcttcaaagagcaaatccacggaggggtccagtcggtgccctacgtcgtgggcctgttcaacgcgatgctgtgggtcttctacgcgctggtgaagacgggtgagggctcctcatcaacatcaaacgctgccggtgcgtcatcgaagacgtctacatcgtcatgtactcgtctanccccaacgaaagccaagtttcacagcaagncgtcctcctantcaacncgccaactcgggnatctctccnaactcnttgcctcacgggaganagctctctcctcgctgattgcncggttcncgtttggctcgcc

SEQ ID NO: 90082 - DNA, 564 bp, Triticum aestivum
  unsure (1)..(564): unsure at all n locations
  Clone ID: PAT_TA_90082
gaagaacctcaccgcccttaaaaaactgaggttggaaatgtgcaaaggcatggggacattaccaggatggttgggacaattgacttctctagaagaaattttaatcagcatttgccccaacctgacatgtttgcctgaaagcatacggagtctctctgctttgaagctactcagaattgttgaatgtccaggtctgattgcgagctgccaaggggaggatgccggcaagatttgtcacatcccaaccgtcgaatacagctgatttgttgtacaaaactgttggtctcatgcagagctcaaggcatccgtcgcccaacgaatttgcacaaaattggcatatgtgctcctgggtggttacatgcanggtgctctaccccgttactacataatntgtttgagggtgtcctgtttgncccaaagactgcagaggagnttacacactgttctcgactggctaatttgcacaagnnaattcacaataaatgaggaagagagtcaagganatattggatgtgaagactctaatgcnacactcactcgncaggcaattaggttgtgcctcnc

SEQ ID NO: 90083 - DNA, 482 bp, Triticum aestivum
  unsure (1)..(482): unsure at all n locations
  Clone ID: PAT_TA_90083
ctcgccgccgccgccacctcccgatccaatctcaccccgccgccacctcccgatccaatcactgcccaatccaaccagacccgatccccacgcgcattccctccgctccccgccccggatccgaccgaccgaccgaccgcgccgcgcgaccgccgggagagcatggggagcgggggcaggacggatctgacgcnnngggcgccgtgggcgccgcttgaccatctgcgtgattcggcaccggcggttcatcggctcgcaactctncgaagaagtcatggccgagaccagcagacggcctcgcctcgacgtctacgaaangattncggcatcttnnaacccgccccgcccaactcgccggcgcactccttcaacggctcaacatcnagaacganccgctcnaanggctcatcaagatggcgttntgacaataactggcgggatttggcangccggcgatacaanagcgccggtcgacacatctc

SEQ ID NO: 90084 - DNA, 336 bp, Triticum aestivum
  unsure (1)..(336): unsure at all n locations
  Clone ID: PAT_TA_90084
gagagangcaaagcttgagatggngcanaccatggngtccatgaccggcctgtcgcagggcgtgcgtctcccaggcccggccggcaggcgcgccagcaggttcaccgtgagggcgtcgtcggcggaggccgaggccgccggccgccgagcggtccttggcctcatggccancggnatcgtcgggagcgcgttcnctcaggtggtgcaccccggcaccgtcgcggtcatcaaggttggatcnccgccgncgctctccggtggactcnccggaacngncaactcngccaggcaatggnttcgacntgcctctgangaancggttcnanctgcagcccg

SEQ ID NO: 90085 - DNA, 558 bp, Triticum aestivum
  unsure (1)..(558): unsure at all n locations
  Clone ID: PAT_TA_90085
ttacaagattggtggcattggaactgtgcctgttggccgtgttgagactggtgtcatcaagcctggtatggttgtcacctttggtcccactggtctgacaactgaggtcaagtccgttgagatgcaccatgagtctctcctggaggcgcttcctggtgacaatgttggcttcaatgtcaagaacgttgccgtgaaggatctgaagcgtgggtttgttgcatccaactccaaggatgaccctgccaaggaggcagccaacttcacctcccaggtcatcatcatgaaccaccctgngtcagattgggcaacggctacgccccantgctggactgccacacctcgcacattgctgtcaatttgctgagctggtgaccaagattgacangcgatctggtaaggactggaggcctgccaaantctcaaagaatggngatcctggaaagtgaagattatcccaacaaaccatggtgtggagactttgcnactacctctctgggcctttgcgtactnaaanaggaaatgtggtntgggtcacaaggntcananaagncaacgggt

SEQ ID NO: 90086 - DNA, 558 bp, Triticum aestivum
  unsure (1)..(558): unsure at all n locations
  Clone ID: PAT_TA_90086
atgcatacatccatcgcacaacacctccggcacccatccatcgcacaacacctccagcacccatccatttgtcatctcacgcacacatctattcgtcaaaccacgcagcaatcaatccatccgcaacccacgcacccatcaatcgggactcacggccaggccgagggaagaacgcacgtagaatcctcacgcatcggccggaggcggagtggatagcctctggcagagtttcaggcgactgcatcccgggangcngaanggaggangaggcgaaccaccatggaggccaaactcgtgttcccgaacggtaaaactttgatctaacaaatctcttgcttagttctttcttggcatatagcatgcacacacacaagtcgggagcgttcccggcatcgttcgcatgattggaccgccccggagatggagccgccgggccggatgatgaatcaacgttccggggatggcttaacaaagcagcgttacaaaaacgacaggagtcgcatacactgctgtcactctacacggtcgacaagatacactgggcagcanaagccncan

SEQ ID NO: 90087 - DNA, 241 bp, Triticum aestivum
  unsure (1)..(241): unsure at all n locations
  Clone ID: PAT_TA_90087
ctagaaccctaccgccgccactctccaaggtcccaangntccanatctccctccttcgcatactgcctcggtggcctttggagcgcacgaggatggtnggaagaagncccgacaccactagttgccccagtacgaggcacctacactggttcttggtcangccagtggacttgcatgcactgctctacagcttgtcatgaataantcangtgctcatgattgccttntgaacgggctccgt

SEQ ID NO: 90088 - DNA, 537 bp, Triticum aestivum
  unsure (1)..(537): unsure at all n locations
  Clone ID: PAT_TA_90088
ccctcccgcgcctctgctgatggcccctggacgcctacgatggtcggcggccgcgctcgtcctgctcttccttgccgccggggcggcggcggaggctgcacgcagggaggttgtgacctcgccgcgcggcgccgtggcggccgacgacgagcggtgctccaagatcgggcgtgacgcgctccgctgtggcggcaccgccgtggacgccgcantcgccacgtcgctctgcctcggcgtggtcagccccgcgtccagcggcatcggcgggggcgcgttcatgctcgtcaggtcgcccgacggcacggccgtcgttacgatcccgtnaaaacgcgccgctggcggtacaaaagaatgtacngnggcaatgacacctgaaagcaagggccgtctcancngatcccgggtgaaacncnggctctaacaagcgtggaacgcaccgnaantccatggaagactggtgatccggcgcaannnctggcgtcaagttcccgtactcaatganatnaacnacgaactgatctcgaaccccggatnggg

SEQ ID NO: 90089 - DNA, 560 bp, Triticum aestivum
  unsure (1)..(560): unsure at all n locations
  Clone ID: PAT_TA_90089
caacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtccgacgtctgcgacgacgcccaccccaagtgtccccaagggctgctccggcgtgccgcgtgggtgtcgaacgancccgaaatgtggcgctgcgccggatatgaaaccaccgttcgacggacctgcngtggacctgcaagaanactgatncggtcatgcccgcatgatatttccgcctaaaataaaataaaantcaaggcgagatgacagctcatcgtgcctagcntgtgtgtgtgggcaacaagcttatacaataagnctcnctcntcctgtgtttctctcnccaanaaaattggngtgcttgttgntaacttcgggatatcnccgtnataanacttaagatgtcgtgtgcaaaaaaaaaaaa

SEQ ID NO: 90090 - DNA, 508 bp, Triticum aestivum
  unsure (1)..(508): unsure at all n locations
  Clone ID: PAT_TA_90090
ctttgatctacaagtagaggagagcacacttggtactagtacgggtagagccgtagtacagcgagtcagtgtgccattacctcattattatggacttcgctgtcgtggggaacgcggccgctgtgacccagctcgtcgggaacgccgccgggctcatccgaaggatcattcaggcggtggagacggcacgccagaacaagcgggagtgcgagcacctcgcgctccgcctgtccatcatcggcgacgtgctgcccggctgccgcaagacgcggaggtggagccggccgctcatgggagctgggcaagacgctacgccgaggcgcacgatttgggtcaacgcctgccagacctggagcgccgcccacagttcttccggggcacccgccacgccgacagttccngggagtcaatctcggatcgatcccactcgcctcttcccctcgtcatctatccgccctcgctaccgctcnattggttatctccaagacaagccggcaacnacgggaca

SEQ ID NO: 90091 - DNA, 506 bp, Triticum aestivum
  Clone ID: PAT_TA_90091
tttaaaagaagtcaaaattactcagttcgagacaaattgatgacaaaaaatcagaaaaggccaagtagttctgcctgttcaaatctgtatgacgaccagcttgtccggttctgcactggacatctttatctcaaattttgtacatcaatgggcagattcatcactgctatcctatttcacatctcaaatgtgtttcaaaatctatctggcagctctctctacaaaagcacaaagtaaagaaaatgcaagagctcctgcctgtcctgtcaggtaaagctataagcaactctttcatgtacaccatggtattcacccatttgtggaaatctatcttgaaatctcagagctggctgggctacgggtacctatgctgcttccacggctcctccctcagcggccggtgctcgccgctggtgctctggcctccaagggattactgcgacatgatcccgcactccgatcaagtaccgcctgacctgtactgtagaagggaaccggcgaaccgg

SEQ ID NO: 90092 - DNA, 524 bp, Triticum aestivum
  unsure (1)..(524): unsure at all n locations
  Clone ID: PAT_TA_90092
gtttttttttttttttttttttttttttttttttttttttttgatcaagatatgattggttatttccgttctacaacaagaccgcttacatcttttcctatctttccctactaataaagcagctaatgcttctggtcatccgtcgctgtcatttttgcaaaaaagtccccctattttcccgaaattaacgcgcagtcctacttaaattgtagataacgtttgtttttttgcaaaaaacaccctgcctctactgaaccgcttgtcgccgncgtcgacaccacacaagcaaggcaggggatgcgtcncggcggacgtgagcgccgccanagcccacgaatggggcgangtgccncgactggngttgtacagcgcggcgtacanagcntcnccgcgggcgttgaangcgccgtggaccgagngtcccggcggnggacccgtcaactgganctcgcctccagcttaggaggccgcacnttgcnaacgggcggcacgtggcgggaacccngcaaatccggcacggaacn

SEQ ID NO: 90093 - DNA, 486 bp, Triticum aestivum
  unsure (1)..(486): unsure at all n locations
  Clone ID: PAT_TA_90093
gaagctcctagccaacaccaatcaaagcctccatccaatcccaagcaacctcgaagatgtcttgctgcggaggaagctgcggctgcggcagcgcctgcaagtgcggcaacggctgcggcggctgcaacatgtacccggaggtcgaggccgccggcgccaccctcctcgtctccgccactgccacccacaaggcgagctccggcgggatggagatggcggcggagaacggcggctgcggctgcacccagtgcaagtgcggcaccaagctgcggctgctcctgctgcagctgctagtcattgatcatgcatgcgccgcgtgcatcatatctatgatctatctaccatctaatnacatgttacctcctgatcgangnctttgtatgtatgtacgcacctgcctgcatgaacaaagcgggtgccatgcatgcatgttaaccctaaataaanctcccgtggtttgctacatctgttgttaaaaaaaaaaaa

SEQ ID NO: 90094 - DNA, 468 bp, Triticum aestivum
  unsure (1)..(468): unsure at all n locations
  Clone ID: PAT_TA_90094
ccgtcgcgtcactgccccgtccccccctccgcgctcgctcctgctccccccctcccctccgcgccggcaacagcaacagctctgggtttagcggcggcccggcgtcggccggcggcagggacagctccaggctcgatgtctcgccctacgctccgcccaattaccccctgaacccgaggcgacaacaacagctagctccgtacaggctaaagtgtgacagggaaccacttaacaacaagcttggaccacctgacttctatcctcaaaccccaaactgtcctgaagagacgttaaccaaagaatatgtacagtctgggtacaaggagactgttgaaggaatanaggaagcaagagagatngtactcagtcatatctcatacttctgcaagccagatatagttggnaaatgcaaggaggcactaaagaaatggntaaaggctaataatgaatctcgtgctcaaaaanaaa

SEQ ID NO: 90095 - DNA, 466 bp, Triticum aestivum
  unsure (1)..(466): unsure at all n locations
  Clone ID: PAT_TA_90095
gcatttcatcatcttgaagacgttttggacgatcttgttgtttctctctgcaaattcaccactcttttgaatacctctttggtcgaggaaccagtcaccgcctttggagatgatctgaaggctagattggcaactgagacactgtttaccatagctaataaatatgggcattacatacgtactggttggaggaatgtattggattgcatcctgagactgcataagctagggcttcttcctgcccgtgttgctagtgatgcagctgatgattcagaagtttctgctgaaactgtccaaggaaagcctgttcctagctcaatctccacatctcacattccagtgatgggtaccctcgggaaatcctccggactcaagggaagattaatcaactactccccgcttgacancnaaggaacaaagatnacaaccaactgagcaacaacttgctgccacaaaaggaccttca

SEQ ID NO: 90096 - DNA, 464 bp, Triticum aestivum
  unsure (1)..(464): unsure at all n locations
  Clone ID: PAT_TA_90096
cgagtttttttttttttttttttaatacacgtgctctggtgtattataatgcatcgtaaaattttccttgacaatttaaggccagtgctaggcgtcggtccaccggcgctagctttgggccggtcctgcatgcaccgtacgatgtgactttttgcagccgtctgatccagctttaatcccgactcgctcgtgccttcttccttcatacgtcttcctcacaaggcccacctctccactgcatctccgttcctcaaaaacagcatatgccgtctcgatttcccagcagcccaacgacgcaatatctgcatcagcgatcgtcggctacagtagccaccggcaacccgcgctcacccttggccgtccgcgctcgccgtctcccgtcgcccctccggaagatgaggaagacattgcaactctccgttggtcanttcaacaagggtnccccctggttgnaaaattctgga

SEQ ID NO: 90097 - DNA, 454 bp, Triticum aestivum
  unsure (1)..(454): unsure at all n locations
  Clone ID: PAT_TA_90097
gtcgcgcaggtgcaggcgctccacatcaaggccaccggcgcaaggcacatcgtcaagttcgccaccaagtgcttcatggacgatgaggagactctcgccatcgatggcgaggccatggcttttctgccgacactgcagctcagcgcggaggcaatcaagtgacaagtatgttcattagaaccatttggaataggacgaattttatctcatgacgaaacatgtcgccttcgcataagctccgggcctaggggacatgagattgcagctttgttggtaatacttcgttgcagccttcctgttatgattaacagcatgagcaaagagtagtagatcacttcagttttctgaacattcaattggttgggtgttcatgctgactgtggtangaactgaagaattcaacagaataatttgaaccactaggcatatcagtggatnactcagtctgctccan

SEQ ID NO: 90098 - DNA, 243 bp, Triticum aestivum
  Clone ID: PAT_TA_90098
ctcctctccagcacccaaccatctcccgcaattcaccgcgccggagatgacctctacacccgcgggcgacgccctgccggcgctgccgccgatcaggacgagagcggcggccgccgatcctgcgcctgaccacgcgtcggcctccacgacgacggtgccggaagccgaggccctgccggcgccagcggtggcggaggaagaggtggtggcggagtcccggacgccggctgcggtggcgagagg

SEQ ID NO: 90099 - DNA, 552 bp, Triticum aestivum
  unsure (1)..(552): unsure at all n locations
  Clone ID: PAT_TA_90099
ctttacacaactacacgagcatgcccacctgcttgcaaaagttcgggtcatttatccatagttcaaaaaatatgtagttatctataatttgagtgcttctgttatttgcaattttggtcattaccaatcaacatgaacattttttctactaaccatttcttaaaatttatcaacaatttggcaatatcaaattgtgtatgaaaattttacaaacatgaacgcttattttcaaaaaaattaaaaaatcccaacaatagatgaaaagtttgaacacgaattgcaacccacacactttatcaactttttacgaaacacaattagatttatgaatataaaattgaaaacaggaacattctaagaacatttttgggtanccanactatattcaattttttgaacggaatcanaaggataataattcanaaaggagaaataattagaaaataaagganaatgaaaagtagaaagaaanaaaaaaaacactcggcgcgacacgctatcaatccgcggcgcangcggcgggagcatcaagtcgggcaatcgcctaagngg

SEQ ID NO: 90100 - DNA, 582 bp, Triticum aestivum
  unsure (1)..(582): unsure at all n locations
  Clone ID: PAT_TA_90100
gaaaagtgtagttgcgtcggcagtcttagcttaagattgtctaaccttttccttaaaaaaanccaatttcattattttcgcttgcgttaataattttcttacagtatgactggggagctaggtgacgattttgagtcgatggaagggtatgaggaagagagtcagttcgtggctgaccgggaaagaggacgtgaggatgtggaggatcaggaaggaatgttgcctgttcccaacgtgcagttgggattcaactttatgagagatcgcagaaaatacagatatgatgtatttgctgcgagagtgaacctgcagtgtctttcgctgtaccaaaaacgtcgtctgagtgccacagaagcangcgattgttggacaattgcactgtcccttgggttgggacatgctgggatcgctgagncgctgcttcgataagcataattttcaacatacttgaatggtgcacattgngcaggatatcaggtgattggaatgggagaaatagtanccatgaaattgtangtcctgttgggcaggaatgcaaggagttttccgccanagccgatgacnttcacctcataaaaggtn

SEQ ID NO: 90101 - DNA, 566 bp, Triticum aestivum
  unsure (1)..(566): unsure at all n locations
  Clone ID: PAT_TA_90101
ccgaggttgcaaccgggactaatgtgtatattgcgctgtgaccaaagccctgttttccaataatggtagggctcctagtaactagaaccaaaggcacgcgttactgcatagttgtaccttaccgttgttgaaacaactatttctacatgcattttataagaactaacgattatcttaaaacactatgaattggccggcctcatggagatgcaggttcggaacctctaataaaggagtagattgtcattgacatcagataaagtggttttgcctatgaacgacgcaattgccagctccatccgtacgtgcacacatatatggtccaaggtgggcaaaccataggcatataaacaaagaactacagtgtgtatatgtatgaanatgcgaaacattcatgtcaataacctgtgactatcaaagagagataaatatgtaatgcatgatattaagctagcaaggaccccagaatattacacatatggtcataatactgaacttatgaatctcacgatatcaaaaagctccctatcangaaaggagatatccagtagtgccacaaataaaaa

SEQ ID NO: 90102 - DNA, 262 bp, Triticum aestivum
  unsure (1)..(262): unsure at all n locations
  Clone ID: PAT_TA_90102
ccgangtcacgagcagacgggacagtgcagagcttccctggttgaagaagtttaggagcaacgatgaagagtagcacactcgtggtcatcctggttctccaggccgtcctgntcatggggatcctctcacaggccaacgctcgagttcccaaagtgcttgcgacaccagcangttcttctcgggggccgtgggtctgcnanaacgccggcccaatttgcnnaaagggggggctaaantgccngttttttatncnnggcccta

SEQ ID NO: 90103 - DNA, 441 bp, Triticum aestivum
  unsure (1)..(441): unsure at all n locations
  Clone ID: PAT_TA_90103
caagaacaagagggtcctcatggagagtatccaaaagtccaaggctgagaaggcaagagagaagaccctctctgatcagtttgaggccaagcgcgccaagagcaaggcaagcagggagaggaagcatgccaggagggaggagagattggctcagggccccagagatcatgcaccagcaccagcggctgcagctccagctccagctccggcagcagcggcaccaaagaaggcaaggccaagaagtgaagtctgacatgaactttactttcnggtattataaaggttacctgattttgggncatctgaattcaaaatgtttccggngaanaccggttnncccgtcngaanncttaaattcaaaccgtttgtnccgttgggnttcaaaaangtnngcaggttccttaaaaattgggtcncggacctatttncaaaaaaaaaaaa

SEQ ID NO: 90104 - DNA, 562 bp, Triticum aestivum
  unsure (1)..(562): unsure at all n locations
  Clone ID: PAT_TA_90104
ccgaggtgtctcgagtttttttttttttttttttttttttttttttttttttttttttttcttcaaagaaaagcatggccacatccatcatgccatgcttagcatagcattaatcagtatgttgaaacaacggacgttgggtatgatacgatctcctgccatcagctcacagagatcaatcattttaacaagggatccttctatagcatacccatggagcataatagggtatgagactatatctggtttcggccattcacggccatggaataaaatatttccctcagcttctttgattcttccaagcttgcaaagtagnccatgactgagctgcaaataaaactttggatattaccttggttttcattactttcaacaacataacactctttgaacttgcccaaagtggataccattgatcaggcnagtatatgttacagttcggtgggcaccatcntgacnatttcnaagaccactctgccttgtcattgctctgctttgcanangcancataggggggctatacatcacaatgggaaanccctgcgaannatttntgana

SEQ ID NO: 90105 - DNA, 190 bp, Triticum aestivum
  unsure (1)..(190): unsure at all n locations
  Clone ID: PAT_TA_90105
ggcaagaaggacggngaccacaaggagaagaaggacaagaagaagaagaaggacaanaagcactgcgagggccananngactacnacggccacngnagcagcagnagcnacagctacagcgactganccagctccggccgcgctccgngcatcatcgttcagtgtaagcganatcganganngcttggga

SEQ ID NO: 90106 - DNA, 274 bp, Triticum aestivum
  unsure (1)..(274): unsure at all n locations
  Clone ID: PAT_TA_90106
ccgaggtagccgccggccttccagaaaaccaagctcatgacccgtctcacctacacccttgacgagatggaaggcccgctcgaggtcggcgccgacggcaccctcaanttcgagganaaggacggnatcgantacgnggccntcacngtgnatctccccgggggngaacnagtgccnttcctcttnaccgtnaagcanctcgtcnntangggaanncccnatatnttgagngggcntttnctcgtgcaaaaaagggggntttctttttcctaaa

SEQ ID NO: 90107 - DNA, 157 bp, Triticum aestivum
  unsure (1)..(157): unsure at all n locations
  Clone ID: PAT_TA_90107
ggccgaggtctagtctcgagtttntttttttnttttttagggnngttagcantgtttttcgtntaatcnacaactgtccgcacaaatgttcnttacagntgaatcaagngaattacntcanaggganagttatttcgnttangagatgtctcaccaa

SEQ ID NO: 90108 - DNA, 223 bp, Triticum aestivum
  unsure (1)..(223): unsure at all n locations
  Clone ID: PAT_TA_90108
agncgangtttttttttttttttttttttttttggactgaaaccaggcatgctaatttgaattatctagggnatcatttacctttaaaaacaaaacnaggnacagtangttanactgacaanaacctcntaacaccatgatttgcnttttcncncngtaaaaatggacntccctcnaaaccatcacatttccantccaacanttctactgaaanctaaatggg

SEQ ID NO: 90109 - DNA, 526 bp, Triticum aestivum
  unsure (1)..(526): unsure at all n locations
  Clone ID: PAT_TA_90109
ccgaggtcaacaacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcnacgagccccgaaaatgtggcgctgccggatatgaatccaccgtcaanggactgcggtggaccttgcaanaantacgatcggttatgccggnatgatatttccgccnaaataaataaagccngngaatgccangtatnggccaagctgtttttggcanaatgntaccattgtcncctcgcnnggttttcccccnaaaaattgggttgctgtttnantnccgganaccccgtaanaacagngaagantgncgggccc

SEQ ID NO: 90110 - DNA, 346 bp, Triticum aestivum
  unsure (1)..(346): unsure at all n locations
  Clone ID: PAT_TA_90110
gtttttttttttttttttttttctctttttttccncacacnttttttttctntctctccctttttttctgacntttttttctccntttttttctctcgntttttttctcttttttttctccctctntccaaaacaaactaaataanatncagattggntcaagtgaagatgtgaacgatntcaactatnattatgacaangaatggtgggtagnacatggnggaaattganggatgggtggtggacagcnnaagagataangatgcancggtggngtgactaatgtgancanaactcgaaactctaaacgagctatacactangaccagcaantcnacacgacaat

SEQ ID NO: 90111 - DNA, 525 bp, Triticum aestivum
  unsure (1)..(525): unsure at all n locations
  Clone ID: PAT_TA_90111
gagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgancccgaaatgtggcgctgcgcggatatgaaaccacgtcaaggcactgcggtggacctgcaanantatgatcggttatgccggatganatntcngcctaaataaataanaccaggcaantgagaagtcactccnagnttttgtgnggaaaaagttaacanntgtcnccctcggcccnggtttccccccnaaaaaanntgggtgctgttgtanctacggaaaaccccgtaanaaaanttnanattgncggggngcaaaaaattttcttt

SEQ ID NO: 90112 - DNA, 294 bp, Triticum aestivum
  unsure (1)..(294): unsure at all n locations
  Clone ID: PAT_TA_90112
ccgaggtccatcccatcccccaagtcataaacccaagtcggactcgccttcctcctccccaactactcctctcctccgcgcatcgcatcgcaccgggggtcacctgagatcacatacacaatggtgaaggctgtggctgtgcttaccggcagtgagggtgtcaagggcaccatcttcttcacccaggagggagatggcccgaccaccgtgnacgggaancgtcactgggactcaanggaaggctcaanggttcaacgtgnacctcttggngacaccacaaanggntgcatgtca

SEQ ID NO: 90113 - DNA, 562 bp, Triticum aestivum
  unsure (1)..(562): unsure at all n locations
  Clone ID: PAT_TA_90113
ccgaggtttttttttttttttttttttttagaataacagggcagaatctcttgattcaaccaaaacacaaccacaccaatttcacgattaccattacaaagcaaatcccacaattatcagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaattggtcagcagtccctccttgtagtaagcgaacaccacgccgccatcatcatgcatgctctcgccaacaaagaactgaaggccttgacttgctaagaagaacttgtggcggcncaacatctctgaaacactagncacccctcaagctggcagaaggtctgatgtaccctcagtgagagataactgctctgtaaaacaggtgctctnagacgaagtgtacaatgtaacacttacgccggtatacanctcactacacacctcacaaggatggtccatgtcan

SEQ ID NO: 90114 - DNA, 320 bp, Triticum aestivum
  unsure (1)..(320): unsure at all n locations
  Clone ID: PAT_TA_90114
ccgaggtctcgagttttttttttttttttttttttttttttttttttttttttttttttttttttttttttttttttttttttttttttttggncttaanttcaaaggncantttcnaaacccatgcaanaaaanatatcaantcnaaacccaattctanannaaaaatattttangnggggtaaaacccaancaaaaantctttaaattcaancttcagggtatncctgagggggnaaaanccaaaantanttggccncggccctnttccngggngaaaccncggnaccttcccnnaatttgcccttnaacctgcaagg

SEQ ID NO: 90115 - DNA, 481 bp, Triticum aestivum
  unsure (1)..(481): unsure at all n locations
  Clone ID: PAT_TA_90115
cactatcatancanaactgatcaagaacccttgtgcagtacttcccanacagccantggcaggtttactcctggatcagtttggagggcagaatcacacaaccaaactantattcttggtacatggcagcaaccttcaggaggtcactgcatcagggactttcagaacaggactggttanccgttacgggcagcttcttcgcaaagaaggttcanttcacacggaaatgctgntcctcacctttggagtatgaacaaagagaagcggctcgggaatcatccacgaagagcaccatncacatacaggggacaagcaccccaccagggagttggtgcccgagttacanacatgccttcatntcatgagagagcatctanggtgtccgcatgagcatcnagtaacactcggatganagaactcannttgggtgcagantncactctgagctgttccaggatttgcagttctganaccagggtaa

SEQ ID NO: 90116 - DNA, 556 bp, Triticum aestivum
  unsure (1)..(556): unsure at all n locations
  Clone ID: PAT_TA_90116
gagctgcctagtggcccttccttcccccagctacatgctgttagggtttcggcgtccagagtgggggcatgcccaagctgttcttcccctcctctgctctgagttgtgacttatgacacatcaaatcaaactgagagatgagatggagggaagaacatgcatatgctggtagatagtgacaggtggggttcccctcaacaaggggggagggagtgtgtttgaaagagttgaaagggagatttgangaaaggaggagaacgaggagctctgtgtaaagcttggaaaangattggcagggttggcttttancgtgcacaagtttacttgcgatgactcgcctctgtctctgtgtgttgcttttgcttantgaaagatggatttgnttcacntttggcagaagaattgtccaggattaaagtggtngtgctgttgacanactgacacattaggagacatgtgtttcnaanngggtaaagnattgcngggttctnatcagcttnactcgtggnagcttcaagggacannntgacttgaanaaaacnaataaaanaaaang

SEQ ID NO: 90117 - DNA, 186 bp, Triticum aestivum
  unsure (1)..(186): unsure at all n locations
  Clone ID: PAT_TA_90117
ccgaggtgaggatgagaagaangatactgagganggcaaggttgnggaaattgatgaagagaaggaagaaaaggagaaganncagaagangatcaaggaggtttctcacgagtggaacctgatcaacangcagaagcccatctggatgaggaagcctgangagatcaccantgaggagtatgctgc

SEQ ID NO: 90118 - DNA, 556 bp, Triticum aestivum
  unsure (1)..(556): unsure at all n locations
  Clone ID: PAT_TA_90118
ctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctaccagacctctcatcaaggcaatgacactatcaagctcgacctggagacaacaagattgttgactnaacaattcacttggnacgtggtcatggtgactggngggcgcaaactggcggttgggtntaagacaggagaacataggaacttgagacatcacgtgaggtgcaaggcacantcgcaccgtctgggaagtttacatggnangcn

SEQ ID NO: 90119 - DNA, 469 bp, Triticum aestivum
  unsure (1)..(469): unsure at all n locations
  Clone ID: PAT_TA_90119
cttaggtttcagttctcctccgcctccggtctcgagagctcgccagaatggtcgcccacaggttccaccagtaccaggtggtgggtcgcgcgctgccgacccccggcgatgagcancccaagatctaccgcatgaagctctgggccaccaacgaggtccgcgccaagtccaagttctggtacttcctgaggaantcaagaaggtgaagaaggccaacggccagatgctcgccatcaacgagatctttganaagancccacaaccatcaagaactacggaatctggntgcgctacaaagcaggacggttacaaaacatttcaggagtaccgcnacacnaccctaanggnggtntgaacanntntcacggaatgggtaanggaccgcgtgttnccctgnacannttatcaangtgcanggggctcanntgtaanggggnaacanagnattcaaacccaanataantcccgt

SEQ ID NO: 90120 - DNA, 382 bp, Triticum aestivum
  unsure (1)..(382): unsure at all n locations
  Clone ID: PAT_TA_90120
ccgaggtgagagagagagagagagagagagagagagagagagagagagtttttttttagcgaagaaagacatgagttacctaagtgcgtttcagtaatacaaaggagataccaagtgtggagtacgtattaacaagtcattcgaaggacagagaaacagaaatgacaggttgcatataaacttgtttaacaagctgcatagatcacaggtacaagtagcacgcccatcgccccgaccatcaagtcattccgttgcctcactgcatgcacgcttctcatgcctcagtgtttgtnncctctatgccaanggagacggtgccttggggacccganaggatttggtcgaangggttctggtannctggcnggncttanttccgtga

SEQ ID NO: 90121 - DNA, 214 bp, Triticum aestivum
  unsure (1)..(214): unsure at all n locations
  Clone ID: PAT_TA_90121
ttttttttttcacagaaagaacacttttattcaataatataattgtgttccacactatagattccttaaaattgacacctacacatacttggtgttacaacaagaattgtaacatctcatgtgttggctagacaaagaaatcataaatattgcatcaaatacatcacctctcatgagagtgttgaatccttcaggtanctgctgctgacctcgg

SEQ ID NO: 90122 - DNA, 167 bp, Triticum aestivum
  unsure (1)..(167): unsure at all n locations
  Clone ID: PAT_TA_90122
gcaagggtgcntgtgcctgtncgtgtggtttacttgctcnctctccgcctatgctctgcccttggtgtccttgtgtgtatgtgtgtgcacgtgtccctgtaattgcttcatctatctccactatggatggagtgntgaatatntaagaangaatnatttacctaatt

SEQ ID NO: 90123 - DNA, 259 bp, Triticum aestivum
  unsure (1)..(259): unsure at all n locations
  Clone ID: PAT_TA_90123
ccgaggtctantctcgagtttttttttttttttttttttantatannacaatgctctataatgattatananaagagatganngtctgcanattacatatagacgtgatagatacaagtaantaccaaattctcactctaaaananantacatgtnntcacccgtgataangantacagcantagttaacaatatnaaanctcatatgtgcncgtggtaactgatcaatatangcnttcaagccangacaccagccgcc

SEQ ID NO: 90124 - DNA, 578 bp, Triticum aestivum
  unsure (1)..(578): unsure at all n locations
  Clone ID: PAT_TA_90124
ccgaggtgagagagagaactagtctcgagtttttttttttttttttgacagttacatctttttatttcacttcaattaaaagctcctgtgcgagctattcttccagatacctctagcctcaatcattacagcttccgaaccagctcaaaaggttcgacaaattccaacacaaatgttatttttttaaatacatatttgggagtttaggggttatccagcttcttagagccaataccagtgacctcaattgatatgctggaagaagagagtggtttgtcttcctgcctctagtctaaaatcggaagattcgtatcacgtagctggtaccttccttgacttagttttgtacgcaggtgtgttgccccaataacaactactagcagctcaataaaaatgtgaccaatacataattatctggtgctcacatattttattttagcgttcaacatgccgtagttagtctcatgagatgattgagcgatacaaccagtcagtactcgaatatcggatcaantccacgatgctcgacangcttcggtatttctcatctcgtcatcttcaactgccgggcggcgctc

SEQ ID NO: 90125 - DNA, 184 bp, Triticum aestivum
  unsure (1)..(184): unsure at all n locations
  Clone ID: PAT_TA_90125
ccgaggtgaagtctcgagtttttttttttttttttttttttttttttttgagatgttgtgcaatananactccacagggtagtacattgttgacaaatatacaacacgcaacgattttgcatctttgaataaatcaccgaatatccgaacaaagcttgcatcatatttaccaaacaacaacctg

SEQ ID NO: 90126 - DNA, 238 bp, Triticum aestivum
  unsure (1)..(238): unsure at all n locations
  Clone ID: PAT_TA_90126
ncgaggtttttattatgccattgaagggggggggagataataccgatttaagagtagttcactactgcaataaaaaaaaagagaattctagttaacgattccaatttgttctgaattttgcagcctgtgaatagaaatccaaattttcctccttttcaacctcaatangaaaagaaatgggaaattttaatngtnttaacantggtncgttttaagatngaaccaatccaggagaata

SEQ ID NO: 90127 - DNA, 473 bp, Triticum aestivum
  unsure (1)..(473): unsure at all n locations
  Clone ID: PAT_TA_90127
agatcatcnaagaattgccgcaagcccgcccgtacctttcgccgtccctcttcgtgcgcagcgcgttctctccgacggcggtgttcttcaccattgactgtgggcaangaggggagagtgtcttggaggagatantgcagggtcatcttgcgtcagttgtgacggcggttcntcagatttggcttgatacttgcnccgttggcacctcngcaaatggnagagggcgagagggagatcatggtcaananggaccgaactntgagatcaaagtcgatcgangtcgatcctgaccgcanatttgccnaagatgtttggccccgacgtgtccggccgcgncatcgccganaatcgtaaagggcctttggggtacaagacncctagcattgacaagtangaaagtnactttacattncaagccaannggcaatgttaaaaantnngttggggggaaatnttcanctccgcagtccgta

SEQ ID NO: 90128 - DNA, 158 bp, Triticum aestivum
  unsure (1)..(158): unsure at all n locations
  Clone ID: PAT_TA_90128
gaattcacnangtgattcgatggtcgcggccgangttttttttttttttttgtcaaganangtttaatttaggtatgtttgcattnccgatagggtgaagacagagnagtntnaatttagtagcagtaaacagcgatanactaganagcccagaatag

SEQ ID NO: 90129 - DNA, 553 bp, Triticum aestivum
  unsure (1)..(553): unsure at all n locations
  Clone ID: PAT_TA_90129
ctagtctcgagttttttttttttttttttttcagggaagttcacctacaatgcataatcactgggttaaggtacacacacatccccagtggatcgacaaacaatgtcagcttgctccaacctccaatcaggatacaggtttatcggattacatcaactagactaggaatctaaaaacagagagagctagctagagcagagagattgaacagagctaattaagctgactagagaactagagacggagaaatagatagatcgcagctcagacgagcactgccctcacatactagagctacggttcagagctgctctgggggctttggtgcctctcagggcgacaaacagtacatgacagcaccatatggattgcaaagtangccagcacagcaaagatgagcgcgacgacataaaccgacgtcttccactgcctgttgggagcccgctgcataggacaccaaggagagtgnacaaatccagtaggatgtccaantcatcaacctcaagcgacaattcccccaatcctctttcttanctngggccgcgacaagcnn

SEQ ID NO: 90130 - DNA, 583 bp, Triticum aestivum
  unsure (1)..(583): unsure at all n locations
  Clone ID: PAT_TA_90130
cgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcatgctggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctcactggagagtggtaacactaaggatgacctgaagcttcccactgatgatgttctgcttggccagatcaagactggattgctgatggcaaggacctgatctgtctgtgatgtccgccaaggggtgaanaacagatttgcgctgtganggaanccgtggtggaaataancaactgttcgtggttgctaactgcaatt

SEQ ID NO: 90131 - DNA, 226 bp, Triticum aestivum
  unsure (1)..(226): unsure at all n locations
  Clone ID: PAT_TA_90131
gagagaactagtctcgagtttttttttttttttttttttttttttttttttttttttttttttttttttganctggacaacgaaatttgttttaggataaactgtttccacacctctgcagtgcantgcagtacaacacnatcaacanatatnttcatcaaantccnatanagtgtctacnanttgaaatcaaatcaaantccaaggagtatgnaaacaaanccat

SEQ ID NO: 90132 - DNA, 541 bp, Triticum aestivum
  unsure (1)..(541): unsure at all n locations
  Clone ID: PAT_TA_90132
ccgaggtcaccgatcaccagcacagccgcgcatccaccgttgctangcaangtcgaccaagcagcaccgaggatggctgctgccttctcctccaccgtcggtgccccggcttcnacgccgaccaacttccttgggaagaagctcaagaagcaggtgacctcggccgtgaactaccatggcaagagctccaangccaacaggttcacagtcatggcagcggaaaacctcgacgagaagaggaacacggacaagtggaagggtcttgcgtacganatctccgacgaccagcangacatcaccaganggaagggcatcgtggactcgctcttccaggcgcccacgggcnacggcacccacgaggccgtcctcagctcctacgactacgtcagccanggactcaagaagtacgacttcgacancacatgggagcttcacatcgctcctgctttcatggacaagctgttgtcaactctcangaactcatnacctgccaacatcngatccancatctggtattgggaagnaaggtcangananattg

SEQ ID NO: 90133 - DNA, 392 bp, Triticum aestivum
  unsure (1)..(392): unsure at all n locations
  Clone ID: PAT_TA_90133
ccgaggttttttttgaccaaaacataaccacaccaatttcacgattaccattacaaagcaaatcccacaattatcagaaagttttcaagacactcaacatctgatagttaccggcacancattggagantcgatnngaacccatagncncagagcaaaatncngactaccgcataggttttagcatacagtgcgattagcacttgacctctttcagcccatgtgcaaagtacaggaaagttggatcagcanctccctccttgtagtaggcgaacaccacgccgccatcatcatgcatgctctcgccaacaaagaactgaaggtccttgagcttctangaagatactttgtggcagactcaacattcttcttgaaaacatcaggtcancccct

SEQ ID NO: 90134 - DNA, 471 bp, Triticum aestivum
  unsure (1)..(471): unsure at all n locations
  Clone ID: PAT_TA_90134
ccgaggttttttttttgaccaaaacataaccacaccaatttcacgattaccattacaaagcaaatcccacaattatcagaaagttttcaagacactcaacatctgatagttaccgacacaacattggagagtcgactgacaaccatagagcagagcaaaaatactgacgaccgcatanattttagcatacagtgcgattagcacttgacctctttcagcccatgtgcaaagtacaggaaagttggatcagcagctccctccttgtagtangcgaacaccacgccgccatcatcatgcatgntctcgccaacaaagaactgaaggtccttgnggcttgccaacaagatacnttgtggcangactcaanattcntcttgaaaacatcnangtcaatcnccntcaagcttggcagaanagggttcttgatgtaacgccttcatgtngagagatnaactgcntcntggccaaagc

SEQ ID NO: 90135 - DNA, 419 bp, Triticum aestivum
  unsure (1)..(419): unsure at all n locations
  Clone ID: PAT_TA_90135
ccgaggtctcctccacacaagtgaagtgagagctttgcgctgaaagttcatcagcaactatgaggggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgttgtgtcgacnanccccganattgtggcgctgccncggatatgaaatccaccgtcnannggaccctgcgggtggaccctccaagaagtactgatcggntcatgctggcanatgatatnttccgccnaaantaantaanggctcggtcnnattagcaacgtcagnntccnatgcntttct

SEQ ID NO: 90136 - DNA, 407 bp, Triticum aestivum
  unsure (1)..(407): unsure at all n locations
  Clone ID: PAT_TA_90136
ccgaggtgaaactagtgcgccggatgtgggacttgtacacgccactggtgatcatgtatggcttccgcggttctggcaagaagcatttgaggctgcatatgaggagcttgctggtgatgatacgcctgcaagtgacgcagctgtatcggagattgctcgcatggcaattcacaggcctgagcttgagcaggcaggtaataataattagaaacagtacactgtgaccatttggagaagtggaggcccaagcctccancgtgaatgagtagatggttcatgcaaaatttgtctgtccnatttcaagagaagattttttacaaaacgatcatttcaacgagaagatcacttnctaactgtgatcatcnnatcatttcaanttctnccnttatctttcatctcnttgngca

SEQ ID NO: 90137 - DNA, 421 bp, Triticum aestivum
  unsure (1)..(421): unsure at all n locations
  Clone ID: PAT_TA_90137
ctagtctcgagtttttttttttttttcccaaacnaaanaaactccattattccacatcatatccaagacattacatagacaccaacaaacagatgggttgacacagattatggactggatatccaccatgcgagaaacccacatgatattttgaatgaaagatagaaanagggtatgctagctaacgcatactctaatgacacaggcagaccacaacaacgacctatcacactacaagcaaaatgcaaacacatttccccatcaaattactgacattggcgctagtctttnaagggacnagatccacctcaagcngcttgtgtaatancccttgntgaancgtatacnaatattnagttctttaataccancttcaaacntccaggccgggagattttnnaactattatccctgtnccata

SEQ ID NO: 90138 - DNA, 531 bp, Triticum aestivum
  unsure (1)..(531): unsure at all n locations
  Clone ID: PAT_TA_90138
ccgaggttttttttttttttttttaaccacaccaatttcacgattaccattacaaagcaaatcccacaattatcagaaagttttcaagacactcaacatctgatagttaccgacacaacattggagagtcgactgacaaccatagagcagagcaaaaatactgacgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaancaaagaactgaaggtccttgagcttgctaagangatactttgtggnagaccaacattcttcttganaacatcnaggtcatccccttcaangnntggcagangangttcctgatgtatcgcctcatntgggangataancggcttcctggcaaaagcagttcccccgaagacgganggggcaacaangtnaccagctgnangggccnaaccgnnctnggctttt

SEQ ID NO: 90139 - DNA, 313 bp, Triticum aestivum
  unsure (1)..(313): unsure at all n locations
  Clone ID: PAT_TA_90139
caagaacaagagggtcctcatggagagttatcaanaantccaangctganaangcaagagagaagaccctctctgatcagtttgaggccaagcgcgccaagagcaaggcaagcagggagaggaagcatgccaggagggaggagagattggctcanggccccanagatcatgcaccagcaccancggctgcatnctccanctccatctccggcagtagcggcaccactttaaggccanngccaataagtgaangtctgagatcaatgctttaggctttctgagtannacgaacggttcgcctnagttttggagc

SEQ ID NO: 90140 - DNA, 349 bp, Triticum aestivum
  unsure (1)..(349): unsure at all n locations
  Clone ID: PAT_TA_90140
caagaacaagagggtcctcatggagagtatccaccaantccaaggctgagaaggcaagagagaagaccctctctgatcagtttgaggccaagcgcgccaagagcaaggcgagcagggagaggaagcatgccangagggaggagagattggctcagggccccagagatcatgcaccagcaccagcggctgcagctccagctccagctccggcagcannggtaccatagaangccaangccaagaagtcaacgtctgacatgaagctttnnctttctggtatttannantgggttagcctgattttggnagcatctgcannttcatcacctgttttcttntgtnnctaacc

SEQ ID NO: 90141 - DNA, 168 bp, Triticum aestivum
  unsure (1)..(168): unsure at all n locations
  Clone ID: PAT_TA_90141
aagaggacaggtatgtttggcatacacnaatngntggcgcacngggacanggaagaactcnaacgaanctttggntgtnatgatgaactataaccccactcgggaagtacttaacnctttactggacanccacantnaggaccancttttggaggatcntgcanatga

SEQ ID NO: 90142 - DNA, 378 bp, Triticum aestivum
  unsure (1)..(378): unsure at all n locations
  Clone ID: PAT_TA_90142
gaattcactagtgattagcgtggtcgcggccgaggtttttttttttttttttttttttttttttttttttttttttttttccaactttacaaaaattttcccnaatttcanatttattttcaaaccgccnancgcaaacgcagctcanacactatttcgtatgggcctatttccanatttcanatccatcggtgttgggaaggttctaaaaatttccttgaatcatttttttgtttnnnttgcatttttntcanattttcatttttccctttttttcatttttcctttttttttaaanttttctaatttctaattttttattacttcnatttttctgcaagcatcttttacctcggccgcgacnacgctaatcaangt

SEQ ID NO: 90143 - DNA, 528 bp, Triticum aestivum
  unsure (1)..(528): unsure at all n locations
  Clone ID: PAT_TA_90143
gaattcactagtgattagcgtggtcgcggccgangtccgcaccgcacnaatnaanttaaaactttncaacaaaaatttaatcancnaccatnaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgcnccaanggctgntcngcntgccgcgtggtgtcnacgagccccgaaatgtngcgctgcgcggatatgaaatccaccgtcnacngcanggggggtgggccctgcaagaantactgatcggctcatgccagcatnatatttccgcctaaaatgggntaaanaccggagaccanattacagcgtcatcgtgcgnggcgngtntgtgttgccaacaaatagtttacaattatcctttcttcntccttgttttctctctcnagagaaatttntnttgcttgttttcaaa

SEQ ID NO: 90144 - DNA, 247 bp, Triticum aestivum
  unsure (1)..(247): unsure at all n locations
  Clone ID: PAT_TA_90144
taattcactactnattatcntcgtcacacncccatntctcnaattttttttttttttttttaaanttacntaanatttcaattttccctaacaantccnttcttaatcttntacctanaactcaanatcanttcaacattactnactnacatanttaacttcaatataacaacaacacctcattctacttccactaaaaacacacatnncaacacatnataattataaactcanntctttctcaccc

SEQ ID NO: 90145 - DNA, 534 bp, Triticum aestivum
  unsure (1)..(534): unsure at all n locations
  Clone ID: PAT_TA_90145
naattcactantgattancgtngtcnccgcccaagtctaatctccaatttttttttttttttttttaacnacaanaataccacttacaaaccaantctcnctcntcacantccaanttcannaatacaatacntacnttacacattatcttatcttacanatccnggtgccctgcnattncacccanncaccnatcctctttatttattcttaataacanaancngctctgcttccggatcatctcatccacngcatctctgctcngctgccatatcacttngtcncaattaacancccccacttctgctcnccngcanacctgnggtcaccttcgcnctccatccgttgaccatntcntcgtactcctcctgcnttaantcccccangaaggcctccttgttcttctcnngtctcacccaactccctctccaanaccctcaagaactngtccnttcantcctcaactacnacatcattgaaaaccngcatcctcaancatctttccctaagtcttcacatcattnaagtcatn

SEQ ID NO: 90146 - DNA, 450 bp, Triticum aestivum
  unsure (1)..(450): unsure at all n locations
  Clone ID: PAT_TA_90146
gaattcactagtgatttcgagcggccgcccgggcaggtctcgttacgaagaaattgttaaggaggtctcttcgtacctgaagaaggtcggctacaaccctgacaaggttcccttcgtccccatctctgggtttgagggtgacaacatgattgagaggtccaccaaccttgactggtacaagggcccaaccctgcttgaggcgcttgaccagatcaacgagcccaagaggccctccagacaagcccctccgtcttcccctccaggacgtttacaagattgggtgggcattgggaactgtgcctgttgggcccgtgtttgagactggtgtcatcaaagcctgggtatggttgtcaccttttggtccccactggtcctgacaactgaagtccaagtcccgttngagatgcaccaatgatctctccctgggagngcttccctgggtgacaagtt

SEQ ID NO: 90147 - DNA, 213 bp, Triticum aestivum
  Clone ID: PAT_TA_90147
ccgaggtgatacggagaggtatgagaggcagtcacactaggtgattagtctggggatccatattgcttatgattttggtttttgtacggctttctttctcttctgattcttgcccatgtgcatgtatactactactagattgattaattaacagaccaccgatgtataattaacagttgaattcgaacacagtcgtcatataaaaaaaaaaaa

SEQ ID NO: 90148 - DNA, 271 bp, Triticum aestivum
  Clone ID: PAT_TA_90148
gaattcactagtgatttcgagcggccgcccggcaggttaaactgcttgaagtccaggcaaaaagaggtactctttctacaactatattagtattagtaccgaatttaaacgggaaatagctaatgtaaaatttatctgatatagaacactcatatcgataaaatggtttgaactatttactagaaaaaaaaagggggcaccctgcccttttttaaccaatgccgaatcgacgacctatgtataaaaaagagaaatttttgggatttggaag

SEQ ID NO: 90149 - DNA, 165 bp, Triticum aestivum
  Clone ID: PAT_TA_90149
gaattcactagtgattagcgtggtcgcggccgaggtcagcagctgacgatgatgatttatatagctaaatcctttcgcgttcgtagatgttgtgctccggtacgcagtacacggaagaactatgttcttaagttaatattgtgatgcacagttaaaaaaaaaaaa

SEQ ID NO: 90150 - DNA, 479 bp, Triticum aestivum
  unsure (1)..(479): unsure at all n locations
  Clone ID: PAT_TA_90150
ccgcccgggcaggtgtcctcaacccccacagcaattcctcccctgcgtactctctctcccatggcctacctccaaataaacagctcgccggccacggaataggtgcgtggcgagctggcgatcacggaggagcacacatgaagatgcagaggtgcgcgtcgtacgacgatcagcgagcagaggtgcagtgctcgtcgtcttatatgctggaactagatgtgcgccctctccatggccatccgcaaccagggttccgttagtccgcatggccaagctgcaattgggccacgggggcaacgaatctgtgctggaaccaggttttggttttgcctggttccatccatttgttttggctacaaccctttctcttttttcctaaccatcccccattccgatttcctccaatgaacattttgggattttttggcctgggaacccgggcccctttttttggccngggaaccaacngggtgggatat

SEQ ID NO: 90151 - DNA, 512 bp, Triticum aestivum
  unsure (1)..(512): unsure at all n locations
  Clone ID: PAT_TA_90151
gaattcactagtgattagcgtggtcgcggccgaggttttttttttttttttgggtcaacacacaatcgctttcttctcttccacattcagcagaacgcaaacatcatgcacacaagccgccgtagcaccgtcgttccgtcgcagcaaccggctcggcaccgaccgatttgttgctcctgcctgcatcatcaccctgccgcgcagcaccgccaaactccgccaccgtccgagcgctgcgttgaagcaagggtggccaccggcgactgttgtgttgcaagccccgggcggccggctccgaaatccgaatcccgccggccgccatgggcggcccggggagcatgccacgttcggggcccaattccgccctaataagtggagtccngtaattacaattcaactgggcccgtccgtttttaacaaacgtccccttgaactgggggaaaaacccctgggccgtttaccccaactttaaccgcccttggccaagcaatcccccccttttcgcccaaact

SEQ ID NO: 90152 - DNA, 547 bp, Triticum aestivum
  unsure (1)..(547): unsure at all n locations
  Clone ID: PAT_TA_90152
gaattcactagtgattagcgtggtcgcggccgaggtggataaaccaattctattatacagtgtagttcacaaacatgtcacacggcatgtatatgcatgcataataataagcactggtttgttcatgcatccatcacacataatctaggccaaataaatccatcattacaagttcatccatatacataactccccaaacaaaacagacataccgctcacattgggcgccatcctttttattcccaagaaacatacagtacttgcttattattaagttcgccgcgctgtttggaaccaaacaaactggtagcatgttgccatccattccaccaaggcaacgattctttcccagccgctggtttgttcgcccttcnagtccactccccaacaagaatgagggttnggttcccatccgcgcacacccgcccatggcccttgtccgcccatgggagtgcatccaaagtttcaaagttagatgttggttcaaccatccccggatgcaacggtagccctgccccgacgttcccctgctctcnggtcccaaaag

SEQ ID NO: 90153 - DNA, 555 bp, Triticum aestivum
  unsure (1)..(555): unsure at all n locations
  Clone ID: PAT_TA_90153
gaattcactagtgatttcgagcgccgcccgggcaggtgtgccttgttcctggacagagttcctggacaacggagtctccccctggacctgactttcgccaaatggccaactgcttgacacctaaacaaagggataaaagtaagaggcatggggatgatgatgtcatggatatttggtaaaatggtaacggcgagagttcatcatgcagtaagaaaccagatttgagcacaaggagaacattcttaagaggacggtgcctngggaggcctctatccactccatatcatccatccatccatcttcaatggtcccaaattaaacaaagcaaattattgtcaaccaaagccatccatccatccaanggtgggcataagtccgatttangtcatcccatccttcnagtcccatagtttaaataaggttcccttaagccaaaaaatnaactcctccctttaatggagaatagtggttgagtccantttggtgattcccgtgttntcaacnaanccaaaaanccatccnatttacccctatccccacctcctacnantgtgt

SEQ ID NO: 90154 - DNA, 537 bp, Triticum aestivum
  unsure (1)..(537): unsure at all n locations
  Clone ID: PAT_TA_90154
gaattcactagtgattagcgtggtcgcggccgaggtgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccggcaggacatcaccagagggaagggcatcgtggactcgctcttccaggcgcccacgggcgacggcacccacgaggccgtcctcagctcctacgagtacgtcagccagggactcaagaagtacgacttcggacaacaccatgggaggcttcctacatcgctcctgctttcatgggacaagcttgttgtccanctcctcccaaagaattcaatgaccctggcccaaacatcaaagatccaactcatcctggggttatcctgggggaagcaaagggtcaaaggaaaaacatccaat

SEQ ID NO: 90155 - DNA, 411 bp, Triticum aestivum
  unsure (1)..(411): unsure at all n locations
  Clone ID: PAT_TA_90155
gaattcactagtgattagcgtggtcgcggccgaggtttttttttttttttttttttttttttttttttttcatnacnttttttttttttcatttttatttttttcatttcttttntgggtataatattcacattttttaaangttcctanacaaaaaaaggtatccaacnacgtaccnccgccgcggccaaatgaacgcaccnaaaggnggcngcancnccaaaaangananaaaaaccnctatgtgtaacctcatacaaccaagtacancgtaccaatacaacaacanactgctataccaaggaantgcactgaccacaangatcataccaaangcngcaancaacacaanactgcacaaccggnaagcccacttggnggggctgcaagcaagctcggnaaaancgaaag

SEQ ID NO: 90156 - DNA, 214 bp, Triticum aestivum
  unsure (1)..(214): unsure at all n locations
  Clone ID: PAT_TA_90156
ccgggcaggctcgagttttttttttttttttttttttttttttttttttttttttttttttttttaaaaatcctaattattcttgattatggattgaataagggatnttatggattgaatgtntaaaanaagcantatattgataaanaggntgtnttccaaagtcaaaaaagcnattggcctgcaaaaanaaccncggccgcnacnacnctaa

SEQ ID NO: 90157 - DNA, 386 bp, Triticum aestivum
  unsure (1)..(386): unsure at all n locations
  Clone ID: PAT_TA_90157
gaattcactagtgattagcgtggtcgcggccgaggtgagaactagtctcgagttttttttttttttttttctagagcaanttccatagcntttttntaantaatnancctatcctctatcttctttttnatntttacatttcaatanaccgancccgacatcaggactanataaatattaanaggantcttccgcctaaataaaaatatancatggtcagcagagttgtntctntatttttatttgcncactttaaaanttncaatttcannaacaaaanctaacnaaatanatggnaaatganaattaatacaattctntnttnttttctncaaatccaaaaatttcnctttnttatacataagtcgncaantcggnaatggtta

SEQ ID NO: 90158 - DNA, 617 bp, Triticum aestivum
  unsure (1)..(617): unsure at all n locations
  Clone ID: PAT_TA_90158
gaattcactagtgatttcgagcggccgcccgggcaggtctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactgggacaatgtggaagctgcctatgttcgggtgcaccgacgccacacaagtgatcaacgaggtggaggangtcaagaaggagtacctgacgcgtatgtcgcatcatcggattcacaacatcgcaagtncagtgcgtcagcttntcgccttcaancaacgggctgcaagagtcggnaggccaaacagctactcacacaggcatatataagtgc

SEQ ID NO: 90159 - DNA, 446 bp, Triticum aestivum
  unsure (1)..(446): unsure at all n locations
  Clone ID: PAT_TA_90159
gaattcactaagtgattcgagcggccgcccgggcaggtctcaaatatgtcattctcatctaacatagcttccctaagcttgggccttttcatatcataagcataatcactctcatcattaatagtatggatagcaccaatagtatagcaatcatcatcacaatgagtagtaggagcaacatcatttgggagagatacctttctacctttgcttcttcgtctttcatttttcttcttcacattatgtgtgggttcaaccttcttctctgagctccttattgatgagattgggttgaatagaaagctcctcctcattaactgattcatcataagaaataataggagggatattgggaagtcctcttcccctttcattaagtgttctcttcaaggttccnaatttgctttccttttccttaaggtaattgagaaataataagggatttt

SEQ ID NO: 90160 - DNA, 391 bp, Triticum aestivum
  unsure (1)..(391): unsure at all n locations
  Clone ID: PAT_TA_90160
gcggttgggggaagctcccccaataatgggtcngaccctgcangggcggggcggcgaaattnaactaaatggatttnctancgggncgnccggggcanggtcaagaatttcctccgttcccccaagcaagggagncatagaagcaaatgtnccacaactcctatgctctacttccaaagcccaacatccccattccaactttcatgnaaaccatgccaagtgtttttnagaaagaagcaacaattagggngaaccaatgtncaatcggnccaaaaaacaagtcaggtttcagggnaaaccatgccanatcctntcaagaaagatggtgtggatacaaaatgtgggtttcggtgggtttcnggncctttnatnacaagcngnaaagcacaaa

SEQ ID NO: 90161 - DNA, 220 bp, Triticum aestivum
  unsure (1)..(220): unsure at all n locations
  Clone ID: PAT_TA_90161
gaattcaataatgattaacgtgggcncggncgangntttttttttttttttgnatttanatggnancaaaaatagcanataagataacaaactatctcanatnctnacaagtccancaaaatctcaaacactaactaaattttcatcctgatacaccaataacaagtgctgagtgattcacacaatatttcaccattttggggngaaanctgccccgcgg

SEQ ID NO: 90162 - DNA, 260 bp, Triticum aestivum
  unsure (1)..(260): unsure at all n locations
  Clone ID: PAT_TA_90162
ggcggcgaattcaccaaangattaacgtgggcccggccgangggtccccagttttttttttttttttggnaccaagaatgtttcatttcacacaggggtggcaaatggggccacacagggggttcaatatacaangggnaagcaangagggnaaatcaaancncccaaacncccaacnaggggcanacacaaaaagtnntcccccaaatggntaaaanaaaantggggatntaaaanttgtacaaaggacnttgtgncac

SEQ ID NO: 90163 - DNA, 163 bp, Triticum aestivum
  unsure (1)..(163): unsure at all n locations
  Clone ID: PAT_TA_90163
ggtggacactatagaaatactcaaggctatngcatccaaacggcggttgggggaggctcctcccaataatgggtccgacctggcaagggcgggncggcggaaatttcaactaaggtggaattaaagcggtgggtccgcgcccggagggtcctccgaagttttt

SEQ ID NO: 90164 - DNA, 448 bp, Triticum aestivum
  unsure (1)..(448): unsure at all n locations
  Clone ID: PAT_TA_90164
gaattcactaagtgattcgagcggccccgggcaagtcgcgcacgaaccccctccgccgccgtcctcgcgtcttctcctgcgcatctcggaggtgcttcctagtttccacgatgaagctgatcgcagcctaccttctcgcctatctgggcgggaactcttccccaagtgccgctgacgtcaagaacatccttgactcaattggtgctgaggctgatgaaaaaaancttgagttccttcntgctgaactcaaaaggcaaggacatcacanaagtgattgcatctggaagggaaaagttttgccgcctgtgccttcaaggtgggggggggncaattgctgtggggagctccnanctgcctgcatcctgggtgggngncgccaacancctgctgcctgagttcaaanaaaagagggagaangggttntntnaagaaagggaagaatncttga

SEQ ID NO: 90165 - DNA, 591 bp, Triticum aestivum
  unsure (1)..(591): unsure at all n locations
  Clone ID: PAT_TA_90165
caggtgcacactatagaatactcaaagctatncatccaaacgccgttggggaagctcccccaataanggtccgaccttgcaanggcgggcccgccgaattcaactaagtggattaagcgtgggtccgccgggccgaaggtagctgggtcnggcccgggaccgatncaagggaggcgggagggagaaagatnaaagggcgggacccgaccgggacctcaaaagtttgtcatttgtcccnggtaaggaaagttgttgttgacacaaggaggtccgatctgaacccgccgtccgccgtctgggtccgacacaagtggcgggaggttcccaaagattggctaagctagcttgtaattagccaactggaataaaaagcccatgcaagtctcaacatcgtccaagttaatttgccgaacaaataagcatgggtatgttgtgaaagaaaaataagtatttgttggtgttttgccgggaaatgtatcaagtgtgggatctggttaangtatgttanttttgttggaaagttgtnataaagcaancgttaaataattatctgggccctggtttaaaaattgtnccaaaaaaaanctggcc

SEQ ID NO: 90166 - DNA, 632 bp, Triticum aestivum
  unsure (1)..(632): unsure at all n locations
  Clone ID: PAT_TA_90166
aatactcaangctaatngcatccaacgcgttngggaagctctccccataanggtccgacctgcaaggcggggccgcgaaattcactnagtggantttcgaggcnggccgccccggggcaaggtccggggcaaggtagtcctccgagtttttttttttttttttttttaccaaaaatcaaaaatanaaataacaaataaaaggataagaaaggcataagcttgaaatttcatcaaccactaaattaaaccatttacatattccngatctcgacgttagggattattccaaggaagaataaattcaagtacatgggtggattgcaaaggcctaaatttccttttccggaaaccatgggcaagcccaaatttccttaacaactaatgctttcaaagtttccaactggaaatgtttgtacaaagttttaactggggctactggcaagaggcccctaaaacctccgggncggccggancaacgcctnaatncgnaaattcccccngcgggcccggccaatgggcngggccgggggaaggcaatgccgaaccgtcccgggccccaaatttccgcccctaannagggggaggtccgtatttacaaatttcaactggggccggtccggtttttaacaacg

SEQ ID NO: 90167 - DNA, 271 bp, Triticum aestivum
  unsure (1)..(271): unsure at all n locations
  Clone ID: PAT_TA_90167
gaatcactaagtgattcgagcggccgcccgggcaggtctagtctcgagtttttttttttttttttgcacannactttgactttattanagttcaaacgaaatanagtgaagganantttacgaaaaataantacagcaanggnagctganannaaatgaaagnaaccagtttttgtncnattttatttaggtaatananatatttttggctgaggggcnattgnaacggcnaaccanctttatttaanttncnggaanctggaacggggag

SEQ ID NO: 90168 - DNA, 182 bp, Triticum aestivum
  unsure (1)..(182): unsure at all n locations
  Clone ID: PAT_TA_90168
tgacactaataagaaataaccaaagctatncaatccaaacgcgttggggaagctcccccaataatgggccgacctgcangggcgggccgccgaattcantantgattaagcgtgggccgcgggccgagggtgtgccaatccaaattcttantttaagttttgttcattttcttaaaaaaaaa

SEQ ID NO: 90169 - DNA, 206 bp, Triticum aestivum
  unsure (1)..(206): unsure at all n locations
  Clone ID: PAT_TA_90169
gacactattagaaatactcaaggctatgcatccaaacgcggttgggggaagctcctccccataatgggtccgaacctgcaagggcgggccggcgaanttcaactaagtgattttcnaancggggcgccccggggcaaggtcctaagtcctccgaagtttttttttttttttttttttttttttttttttttttttttttttttttt

SEQ ID NO: 90170 - DNA, 452 bp, Triticum aestivum
  unsure (1)..(452): unsure at all n locations
  Clone ID: PAT_TA_90170
gaattcactagtgattancgtggtcgcggccgaggtgaactaatctcgagnnttttttttttttttttttttttttttttttttttttggggcgacnaaacattatttccattacaagaaatacctacaagtttntctgccaaanacaaaagcacgtntcctgacaaatttggggataccanaaagtcncanagtacttntgtggnagcctgaatcaaacgacnccattgnttggcaaactacaacaaagtnnacnaccactgcangattgngntaatngcacaataacaagaactncancaaggtaagagggagtccttggtgcatctgttnccaacccaactaaatcaatacaaanacttcagngtcntcaagcanccaaagaanaaagcaanngggaagaaattnaatgnaaccctcccanagattttccaccccnccagnaaaggggg

SEQ ID NO: 90171 - DNA, 344 bp, Triticum aestivum
  unsure (1)..(344): unsure at all n locations
  Clone ID: PAT_TA_90171
gaattcactaatgattaacgtggtcgcggccgaggttgtaaatctagncaccncggtttgcacatccctaaacctaaaatttgnagncccancttttantcntgtcagttttcttacttgggttcatccagtccagtaattatgtaagaggatgtcatgaacttgggtatgcactgtcatangtatataccctccgnattttggnanttagcaattttttancttaaaaaaaaaaaaaaaaaaaactccnnacctgcccgggggggcgctcnaaannaaattcccnccggcgccattgagggcggggagaangcaaacgaccggcccaantcgcccnaaaaang

SEQ ID NO: 90172 - DNA, 224 bp, Triticum aestivum
  unsure (1)..(224): unsure at all n locations
  Clone ID: PAT_TA_90172
gaattcactaagtgattagcgtggtcgcggccgagggttttttttttttttttttttttttttttttttttttttttttttttttttttttttttatgnanaataaanangcntccgccggccgtcgtcccanggtgctccatcagatcgctctcttcgtcnncgtcccgcngtgatcatgaacagccccntcngccttggagccnctngccaacnacgccact

SEQ ID NO: 90173 - DNA, 186 bp, Triticum aestivum
  unsure (1)..(186): unsure at all n locations
  Clone ID: PAT_TA_90173
gaattcactaaatgattaacgtggtcncggccgaggtatgnacccngcncngtggggggcggcctacggcaacaantggngtgaaacaccaacgacatctanggacacctgggnacaaaaatgatgtcttatnggnggggccaanaacnangtgtggggccgagtattccccccccccgcggtttg

SEQ ID NO: 90174 - DNA, 158 bp, Triticum aestivum
  unsure (1)..(158): unsure at all n locations
  Clone ID: PAT_TA_90174
cacttataaaaatactcaaagcctatgcatccaaacgcgttngggaagctcctccaataaggggtccgacctggcangggcngggcccgcngaattcaactaagtggattaagcggtgggtccgcgggccggggtggaaactaagtcctccgaggttt

SEQ ID NO: 90175 - DNA, 195 bp, Triticum aestivum
  unsure (1)..(195): unsure at all n locations
  Clone ID: PAT_TA_90175
gaattcactagngattaacgtggtcgcggncgaggtccactctcgagntttttttttttttttactncctgtcaatgaatactcnaatgggaatgnnacttcacaatactgaaagacaagagctancaattcggaacgcanattgcgttttaatacntcncactattctaantttttaaaaanaaatgcacttta

SEQ ID NO: 90176 - DNA, 290 bp, Triticum aestivum
  unsure (1)..(290): unsure at all n locations
  Clone ID: PAT_TA_90176
gaattcacnantggattagcgtggncgcagccgaggtctcgagncccttcttttttttttccnnttttttcttttntttttttttttntttttttcggggcactgaatcatttnttattcancacagggatcatcnccaggcaaagaagtttccatgaaacattttcaancaggttttgtgnaaaccaccanacaagtgntananggatncatgcnggnangggtacacggggaaagccaatcaaaaaaacntantcggtaaccttttggngtggatatgtacatacata

SEQ ID NO: 90177 - DNA, 158 bp, Triticum aestivum
  unsure (1)..(158): unsure at all n locations
  Clone ID: PAT_TA_90177
naattcacnagtgattancgtggncncggcgaggtcttgtgtcctgtgtacattcngtttgctgtgttcgntgntctgtttgattgcaagttcgcanctggggaatagactaaanaggtgnagtgcattgtttncaaaacaaaataaacaagaaaatc

SEQ ID NO: 90178 - DNA, 194 bp, Triticum aestivum
  Clone ID: PAT_TA_90178
gaattcactaagtgattaagcgtggtcgcggccgaggtgttttttttttttttttataaccaatcaatctcgggccaatcatccaccaatttgatcaatcgacctacaaataataagctgcgagtctccggtcccctacacaatcatccgctggccggccgatcgatacatcgacatgtcacctgcccgggcgg

SEQ ID NO: 90179 - DNA, 381 bp, Triticum aestivum
  unsure (1)..(381): unsure at all n locations
  Clone ID: PAT_TA_90179
gaactagtctcgagttttttttttttttttttttttcagcaaaaatcttctccacggatcaaagtccggtggtcggttgaagcaaaaccaaaaatccttccaacacaatcaaacttaggttccagcaaaaacgacatgagcatttgagagctctgcagtcgttgaagcaaaaaaaatctcggttccagcaaaaaaatacatcggntccagcaaaaacaaaattgggttcggcaaaaagaaaacacattcgcaaaaatggnctcccctcttgcagctcctccagtagccaattgcagctccaaacgtgcacggttgcagctcccgacatcgaacggtgttggatgcaagactcttcgccgctggatgtagcttaactccggg

SEQ ID NO: 90180 - DNA, 273 bp, Triticum aestivum
  unsure (1)..(273): unsure at all n locations
  Clone ID: PAT_TA_90180
gaattcactaagtgattancgtggtcgcggccgaggtaagtgtgctttgtgagtagatgttgaaagtgtggattgtgtgtgtttggtgcctcggtattgataatcaagaacaagttacatatggaacttgaatcgcatctgaagatggaaatagtanccggaatgattattaaaaaaaaaaaaaaaaaaaaaaaaaaaaaaaaaaaaaaaaaaaaaaaaaanaaaaaaaaaaaactcnaaanctgcccgggggccgncncgaatcnanttccc

SEQ ID NO: 90181 - DNA, 236 bp, Triticum aestivum
  unsure (1)..(236): unsure at all n locations
  Clone ID: PAT_TA_90181
nanttcacnaantgattancgtggccgcggccgaggtaacnaatctcgagtttttttttttttttacggcaccaacttactcnatgcaatgcgaatgcttggnactggtacaangatgatgatgatacaatanacaacggaatacaatttttttgatactggtagtagcactgtctgctaagaactatcgnattttcaaacgcccgggacaaaaatgtcatacctgcccgggcggg

SEQ ID NO: 90182 - DNA, 255 bp, Triticum aestivum
  unsure (1)..(255): unsure at all n locations
  Clone ID: PAT_TA_90182
tatagaatantcaaagctatggcatccaaacgcgttggggaagtctcccaatatngtcgaactggcaaggcggggcgcnaattcantaaatgatttccaancggncgcccgggcaagtgtaatccccaaggaccnttttttnttttttttttttttttttttttcntctttttnttttttttnttttntcttttttntttcttcgggcgggggaaaagnctaanttnaaaggggnttttaaacnannaaggtagc

SEQ ID NO: 90183 - DNA, 252 bp, Triticum aestivum
  Clone ID: PAT_TA_90183
tcgcggccgaggtgaactagtctcgagtttttttttttttttttgcaaaaaaagataattatatattttgctcaatgaaaagaacaaataccacaataaagagtagtacatttcaattcctcgtatcggttctgaaggctgaactgcgaggctaacttattcaattttattacaactgcatggagcttaaccagaagcttgaatacatgtcttctgtggagaattattacctgcccgggcggccgctcgaaa

SEQ ID NO: 90184 - DNA, 225 bp, Triticum aestivum
  unsure (1)..(225): unsure at all n locations
  Clone ID: PAT_TA_90184
gaattcactagtgattagcgtggtcgcggccgaggtcgagntttttttttttttttttttttttttttttttttttttttncaggagantgttaagctaaaattatatacaanaaagggatttntacatcatcagctaagacagcaataatatgtgttctagaaaaatatgctatggcatacatancattaaaactccagactagttctctacctgcccgggcgg

SEQ ID NO: 90185 - DNA, 514 bp, Triticum aestivum
  unsure (1)..(514): unsure at all n locations
  Clone ID: PAT_TA_90185
ggcgcgacntcacnaatnattaacgtgggcccggncgaggntttttttttttttctantaagctatttccaaancttttttttaantaanggagcctaacctcaagcttcttttttangtttaaattncaatntaccgaaacctaanataacacnagataaacattaagagggctcntccgccgangataaaaatatatcatggncagnaaaggtggttcattanntttattngcccccntnaacaatnncangtttcattaaggaaaaactaactaaataaaatgggcgaaaatgaaantttaatanaattccctttttttttctncctcaaagccaaaaaaatttcccccttttttaaaacacaaggncggtcgaatccggcaattgggtaaaaaaagggngagggggngccccccntttttttttccangtaanaangtccaaacaatctanncgaacanggaggggccccaatagcaaancaaagnttnaacattnagcgnacntncccg

SEQ ID NO: 90186 - DNA, 166 bp, Triticum aestivum
  unsure (1)..(166): unsure at all n locations
  Clone ID: PAT_TA_90186
atgattaagcgtggtcccnggcgcangtcccanccgccttccttcctccgggacttgcctgnccgccctcagtcaagccggncaatgggggctcctcaccgctttcctcaacctccgacctcacccgactccacnggcgcaaagatnatnncccgcagtnnatatg

SEQ ID NO: 90187 - DNA, 452 bp, Triticum aestivum
  Clone ID: PAT_TA_90187
gaattcactagtgattagcgtggtcgcggccgaggtcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatgttccgcctaaaatgaaataaaagctcaaacgaagatgaacaagcgtcatcgtgcctaatgg

SEQ ID NO: 90188 - DNA, 225 bp, Triticum aestivum
  unsure (1)..(225): unsure at all n locations
  Clone ID: PAT_TA_90188
naatgnttnctagcgggncgcccggcaagtacgggacggngggctaaaccanatactatatgngggaacaatgcatgcctcctacgtaatgtatgtaacggtatcaacaaaaattagtntatcgccntgcacgaacttntttagtganngcaacncccgcntntacaactaccttcatgcnnacaaaaanggggctgttngntgtctggcanaaaaaaaaaaaaa

SEQ ID NO: 90189 - DNA, 490 bp, Triticum aestivum
  unsure (1)..(490): unsure at all n locations
  Clone ID: PAT_TA_90189
naattcactantgattatncgtggtcgcngccgcaggtatcngcaccgcacaagtgacngtgacgagctttgcgctgaaagttcatcaagcaacctattgaagggcaccaagctcgcggngatcctgattcctccaagggccgtcctggtcatgggagtcctctcgcacgtcaacgcccnacttcttccccaagtgctgcaacaactgcaggtccttctcgggggtcgacgtctgcgacgacgcccaccccaaagtgtncccaaagggctgctcgggggntgccgcgtggtgttcnaccaaccccccnaaatgtgngccgctgcgcgcgatatggaaaatccaacccgtccgaacnggcaacctngcgggtgggaccctngccaaggaaggtaccntgattgggttcatggccgggcataatgatnatgtttccnccttaaaaanttaaaatanaaancctccggctcgagaatgnaggcaagcggtcaa

SEQ ID NO: 90190 - DNA, 523 bp, Triticum aestivum
  unsure (1)..(523): unsure at all n locations
  Clone ID: PAT_TA_90190
gaattcactagtgattaacgtggtcgcggccgaggtcaacancgcctcatcttcgccggcaagcagcttgaggacggtcgcacccttgctgactacaacatccaaaaggagtccaccctccacctggtgctccgcctcangggtggtatgcagatcttcgtcaagaccctcaccggcaagaccatcaccttggaggttgagtcatccgacaccattgacaacgtgaaggcgaaggattcangacaaggagggnatccccccggaccaanaacgctcatctttncccggnaaagcaacttganggnnggggcgnacccctcnctnnactacaacatccaanaaanggagttcnaccccnccaacctnggtggctnccgntctcaaaggggnggggnatgnnaaattttncgtttaannacccccaacccggcnaagancaatcacnccccgnaggtccgnagttccatctngaanaacaatttaacaaatgttaaanggggaacgattcaaagaacaaangggg

SEQ ID NO: 90191 - DNA, 292 bp, Triticum aestivum
  unsure (1)..(292): unsure at all n locations
  Clone ID: PAT_TA_90191
gaattcactagtgatttcgagcggccgcccgggcaggtgagagaactagtctcgagtttttttttttttttgaagaacggcctgtcaaactcttcaaactttagcgttgtatcgaattgctaacacacaagctcgtgcctgtcttccacatcaaatttatgctttgattatttccgtctcacgctcaccgagtatagtcagctcacnacgacggctgctccgcggttgccgaagtttccgcctctaaggtgggtgaatcaaaaaggcgtctcctcggccgcgaccacgctaa

SEQ ID NO: 90192 - DNA, 359 bp, Triticum aestivum
  unsure (1)..(359): unsure at all n locations
  Clone ID: PAT_TA_90192
gaattcactaatgattaacgtggtcncggncgangttcttccccttcttcttcttgtcaaggaagcaaacancaagcgagggcgtgcgcaaatggnggattcntcngngccgacgcgggtgatgatggnggtgaacnantcntccctcaangggtaaccgcaaccctccatcaactggccgctccgccttcnactggatgctctccaanctcgtccgctccaanaacgangggttncaactcctcttcctccaangtccaaagtcccccaacangacgggtttttntgatatggatangtaatatntgcaatcaaacgacggggcntccaagagcaatnaaagcaacngaagacaaggg

SEQ ID NO: 90193 - DNA, 222 bp, Triticum aestivum
  unsure (1)..(222): unsure at all n locations
  Clone ID: PAT_TA_90193
gaattcactanatgattancgtggtcgcggccgaggtttttttttttnttggnactgggacatttatatnttcttcacnanccacaaccanaaaaagagtacttgtatttgcaactccattacagatacacanttnatgcgggaaacaaaaangtaactcatgtccaactaacataaaacaaagcgncnnctggcgacgncatccaaatttattcttcncat

SEQ ID NO: 90194 - DNA, 488 bp, Triticum aestivum
  unsure (1)..(488): unsure at all n locations
  Clone ID: PAT_TA_90194
gaattcactaagtgattancgtggtcgcggccgaggtcgagcgcctcctcctgtctcgccctcgccccccgtcccctcgtcggggcccgatctaagtcaanatgagtcntggcgggagtgctggtggtggtcaaagttctctgggttacctgtttggaganggtgagcctgcaaagcccgctgcagcaccagctgcgaagcccgcacctgctgagaaaccagcaccggcagctgctgatgtacccaagcaagattccagctgggcattccaggtancccgggcnaacaactactaccgtgcagatngccagaacacgggcaacttccttacgggccgtccttcaaccaaangttcatgctggcccctgccggtggctcctcccctgggctaacttgntttggcggnaaangtgacgttaatgangctgccttaattgnaagaaccaatgaattggccctgtatcctctgtttatccaatggnggtgaa

SEQ ID NO: 90195 - DNA, 274 bp, Triticum aestivum
  unsure (1)..(274): unsure at all n locations
  Clone ID: PAT_TA_90195
gaattcactaatgattaacgtggncgcggncgaggtcccctcccttggatcatttgggactttcnaattggaaagaattctgacccccgggnttttctcataagataaatgtangaaacaaatccaataagaaaaaaaaaaaaacggnattattactccncncgtccaagattccgtcctgggtcattagatnagaatccaaagataaagagtgaaacaaanaatatcactactgtntaaacaaaaaagtttgntgntggggttcgaaccaaaa

SEQ ID NO: 90196 - DNA, 467 bp, Triticum aestivum
  unsure (1)..(467): unsure at all n locations
  Clone ID: PAT_TA_90196
gcaggtccaagacaaagatctatgtgaatgcatgggcaattggcagagacccggtaagttggcccgacgacccagaggagttcaaccctgataggtttgaagcgaatgagatagacttcaagggcgagcatcctgagctgatgccattcggcacggggcgccggatatgcccaggcatgtccatggntgtggccaccatccgaagtttacactccgccaatttgctcttcaacttccaagtggacacttccggaggggacaacggcgggacgatgtgaacatggaggaagaagggaggctcatcttccaccgcaagacgccactagtcctcgtttcccaaaccaataccaccaaatgtcttgaaataaaaaagcgaagtggtcacaatttgaataaggtgcagtttgtcctgcacaccctaagaaagggttgggtgccangcaaggacaaaaaanaatttctcattg

SEQ ID NO: 90197 - DNA, 487 bp, Triticum aestivum
  unsure (1)..(487): unsure at all n locations
  Clone ID: PAT_TA_90197
gaattcactantgattagcgtggtcgcggccgaggtcacaagtgaagtgagagctttgcgctgaaagttcatcaacaactatgaagggcaccaagctcgcggcgatnctgatcctccangccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgaagccccgaaatgtggcgctgcgcggatatgaaatccanccgtcnacggcaactgcggtggaccctgcaagaagtactgntcggttcaagccggcatatgatatgttccncctaaaaantaaaataaaaagctcngggcgaagattaacaagggtcatccgtgccccaatgcgttntgtgtgttgnncaaacaaaaatatttnttancaanttat

SEQ ID NO: 90198 - DNA, 446 bp, Triticum aestivum
  unsure (1)..(446): unsure at all n locations
  Clone ID: PAT_TA_90198
gaattcactaagtgattagcgtgggtcgcggccgaggtgagagaactagtctcgagntttttttttttttttttttttttttttttttttttttttttttttttttccnatccaacgggggaaatgtcgtaanatganaactcanagngtgattaaggttggttgcccaccgcggaaacaggacaggaaaaggataagtgcncanatgcgtggttgcaanagtgcgaaggtaanattacccaactttacatcaggttcttgcncanctaancancttattcactgcataccggagccncatttnttcctggacgatgaagcaacagctatgnttccaccagnaanaagccccacaagtccaaaggggccaagtcacaatggccatgccaatcaaaccaacncttttggttttcncttcaaggagcctttccaaaanaanagctttn

SEQ ID NO: 90199 - DNA, 505 bp, Triticum aestivum
  unsure (1)..(505): unsure at all n locations
  Clone ID: PAT_TA_90199
ccttgcaaaggngggcccgccantttcactagtngattttccaagcgggcccgcccggggcnaaggtctantcctccgaagtttttttttttttttttaaacaatggcaancngaattccaaaatttattccnngtttaaagtaanggtacagggtaacatcaacnaagangggtattaccngagtaacataanggtggggtgcngttgaccantagaattaaccttgngctaanccaaanttacattatatccgatgggatccctcgcaatgcatttgtgtctgggggaagaatgggggcatgctgcaccgccnggntggtaattaangggctgggccaaccccgcccgggtgggnccaacaatccngtaaaactgtggcnggcaacccaaccggccggggttgtaaggggtttganccgggccaacccgcccccgggcggtncgggaaacaagcaaaggnnancttaatnnggtccgaatgaaccaaccgggtgcccctggaa

SEQ ID NO: 90200 - DNA, 221 bp, Triticum aestivum
  unsure (1)..(221): unsure at all n locations
  Clone ID: PAT_TA_90200
caaatctgcgctangctgacacagaggncttcangcaaatnagaatgnttcccgaagaatangtccagaggtanctggctgtnangaaagcangggttntantatgatancaanatncccgccttaccgtgcctgtncttactaanccaatgcnctgctctttgatctgaaaaggcatcatccttttcctcctgntcgcgncnctagctcacnacgctact

SEQ ID NO: 90201 - DNA, 356 bp, Triticum aestivum
  unsure (1)..(356): unsure at all n locations
  Clone ID: PAT_TA_90201
gaattcactaatgatttcgangcggccgcccgggcangtgaactaatctcgangttttttttttttttttttgataannagttctatttgtctttaccaaataagtatactcaatatctttttatattaanaaaacatgcccagcaatcgcttggatgcgatgcggtacttaggtacaaangananaacatcagatattaaattggcatgcntaaaaggggtaaagggagntcccgtcgtcactcctcgccgttggggtcgaanttcttgngaagctggncggntgancctgcngggnacaggaaaaagtaaccttgctgtgnccctttaactnctcccnatgcancaaaaaaagg

SEQ ID NO: 90202 - DNA, 234 bp, Triticum aestivum
  Clone ID: PAT_TA_90202
gaattcactagtgattagcgtggtcgcggccgaggtggtactaatatcttccataacaaggttcgacacaacattcagacaaaataacatagcaccacaggcacttggaatctaagttccacacagtaaaataagttctgatagaacggatagacttcttctgctagattatgcggcaagacaggaaagcttgtccaggggcacggttcgcaaggcggccacctgcccgggcgg

SEQ ID NO: 90203 - DNA, 437 bp, Triticum aestivum
  Clone ID: PAT_TA_90203
gaattcactagtgatttcgagcggccgcccgggcaggttttttttttgccctcgaagttatcattcttccttcgacaaaatatatcatccttccctgcgctcagaagtgaacttcgtctctttatttacaagctcgacgtcaaatgataaatcggaatataacatcacctccactataccacaaacatgccattacaagcatcgggtctccacttgctgtcatctgtttagtgaatcaagcctaacagtccgacagaaagcagtttactgctttccttgagaatcagcacactgaatcccatgagcaacactaggcatacaacaaacaacaaagcaagcgtatatcgaacaaagggacgtgttctatacactaaatcttgagctagctacacctcttcctggcatcctatcaacacgggggggggcaaagggcaatc

SEQ ID NO: 90204 - DNA, 450 bp, Triticum aestivum
  unsure (1)..(450): unsure at all n locations
  Clone ID: PAT_TA_90204
gaattcactaagtgattcgagcggccgcccgggcaggttagaatcattatataaaaagacatgaaggcctgcagattacatatagacgtgatagatacaagtaactatcacattctcgctctaaaaaagaatacatgtattcacccgtgataataactacagtatagtagttaataacaaaagataaagtcgtatgtgcgcgcggcagctgatcaatatatgcgttcaagccatgagaccggccgccaggagggcgacgaggccaaatcctgctgtggcaccgacggaggtagcggcgttggagggcggcgccggggggagaattgctcgcgccaggacctgcagctggcatgggtgacacgggcgaaggaggagccccgaggcgacgtcgatnacgaccttcatgctggcggcngcggcggggctgcaatggttanggacgccacaaat

SEQ ID NO: 90205 - DNA, 441 bp, Triticum aestivum
  unsure (1)..(441): unsure at all n locations
  Clone ID: PAT_TA_90205
gaattcactaagtgattancgtggtcgcggccgaggtcccgccgcgtcttcgactccatcgcctcctcctccccctcgttgtctccggccagccaggtagtcctccatgggcaaggagaagatccacatcagcattgtggtcattggccatgtcgactctggcaagtcaaccacgactggccacctcatctacaagcttggaggcattgacaagcgtgtgatcgagaggttcgagaaggaagccgctgagatgaacaagaggtctttcaagtacgcctgggtgcttgacaagctcaangntgagcgtgagaggggtatcaccattgatatcgctctgtggaagttcgagaccacaaagtactcnngcactgtcattgatgctcctggncaccgtgatttatcaagaacatgatcactgggacctcccannctgactgtgcg

SEQ ID NO: 90206 - DNA, 399 bp, Triticum aestivum
  unsure (1)..(399): unsure at all n locations
  Clone ID: PAT_TA_90206
gaattcactaatgatttcgagcgggcgcccgggcangtacggaacgggggcctaaacgcatatactatatgcggnatcaatgcatgcctcctatgtaatgtatgtaacgtatcatcacaagttactctaccgccatgcacgaccttatacagtgataccatctcgtgtatatactagctacttgcactccnaataaaactgggactgttgcatgtctggaaaaaaaaaaaaaaaactcgagactaaacctcggncgcgaccacgctggccgcccgggcaagtctcgagtttttttttttttttttaattttctgggagtcttcaccctcaggatcgggntttaaaaccaaaagttttggctagttgctctttggcaaaactgtccacgacctcatcaag

SEQ ID NO: 90207 - DNA, 488 bp, Triticum aestivum
  unsure (1)..(488): unsure at all n locations
  Clone ID: PAT_TA_90207
gaattcactaatgattaatcgtgggcgcgggcnaagtgntttcctggancgcatcaaaaaagnctatgaaaggaacggtgaagcttgccaacctcctcatcgaccccgaagttcgcacaagagatnatggacaggcaanccgcgtggcggagggtcgtntgcctcnccatcaacaacggggtcagcacccccggcatgtcccgcgaagtctggcctacttncgactcctacccggaggggacaagcttccccgcgannctcgtccaaggcccaagaganactactttggggggcgcacacctacgaaaaggggtcgacaatgcccgggntcctttccacaccggaagtggtaacaaagattngccaaactcgaaagattnangntggcttggctcctaccaaaagaagacnggccatcaangtttccgtccttctttgggaatccttttgttngctgccaagtcaatgagtnccttttccttgtaggg

SEQ ID NO: 90208 - DNA, 248 bp, Triticum aestivum
  unsure (1)..(248): unsure at all n locations
  Clone ID: PAT_TA_90208
gaattcactagtgattagcgtggtcgcggccgaggtcgacccttttgcttccgctgctgcagcagctgacgatgatgatttatatagctaaatcctttcgcgttcgtagatgttgtgctccggtacgcagtacacggaagaactatgttcttaagttaatattgtgatgcacagttaatcgttctgcccgttaaaaaaaaaaaaaaaaaaaaaaaaaaaaaaaaaaaaaaaaaaaaaaaaaanaaaga

SEQ ID NO: 90209 - DNA, 650 bp, Triticum aestivum
  unsure (1)..(650): unsure at all n locations
  Clone ID: PAT_TA_90209
tagggtggacactaatagaaataatcaaagctatgcatccaaacgcgtttggggagctctccccatatnggtccgancttgcaaggcgggncggcgaaattcaactanttgntttagcgttggtcccngggccgagggttcacttgattaacaagcaaaagccgccgcatccaccgttgctaagcaaggtcgaccaaagcancacccgaagatnggtggtggncttctcctccaacgtcggtgcccccgggcttctacgccggaccaaacttccttngggaaagaaagctcaaagaagccgggtgacctcgggcccgtgaactaccatgggcaaagaagctccaaagggccaaacaggttcacaagtcatgggnangcggggaaaacctcccacgaagaaagagggaacaacgggacnaagttgggaaaggggtcctttgcggtacngatatctcccggacngaccaagcaaggacatcaccaagaggggaaaggggcatccgtgggnctccgctcctttccaaggcggccccaacggggcgnacgggcaaccccaacgaagggcggttcctcaaactccctaaccgaggtacgtcaagcccaaggggaactccaaagaangttaccaacttccnacaacaancaattgg

SEQ ID NO: 90210 - DNA, 332 bp, Triticum aestivum
  unsure (1)..(332): unsure at all n locations
  Clone ID: PAT_TA_90210
ccgcccaggcaggttgcggctgcacccagtgcaagtgcggcaccagctgcggctgctcctgctgcagctgctanatngatcatcgaccatatgcatgcaccgtgccgtgcgtgcatcatcgatcatatcgatctactactaccataccatgtaaccgcaacctgatcgagggcctttatctatgcacctgacctgcatcaagcaagtcaggtgccatgccatgattgtaaacaggcccccctaaataaaatttcccctgattaactaaaaancgttggcaaacnaaaattnantgtttcngnnctcacctcgggccgcnacccacgggntaa

SEQ ID NO: 90211 - DNA, 172 bp, Triticum aestivum
  unsure (1)..(172): unsure at all n locations
  Clone ID: PAT_TA_90211
naattcactanatgattccagcggncgcccnggcangtcaacaacaagctgaacggnccaaanctgcaaggnttggnttcctangactttggntgctangaagcgccgacgcacacnacaatgcacgtggnaggnaggcaaaaaaaatatagtngtacaacaaatantatgg

SEQ ID NO: 90212 - DNA, 285 bp, Triticum aestivum
  unsure (1)..(285): unsure at all n locations
  Clone ID: PAT_TA_90212
gaattcactaagtgattancgtggtcgcggccgaggtntctngnttttttttttttttttnacacaaataaacaaatattttantttgatttgagcanataggcataaattgatacaatgtgcttattcacggaagcaacaacangtttttctattcgcaaaaaaaaacaggttttttctgaagaanaagaaaaagataacgangaggacaacaacaacaattgttgttgggcgtggaccacntgcacgtacaancaccctgcccggggcnancttttttttttc

SEQ ID NO: 90213 - DNA, 479 bp, Triticum aestivum
  unsure (1)..(479): unsure at all n locations
  Clone ID: PAT_TA_90213
gaattcactaagtgattancgtggtcncgggcgaggtatcgcctcgcgcccgcaccccangaaggtaagttcaagggctgtcctgagaagctcaaatggctcccaaagttgctgttgccaangaanggcgaatgccaagggccangccgccaaggttgccaaggctgtgaaagtctggggtcaatcaagaagacggcaaagaagatccgcacttctgtgacatttcaccgccccaagaccctgtccaagggcaggggaccccaaagtaccccagnatnagcacccctgggaggaaaaagctcgatnaatatcaaattctcaaagtaccccgcttaacactgaagtctgcaatgaagaagatngaggacaacaaaacactcgtcttcatccgtcgnaccttgaaagggccgacaaagaaagaanattaagggccgctntcaaaaaaaatgtacgaaattcaaggccaaggnaaggttaac

SEQ ID NO: 90214 - DNA, 295 bp, Triticum aestivum
  unsure (1)..(295): unsure at all n locations
  Clone ID: PAT_TA_90214
gaattcactaaatgattaacgtggncgcggccgaggtgagaantaancctgagttttttttttttttgnaataanantgtcactggattccccgtccttccatccatcctatcnaaagcaaagcttggttttcnaataaaaaggacgggnagcgactacttgcgtcgaccgggtaatcttatatctaccgtagagtacaacanacgtacaaaacacgcccattaattgntttatnaagatnggnggcgaacaacgtcccgcgccnaatttcnngcgnagaaatttanacaaatgt

SEQ ID NO: 90215 - DNA, 549 bp, Triticum aestivum
  unsure (1)..(549): unsure at all n locations
  Clone ID: PAT_TA_90215
gncggcgaattcaatangtgattccaagcgggccgccccggggcaagtcngcggcgaatnggcgggcgggcggcggcaanaacgtacaaggggctacancatcccccacaacaaagcgctgggnacaacatccgcccgggcaagggcctcctgcgccaacatgtggttttgggattttctacagggctaaacaaggacgggcgctgtgctcttgggtatgccgtcatcctttggggaatgaaccaatgaatgatnatgcgcatgggtcatgggacatgcaaaacgaagcanggagggcttcatccgtcngtcatcgcccggtccccatttgaagctcaaaccgcttgaaaaaagtgggctgaanaaaagaaccctggacgcatccgcatgtttcngaccgcaagttctctggctaaaataaaaaaaacaaagtcacaaacttatcaatttaattcaaccccctggttgttttgcnaaagttataatttttttttaagcaanaacaaaactngggcntttggtttaangttatttttggggttttggggg

SEQ ID NO: 90216 - DNA, 496 bp, Triticum aestivum
  unsure (1)..(496): unsure at all n locations
  Clone ID: PAT_TA_90216
gaattnactaatgattaacgtggtcncgggcgaggtccgcaccgcaccaantgaaagtgngaagctttntacnaaaagttnatcaacnaccaagaaggggaacaaagctcgcggngattctcatcctccaagccgtcctggtcatggggaagtcctctcacacctgaaacgcccgactaatttcccaaagtggtgcnacaactgcangtcctttctccggggtcgacgtctgcgaagaacgcccaacccaaattgcccaaaggggctgctcccggcntttccnccgttggtnttccaacaaaccccccaaaattttngggggcttgcnccggnntaattaaaattccaaccgnttnaangggaaccttgnggnggggncccttgcaanaaanttaattgatttgggtcaatgccaancnatnatatntttccgnccttaaaattgaaattaaaaagctcnaaacnaanatttaggcaagcgtcnatccnggcctaa

SEQ ID NO: 90217 - DNA, 564 bp, Triticum aestivum
  unsure (1)..(564): unsure at all n locations
  Clone ID: PAT_TA_90217
gaattcactaatgattaaagggtgggcncggccgaggtcaaaaatttaactttaatttatcgcaacatcangtttggnctttcttcanctcctctgtttcttgcngggtaacattaacgaaatgtgtgtccactctgtgacagatactataatcaagtatacttaggacgagcgaacaatcatgaaagtactacaacaccaaaccaaaatgctgggaagtccaaaactccaaaagcacgtacgttcggcacggggctgctctaaaaaaaccctgggcttgggcaacgaatggtggagttgctttgaaggatgtngaaggctgaaactgggccgcccttcctcaatccgtggtcaaagccttgtcctggcccggggcgggccgctccnaatcnaaatttccccgcgggccgccaatggcgggccgggancnatgcgaacgttcggggcccaaatttcnccctaanannggaggtcngtaataanaanttcaatggggcggtcgnttttanaaacgtcntngaactggggaaaaaaccctngncgnttacccaaacnttaatccgn

SEQ ID NO: 90218 - DNA, 460 bp, Triticum aestivum
  unsure (1)..(460): unsure at all n locations
  Clone ID: PAT_TA_90218
caattcactaatgattaacgtggncccngccgaagnccagttttttttttttttttaattnatcncataantactatcacagacgtaggtttaattttcacaaacgaacatcgatnacacgacacacactcggagtattacgcgatatgcttacttttgtgcttcttanaagcggtaacacatacctaatgagtagattttacataataataaagcggggatctttgaccagtggatacattggtaagttgggcaaagtactgcaagtataggagtattatttaggttccgttggtatcgtccgttcgacncnccggttggtagncnaagcatcctacacgaagggaagaaggggaatggggatgatgttaaagatgccccccnaaggagggcccccacnaatctgggccgatggaggncnattanggccgcccaaaggcccccganggcgcacctgccc

SEQ ID NO: 90219 - DNA, 506 bp, Triticum aestivum
  unsure (1)..(506): unsure at all n locations
  Clone ID: PAT_TA_90219
gaattcactaantgattaacgtggtcncggccgaggtcaanagttatagggagggacttatgtcaccacaaacagaaactaaagcaggtgttggatttaaagctggtgttaaagattataaattgacttactacaccccagagtatgaaactaaggatactgatatcttggcagcattccgagtaagtcctcagcctggggttccgcccgaagaagcaggggctgcagtanctgccgaatcttctactggtacatggacaactgtttggactgatggacttaccaatcttgatcgttacaaaggacgatgctatcacatcnagcctgttgctggggaagacagccaatggntctgttatgtnacttatccattagacctattttgaagaagggtccgttactaacatgtttacntccnctgtaggtacgtattttgggttcaaagccctacggtgcctacgtttggggggtttaccaantccccccncntattcaaaaactttcaa

SEQ ID NO: 90220 - DNA, 353 bp, Triticum aestivum
  unsure (1)..(353): unsure at all n locations
  Clone ID: PAT_TA_90220
aaggtcggggcctccacttctctgctccctcctctcctcgcgcgcagggcccggtgaaaggggaaccaagatgnacaccnnccaaggaagaangatncagaaggncaanggcgtcgagccctccgnagntctaggacaccgtcccgcaggctttctttggcctngnagaaacggcaaccanngagctnaangangcggacctcaaaggaccctggtncaatcaacactgcaantccnagattnggtntttgttttgngaaacaaagaaaaggcccgtnggnngattccaatgttggccnacaaccggtcttggccgcnaaagcccccttccaacgagaaggaantccantggt

SEQ ID NO: 90221 - DNA, 335 bp, Triticum aestivum
  unsure (1)..(335): unsure at all n locations
  Clone ID: PAT_TA_90221
gaattcactagtgattagcgtggtcgcggccgaggtggnnttttttttttttttttttttttttttttttttttttttttttttttttttggncgatggntanatgcanaatatatcncgtgcanganaaaaaatcatttntgtttnttcaancaatcccaaantcgtgtccanantggnaggtgcagctcaagganaccacgggtccacggcttaacaaccaaatgcagcgtggccttgngccggacgggnaacccanacagctcgctcaagtccaggttcnccccggncgccgccgccganctgtccgggngggcgctccaatcnaattcccc

SEQ ID NO: 90222 - DNA, 521 bp, Triticum aestivum
  unsure (1)..(521): unsure at all n locations
  Clone ID: PAT_TA_90222
ggcaagggctgtgccgccgcactcaaacaagctggtgcccgtgtgatngtgacaaaaattgaccccatctgtgcccttcangccctgatggagggtatccaaatnctcaccttggaggatgttgtctctgaggctgacatctttgtgaccaccaccggaaacaaggacatcatcatggtccaccacatgaggaagatgaagaacaaacgccattgtctgcaaaattggtcacttttgacaatgagattcgacatgaaacgggctttagacctaaccctgggtgtnaaagcgcaatcaacatcnaagcccccaaaactgaccgttgggtcctccccnagaacaaagaatnggaatcaattgtttcttgctgnagggtcgtcntgaattaaanccttgggatgttgcactggggccgccccaancttttgtcaatgttcctggctcaatcaaccaaaccaaggttaattgctcaaccttnaatttttgggaacnaanaaanggcanttggnnaagttattana

SEQ ID NO: 90223 - DNA, 511 bp, Triticum aestivum
  unsure (1)..(511): unsure at all n locations
  Clone ID: PAT_TA_90223
gaattcactagtgattagcgtggtcgcggccgaggtatcgcctcgcgcccgcaccccaggaaggtaagttcaagggctgtcctgagaagctcaaatggctcccaaagttgctgttgccaagaagggcgatgccaaggcccaggccgccaaggttgccaaggctgtgaagtctgggtcaatcaagaagacggcaaagaagatccgcacttctgtgacatttcaccgccccaagaccctgtccaaggccagggaccccaagtaccccaggatcagcacccctgggaggaacaagctcgatcaatatcaaattctcaagtaccccgcttaccactgaagtctgcaatgaagaagatngagganaaaaaaacactcgtcttcatcgtcnaactgaaaggcgacaaaaaaaaaattaaaggcgctgtcaagaaaatgtnngacattcaaggcaagaaaggttaaaacctcatcaagcctgatgggaanaaaaagggtatgtnaaacttacaacaaa

SEQ ID NO: 90224 - DNA, 495 bp, Triticum aestivum
  unsure (1)..(495): unsure at all n locations
  Clone ID: PAT_TA_90224
gaattcaccantgatttccagcgggcgcccnggcaagntttttttttaattcaataccaaaggtggggggtttcaaacacgattaataatgnagcgtncaaaaattcanncaccttanagacacaaacaccttacaaacgttcttanaaatatatggnggnattagttgcccnancntaaagggtttcncaaacacaacttagttacaaacncccgtncaccttatgagatngggccantatgagtagcccgctcaactancctccaacaaccgtgggccttgggccacgttnangggggggggatccacnggcaaaacntgngaaaacnatcaaagnagctccaaaatcctccnttcaaagnaaaattcccttggcaaaaaaaccaagccnncttcctaagggttcccgggggngcctcnaaaaaagnccccntttccaangcttttaatccccaannaanggtttggggccccccctcccaccnaaaaaaagc

SEQ ID NO: 90225 - DNA, 514 bp, Triticum aestivum
  unsure (1)..(514): unsure at all n locations
  Clone ID: PAT_TA_90225
gaattcactaagtgattagcgtggtcgcggccgaggtataatctcgagttttttttttttttttttttgatgcggaagtgagtgctcattaactgtgcccaaataagactgaacaacatgagctgataattgtacaatacatatggcttgtttgtgataatctcaatccaggaacagtacatacaatttaaaacaaaatactcaacaatcacacattcgttcagccaaacaactgacaggaaggnaggcgtacgttcaaaggaccacatgatagacatgcatcgaccatagctccatgatgccttcataactattagtactattcttctctgancgggagaaaaccgtaacggnctatgatcttgcatcctttgtctcctaagtgaaccagcgtgctgtcaattgaaaaaacctttaaaatantcaccgcctaccaanctgaaggaagggaaggngcaattaatccaaccnggggaatccgttcccaaatggccttgcaaatttgaaaatgata

SEQ ID NO: 90226 - DNA, 391 bp, Triticum aestivum
  unsure (1)..(391): unsure at all n locations
  Clone ID: PAT_TA_90226
gaattcactantgattancgtggtcgcggccgaggtgagagcattctaccaccgcaccgcacgagtgaagtgagagctttgcantnaaagttcatcatcgaccatgaagggnaccaagctcgcggngattctcatcctccaagccntcctgntcatgggagncctctcacacgtgaacgcgactattttcccanntgntgcaacaaatgcangtccttctccntgggtcgantctgnnaatgaaaccancccaagtgacccaaagggatggncnggcgggcgcnccaaatcaaaattccctccgcccccaanggcaggccgggaanatacnatttcagggccaaattcancctcaaaagtagngtccgnntttacaaattcanttgnaccg

SEQ ID NO: 90227 - DNA, 244 bp, Triticum aestivum
  unsure (1)..(244): unsure at all n locations
  Clone ID: PAT_TA_90227
gaattcactaagtgattagcgtggtcgcggccgaggtttttttttttttttttttttaaatcgaaagtacctttctacactcaacaagcaaatgctcccggtgtgaacagtaaaatcaaaaattaaaaaaaaaaatctgatttttttgtgacatacttacacaaatgtttgttgtgtatgcaaaatttcatcacaaaatcacattcgcgacctgcccgggcggncgctcnaaatcnaattcccg

SEQ ID NO: 90228 - DNA, 224 bp, Triticum aestivum
  unsure (1)..(224): unsure at all n locations
  Clone ID: PAT_TA_90228
catagaaaactcaaagtatgcnaccaacncgttggggagctcccccaataagggccgaacctgcanggcggggcgcgaattcaactantggatttccgaagcggncgccgggcaaggtttttttttttttttttaganaananaagacntgtnttntaactngngacacanncacaaaaaagtcancgccctcacaaaatngggggnganagactatgangcta

SEQ ID NO: 90229 - DNA, 527 bp, Triticum aestivum
  unsure (1)..(527): unsure at all n locations
  Clone ID: PAT_TA_90229
gaattcactagtgattaacgtggtcgcggncgaggtttttttttttgaccaaaacataaccacaccaatttcacgattaccattacaaagcaaatcccacaattatcaagaaagttttcaagacactcaacatctgatagttaccgacacaacattggagagtcgactgacaaccatagagcagagcaaaaatactgacgaccgcatagattttagcatacaagtgcgattagcacttgacctctttcaagcccatgtgcaaagtacaggaaagttgggttnagcagctccctccttgtagtangcgaacaccacgccggccatcatcatgcatgctctcgccaacaaaagaactggaagggccttgagccttgctaagaaaatacnttgggggnaanactcaacaatccttcttgaaaacaacctaggtcatccccctcaaagncttggganaaaaggttctgatgtancccctccatgtgagaagaaaaaacngcttcttgtcaaaagnaaggtggcncctgaag

SEQ ID NO: 90230 - DNA, 524 bp, Triticum aestivum
  unsure (1)..(524): unsure at all n locations
  Clone ID: PAT_TA_90230
gaattcactaagtgattagcgtggtcgcggccgaggtttttttccttctatgcatattttcgagagccacaaacgaaacaaagtgcattacaaaaagtgaacttctcatgggaatttatttttctcctttgttacaaagtaaaccactaatcaccacaaaatggaccacaccattttttctctaagtacatagcatgataaaaagaatccagtttgacaaaagaactgctcagtacaagtcaagcgaagatcttcagcccaaagcgactttactttcttgtgatatgggcttcaacttctctcaaagagcactgcatttgtttgaataatttacaaaaacaacaagaggcaaaattaacaaactggccaatactttcaaagcgggcatcttcggtccaaatggactttagttaattggggatcttggnntcaacntctcccaaagaggcaccgcaattttgtttgnataatttacacaaaacaacaangggaaaaatttaaaacaattacacaagggangncta

SEQ ID NO: 90231 - DNA, 283 bp, Triticum aestivum
  unsure (1)..(283): unsure at all n locations
  Clone ID: PAT_TA_90231
gaattcactaatgattaacgtggncncggncgangntttttttaaaaaatnatnttctaagaatcattaaaaaaaaagacntgaaggcctgnanattacatatagacgtgctngatacatagtaactatcacattcccgctccnaaaaaanaatacattttttcacccgtgaataatactgngttcaccagttaaaaananaaagataaagtcctttttncccncgggnanctggtcnaatatntgggtttaaagccatnnaaaacgggccgccatctggccc

SEQ ID NO: 90232 - DNA, 559 bp, Triticum aestivum
  unsure (1)..(559): unsure at all n locations
  Clone ID: PAT_TA_90232
gaattcactagtgatttcnagcggccgcccgggcangtgttgaagggaagtctttgaagtggaactgtaaatgatcctttccgaaggagattcngggctcactaagtaattccacgtgggcttcgatgaagtaacttggggaatcccaaacagaggtaaggtttctttgggaggatcttgtaggtagacgaacttctaaccttcctttctttccaaacgtctgtactcaaacaaggttaagcttccgcctggntgcttggtaatgactttgtatgttgggtcaaggaagatncaagtttggtaatatcaangttatgttatggctcctttgggagcccccctaaatgaatacaattgagtcaaaagaagnttaagtttgtgaaaaaaaaaaaaaaaaaaccccgagactaanacctccnggccgcgaaccaacgccaaaccgaaattncccnccggccgcccaagggggggcccgggancaaatgcnaacntccngggccccaaattcccccctaanaanggagtcntaattanaaantcaacngggncggtccgtttt

SEQ ID NO: 90233 - DNA, 517 bp, Triticum aestivum
  unsure (1)..(517): unsure at all n locations
  Clone ID: PAT_TA_90233
gaattcactantgatttcnaagcggncgcccgggcangtcaacacanagcattctancaccgcaccgcacgagtgaagtgagagctttgcacgaaaacttcatcanaaaccatgaagggcaccaagctcgcggcgatnctgatcctccangccgtcctggtcatgggactcctctcacacgtgaacgccgattttttccccaagtgctgcaacaactgcaggtccttctcgggggtcgacgtctgcgacgacgcccaacccaagtgtccccaagggtgctcngcgtgccgcgtggtgtccacnanccccgaaatgtggcgctgcgcggatatgaaatccaacgtcgacgggacctgcgggggnncctgcaaaaantactgatngggtcatgccggnatgatatgtttcgcctaaaataaaataaaagctcaagggagaatgagcancgtcatcgtgcccangcgtgtgtgttgtgggcaanaaagcttanaacaatatgtcgtcncctcncccccgg

SEQ ID NO: 90234 - DNA, 221 bp, Triticum aestivum
  unsure (1)..(221): unsure at all n locations
  Clone ID: PAT_TA_90234
gangtaancgccggncttccanaaaacaagctcangaaccgtntcanctanacccttnacnagatggaanggccgctcnaggtcggggccgacgggancctcaagttntaggngaaggaagggatcgaatacgcgggcgtcaccgtgcanctcccccnggggggagggagtggccttcctcttcaccgtcaaagcanatcgtcnctnccgggaangccnga

SEQ ID NO: 90235 - DNA, 210 bp, Triticum aestivum
  unsure (1)..(210): unsure at all n locations
  Clone ID: PAT_TA_90235
gaattcactagtgattagcgtggtcgcggccgaggtcagtgttcgaactgcttattactgtggtcatagtatcgttcggttgtgttggtgaaacttcgtcagataaagttgctattttatatttgagtgatatttggagtcgttttattacanaaaanaaaaaaaanaaaaaaaanctccgagactagttctctcacctgcccggggggn

SEQ ID NO: 90236 - DNA, 266 bp, Triticum aestivum
  unsure (1)..(266): unsure at all n locations
  Clone ID: PAT_TA_90236
naaatcactaatgattaacgtgggcccnggccgaaggccccaccgcaccaatgaagtgagaactttncacnaaaagnttatcaacgaacaatgaangggaccnanctcgcggggattctcatcctccaaggncgtcctgggcaatgggagtcctcncacacgtgaaacgcccgactaanttcccaaatgnggggaaaaaaagggagngggcttntcccgggggnganntctgtgaaanaaaaccacccccaaattcccnanagggg

SEQ ID NO: 90237 - DNA, 541 bp, Triticum aestivum
  unsure (1)..(541): unsure at all n locations
  Clone ID: PAT_TA_90237
gaattcactaatgattaacgtggtcncggccgaggtagagagagagagagagagagagagagagagagagagaactantctcnagttttttttttttttttgacaaatgataagtanttctatttgtctttaccaaataggtatactcaatatctttttatattaacaaaacatgcccagcaatcgcttggatgcgatgcggtacttangtacaaaggataaaacatcaaatattaaattggcatgcttaaaaggtgtaaagggagctcccgtcgtcactcctcgccgttgggtcnaagttcttggcantctggtcggtgcatcctggccggtacaagcaaagtaacttgctgtgcccctttacctccccccatgcaacaaagagatggntgggtggtgtatgggagaatgttcctaancgtaaaaanggaaccaatcctcanccncaancctgggttaagnancaacccaanagcnggcctggcccaanggttagggngtcaaagnaaancctgcnacaagccttgacaattgttccttg

SEQ ID NO: 90238 - DNA, 460 bp, Triticum aestivum
  unsure (1)..(460): unsure at all n locations
  Clone ID: PAT_TA_90238
gaattcactantgattaacgtggtcncggccgaggttaagtttcaattntcctccgcctccggtctcgagagctcgccanaatggtcgcccacaggttccaccantaccaantggtgggtcgcgcgctgccgacccccggcgatgagcaacccaagatntaccgcatgaanctctgggccaccaangaagtccgcgccaagtccaagttctggtacttcctgaggaanctcaaaaaagtgaagaangncaacggncanatgctcnccatcaanganatnttttnaagaaccccaccacaatcaaaaactanggnatctgggttgaggtaccanaacaagaccggttnncacaacatgttaaaggagtnaccgtggcacgaaccctcaacngnggggggtggggcanatgttcaaggganatggggtccncggaaccncatgcgttgccccctgcattcca

SEQ ID NO: 90239 - DNA, 547 bp, Triticum aestivum
  unsure (1)..(547): unsure at all n locations
  Clone ID: PAT_TA_90239
gaattcactantgattaacgtggtcncggccgangttttttttttagcagctaagtagtatatttcaagtaagtactaaggattggattgagcaatccatatatatagcacaagtacaaaccaagttcatcatgagctgctgctgcaacttagtaaaaattatgtcaatcctacatatcttccttatcaagccaaactaaattatacaacaacaacaacaaggagaggcgaggcgaggcaattatgatncctttgatcgaagcaagacactgcaaaacaaagggctgctgctcagctcactctaacaatttgagctaagttttacaagatgctgcatcctttctgcganttcctcctcctccgcttctgcttcgggnggtggggaaacaaccttgatcgcccgcaacaaaacaaccgcccttgataattccgccngtgntttttgagccgcacnccaatgtagggcgtcncgccaaataacttcctcanctcctcaacccgaagctgggggaataaggaacaancccaanggtgnttcaccaaaaaa

SEQ ID NO: 90240 - DNA, 534 bp, Triticum aestivum
  unsure (1)..(534): unsure at all n locations
  Clone ID: PAT_TA_90240
gaattcactantgattaacgtggtcgcggncgaggtccgcaccgcacgagtgaagtgagagctttgcacgaaaagttcatcaacgaccatgaagggcaacaagctcgcggngatnctcatcctccangccgtcctggtcatgggagtcctctcacacgtgaacgccgactatttccccaagtgctgcaacaactgcaggtccttctccggggtcgacgtctgcgaagacgcccaacccaaagtgncccaaagggctgctcggcgtgccgcgtggtgtcgacgaaccccgaaatgtggcgctgcgcggatatgaaatccaacgtcgacgggacctgcggtgggccctgcaaagaaattactgatngggtcaagncancaagatatgttccgcctaaaatgaaataaaagctcaaaccaagatgagcaagcgtcatcgtggcctatgcgtgtgtgtgtgggcaaaaaaatatgttaacaattatgccgtgtcttctcnctgtgttttctctctcaanaaaaaattgggtttgcttg

SEQ ID NO: 90241 - DNA, 408 bp, Triticum aestivum
  unsure (1)..(408): unsure at all n locations
  Clone ID: PAT_TA_90241
gaattcactaagtgatttcgagcggccgcccgggcaagtttttttaaaccaataataatgccattatttctgggcaaaagcaaacgccgcctctcccaancctcanaaggctcaaaacataaccataataacaaatcctccgccctaaagagacaacatgttagataataaaaagggaaacaaggatagtttgataaaaatttcccgttgggtggccgctgctcccgactcaanggtcaaaggcaanccgctagtccgtggtnggcaacaactaataaccgggtaaggccgcaaagntttgtacgggncccccaaactngggaatgctaaatgttatcaanaccngggaacttgggggagccttggtcaaacctgggggnccaanctttgcccaaagttggangggcg

SEQ ID NO: 90242 - DNA, 708 bp, Triticum aestivum
  unsure (1)..(708): unsure at all n locations
  Clone ID: PAT_TA_90242
tgnccctatngaaatatcaaagctatgcatccnaacgcgtttgggaggctcccccataatnggtcgaacctgcaaggggggccgcgaaattcactaattgattaacgttggtccccggccganggtccgccaccccacaagtgaagtgagaagctttgcacaaaaacttaataagaaaacaatgaagggcaacaaagctccgcggggattcttgattcctccaaggccgtcctggtcaatggggaatcctcctcaacaacgttgaaacggccgatttttttcccaaagntgcttgcaaacaacttgcaaggtcctttctccggggggtcgaacgtctggcgaacgacgccccaaccccaaagtgtcccccaaggggctggctccngcggtggccgccgtgggtggtcnaacgaagccccccnaaattgttggcgcttgcgcgggatatnaaatccaaccgtncgaagggnancttgcgggtgggacccctgcaangaaagtactggatncggntcaatgcccgggaatgaatatgtttccgcctaaaataaaataaaaagctcaanggcgaagatgagcnancgttcatncgtgcctaatgcgntggtgttgtgttggccaacaaatgcttaanacaaatatgtccgtcncctccgccgctgtggnttttcccccnccaaaaaaaaaanttggggttgccnttgtttg

SEQ ID NO: 90243 - DNA, 566 bp, Triticum aestivum
  unsure (1)..(566): unsure at all n locations
  Clone ID: PAT_TA_90243
gaattcnctaatgattccagcggncgcccgggcangtaaatcacataaaantgcataaaactcctggcgtttgcccaatttcctttccaacatgagcaaaccatgcnacggtgccaanacggagtggcctgagctggtcngggcgcaccattaaagaggcggnggagaagattaaaggggacccgaccgggacctcaaagttntcattgtcccngtaggaantgttgtgacacaagaggtncgatnttgaaaccgcgtccgcgntctgggtcnacacantgggcgggggttcccaangantggggtaagctaacttgttantanccctactgggaataaaaagcccatgcanggtctcaaacntcgtccaagtttaatttgccgnaacaaatnancaattggggcatgtttgtgaaaaaaaaaaataanttantggttggtgnttccccnggaaatgtntcaaggtgtgggtgtgttaaggtangttaaattttggttgtaagttgttaaaaaancnccgtttataattatccnggccctgtttaaaattgtcnaaaaaaaaaaac

SEQ ID NO: 90244 - DNA, 266 bp, Triticum aestivum
  unsure (1)..(266): unsure at all n locations
  Clone ID: PAT_TA_90244
gaantcaccaatgantaacgtggncncngccgangntcnaattttttttttttttttttttgacctgaaaatgatcgnataactgatattcaccacaccancaatttatcaatatcaaaggaacgaaattccnttttacgaattgcaaaaaanancggnaaaanctcanttcangcaattgtaacaacangnagaggntaccnanttgacctgttggtttaagaatcaaaactaaatntaacaanaaacacccgnccncggggggg

SEQ ID NO: 90245 - DNA, 549 bp, Triticum aestivum
  unsure (1)..(549): unsure at all n locations
  Clone ID: PAT_TA_90245
gaattnactantgattaacgtggtcncgggcgangtaacaacaaagagcattctaccancgcaccgcacgagtgaagtgagaactttgcacgaaaagttcatcaacgaccatgaagggcaccaagctcgcggngatnctcatcctccangccgtcctggtcatgggaagtcctctcacacgtgaacgccgactatttccccaagtgctgcaacaactgcaggtccttctccggggtcgacgtctgcgacgacgcccaacccaagtgcccaaggggtgctcggcgtnccgcgtggtgtcgacgagccccgaaatgtggcgctgcgcggatatgaaatccaacgtcgacgacaactggggtgggccctgcaaaaaagtactgatngggctcaagccaacaatgatatgtttcgcctaaaaatgaaattaaaaagctcaaaacgagatgaacaagcgtcatcgtgnctaatgcgttggggtgtngttgggcaacaaaattatgtntaacaanttatgcccttgtcntcctcccctgtgnttttcccccncgn

SEQ ID NO: 90246 - DNA, 544 bp, Triticum aestivum
  unsure (1)..(544): unsure at all n locations
  Clone ID: PAT_TA_90246
gaattcactaagtgattancgtggtcgcngccgaggtcccgagncntttttttttttttttttttttttttttttttttttttttttttttttttttaaangngtggacaaganaactcanattattgggagccacncanaatcattacagctgtttattcacgggggatattccggatagctgaanaacaagcaacaccaattttttctcganagagaaaacacancgaccaagagacnacatacnggtataagcattgntggncacacacacaccccanaggnacgatgacnctgcccancncgtccgagcttttatttaattttaggngggacaanatcanatgccgggatnaaaccgattaaatacntcttgcaggggnccaccccaaggngccctcccacggngggttttcaaatccgcgcancncccnaattttcgggggtcgttcgannaccaaaccgggaaccccggaagaaacccttggggaaancttgggggngggngncctcccnaaaaagncncccccccgagaaangggnn

SEQ ID NO: 90247 - DNA, 544 bp, Triticum aestivum
  unsure (1)..(544): unsure at all n locations
  Clone ID: PAT_TA_90247
gaattcantaatgattttcancgggcgcccgggcaagtantcaacacnagctcacaaaaagctagttaagccaacccaaangaaactccatccaacaacgggatggggnccttccgcaaaaactgnccgtttcctttgtgctcctccaaattgttctgttngtcaactcccgccgtgctcaatgagcgggccccgtttggcaatgggagcccgcccaagggatnaatggtgggagctctcgaacctaaacggncaaacantttaaatcccgcctgggtggcccctanaacccgtcggtgcgggagctttaataagtggccaacaagtgttcaaccctgataccgcaacaaaaaactctccnaacaaatggaaggattgaacccctggattgcttcatctagttataacaagtaaaagnttactggcaacgaacnttttnttgaanccaaaagtaaaaacctccccgtgtaccttaaaatntttacnacncccgaaanaaaaattgggttgtttggttgttccggttcaaaaaaaaaaaaaaaaa

SEQ ID NO: 90248 - DNA, 332 bp, Triticum aestivum
  unsure (1)..(332): unsure at all n locations
  Clone ID: PAT_TA_90248
gganaaaactaatccccaaggnntttttttttttttttttttttttgggttttggaaacaaattantttcctttccaattttcntcccaaagattgtttanaaccggtatgtacacgctgacttctctcgtctaataactcaatcaaaactcaaaatgcatccatccaaccatccatcanggacanaagnatttcgagtttaaaatccgaatctgatcccgtcaatgagtatgcntcgcaaccacattccaaaaacggtaacctggccgggcgggcgcccgaaatccgaaatccccgccggccgccaagggggggcgggaacaaagcgaact

SEQ ID NO: 90249 - DNA, 542 bp, Triticum aestivum
  unsure (1)..(542): unsure at all n locations
  Clone ID: PAT_TA_90249
gaattcactagtgattaacgtggtcgcggccgaggtaaatccacacccaatctcgtctccgatngactcgagagctcgtcgaatcctcctcccccatcgtctcaagatgcagatcttcgtgaagaccctcactggcaaaaccatcactctggaggttgagagctctgacaccattgacaatgttaaggctaagatccaggacaaggagggcattcccccggaccaacagcgcctgatntttgctggcaagcagctggaggacgggcgcaccctggccgactacaacatccagaaagagtccacccttcaactggtgctccgcctccgtgggggtatgcagatttttgtgaagaacctcaccggcaaaaacatcaatctggagggttgagaagctctgacaccaatnacaatgtttanggtaaaattcaagacaaanggaggggcantcccccgggaccaancaanccctgatnttttgctggnaaacaacnttganggatggccgttccctggctgactanaacatncaaaaanggggtcan

SEQ ID NO: 90250 - DNA, 339 bp, Triticum aestivum
  unsure (1)..(339): unsure at all n locations
  Clone ID: PAT_TA_90250
ngaattcaccaatgattcnaacgggcgcccgggcanngtgcaaananccctnatgtttggggagctcaatgnttgaggaagcgnaaactggtctctgntgcntaaaanaaaagtgaattggtggcccggggggnttnctgggnggnttantctcctccaatnaagcaanaaaggnnggagaagccctggggaaacnaaggncctatggttngctttcaatccaaaggnggtaaccgtttcaaagaatttgaaaactgaacccaagcnaagaatntggtgntggggaatcctcaaanctttttgggactcccaaacttttgtccccctctggccaaattg

SEQ ID NO: 90251 - DNA, 316 bp, Triticum aestivum
  unsure (1)..(316): unsure at all n locations
  Clone ID: PAT_TA_90251
gaattnactaatgattccagcggncgcccgggaggtccaacaactgctaaccaatgaggagattctcnacaacggnatgttcgccctggttnccagccatgacaccanctccatactcatgacgtgcatggtcggncaactcnccaatgattcggntaacctcnccgctatggtgcaaagagcatgaaaagattgcaaggnacaaggntgagggaaagggtctcaactgggaaaaactctcaaaagatnaaagttcacatgggaaagtttgcaaaaggaganacttcgcatcgaacctcctatcttcgggcaactt

SEQ ID NO: 90252 - DNA, 482 bp, Triticum aestivum
  unsure (1)..(482): unsure at all n locations
  Clone ID: PAT_TA_90252
gaattcactaatgattaacgtggncccgggcgantctctgntcaactctantgnttcccctccanccancgattgagtgaaaaagctctccgtccgccggaaaancnangaacaaggggggcaagggcaactgcatcnaaatcaacctcgccatcatcctcccgcccctcggggtcttcctcaaattcggntgcgggcacgaattctggatttggctcctggtcaacttcctcgggtanatcccggggatnatctacgccatctacgccaacaacaaataaatcaaaggaagccgcccccagtgttccggcgggaataataataaaattccaatgaagatttcgcctgtctaattcctaacggtgctccgggtaattgcctgtgtggggttctttgaantcttttccgtgtacggttgacaaagcgaaatttctctggtgggtttcaagggaccgtgtgaaaaaaaaattcancctccttta

SEQ ID NO: 90253 - DNA, 645 bp, Triticum aestivum
  unsure (1)..(645): unsure at all n locations
  Clone ID: PAT_TA_90253
ccgaacccngcangggccgggccgccgaaattcaactaaatggaattaaaccgtggggccgccgggccgganggnccnaaatccnccgaagttttttttttttttttttcaaccaacaaaaantngaatccctaattcgcaattccnaanaaaacgcaaacttggtttggtccctaaaaaatgccttttcaaaaaacacaaacaaagccctggaaaactggttggtcaaaatcaaagaaaagatggccaaaatcaaaggggcgtcctttagctggctaatgacatccgattcaaganttaattgaagtaaatatacaaagcacaagggtccctgaactaaagaccaacctatgtacaagcaaaccaaggagccccttgcaacaagcaagtaagactcaaatgggtggattttatttaaaagatnaagtaacaacctaatcaagaacttccacatgaacaacaataaagcctgggtganggatcntttgggggacctgggtgcggttcactgggggaatttggngggccgggctantcnccgggagaaaaccctaanaanccccacccaaagaagccccttactaagggtcancccntgtgcaaaaattaccccnataaaagcacaaggntgtnccttggtgggnc

SEQ ID NO: 90254 - DNA, 368 bp, Triticum aestivum
  unsure (1)..(368): unsure at all n locations
  Clone ID: PAT_TA_90254
gaattcactaatgatttcnagcgggcgcccggggcaagtgtctccaagttttttttttttttttttttttgcataaaaaacaagggaaatgtattaagttaatcctgcanaaaaacanaatggctggccgttacaatctaacaaaccctcannnaattaacttacacnagcaattcacaaaacccnagttggtaatgttaatggtgggataaggaagcnaaaaaaaaaaggngngtacgaaatgggaanaagcactcccnccgtccnccccanaaaatggnnccgaacaaaatttaaccaanagttacttaaacgnccnaaattnaaccnaaccncccgggcggggggaacnnnaaaaaaccggttaa

SEQ ID NO: 90255 - DNA, 319 bp, Triticum aestivum
  unsure (1)..(319): unsure at all n locations
  Clone ID: PAT_TA_90255
gaantcactaangattaacgtgggcccngncgaaggggttttttttttttttttttaaaaaaaaanaaaggcccaaaatggnttatataaaagacatgaagggctggaaattaaatataaacgtgggtaaatacaagtaactatcaaattcccactccaaaaaagaatacatgtattcacccgtggataatgactacagcantagttaacaatatataaagctcanatgtgcgcgtggnanctgatnaatatatgcgttcaaagccaagagaacaagccgccacctggccgggngggcggctcnaaaatccaattcccc

SEQ ID NO: 90256 - DNA, 185 bp, Triticum aestivum
  unsure (1)..(185): unsure at all n locations
  Clone ID: PAT_TA_90256
tttnagggtggacaactaattanaaataactccaaagcttatggcatnccaaacgccgtttggggaaggtccccccaanaatnggtccgaaccttgcaaggggnggggccgccgaaatttcaactaaatngatttaaacgtggggncccccnggggccngaaggtgaaaacctaaatcctcccaa

SEQ ID NO: 90257 - DNA, 211 bp, Triticum aestivum
  unsure (1)..(211): unsure at all n locations
  Clone ID: PAT_TA_90257
gaattcactaatgattaacgtggncncgggcgaggncnaatctcnagttttttttttttttttttttataaaagcantacaaccaacctcanatttatttgttgtcaaacaccaacttcgtaatcatttccaaacaccantgacaaaaagtgtaggnaatantcaatggnaaactttccaaagactcncgcggaacacctgcccgggcggg

SEQ ID NO: 90258 - DNA, 603 bp, Triticum aestivum
  unsure (1)..(603): unsure at all n locations
  Clone ID: PAT_TA_90258
aaaaacccaactatgcaaccaaagcggtggggagccncccaaaagggcgaaccgnaagggggcgcgaaattactaaangantaacgtgggcncgggcgagggccaatcccnagtttttttttttttttttcncaaaattaaatganaaaaantaatgncntgaantaagtaaatgaaaaaaaatccttggncanctacaaaagaaccaccaacataacatgaaagaattataaaagctgcttcantaatcccnttctcaaaaagagctatatctagggcccaaacaaanactcttgggtccccanccaacctanttgggtggtggcttgccgttcccaaaaacaacgacaagcancanatggggtcanctcgtcccaagcctccattcangtgaacaaggggancancaaagcttcaccaagtaangggcaatcctggcaaagcntctccttgaactggctccganagggagaagtagcacctctggggcgggtcacacnccctggggaaaagtggggntctgggaaaaaagggaaganntccccccggcaaaaaaaggccctggantccttcctcaaaattganaaaanggggtggcanncc

SEQ ID NO: 90259 - DNA, 548 bp, Triticum aestivum
  unsure (1)..(548): unsure at all n locations
  Clone ID: PAT_TA_90259
naattnactaatgatttncagcggncgcccgggcangtctccggagagagccaagaaagctatgacanaaagctnaaacggnagcaacanattaaatnanggacccccatcaagtcgccaaattccaacactgtnaccaaacacaaacctgcaagagagctgggaagaaaacggtancantggtctcttcttcttccaaaagcgcgttaaaacacanattattcccgccgccaagggcaaaagaanaattgagtacaagcaacgacgaatgaccacgacgacaaaagaatttcttgtcnagctcaagagaaccaatttnaactccaactccaattccaatttcaaggggggntgaacaactcctcaacaattgatgaatggggcccgtccgnncngtttggttccttccancnaagcaanatatnctaactacatggntnaaggcaataccaatctcaagatttaagactcangnttactnactccgacttttaattaatttggntttcaacctanaagttcaacaanggaattggntcctctgncnc

SEQ ID NO: 90260 - DNA, 208 bp, Triticum aestivum
  unsure (1)..(208): unsure at all n locations
  Clone ID: PAT_TA_90260
aaaagaataaanggggcccgggccanggttncaatccgncaattttaaaaacccccggtgnaactttccctccctttggaattgnnccnggttaaagggggcgtggaaaagtttgttaaattactaatatgnaaggaacaacatttagtttaattaaagatttttccncccgggggaatgngaataatatntnttaaacantttgttg

SEQ ID NO: 90261 - DNA, 290 bp, Triticum aestivum
  unsure (1)..(290): unsure at all n locations
  Clone ID: PAT_TA_90261
gaattcactagtgatttcgagcggccgcccggggcaggtcaaaagtgcaccaanaacttggcctgggcggtggcatacaacatagtggccaatcccccgtcgcgggctgggagccgctactggcctcaatttcgatttccccnatgaacaaccctcctnctttcnanggagggacngatgggcccctngagncccaatcctttngtccgtcaagcaattncttngtccnggaaagctngcaatgggnattntttnaaaaaangggnggnaaanaaaccgggnccggggat

SEQ ID NO: 90262 - DNA, 409 bp, Triticum aestivum
  unsure (1)..(409): unsure at all n locations
  Clone ID: PAT_TA_90262
ccgaggtccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcngtgggccctgcaagaagtactgatcggctcatgccagcatgatatgttccgcctaaaatgaaatanaagctcaanacgagatgagcaagcgtcatcgtgccta

SEQ ID NO: 90263 - DNA, 546 bp, Triticum aestivum
  unsure (1)..(546): unsure at all n locations
  Clone ID: PAT_TA_90263
actaagtgaattaagcgtgggtccgcggcccgaangtcgngccgangtggganccctgaaaccctgaagaanggtggaggaaagaggtganagccaagaagccccccgccgcaagccccaaggggtgattctgggtgggatcntaagaagaaagacactgtgaagtgcaagattgatgcaagggcaaataagggcttgctctgggccctcttccaaagngggccacctgctgctgggtgggtaagcaaatgggggtcatgggggaagggccttccccttccaatgngtgggcaaacgnaangtgactctctgcaatgggcaagaaatccctgccggctgaagccccggtnaagggctgaatttggggaaactttgcccctttgttgggagaacgggctaancaaactttgtcccaaagccaagaaagggnttgttaattgacaagggtgggtatgggantaaatcctggctaacttgaaatggtaatgttccgaaccaaagggtgtttgtnnccgtccaagcaatgttcaaancgcaacaagggcn

SEQ ID NO: 90264 - DNA, 165 bp, Triticum aestivum
  unsure (1)..(165): unsure at all n locations
  Clone ID: PAT_TA_90264
gaattcactaatgatttcnaagcgggcgcccnggcangngaactaatcccccagttttttttttttttttcggcgtgcgtggtancaaccnctgcggtacggnccantttnttaccaaaacaattgntgattacaccagancgagancacaacanccacnnggga

SEQ ID NO: 90265 - DNA, 380 bp, Triticum aestivum
  unsure (1)..(380): unsure at all n locations
  Clone ID: PAT_TA_90265
gaattcactanntgatttcnangcggncgcccgggcaggtctcgagcttnttttttttnttttttttttttaaccanatgcaggnatgtatcatttttattgtctcgtcntcaaatgattaaaaaaatcaaattggntgtctacactctaanaatggtaaacgttattgctcaaaangatgtncaaacaaantaagtaanattacaacgaaaancagggtnnaaatacanccaagcatttagccaccanactttntnanaccaaagncaaccgcattcaagcnaagaggctcccaangaattggcttccnatcccccnatccccccctgnaattgcaatgtccnaaaggtttctctcgggtcncnctaagcnangagcaa

SEQ ID NO: 90266 - DNA, 446 bp, Triticum aestivum
  unsure (1)..(446): unsure at all n locations
  Clone ID: PAT_TA_90266
gaattcactagtgattagcgtggttgcggccgaggtgcattctaccaccgcaccgcacgagtgaagtgagagctttgcacgaaaagttcatcaagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgcccgcgtggtgtcgacnangccccgaaatgtggcgctgcgcgggatatnaaatcccacccgtcgacggcacctgcggtgggcccntgcaagaagtactgatcggctcatgccagcatgatatgttccgcctaaaatgaaataaaaaggctcagacgaagatgancaagcg

SEQ ID NO: 90267 - DNA, 296 bp, Triticum aestivum
  unsure (1)..(296): unsure at all n locations
  Clone ID: PAT_TA_90267
gaattcactaagtgatttcgagcggccgcccgggcaggtnccgtanaaagcatgtattgtccagcanggngtaaacanaaataagtgtgcaanttttactggntaccttganacatatatgaacctttcatagtttcattacagttagtttantcnctangctgatattgagttattcacatgggactctacanngantacaacacaactattccctccgtccggaagatacttantgaaggaatggnntgtntctagaccgtattttanntctanatacatccangtggcnagaa

SEQ ID NO: 90268 - DNA, 483 bp, Triticum aestivum
  unsure (1)..(483): unsure at all n locations
  Clone ID: PAT_TA_90268
naattcactagtgattaccgtggtcgcggncgaggtatcccatccccaggtcataaacccaagtcggactcgccttcctcctccccaactactcctctcctccgcgcatcgcatcgcaccgggggtcacctgaggtanatcacatacacaatggngaaggctgtggctgtgcttaccggcagtgagggngtcangggcaccatcttcttcacccaggagggagatggcccgaccaccgtgacgggaagcgtcactggnctcaaggaagggctccacggcttccacgtggacgctcttggtgacaccaccaanggctgcatgtcanctggaccacatttcaaccctgctgggtcatggtgcatgggggcaccaagaagatgaaatcccgccactgcttgggtgatctttggaaatgttgacangctgganccggnatggngtttgccaacaatcantgttactggncngccaatatnccccctt

SEQ ID NO: 90269 - DNA, 572 bp, Triticum aestivum
  unsure (1)..(572): unsure at all n locations
  Clone ID: PAT_TA_90269
ngcactattnggaataactcaaggctatggattccaacngcgttggggaagctcctcccaatatggtcggaccctgcagggcgggcgccanattcaacnaagtgaattaagcgtnggtcgccngcccgaggtcaaaacaattcaaagggttctcnganggtncctcccgaatcgtncaaagagctgggngggcgccnggnngtgcaangangccaacngagccaagtaccnttgcttccctgagcaaagancggtccccgccgcggcgggtctccgaagatgcccnggagcccatccccaatcatcgaactcaagccggcttgtntggccgggangcgnccgnaagagttccganaagcctgcgggcccgcccttgggagaaactggggacccttcttcctgggcntgtttggnacattgggaaatgggagccttagcttttctttgccngaggggcgattaaacngccacccaagaagaggttcttcaaaccctncccactggggaagaagaaanaaaggangttacncaaaaccatttgtccaccggctgaanaaaggctgggcattggg

SEQ ID NO: 90270 - DNA, 443 bp, Triticum aestivum
  unsure (1)..(443): unsure at all n locations
  Clone ID: PAT_TA_90270
gaattcactagtgattagcgtggtcgcggccgaggncatcactattctgacgagcttgattgcaatgtcactatattatggttaatgtatgtgaagtgctaaaaaaaaaaaaaaaaaaaaanaaaaaanaaaaaaanctcgngacctgnccgggcggncnctccaaaatcgnattcccgcggncgcaattccggcncggcgaccatggcnanntcgggccnaaattcgccctanacaagattccnccttanaattcanctggccgncnttttaaangcgtccccgntttggggaaaancntggcggntaccnaacttaatcncctntgcagttaaatcccccntttcgcanagntgcgccnttntacngaatgnggcccggnacccgatcgggccttcccaanaatttnctcncccctnaantttgcgnatggtcgaacccct

SEQ ID NO: 90271 - DNA, 173 bp, Triticum aestivum
  unsure (1)..(173): unsure at all n locations
  Clone ID: PAT_TA_90271
gcgaattcactaantgattagcgtggtcgcggnccgaggtgtcgcttcttanttcattagcaagatttcaaactatttcctgtattgcagcacattantagtantgctgtattagcaattttcaaaggntnagganggaagcaannaanaacctgcccgggcggccgcncgaa

SEQ ID NO: 90272 - DNA, 539 bp, Triticum aestivum
  unsure (1)..(539): unsure at all n locations
  Clone ID: PAT_TA_90272
ggaattcantanatgattagcgtgggccgcngccngagggttttttttttattccgnttagaaaacaccgtccaancctttanttctgaacccgaacaacanacatccacttttattccggggtaagtaaacatctaaagtacacgagacgatattactcctgggttcaacanaaggtccgtggcaagtaacttgtactgctatnacnagatgaaagcatccanngcgggtgcaatccntccatttgntccgggagagggtgtttgtgcggggtaatcaangggctgaacaacccngggtggggcaacctaattccaagcttgccgcaccggaccgggtgtangggggcanccaaagcggggactgtaactgtttggcccgggtanggggtcnnagagnctcccancaactggatccctgggggnggggccncatgggcaanancggggggccgcctcaatgnagcnacggngggagatgnaccaaccaanaaccattctgggaggagcanaangggaaaacgcgcaacctcctggcgg

SEQ ID NO: 90273 - DNA, 473 bp, Triticum aestivum
  unsure (1)..(473): unsure at all n locations
  Clone ID: PAT_TA_90273
gaattcactaagtgattaagcgtggtcgcggccgaggtccaanagtgacctgcaggctttgctgtgcggtgtactgcaggtcatcgtcccgaaactgagcaactcagatgcggagcccattatcacccagaatgctgatcagttgatgtttctgtttctccgtgtctttgcttgccacggttctactgtacatgaagaagcaatgcttgcctattggtgttcttgcggatgctattggtccagattttgtaaaatacatgccgngagtttttcaagtaccttgaagcaggcttgcagaatcatgaagaataccaaagtatgctccatttctgttggagtgggggggtgacatttgccgtacactagaagataaaagtgtttgccattctgtgatggnattatgactgttctcctcaaggatctttcaaatccaatgctcaaccgggtcctgtcaaancctccattttctcatg

SEQ ID NO: 90274 - DNA, 464 bp, Triticum aestivum
  unsure (1)..(464): unsure at all n locations
  Clone ID: PAT_TA_90274
gaattcactaagtgatttcgagcggccgcccgggcaggtttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgccgtgtggtttgcttgctcgctctcccatgctctgcccatggtgtccttgtgtgtatgtgtgtgtgcatgtgtccctgtaattgcttcatctatccccactatggatggagtgatgaatatgtaagaatgaaagatttacctaattaactactcctaaatcgctacttcggttaaaaaaaaaaaaaaaaaaactcganacacctccggccgcgnccacgctaatcgaattcccgcggccgccaatggctg

SEQ ID NO: 90275 - DNA, 663 bp, Triticum aestivum
  unsure (1)..(663): unsure at all n locations
  Clone ID: PAT_TA_90275
ngacacttatnagaaaanctcaagcttatggcatccaaacggccgtttggggaggctncccccatattggtccgaaccttgccagggcgggccgccgaatttcactnaatngatttaacggtgggnccgcgggcccgagggtttctttgnctnactngcgnactccgctcaaagccccggggttccgtccgcgcaagctcaaacgccaaagatgaaagaggtgggtacaccgaacgactttcttccgcgcaagattctcggggaaagaaacgtgcaagcagctggtgggaaagggactacaaaagccaaagtttaagaggctganacgcaccaataaagttggatggggtccttcacgggtgtgatgggcaatnacgcactaacttcgaaataaagacatgtgtggatggcataaacacaccatatactggaaaatggatcaaacaagaaacaatgtccctttacgctctggtagtggaaaggataaataaaaccgattttcaactaattccgaaaatccgaccttttgaggtttaaaaaaaaaaaaaaaaaaaaaaaactcngaccttgccccgggggcgggncgctncgaaaatccnaatttcccccgcggccggccatgggcgggccggggaggcatgcgaacngtccggggccccaatt

SEQ ID NO: 90276 - DNA, 298 bp, Triticum aestivum
  unsure (1)..(298): unsure at all n locations
  Clone ID: PAT_TA_90276
atttcgagcggccgcccggncaggtcaaaatcanacatccttgcaaagtgnttcccaatttttggacncaaaatgggttatnctctgangcantgtaccactttaattgaaaatgcacancatgatgggtaccttaaggacaacttttttggtttccatacnttaatggtcttcaaaaaccaccctctccaagatatancgtcttgtnaagcatgtgataagctactccaattggnaaagatgaaaaatacaccgttaaaatagntgaantcgtgcttaattacganaaanactattg

SEQ ID NO: 90277 - DNA, 163 bp, Triticum aestivum
  unsure (1)..(163): unsure at all n locations
  Clone ID: PAT_TA_90277
gnantcactnaatgattcgagcggccgcncggggnaggtcggccaagcctctgattgnggntgacatgttcganaaagttgagctcaangntcnggggctntggctccccgtcngtccgtaaaatacccccgnctgtaagcctcaaagcggcaggtcnggngt

SEQ ID NO: 90278 - DNA, 455 bp, Triticum aestivum
  unsure (1)..(455): unsure at all n locations
  Clone ID: PAT_TA_90278
gaattcactaagtgattagcgtggtcgcggccgaggtatcactgatcaccagcacagccgcgcatccaccgttgctangcaaggtcgaccaagcagcaccgagatggctgntgccttctcctccaccgtcggtgccccggcttctacgccgaccaacttccttgggaagaagctcaagaagcgggtgacctcggccgtgaactaccatggcaagagctccaaggccaacaggttcacaagtcatggcaagcggaaaacctccacgagaaagangaacacngncaagtgggaagggtcttgcgtancgatatctccnncgaccagcaagganatcacccanaggggaaagggcatcgtggactccnctctttcaaagcgcccacgggcgacngggaccnacgagggcgtcctcagctcctacnaaatacgttcagccaaggggnctcaanaaaatt

SEQ ID NO: 90279 - DNA, 330 bp, Triticum aestivum
  unsure (1)..(330): unsure at all n locations
  Clone ID: PAT_TA_90279
gaattcactagtgattagcgtggtcgcggccgaggtagagagagagagagagagagagatagaganagagagaactagtctcgagttttttttttttttttgncaaatgataantanttctatttgtctttaccaaataggtatactcaatatctttttatattaacaaaacatgcccagcaatcncntggntgcgatgcggtacttnngtacaaatgatanaacatcagatattaaattggnatgcttaaaaggtgtnaaggnaanctcccgtcgncactcctcgcccgttgggtcnaatttcttggcannccngtcggggngcaacct

SEQ ID NO: 90280 - DNA, 343 bp, Triticum aestivum
  unsure (1)..(343): unsure at all n locations
  Clone ID: PAT_TA_90280
gaattcactaagtgatttcgagcggccgcccgggcaggctttttttttttttttttttttttttttcgcancaccccaatagagtatttgtatctaggtcatttaaaaggncnaaaaattaattaaccgtatttcaaatttaaaatttgaaaatgggggggtantcctatncattgtgcatgntttacttaannaaaacttaaaaatagagtgaataacnaatatttcttgccgntactctaataaaaacntcggncgctaccacgctnatctntattcccncggacnncatgggcngcccgggnatcattctacntcgggncccaattcgccctatnngtgg

SEQ ID NO: 90281 - DNA, 457 bp, Triticum aestivum
  unsure (1)..(457): unsure at all n locations
  Clone ID: PAT_TA_90281
gaattcactaagtgattagcgtggtcgcggccgaggtcgagcgcctcctcctgtctcgccctcgccccccgtcccctcgtcggcgcccgatctaagtcaagatgagtcgtggcgggagtgctggtggtggtcaaagttctctgggttacctgtttggagatggtgagcctgcaaagcccgctgcagcaccagctgcgaagcccgcacctgctgagaaaccagcaccggcagctgctgatgtagccaagcagattccagctggcattccaggtagccgggcgaacaactactaccgtgcagatggccaagaacacgggcaacttccttacggancgtccttcaancaaggttcatgctgctcctggcggtgggtnctcccctgggctacntgtttggcgggaaaggtgattgttaatgantgcttgccttnaatgaaaccnaaacgatgaaatttggg

SEQ ID NO: 90282 - DNA, 250 bp, Triticum aestivum
  unsure (1)..(250): unsure at all n locations
  Clone ID: PAT_TA_90282
caaggggggcgggaatttantaaaggattncagcgggcggccgggcaagggtgataaaataagctctannaaanaaaaanctccttntancttcctcaaaanaagcaccanaactacctattatgggatttccataaccattccggcganatantggcangcaactcccnccaatattntcaagaaananaatacttttntnataatgccaatgcnngatnatgtagttgacaacctatttntgggaagg

SEQ ID NO: 90283 - DNA, 353 bp, Triticum aestivum
  unsure (1)..(353): unsure at all n locations
  Clone ID: PAT_TA_90283
gaattcactaagtgattagcgtggtcgcggccgaggtttttttccttctatgcatattttcgagagccacaancgaancaaagtgcattacaaaaagtgnacttctcatgggaatttatttttctcctttgntacaaagtaaaccactaaccaccacaagatggaccacaccattttttctctaagtacatagcatgataaaaagaatccagtttgacaaaagaactgctcagtacagncaagcgaangatcttcagcccannagngactttactttcttgtganatgggcttcanncttctctcacangagcaatgcatttgttgtgaataatttacaagtcnncanaaaga

SEQ ID NO: 90284 - DNA, 450 bp, Triticum aestivum
  unsure (1)..(450): unsure at all n locations
  Clone ID: PAT_TA_90284
gaattcactaagtgatttcgaagcggccgcccgggcaggtcaatgatgtcatcttctccattgtttgccaatgcaccccctgagaagaaaggtgtcaagaactttgcgattgacttcctcatgggaggagtgtcagctgcagtttccaagactgctgcaagctcctattgagcgtgttaagctgcttatccagaaccaggatgagatgatcaaggctggcaggctctctgagccatacaagggtattggtgactgctttgggcgcaccatcaangatgaaggctttggctcactgtggagaggaaacactgctaacgtcatccgttacttcccaactcaagggctttganctttgcnattcaannggattacttcaagaggatgttcaaacttcaacgaagggacaagggttggnttactggtagtgggntcggtgggcaccctttgctt

SEQ ID NO: 90285 - DNA, 478 bp, Triticum aestivum
  unsure (1)..(478): unsure at all n locations
  Clone ID: PAT_TA_90285
gaattcactaagtgattagcgtggtcgcggccgaggtgaactatttactagaaaaaaaaagggggcaccctgtccttttttaaccaatgccgaatcgacgacctatgtataaaaaagagaaattttttggatttgaagaaaaaaaaaaaaagaattctattaattttcantttccatttatttaggtaggtttttcttaatnaanattgaaaatttattaaaggaggggcaantaaaaaattacaggaaacaccttttggctgnncaatgantatattttttatcctnagggngggaaggagccccnccttaatattttatcnagcccttatataagggtttccgggnatacttggagnataatnncccaatanccaanaggaangatagnngggatanggctcaattacttaaaaaaanaaggatatnggaaantaagcntattaaaaaaaaaaaaaaaaaaaactcgacctgcccc

SEQ ID NO: 90286 - DNA, 455 bp, Triticum aestivum
  unsure (1)..(455): unsure at all n locations
  Clone ID: PAT_TA_90286
gaattcactagtgattagcgtggtcgcggccgaggtgagcattctaccaccgcaccgcacgagtgaagtgagagctttgcacgaaaagttcatcaagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacnagccccgaaatgtggcgctgcgcggatatgaaatccaccgtcgacggcacctgcgggtgggccctgcaagaaatactgatcggctcatgccancatnatattgtttccgcctaaaatgaaaataaaaagctcaanaccgagatnaacaancgtcatcttnn

SEQ ID NO: 90287 - DNA, 437 bp, Triticum aestivum
  unsure (1)..(437): unsure at all n locations
  Clone ID: PAT_TA_90287
gaattcactagtgatttcgagcggccgcccgggcaggtcgccatcagccaaggaaccgattgctccaaggtgcgttaagcgtgagatcagaaccatttcagatgcatggtgagagcgaaataaatcgtggaagccggccgtccttgctgcatggctccaccgcgtttaatttactgctttactagttctactgtttccctaataaataaattagttttactgctgctgctgcttcgatcgtacgttgtggcgcagttgttgccacgagagctgtgatcttgtactcctgaggggacctcgtgtactttgtcggaactattgtaatgcatgcttacatctatatatagatgatgaacaagcgaaaaaaaaaaaaaactcgagaacctcgggccgccgaccaagctaatcgaattcncgcggccgccatgggcgggccg

SEQ ID NO: 90288 - DNA, 344 bp, Triticum aestivum
  unsure (1)..(344): unsure at all n locations
  Clone ID: PAT_TA_90288
gaattcactagtgattagcgtggncgcggccgaggtctagtcncgagattttttttttttttttttttttttttttcngcgncntcttcttcttcttcttcttcttcttcttcttcttcttcgttcttcttcttcttcttcntcttcatcttcntcttcttcttcntcttcttcattcntcttctncttctnctnctccgtcctcctcagcctcntcctcctcatcctncttcttnantctncaatctaattcatacttctncttcanangatcnacgttctncgacgntcctncgttctcatncnccattcanccgttanannaggcgcctagctcccttcaa

SEQ ID NO: 90289 - DNA, 353 bp, Triticum aestivum
  unsure (1)..(353): unsure at all n locations
  Clone ID: PAT_TA_90289
gaattcactangtgattangcgtggtcncggcccgangttttttttttcacatcaatttccagacatgcaacaagtccaagttttattcgagtggaagtagctagtatatacacgangatggnatcactgtataaggtccgtgcatggngcggtagnggtaacttggtgatgatacgttacatncattacatacggagggcatgcattggntgcccgcatatagtatatgncgtcctaggccgccgttccgttacaataaaaccggatcgatcctttgccaattgttttttggaaagaangnagggcctgcgccaacgggggtgtcaaatttagggggctgggcccacctgcc

SEQ ID NO: 90290 - DNA, 374 bp, Triticum aestivum
  unsure (1)..(374): unsure at all n locations
  Clone ID: PAT_TA_90290
gaattcactagtgattagcgtggtcgcggccgaggtgaagaactaantctcgagttttttttttttttttttttttttttttttttttttttttttttttttttttacaaaaaanccgtcngtcggctatatttttaagttaanagttggnaccgacatgcacggtccaaatggntttcttantttatncanaccactcaccggngactcccngngccaacngccanccctaacagaatccgggaangcacaaattggggaacancgnnctcataacgtttacacncaagggcaatgncntaaagtncgtaaaataaanatggctctggaagtgggaagnaaaccaanaaccncctttgggtggatttccnccc

SEQ ID NO: 90291 - DNA, 426 bp, Triticum aestivum
  unsure (1)..(426): unsure at all n locations
  Clone ID: PAT_TA_90291
gaattcactaagtgattagcgtggtcgcggccgaggtgagagcattctaccaccgcaccgcacgagtgaagtgagagctttgcacgaaaagttcatcagcgaccatgaagggcaccaagctcgcggngatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcgtcgtgccgcgtggtggtcgacgagcncccgaaatgtgggngctgcgcgggatatgaaatccaccgtcgacggcacctgcgggtgggccctgcaagaaagtactgatcggctcatgccaagcatgatatgttncgcctaaacntganataaa

SEQ ID NO: 90292 - DNA, 182 bp, Triticum aestivum
  unsure (1)..(182): unsure at all n locations
  Clone ID: PAT_TA_90292
ccgaagtgaactaatctcnagttttttttttttttttcaaaaaatcancaanattttgnggatttaatttatggcancatcaggaggacatctnacggnaatcgtccaagtcttttcctccccgttcgaaatttcttcanntcctctgttttcttgcgggtaaaattaacgactgcccgggg

SEQ ID NO: 90293 - DNA, 330 bp, Triticum aestivum
  unsure (1)..(330): unsure at all n locations
  Clone ID: PAT_TA_90293
gaattcactantgattaaggcgtggncgcggccgaggtcaatgatatcctggtcaacattcttgatcgactccatgtccgcgacgctgtgagaaccantgtcctctccagacggnggnggccaagcttcctgccatgctcccacagcttagaataaatgctcaggacatantgccctcaaaaantaaaaccggcatgtccgntgatgaaattggttcgaatgtccaaatgcagttggtatcaaaagcgacaaaagagcatactgggcaccgcaaggggattcaanttcnaaattgcaaacaaacncgctttcttttagtggcgngggttc

SEQ ID NO: 90294 - DNA, 629 bp, Triticum aestivum
  unsure (1)..(629): unsure at all n locations
  Clone ID: PAT_TA_90294
agaaataaccaaagcctatggcaatccaaacggcngtttggggaaggctcctccccaatatggggccgaacctggcaagggcggggcggcgaattcaactaagtggattaagcggtgggtcngcggggccgaagggtcttttctccgaagccctcctgggccccccaataccaaacattcctaacccgggatttttaangaagcaanatccaagggggggggtttcaagtcaaatgccataacgtcngtgggccctgttcangtgngaatgtttgtgggatnttctacgccgcctgggntcaaagaccggtgaagggggcctccctcaanaagcatnaaacgctgccnggctggcggtnatcnnagaaccgtnctacaatccgtcaatngttcctccngtctatggcccggacnagggganaanggccaaagatttttcannttgncaaaagattcgngtccgtccctccctnnaaacaatccgnncggggcttnngggggcttcaancctttccctccctcaacccctcctttcggnccttttcaatggggggagganaacggnggttcgntcctccnctccggggcttgggttttttgcctttgggntttcntccggtctggnggtc

SEQ ID NO: 90295 - DNA, 187 bp, Triticum aestivum
  Clone ID: PAT_TA_90295
gaattcactagtgattagcgtggtcgcggccgaggtgagcaatgatctgtctgtcgtttaattactgtatttctattcctgcgtcggctaaactcctgtgcccctgagactgatttgttgtgaaatgcaagttattagattgcaaaaaaaaaaaaaaaaactcgagactagttctctacctgcccgg

SEQ ID NO: 90296 - DNA, 463 bp, Triticum aestivum
  unsure (1)..(463): unsure at all n locations
  Clone ID: PAT_TA_90296
gaattcactagtgattagcgtggtcgcggccgaggtgggagccgagctgcagcgaggtaatcttcttctttttctcccggncgtcctcgctaaaattgccattgcatggttctggttgcctggagatcttcgnggaggatgcttccgagagggcttcancctgccatccccatccgggttgggtggatagagtgtgttcatggcacggtgtgaccactgacctgaccaacagtanncaagtttgacacgagtttgagttttccacataaggacacaagactgtcacatcaccgattgtatgccacacccatttccgcttcctttctagtacgtcaagggacttttccttgcacttgcaagcacaaaagagggcantgcttgngtttgacgctcaaagnttaagcnaaatactggtanggatgnggacgggtactaaggnaactaactcagnctaactagnang

SEQ ID NO: 90297 - DNA, 181 bp, Triticum aestivum
  unsure (1)..(181): unsure at all n locations
  Clone ID: PAT_TA_90297
gaattnantaatgattnacgtgggcgngggcgnngtctcgctcgccngctccgattcaacgggccancaacgcgccggggggatggnggggttagtctcacccaacgaccaagatngtcgngttnaaggagggcttcantcctcttcttcaaggacggnggatggttgnatcaccaccaaa

SEQ ID NO: 90298 - DNA, 368 bp, Triticum aestivum
  unsure (1)..(368): unsure at all n locations
  Clone ID: PAT_TA_90298
gaattcactagtgattagcgtggtcgcggccgagggggntttttttttttttttttttttttttttttttttttttttttttttttttttttttttcggacgatggatanatgcanaatatntctcgngcatgataaaaaatcatttntgtttnttcaagnaatcccaaagtcgtgtccanagnggnaggtgcagctcaagganaccacgggtccacggtttaaaaaccaaatgnagcgtggccttgagccggacgganaacccataaagctcgctcatgtccannttcnccccggccgccgccgccgatntgcccgggggggccgctcgaaatcgaattcccgcggccgccaanngngggccgggaa

SEQ ID NO: 90299 - DNA, 466 bp, Triticum aestivum
  unsure (1)..(466): unsure at all n locations
  Clone ID: PAT_TA_90299
gaattcactantgatttccagcggccgcccgggcaggtaggcatcgaaattgtcgaaggaccatcttcagtagcagatttcgtcagctgaccaagctgaggaagcttgtaatctacaagttgaacatcaagaatgagggtaaacttttcgatgaattgaggttctctattgaagatctttgtggntactcgctccaaactcttgtaattgatgatgggtctgctgggtttctcanctcanggggttgnctctcctccccgcccaantttctgaatgcccttgagctgtcttgcaaactgcaangggaaaagtggttaatcccccaaaaatggntcattnnactggggcncactganaaaagctggacccactcaaatcgccgnatgcttagcctcaaaatgctttggggngnaanttatccanctttgatnatgcaaaaacaagggtcctagaatccngnaagcna

SEQ ID NO: 90300 - DNA, 463 bp, Triticum aestivum
  unsure (1)..(463): unsure at all n locations
  Clone ID: PAT_TA_90300
gaattcactaagtgatttcgagcggccccgggcaggtcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgntgcaacaactgcaggtccttctcgggggtcgacgtctgcgacgacgcccaccccaagtgtccccagggntgctcggcgtgccgcgtggtgtcgacgaagccccgaaatgtggcgctgcgcgggatatgaaatccaccgtcgacgggacctggggtgggaaaatgctctgtgntgttganctcgggccgcgaccaacgctaatcgaattcccgcggccgccatgggggggcggggagnaattcaacgtccggggccaaattcgnccctn

SEQ ID NO: 90301 - DNA, 478 bp, Triticum aestivum
  unsure (1)..(478): unsure at all n locations
  Clone ID: PAT_TA_90301
gaattcantaagtgattaacgtggtcgcgggcgaggtcgagcgcctcctcctgtctcgccctcgccccccgtcccctcgtcggggcccgatntaagtcaagatgaatcgtggngggagtgctggtggnggtcaaagttctctgggttacctgtttggngatggtgagnctgcaaagcccgctgcagcaccagctgcgaagcccgcacctgctgagaaaccaacaacggcaagctgctgatgttatccaaacanattccanctgggattccaagtagccngggggaaaaaactaatanccgtggcanatggggcaanaacaacggggnaacttccttaacggngccgttctttaaacaaaggntcaangctggctccnggnggggnggntcctccctgggntaattgtttgggnggnaaagtgnatggtttaatgaatgctgcctaaatggaaccnaacgatnaaaattggngctgttt

SEQ ID NO: 90302 - DNA, 691 bp, Triticum aestivum
  unsure (1)..(691): unsure at all n locations
  Clone ID: PAT_TA_90302
cgggncactaatngaaaaaactcaaggctatggcaatcccaacggcggtgggggaggtccncccaacaatgggncgaacctggcaaggcggggcgncgaaattcactaaatgattccgagcggggccggccnggcagggggtcctcccagtttttttttttttttttttggggacagactcnaatattttgngattcattcaattaccancacactnnacaaacaatctacanggggtngggnggctggnaaacaanaancaagattgccagactcctggaaatggctggggggacaagatttttantttcaacnacaaacaanttattattgggttcctaaaaaaaaanagaggnggccaaattttcccngagnacgcctccngggcnancgggggggcggtnctaaaganggctccccaaagcaagncntcccttgggaaancccntccnccaaanggccccaaaggggggggnaagtgggnccgggggnnaatgggngggggtccnaaaannggggngccccncccttggcaaaacaaaaaaaacttgggggaaaggttcccaccttggnnggctggccccccggaaaaaggggccaacctttgnntanaacttccaaggaaacttnttaagggggnggaaannaatggttggcnggtgggnaaaccaacccttggtaaaaaaagggg

SEQ ID NO: 90303 - DNA, 247 bp, Triticum aestivum
  unsure (1)..(247): unsure at all n locations
  Clone ID: PAT_TA_90303
ggacactatangaataactcaaaggttatngcatccaacggcggttggggaggtcccccaatatnggcngcctggcaaggnggggccggcgaatttaataagtgattaacgtgggcccgggcgagggtnannaaaacaanctccgangtttttttttntttcttntctttccgaaaaaaggncnacccaagggtaaattnaactcatggttcaacaatttaaatcattcaagtttncaaccaaaata

SEQ ID NO: 90304 - DNA, 524 bp, Triticum aestivum
  unsure (1)..(524): unsure at all n locations
  Clone ID: PAT_TA_90304
gaattcantaagtgatttccagcgggcgcccgggcaagtcgcaagttcccttcaaggctccttgtgctcggtgcaagaacattgcctttcggnaaccttttcaatgagctcttcttcaacctttctaagcaatctggctggggaggttctactatgtattcggcttcctggtcaacggtcctcttcctgttgggcaaaagtcctggggggaggtttctttggtcctganctacaatgcaacctcctggtgttgaaggactgggnagtgggtggtgggnaaagccttcttttgcctctggctcccgttgcgttcttccgtccttccctaataactcccaacaaactaacctgggngtttcgaacctcaangaagcctgaagcggggccaagtcccccggcgaaaactccnacctgggggctaactcccntggattnaatgggaatttggcaacaaaggcntggtcaaactgggnggcnatccgggctttcttggctcccccggttnctaactttcggtccaanna

SEQ ID NO: 90305 - DNA, 475 bp, Triticum aestivum
  unsure (1)..(475): unsure at all n locations
  Clone ID: PAT_TA_90305
gaattcactaagtgattagcgtgggcgcggncgaggnaaatccaaanccaatctcgtctccgattgactcgagagctcgtcgaatcctcctcccccatcgtctcaagatgcagatnttcgtgaagaccctcactggnaagaccatcactctggaggttgagaagctctgacaacattgacaatgttaaggntaagatccaagacaaggagggnattcccccggnccancancgcctgatntttgctggcaagcanctggaggacgggcgcaccctggncgnctacaacatccaagaaagagtccaaccttcacctggtgctccgcctccgtgggggtatgcagatttttgtgaagaaccctcaccggnaagaacatcactcctgggnggttggagagctctgacnacattgnnaatgttaaggctaaaattcaagaaaanggnggggnantcccccggnccaaacaganncttgt

SEQ ID NO: 90306 - DNA, 434 bp, Triticum aestivum
  unsure (1)..(434): unsure at all n locations
  Clone ID: PAT_TA_90306
attaagcgtggccgcggccgaggttttaaccaatgccgaatcgacnacctangnaaaaaaaagagaaattttttggatttgangaaaaaaaaaaaanaattctattaattttcattttccatttatttagntagtttttcttaatgacattgaaattattaaagagggcaaataaaaataannaaacaactttgcngaccatgatatatttttatctaggcggaaagagtcctccttaatatttatctagtcttatatangtttcgggtatattganatatacacatnaacaagaagataagaggataggctcattacttaaaaacaagatatgggaaatanctataaaaaaaaanaaaactcgagactanncctgcccgggcggtcgaagcggccgcccgggcaangtcgccggcnaagcaanaaaaggcccc

SEQ ID NO: 90307 - DNA, 265 bp, Triticum aestivum
  unsure (1)..(265): unsure at all n locations
  Clone ID: PAT_TA_90307
gaattcactagtgatttcgagcggccgcccgggcaggtgaactagtcccgaggttttttttttttttttttttttttttttttttttttttttttttttttttttttttttttttttttaaatnaaaccttcccntctttanctttagttttaccnacttancaaaagnancnaccggntcgaactcnantttgntcgccttccaaacttcaaaagntgggggtagttnangacnccatttnnaccncgggcgggancangctaa

SEQ ID NO: 90308 - DNA, 492 bp, Triticum aestivum
  unsure (1)..(492): unsure at all n locations
  Clone ID: PAT_TA_90308
gaattcactagtgatttcgagcggccgcccgggcaggtttttttaaaccaataataatgccattatttctgggcaaaagcaaacgccgcctctcccaaccctcacaaggctcaaaacataaccataataacaaatcctccgcctaagagacagcatgtaatgataatagaagggaaacaggatagttgataagagttcccgttggtgccgctgctccgactcaggctcaggccagccgctagtcgtgctgngacacactantaccggtaggccgcaggcttgtacggaccctcaactggggatgctaaatgtagtcaagactggggacttggtgagcttggtcagcctggcgccgagcttgcccaaagtgggaggggccgcgaaccttctcntcgagggtgcttggggggagaaaggtacaccttccntctcgttncttgncaagtgggccttctccgttcccaaaaactcaaaggctgangcaaataatcn

SEQ ID NO: 90309 - DNA, 467 bp, Triticum aestivum
  unsure (1)..(467): unsure at all n locations
  Clone ID: PAT_TA_90309
gaattcactagtgatttcgagcggccgcccgggcaggtgaaaactttggcatcgctttcaggtaggtttcctctccggcttggctgcatgcagccaaggtatagcacacaggtttcacttggcctttgaggcgcgttaggggctaggaagcttgccagggccgggcaacaccgcacgcagtggtctcgtgcatggcccactagtggcaccagtgggctggactaattcgattacttggtgccacttgattacttggttgagtgtgtgtaatgactttagtcgtgacctggaggttcaactcaactcctcaatgggccaagcaacctatgatgactgtgtgggcaacccgagctaaccaacaccacttcatcgtatatgacaagcagntctagctagattgctactggtaccgttttgatgattgtcagggntactaaacgaccctgctaacaatggttttcactttn

SEQ ID NO: 90310 - DNA, 390 bp, Triticum aestivum
  unsure (1)..(390): unsure at all n locations
  Clone ID: PAT_TA_90310
gggggcccgcaaaattcacanaaaaggntttaaacngggggcccgcggnccgaggggaaacnaaatcccccaggtttttttttttttttaaggggaaacaaacttantccgangcaaatgggaaatgggctgggnaaccggggaaaaaaagattgnttgggtgatacanatanacaaacggggaatacaaattttttggnnaccggggaagnaacancggncctngcnaaanaaantaancngtantttcaacancccccggggaacaaaaaatgncaaaaactgggccggggcggggccnctcnaaaaacnaaantccccgcggggcgccaatggggggggnccggggaagcaangcnaacgtccggggccnaantcccccctaatagg

SEQ ID NO: 90311 - DNA, 480 bp, Triticum aestivum
  unsure (1)..(480): unsure at all n locations
  Clone ID: PAT_TA_90311
gaattcactaagtgattaacgtggncgcgggcgaggttgataagcanttctatttgtctttaccaaataggtatactcaatatctttatatattaacaaaacatgcccaagcaatcgcttggntgcgatgcggtacctaggtacaaaggataaaacatcaagatattaaattggcatgcttaaaaggtgtaaaggcagctgccgtcgtcactcctcgccgttggggtcgaagttcttggnaagtctggtcggtgcatcctgccggtacaaggcaaagtancttgctgtgcccctttacctcctcctatgcaacaaagagatggtgggtgtgtatggagaatgttctaancgtagaaaggtancantcctcaancgcatcctgggtagcaacacccaanagctggcctggctcaagtaggggtcaagnangctgcacacgcttgacattgncctggctcctgggacgaagnatgtggcccg

SEQ ID NO: 90312 - DNA, 484 bp, Triticum aestivum
  unsure (1)..(484): unsure at all n locations
  Clone ID: PAT_TA_90312
gaattcactaagtgattcnagcgggcncccgggcaagngnganaactagnctcgagttttttttttttttngngcaanggaaaccttcatgcctttgnacganggcttganatacatatgtgacacanctcctgttttcaaaangcttatgggccaagaaagggcgccaaagtacattttggntgttgtttaatgggcattgctanccttattaatctcacatatatgaccaatttttaagcaattaattcaccttttgagcanctgagcctgacctgcccctgaganccaatcaatgggctgaggntccccaatcctcancaaggctgagggcgaangcgctgctgaacgcccgctggggnttgcttgccaaagtttttnaccntntttntcgggggccgcccgcccggtgccggngnaaaacaccngggnccggantgcaaagaanaccctccngggaacttngggggtgccngnaanaagg

SEQ ID NO: 90313 - DNA, 377 bp, Triticum aestivum
  unsure (1)..(377): unsure at all n locations
  Clone ID: PAT_TA_90313
aggtctctctctctctctctctctctctctctctctctctctctctctctctctcgagagaantagtttcgagnnttttttttttttttttttttttttttttttttttttttttttttttttttttttttttttttttttttgcannaaaaaaaaaattggntgnaaaaaaaaaaaanggganaaaaatntttaccccnaaaaaaatcaaatcggnangttgcaaaaaataatggtaaaaatctatgcccctaaaccnccncccaaaccttgtangggctanccccccttcaaaaacggnttcnttncacatnanaaaanaaaaggtgnggngnctttnttaaanaaaaacntttttnccgcaaagcccctaaggg

SEQ ID NO: 90314 - DNA, 319 bp, Triticum aestivum
  unsure (1)..(319): unsure at all n locations
  Clone ID: PAT_TA_90314
gaattcactanatgattaaacgtggncgcggccgaggnctcnanttttttttttttttttttggntngcaaacacaggtaggtaaaaanacatttattcaaacnaattcagaaaggnanngtcttccctccacngntggttaatcacanngaagtaanggggactaaagagaaaaantgatntccttgtttaaaaaaaataaaggaatcgctcctcanacaaaaaaaattaaanggggggtcntcccccacacntgcccgggngggcggtcgaatcaaattccccgccggcggcatggatgggcggggagnaangcaaa

SEQ ID NO: 90315 - DNA, 388 bp, Triticum aestivum
  unsure (1)..(388): unsure at all n locations
  Clone ID: PAT_TA_90315
gaattcactantgattancgtggtcgcggccgaggtgtctcnagttttttttttttttttttttttttttttttttttttttttttttttttttttttggaaaaactaaacgtatatacatgtttatagaagcaanaaaacaagtatatanccncccccttccccaaaatgtntanaaaggccaaatcntttaacggnttgttnttntanaaaaaaaaanannttgtgcancaattgcttgactaaatttaatgttaaanaaaggcnggggtttttccnaaatcaaactgatgttccactantactancactaaaggatgaacttnacaggaaggaaatcaaaacaaggncaataatttgttgttgcncccaataatatancatgccc

SEQ ID NO: 90316 - DNA, 417 bp, Triticum aestivum
  unsure (1)..(417): unsure at all n locations
  Clone ID: PAT_TA_90316
gaattcactaaatgattaaacgtggtcgcggncgaggnccnccntcatctgcgtcttntacaaaatttgtgcccacaaanccttcctccacaaactggngccatacctgnagatnanaacggntctgtaggacagggaggagaaaatggggatgatggaccccangggcgcaaggggaaangccanncgtgtantancgctacntggggtctctcacnaanccgccctgntcggaaggtgtcatctggaccatcctcaaaanggtccgcaccntgtctaggnaccaaactggagcttctcccggagggcgtccatgncgacatgggagaaaaacaccangccccctcncgggggtggncagcacanatatcaacatgtttcgggcctttnaataaaataaaaatttnnttnttaact

SEQ ID NO: 90317 - DNA, 497 bp, Triticum aestivum
  unsure (1)..(497): unsure at all n locations
  Clone ID: PAT_TA_90317
gaattcactantgatttctagcggncgcccgggcangtcggcanggnctcttcacctccgaccaangacctgcacaccgangccgggacaaagccgtggncaccaaagttcgccgtcgaccanggggccttcttcgaccaaattcgtcaagtccatggtgaagatggggnagatnaacgtgctcaccggcaaccaanggtcaaatncgctcggantggtccctgcccaangccgcccgcanaanngccggggannagctgccctggtctgtcgtcnagggcgcccgaaagcttcntgtttgtanttaatgggctttaatcggttcanctcnanctgtttggttccctccncaaatgggtttggactccnggatgtganantgatcncctgtgttaatttgtcangcaacanaaatantattgtnggcctcntgttatcggnttcaaaaaaaaanggntgtgccaantttgggaaaaaaaaaaaaaaaaaaaaaaaac

SEQ ID NO: 90318 - DNA, 489 bp, Triticum aestivum
  unsure (1)..(489): unsure at all n locations
  Clone ID: PAT_TA_90318
gaattcactaagtgattagcgtggtcgcggccgaggtctcnagtttttttttaggtacaaaaaattacaaactttctgttagggctttttttattttttttgccttantttttttgtgttttttttgtatttagagtttctttgtgaacatttttgttttaggtacaaaaaattacaaactttctgttagggcttttttttanttttttgccttatttaanttttgtgttgttttttttgtgtatttagagtttcnttgtgaacatttttgttttaggtacaaaaaattacaaactttctactagggcnttttttaantanttttttgccttanttatttttgtgttgttttttttgggtatttagaagtttanttgtgaacatttttgntttaggtacaaaaaaattacaaaccttctgttagtgcccgtangtttcaaatttgaaanaagtttaaattttgaattanttgaaattagtgggaaacnc

SEQ ID NO: 90319 - DNA, 643 bp, Triticum aestivum
  unsure (1)..(643): unsure at all n locations
  Clone ID: PAT_TA_90319
aaaaaaaaacccaaaggttatgcaaccaacggngggtggggggagcccncccaanatggggccnaacctgnagggngggcgcctaaatnaaatanataaataagcgtgggcccccggcnanggtatncaatggnaccacacacggagcacttcatgagcttcttccaaaaaatgcccaaacttaaagggacgtgcaactaaagggagggctactatccancaccggggaacgatatgattgatnacaagaagatgcgggctggagtcttgtctcccggttcnaagcaacaancttgaaaaaaccgggcaatttcggnaaaattccctgatttgatgctgaattggnaaatttcggggaaaattcctgantaattgctgaatttgggtgcnccatttcaaatgattcaaaggggttgaaataacntcaaacacaaaaagangncccnttggctcctggtttaagtcaccccaaaaggtgctactcaatgttttgaagtggggttgctttgcnaatgatccnggtggtaantaaactgggnaatngctccantcccaattgntggntaaagagtanaagnacaacgncctggatnaaagtgaaaagtgggtaanccaaancctttaattgcaaatcccnttttcn

SEQ ID NO: 90320 - DNA, 250 bp, Triticum aestivum
  unsure (1)..(250): unsure at all n locations
  Clone ID: PAT_TA_90320
gaattcactagtgatttcgagcggncgcccgggcaggncnccagttttttttttttttcnatgaatttggatccaacactagtacagtcnnagttgntccagtttgngggccanaacatgcngcatgtcntcnctggccanttccacaaatanaggacaaaaaatcntggncgcnaagcggntttgaatccacccanccaaagcatgntgngcacaaacagctttaaaacnttgcaaagtccaaacaacc

SEQ ID NO: 90321 - DNA, 502 bp, Triticum aestivum
  unsure (1)..(502): unsure at all n locations
  Clone ID: PAT_TA_90321
gaattcactaatgattaacgtggncccggncgaggngtcnccagtttttttttttttaccacaaaacacaaatatattattgnaaattacattaaaatttcattaaaacanactgnngaaaanttacttttactttaaaatgattaaagtactgtgatcacacanaataatccaacgtgcaaagcacgtacaaattactantatctaaaagaaagaaaaatngacgatnagggcaacatcaagattcccgaactcatcnaaaggagagtttggcanccccgtcgangncnaacctggaaatnaatggcccgggaatcctccaangcccanctcgtgngaaccccaagcctggtcaagggtccgcctcaaggntccgncgggggtaaatcgtgtccttcccgtgggcgaacnacgcgtanatcccgaaaggccncccccaaggaaccttcgncttcangttcgggaatcgncccccttcccggggnaacgaaggggtgtcaan

SEQ ID NO: 90322 - DNA, 174 bp, Triticum aestivum
  unsure (1)..(174): unsure at all n locations
  Clone ID: PAT_TA_90322
gaattcactagtgatttccancggccncccgggcatgtgccaaagcatgacaanttctanaatgtattgtttccaattggctaacancagggaatttttgtgtaaanatggaaccccaaaccccttattattttcattgcccttgngtaacaaaancgatctccanccacccaa

SEQ ID NO: 90323 - DNA, 167 bp, Triticum aestivum
  unsure (1)..(167): unsure at all n locations
  Clone ID: PAT_TA_90323
gaattcacaaaagattnacgtggncccnggcgagggtgnacnattnaatcncaantaaatgcatanaggncncggggtttgcccaattttattcccaccaatgagcaaaccatgcgacgggggcaatcccaaaaangngtgggctgaaactggtcnggngcaccatt

SEQ ID NO: 90324 - DNA, 507 bp, Triticum aestivum
  unsure (1)..(507): unsure at all n locations
  Clone ID: PAT_TA_90324
gaattcactaaatgattctagcggccgcccgggcaggtcagacatgcaacaatccaagttttnttctagtgcaagtagctagtatatacacnaaatggtatcactgtataangtcgngcatggnggtagagtaacttgtgntgatacgttacatacattacataggaggnatgcatcgatgccgcatatannatatgcgtctangccgccgttccgttacataaaccgatcgatccttgcattgttttggaagangangccngcgcacgggtgtaattanggntggncgcctgccggtgggacattaaaaacgtaaattttgntgcacggacgaccggtgtagggnttaanaaacngggacngaaaaacaaggtgggtagggncggntgcntaccaaatgcctactaanaatggngtcccgngncaaacgggtccaaaangnaagaaagggnntgttcatnattacccncgggggacggaccaancnataaaancgatnctgctttg

SEQ ID NO: 90325 - DNA, 536 bp, Triticum aestivum
  unsure (1)..(536): unsure at all n locations
  Clone ID: PAT_TA_90325
gaattcactaatgattaacgtggtcncggccgaggtnaaaaaactacttnnaaccaaatggnttcaaattggtgggctctactanccnttcttgcaatgttttcggcantagccacctccgacacccatagnganganaacctcactctccgatgccatccaaaccangctgcaagcctcctcctacnaaagagatacttctcnttcttncgttaccccaatggccttgactcaaggcatgatgacaccgnctgttntctttgggaaggtgntggttgccncaactcctctgggaangtcaccgctctngancaaaataatcgtggcttggacagtcaaggggcttgaccccgtaatcctnaaactcanntcgctccaaataatcgaacttaggatgaaaaattttgggcaatggaatctncccgagacngggggttggtnaggtcnccntgctnaaaaangctnaaaccctccaaattccgggctnaaaggcaaataactantggcannttgcaaaannttgcaaacttaactcn

SEQ ID NO: 90326 - DNA, 576 bp, Triticum aestivum
  unsure (1)..(576): unsure at all n locations
  Clone ID: PAT_TA_90326
gangngtcnccaagttttttttttttttttatcaaaaccccaaggtaagacagtttatgttatttaaaaacttcacagtaacaacacattaanattcccangtccatnaaaaggaaaagtatgttcaagggctgtcaataaacaacaatgggtacaataatgcactacttaaataagtaagccccctgaagttcaacccacacattggagctctgaaagacactgggactgggaatgcaancaaaagctatcaatccgcaaggcaaacaatanggtgancaaacctgcaatgggccgggagggctannttnttagtaaaagctccaagggccaatggcccgtcngtgggntctccgtaantcccccgangggnggaatgtgggccccttgtaaaatgggggtaccaaccttccggggatggcnggattnttcnccgggccctggggccccggtnctggcgnccgccaacnaagnnttcttganggncccccnaanggggtcctcccccngttggaactttgaaggggcaaccttcttccccaaaggggggtccgttgggcaccaaccccnatnanc

SEQ ID NO: 90327 - DNA, 259 bp, Triticum aestivum
  Clone ID: PAT_TA_90327
gaattcactagtgatttcgagcgggccgcccgggcaggttggatgatcaacctgacgagaaggcctgcaattttgaatacagacttgctctgctttctagtgcgtactctgtttttctacagatgaattattactctccatttgttgctgccactttgtctgcgcttgtttgtaaacagagaatgatgatttcatctgttattatcaaaaaaaaaaaaaaaaaactcgaagactaagacctcggccgcgaccacgctaa

SEQ ID NO: 90328 - DNA, 535 bp, Triticum aestivum
  unsure (1)..(535): unsure at all n locations
  Clone ID: PAT_TA_90328
gaattcactagtgattagcgtggtcgcggccgaggtctantctcgagtttttttttttttttttttaccattaaaacgtatatagttgacatattgtataatattatgcgtccgtgcatatacatagccaccgatagcattcacatacgagcatgctttctcgagccatgttggtacatgaacatggacatacacatattcttaggaacaaataagaaagataaatggngaaggaaaacccaaagcaatgtcagagttgacaaaactgcaatggcactttatatatggcctgtcgtgagtgagctgtttaggccttgccggactcctcgcancccggtggcttgaaggcgatgaagctgacgcactgcacctgacgcatgttgtcgaatccgatgatgcgggcatacgcgtcagggtactccttcttgacctcctccactccgttgattaactggtggggngtcagtgcaacccaacataaggnagcttccacaatgtcaaataacggncaacntagtaaccaagagaaggggtg

SEQ ID NO: 90329 - DNA, 317 bp, Triticum aestivum
  unsure (1)..(317): unsure at all n locations
  Clone ID: PAT_TA_90329
gaattcactaagtgattagcgtggtcgcggccgaggtgtcncnagactttttttttttttttttttttttttttttaccaaagtttannttttcaagttttcaaatgaatancggtcnntacanaaggtngcatttcaaaataaaaacattnntttnttaaactaaacnacctacaaaaattangncacttncattattnattccaacatgtaaacattgcnnattcttgcaaattcnacacttnttaacctgnccgggcggncnctccaaatcgaattcccgcngnacancatggtngccgggagaaananaacgt

SEQ ID NO: 90330 - DNA, 538 bp, Triticum aestivum
  unsure (1)..(538): unsure at all n locations
  Clone ID: PAT_TA_90330
gaattcactagtgattagcgtggtcgcggccgaggtctacgatctcaccgggaaacctccgatccgagcgaagcgaaggntctctcgtcctcctcctcaagatgcagatctttgtgaagaccctcaccggcaagaccatcacccttgaggtcgagtcctctgacaccattgacaatgtcaaggcaaagatccaggacaaggagggnatccccccggaccagcagcgcctcatcttcnccggcaagcaacttgaggatggccgcactctggcagactacaacatccaagaaggagtccaccctccacctggtgctccgccttcncggtggtatgcagatnttcntgaaaacctgacgggcaagaccatcacgntngnggggggggtcctcngncaccatccacaacttanngggnaagattcaatgaaaaggnggggatcccccccgggncaagnagngctcatctttctccggnaaaggaaactccnaagggatgggncgttncccttcttgnctaanaanaaccaaaaaggggggcc

SEQ ID NO: 90331 - DNA, 261 bp, Triticum aestivum
  unsure (1)..(261): unsure at all n locations
  Clone ID: PAT_TA_90331
ggcaggttgcngctgcacccaatgcaantgcggaaccanntgcggctgctcctgctgcaactgctagatcgatnatcnancatatgcatgnaccgtgccgtgcgtgcatcatcgatcatatcgatctactactaccataccatgtnaccgcaacctgatcgagggcctttatctatgcacctgacctgcatcagcagtcaggtgccatgccatgattgtaaacagggccccctaaataaaatttcccctgatttacctagg

SEQ ID NO: 90332 - DNA, 559 bp, Triticum aestivum
  unsure (1)..(559): unsure at all n locations
  Clone ID: PAT_TA_90332
gggggggcgcgaattcactantgattaacgtggncgcgggcgaggtctcccctctcctccggaagncaaccctccccgaatanatatacncgctccccgtcgatttattccccantccgtcccantccttcctctcgattccgattggaatcgcaactanccccgccgcttgattaaccggcagcggncccgtccccatggggtccaagcggntnctcaaggagctcaaggacctgcagagggatncccccacctcctgcagcgccgggcctgtggngggagatatgttccactggganggganaatcatgggtccaacnggaaagcccanatgctgggggggtnattttgggtaanaatcannttcccccaaaataccaatcaaagccaaccaagggttgcattttaaaaaaaanggttttcacccaaattttaaaaacaatngggnggnattgttctngatattctntaanggagcaatggngncccggcaatnganantttcaaaaggggggccctttaaatctggnncccnaacaaaaggggnccaaaccctggg

SEQ ID NO: 90333 - DNA, 564 bp, Triticum aestivum
  unsure (1)..(564): unsure at all n locations
  Clone ID: PAT_TA_90333
cccnataagggccgacctgcaaggngggcgcgaantcactaatgattccnagcnggccgccggcaagnttttttttttttttttaaacaatacnaataattangtgnttacttttcgctggcctcactcaatccgantaaagttntcaatgttccacaaagttaacactaaatcccactgaattcctaataagttcaataanagaaaactccccggattanaataaggtgtgtatgggtgccaacaangaataatctaaacaatgctgacaagtcttaagacatttagggacactacaaaaatccccgacaggcttgtttgaaangtttgctcaaccaaagggaagttcaatgattaaaacctccgggccgncgaacaacgcctaaatcgaaattccccgcggggccgccaatgggngggccggggaagcaatncgaacgttccgggcccaaattcngccctannagtgnggtcngtantaaaaattcactgggccgtcgnttttanaaacgtccgtggaccggggnaaaaccctgggcggttacccaancttaaatcgccttg

SEQ ID NO: 90334 - DNA, 358 bp, Triticum aestivum
  unsure (1)..(358): unsure at all n locations
  Clone ID: PAT_TA_90334
gaattcactaatgattaacgtggtccccgcccgangtaatcaaaaaaaagaaanatncctaacncngggctggaggnggggtccaacaaagtggacgtggncatcgacctcnggaaaccgctcctcaaacgcaccgtctacgggttcctcaanatntggccgtctgcgcctgcanggtggtcnccnangacgccttctnctgcatccacangggggatatctccaancgccancttnnaaaaaagctgaanaaaatgtncaaggagggtgcatattggggtgctgttgctggggtgtatntgggcatggagtatngngtggaaagggcccctngtgaccgtnactggaaaaattcgtt

SEQ ID NO: 90335 - DNA, 544 bp, Triticum aestivum
  unsure (1)..(544): unsure at all n locations
  Clone ID: PAT_TA_90335
gaattnantaatgattcnagcgggcgcccgggcangtgagcattntaccancgcaccgcacgagtgaagtgagagctttgcaccaaaagttcatcaacgaccatgaagggnancaagctcgcggggatnctcatcctccanggccgtcctggtcatgggagtcctctcanacgtgaacgccgactatttccccaaagtgctggaacaactggaggtccttctccggggtngacgtctgngangaagcccaacccaagtgccccaagggctgctcggngtgcccgcgtggtgtccnacganccccgaaatgtggcgctgcgccggtatnaaatccaacgtcgacggnaactgcggtggggcctgcaagaaataatgatngggtnatgccancatgatatgtttccgnctaaaatgaaataaaaagctcaaaacnaaaangagnaagcgtcatcnttgcctantgcgtttntgttttggcaaanaaatntgtttaacaaatatnccgtngtcttcctccctngtgntttttctntccanaaaaaan

SEQ ID NO: 90336 - DNA, 538 bp, Triticum aestivum
  unsure (1)..(538): unsure at all n locations
  Clone ID: PAT_TA_90336
gaattcactaatgattancgtggtcgcggccgaggtcattctaccaccgcaccgcacgaagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacgggaactgcggtggaccctgcaaaaaatgctgatcggttcatgccggcatgatatgttccgcctaaaataaaataaaaagctcaaggcgagatgagcaagggcatcgtgccctatgcgtgtgtgtgtggcaaaaatgcttatacaagtatgtcgtctcttcgcccctgtgttttctctccccnaaaaaaaanttgnggtttg

SEQ ID NO: 90337 - DNA, 405 bp, Triticum aestivum
  unsure (1)..(405): unsure at all n locations
  Clone ID: PAT_TA_90337
aaaaccaaagcntgcaaccaacccggtgggangtcccccnaaaggggcgacctgcaggggggccggaatttaccaatgattaacgtgggcccngncgagggtccaatttttttttttttttttactaaagtcaaacacgaatatatngttccgttnaaaanaganacaactaatccaaaagcaatggaagctactccagctttaaactaaagataaaggaacctgaaacnccactgatgacaaagcacaccgaaggntaagctaaacanaaatnaagcattttgaagatncaagctacnccacaaaatagctacttattgaccgaagttctanttaaagccaaacctgcccgggggggcgcccnaaatccaattccccccgggcgncanggggggcnggaagcaa

SEQ ID NO: 90338 - DNA, 525 bp, Triticum aestivum
  unsure (1)..(525): unsure at all n locations
  Clone ID: PAT_TA_90338
gaattcactagtgattaggcgtggtcgcggccgaggttttttaccacaccaatttcacgattatcattacaaagcaaatcccacaattatcagaaagttttcaagacactcaacatctgacagttactggcaccaacattggagagtcgactgacaaccatagataagagcaaaaatactgaagacagcatagattttggcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggnggactcaacattcttcttgaaagcatctangtcatccccttcaagcttggnaaaagagggtcttgatgtancgcttcatgtgagagataaactgcttcntgtcaaaaagcaagntgctcctgaagacgggangngtcaacaatgtcaancaacc

SEQ ID NO: 90339 - DNA, 378 bp, Triticum aestivum
  unsure (1)..(378): unsure at all n locations
  Clone ID: PAT_TA_90339
gaattcantaatgatttccancggncgcccgggcangtctcnagtttttttttttttttttanaaaaaaaatgcttatttataaagttgaganaacttttccccaaacagtatgctcantggggnagacgcancaaaccacctanagctaatagtttattcananagcaatagcctggccggntgnttcacaagtaaccaaacgacaaaagacaaacagtcagagcaaattccacanactgaacattcgacaacaaatcantcgcaaaagaacaagccctcctccananaatcctccgctcnccatgcnangaggntggggaagcttgccttccttgaccancgggncctcgggcggcgaacancgctaaacnaattc

SEQ ID NO: 90340 - DNA, 156 bp, Triticum aestivum
  unsure (1)..(156): unsure at all n locations
  Clone ID: PAT_TA_90340
gangngaaaaaactaatcncgagttttttttttttttgaaccaaangaaancccntttcaaanttccantcaaagaatttcanatacatgtttctcactttctacagntttcccanttctgnagggntcaaaacccacacagcaaaggnggnctta

SEQ ID NO: 90341 - DNA, 267 bp, Triticum aestivum
  unsure (1)..(267): unsure at all n locations
  Clone ID: PAT_TA_90341
gaattcantaaagatttccancggncgcccnggcaagttggntgatnaaactgaccanaangnctgcaattttgaatanaaacttgctcngctttctaaagggtactcngtttttctacanatgaattattactccccanttgttgctgccactttgtctgcgcttggttgtnaacaaaaaangatgatttcaaccgttattatcaaaaaaaaaaaaaaaaaactcnaganaaaacctcgggcggcgaacangctaatcnaattccc

SEQ ID NO: 90342 - DNA, 519 bp, Triticum aestivum
  unsure (1)..(519): unsure at all n locations
  Clone ID: PAT_TA_90342
gaattcactaatgattaacgtggtcncggncgaggtcccaaacccangtacccanccgtttcctcctcaaatcaaatctcancgccgcatccctcaattctcctccgattatcgtcgtcgtttgactanatnttcgctgatttggcattcaaaaaaaattnaaattgtgaactgtgaaaatgacggnaccaacggagctttcccgtgaggagaatgtgtanatggntaagctcnccnagcaagctgagaggtacnangagatggttgagttnatggagaangtgggcaanaccgtcnactccgaggaaatcactgtggnggagcgcaacctgctctctgtttgcaaanaaaaaagtgattggngcccgccgtgccctcaaggggcaacaatctcctccatttgangcaaaaaggaggagaagcccgtggnaaccaaggacccggtcacncctcaacaaaggagtaccgtggnaaagatngagactgaagcttancaaaatttgtgatgggaaccccaac

SEQ ID NO: 90343 - DNA, 481 bp, Triticum aestivum
  unsure (1)..(481): unsure at all n locations
  Clone ID: PAT_TA_90343
aattcactaatgatttccagcggncgcccgggcangtttttttttctcaaaagaaaatttttcnaagagctacatctgatgagcanaccaactaccaagggngttgaatccatggcatggnatgtgacgtgacattatcngntcnatcacnaaaaccantaatatagtagtaatatattataaaatcaacnattgagacntaaattttctgttcaagctgtggacgaagctaggatgatntgctatggntacttgcantggtccctaatggcaaatgganagggggatnatgaggatgatggcgacnaccaatccggcgacgatgagcttgatcttcaagttctggnaacaaaaccttccgcgggggcccgtgccctcnggcccgaaatccaaggcaagggcctggggctggtcaatccccntcaacaaagccgncnatntggtccccncgattcgatnaaccttgtcnaaggttttccaa

SEQ ID NO: 90344 - DNA, 509 bp, Triticum aestivum
  unsure (1)..(509): unsure at all n locations
  Clone ID: PAT_TA_90344
gaattcactantgattaacgtggtcgcggccgaggtcanccccccatccgatntcgccgggaaatctctccgatngaagcgaagcgaagggtctctcgtcctcctcctcaanatgcggatnttcgtgaagacccttactggcaanaccatcacccttgaggttgagtcctctgacaccatcgacaatgtcaaggcaaagatacaggacaaggagggnatccccccggaccancancgtctcatctttgctggcaaagcancttgaggatgggcgcaccctcgcgggctacaacatccanaaggagtccaccctccacctggttctcangctccgtggtggtatgcanatatttgtcaagaccctcactgggaaagaacatcaccctggaggttgngtcctcaaacaccaatgacaatgtgaaggncaagattcangacaangngggtatcccaccgggatnagcaacgtctcatcttttcggnaagcaacttgaggaatgggcgcaccc

SEQ ID NO: 90345 - DNA, 269 bp, Triticum aestivum
  unsure (1)..(269): unsure at all n locations
  Clone ID: PAT_TA_90345
gaattcactaatgattaacgtggtcgcggncgaggtccgtctccggcctctctggcggnaggtgaataaacaaggacaagaagtggtagtcnccgcgtgaggcgttgatttgatttctcatctatcgtgacgtactcatctgctgtaacatgtagcggcacttttcctaatagtggataattaactgcgagcagtagtaatacagtgatgtttttctaagtctgcaaaaaaaaaaaaactcgagactagttctcacctgcccgggcggn

SEQ ID NO: 90346 - DNA, 385 bp, Triticum aestivum
  unsure (1)..(385): unsure at all n locations
  Clone ID: PAT_TA_90346
gaattcactantgatttccancggccgcccgggcaggtgtcganttttttttttttttttttttttnntttttntttttttttttttttttcntaccaaaaaaaggaagggcgannanaaaattcnagcacnatagggggggcgattaccaaatntaacaaaaaacttcncccccaattctgtttaatcgancttcncgatntgtcattantcctccgagaagtaaaaanaaanagtaattcccattccacccaaaactttaggaattccttgaaacgntggtaaaaattcgnaanccgggccnggnganaagctttaaaaaggttcttgttccacaaannccttttccaggctttctcttttgantgncccaaagttgaaacca

SEQ ID NO: 90347 - DNA, 341 bp, Triticum aestivum
  unsure (1)..(341): unsure at all n locations
  Clone ID: PAT_TA_90347
naattcactaatgantaacgggggcncngncgagggttttttttttccaaancnanttccaaaacctttttttaagtaaagagccnancccccaacctcctttttatgnttaaaattcaaaaaaccgngaaccnatataatgactanataaatattaagaggncccctccgccnaaaaaaaaataaatcaagggcagcaaangtggttcnttaattttaattgccccccttaagaatttcaanttcattaagaaaaaccaacnaaataaatgggaaanggaaattaagagaattcctttttttttttcctcaaatccaaaaaanttcccntttttaaacaa

SEQ ID NO: 90348 - DNA, 309 bp, Triticum aestivum
  unsure (1)..(309): unsure at all n locations
  Clone ID: PAT_TA_90348
gaattnactaatgattaacgtggtcncggncgaggtaaaaaataangggttagctaaaatggnaatggncacagcaaggntaatccacccatgcatggtggtgtccaagagcccaagaacgccaccancanccttcctcctccacaccaataagccgctgaccaccgcactgagctcatcgtttcacttnacgctccactccgtcgacgtctccaangacgacaagccgctggacgcggngctcgagaccaaacaanaagatgcaaccgccgccgccgccggngacctggtgacgccactgccggggga

SEQ ID NO: 90349 - DNA, 516 bp, Triticum aestivum
  unsure (1)..(516): unsure at all n locations
  Clone ID: PAT_TA_90349
gaattcaccaatgattnacgtggncccggncgaggntccctnactactgggactccctcaagcccgggttcgtcncncanctcaacgccnaagatgaagagtgggtaaaccgncgacttcttcncgcanattctcgggaanaacgtgcancaactgtggnaggnctacaaagccnagtttaaaggntgaacgcnccanaagttgatgggtccttcacggngggatggnataacgcactacttccaaaaagacatgtgtgatggnaaaacacaccaaatactggnaatgnttaacanaacatntcccttacgctccgtngtgnaaagataaataaacgatttcactaattcngaatcnacttnngttnaaaaaaaaaaaaaaaaaatngacctggccgggggggcggtccaaattccantcccccgggcggcaaggnggggcggggagcaaagcaagtccgggccnaatcccctaaaggtggggtcgaattcaatncacngggcgtttnntttanaa

SEQ ID NO: 90350 - DNA, 252 bp, Triticum aestivum
  Clone ID: PAT_TA_90350
gaattcactagtgatttcgagcggccgcccggcaggtctagtctcgagttttttttttttttggaaaaggttgatgtatatatataagcttctgaaccatcaggacacttgcacatgccaaaaattacagtggggtagacaccctttgggacagtgaacttaaactaaaaatctgttttttttttctttcttttctttacctttgacagtgaaatccaactaaatatctgacctcggccgcgaccacgctaa

SEQ ID NO: 90351 - DNA, 504 bp, Triticum aestivum
  unsure (1)..(504): unsure at all n locations
  Clone ID: PAT_TA_90351
gaattcactantgattaacgtggtcgcggccgaggtctaatcccnaggntttttttttttttttttttttttttgggnttcaacacncatcaanctctgtacaccttatatttntgnaagtncatgtngcancatctttttttcactaacatttactaaaaaaaagatgggtgcacatactancatatatntcctgcccaaaatcactctatatattgaccaaccatgaaaatatatattctggntataacatatgtcctttgttnaccaaaatcatgtcactaactancctgcccatccatccacgattatcttcttgtcactaactgaccaacctacatgggcaaaaagaattctttcatcccgattcaagtcaacaactaaccaggccctccccccgcgcgttattcaaaaccgggggggaanaaaggggaanaagggggggcnnnccgccgttccttgttcctgttggnaanggggggnttcaacancttnaanattntt

SEQ ID NO: 90352 - DNA, 466 bp, Triticum aestivum
  unsure (1)..(466): unsure at all n locations
  Clone ID: PAT_TA_90352
ccggggtcgacgtctgcgacgacgcccaccccaagtgccccaagggctgctcggcgtgccgcgtggtgtccacnaaccccgaaatgtggcgctgcgcggatatgaaatccaccgtcgacggcacctgcggtgggccctgcaagaagtactgatcggctcatgccaacatgatatgttccgcctaaaatgaaataaaagctcagacgagatgagcaacgtcatcgtgcctatgcgtgtgtgtgtgggcaacaaatatgtataccagtatgcccgtgtcttcgtcgctgtgttttctctctcgagaaaaattggtgttgcttgttgttcaaatatccggaatatcctccgtgaataantaatgatttgtgcgttggtggcaaaaaaaaaaaaaaaaaancccgagaactcnggcgcgaccangctaatcnaattccccncgccgccatggggggccggancattnnaa

SEQ ID NO: 90353 - DNA, 512 bp, Triticum aestivum
  unsure (1)..(512): unsure at all n locations
  Clone ID: PAT_TA_90353
gaattcactagtgattagcgtggtcgcggccgaggtgcattaagctgaaatcaacaatgagccaaaacatgcatcattgcattgttcacgacacacacaagtctcgtgatgctacagaccaaaaagtacaacaaaacttccagcccaggtgatatgattggcacccaggactgaataaaatggtgtatagtgtatttctcactatataaaagcgactaacttagtcgacctcctcgatcttggggccagcaccgccgctcgcaagccggngcgtcctcgtccatgcctccgggcatgtcaagcaccggtgccctggtacatcttggcgatgatggggttgcaagagggcctccaagctccttcatctttgtccctcaaactcngtcaacctcaaccgaagcttggttggngtcaagccactgggntngccggggtnaaangggggtccctcgattcttccttcttgtcatccagcaaaggaagctttggggggngatttttcncgccctggg

SEQ ID NO: 90354 - DNA, 502 bp, Triticum aestivum
  unsure (1)..(502): unsure at all n locations
  Clone ID: PAT_TA_90354
gaattcactaagtgattcgagcggccgcccgggcaggtggcatagcgtgttggagctggccaacatgaactccctacgagggacgctgagaataataggcctcgacggtgtcgggagcaaggaagaagccgagcaggctctactaggaaacaaatcttctgtaaaggttctaaagcttgagtggggggctccgagtttgcgacaacttgaagaagaacctgccgctggatgcaaccccgcggtggccgtcctggaaggcctcaagcctcacaagccatctccatcacctacatatcaccaaggtaccctggggaagaagtcgcctacctggctgagtgaaccggagaagatgcagaagcttacgcgcctgtacctcaagaactgtaggaagctcaangatttccggccgtggggcgggctcccctgtctgggagcntctgggttatcaagggagctcaacaaccgtccctgaggatncgacaagtgggttccngcggngggg

SEQ ID NO: 90355 - DNA, 157 bp, Triticum aestivum
  unsure (1)..(157): unsure at all n locations
  Clone ID: PAT_TA_90355
gccgcccgggcaggtggcaaatgtctgattgatnggtcggccccgtataatataatgactaatgagtcatacatatacttgtggtgcttcctanctgcgtgatcattatcattgtactncgtacatttgactaatgtcaatcctcgnttatacatac

SEQ ID NO: 90356 - DNA, 516 bp, Triticum aestivum
  unsure (1)..(516): unsure at all n locations
  Clone ID: PAT_TA_90356
gaattcactagtgatttcgancggccgcccgggcaggtgagagaggagaactagtctcgaggttttttttttttttttttttnttaantaantttaccgaanttcctttttaanttcnctttttctttgttttttccttttttgncattttcaagttttttattttttccacnttttttanttcttcagttttttcanatttttcaaaacnaacccaanattaaaaaatgttcaatttttgaaaactgttccgtgagttcaaattttggncanaanttcaagaaaatgttcanntttttaaanaaatggtncangtntcaaaananggttcacgttntaaaacaantgnttgcagagttaaaaaaaaggggagggntttcanttttttaggagnccnaagttgttcaangttcaaaatttttgttcacaaaattaccncggntcgcgnccaacgccctaancctanattcccccnngncgccattggngggcccgggaagnaaaggcanagcnntg

SEQ ID NO: 90357 - DNA, 498 bp, Triticum aestivum
  unsure (1)..(498): unsure at all n locations
  Clone ID: PAT_TA_90357
gaattcactaagtgattaacgtggtcgcggccgaggtcatcatcccatcccccaagtcataaacccaagtcggactcgccttcctcctcccccaantactcctcctcgcctccgcgcatcgcaccgcaccgggggtcacctgagatcacatacacaatggtgaaggctgtggctgtgcttaccggcagtgagggtgtcaagggcaccatcttcttcacccaggagggatatggcccgaccaccgtgacgggaagtgtcactggactcaaggaagggctccacggcttccatgtgcacgctcttggtgacaccaccaatggctgcatgtcaactggaccacacttcaacccgctggtcatgtgcatggggcacccgaagatgaaatccgccatgctggtgatctttggnaatgtgacaagctgggagcgggatggtgttgctnacatcaatgtttactgaactggcaatntccccccttactgggaccaaantcaantt

SEQ ID NO: 90358 - DNA, 511 bp, Triticum aestivum
  unsure (1)..(511): unsure at all n locations
  Clone ID: PAT_TA_90358
gaattcactaagtgattagcggtggttcgcggccgaggtccgctactcccctgcctcccccanagctcgttagggttttctcttttttcgggggagaaatctcaagaggcggnaccatgctcgtgtaccangacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgaaaaagggngtttgaccaaagccgtgaaaggtgggtgacattgttnacaacntccgtcttcaangagcaaacctgctttttgnnaaagaaacaattttntctctcacattaaagcgctacaatcaaaaaaacctctccncncaaagctttgaaaggggaatgacctaaattttttnaanaaaaaatgtttnntccnccacaaaantnatcttctttannagccnaa

SEQ ID NO: 90359 - DNA, 176 bp, Triticum aestivum
  unsure (1)..(176): unsure at all n locations
  Clone ID: PAT_TA_90359
gaattcactaagtgatttcgagcggccgcccggcaggtgcgccgggactgtatccatccatgtcttttgaaaattgctacgtggctacttctgatgtagtgtgacactcgtataaaagcaaaatctgtccgtggaaactaaaaaaaaaaaaaaaaaanaaaancnaaaanaantac

SEQ ID NO: 90360 - DNA, 315 bp, Triticum aestivum
  unsure (1)..(315): unsure at all n locations
  Clone ID: PAT_TA_90360
gaattcactagtgattagcgtggtcgcggccgaggtgtaaatttcaaaaaaataaacttgtaccaaataagatgttctaactttttttctgaatcagatgtataataaacacatttcantccgcatgtggnccanattggnatatcaaaaacatcttatatttgngnaaaaaaaaaaaaaaananaanaacaaaacacacaaaaaaaaaaaaaacccnagactannacctgccnggggggncgctccaaancnaattcccncgggcgccanggnggggnggganaatgnaaattcnggcccaattcccccnaaaa

SEQ ID NO: 90361 - DNA, 238 bp, Triticum aestivum
  unsure (1)..(238): unsure at all n locations
  Clone ID: PAT_TA_90361
ctctgggtaactaaananggaaatnatntccggggncaaaaagcanttanatncaaaaagactcaaanggnttgttctctttccccnatggngagatggnccaatccaatccangttcttgtgcggggtcnccttcaatcnataatcaaaaanacaagggnatgcatgcataaatnaaccgggggaagagggaanaancacncaagcaagtntaagtccaaattactcctggctaaac

SEQ ID NO: 90362 - DNA, 501 bp, Triticum aestivum
  unsure (1)..(501): unsure at all n locations
  Clone ID: PAT_TA_90362
ggatcancaatggttaacntggnccccggcgaaggtttttttttgggcaanaaaaaacaccgnaagtttaacaatccgnnaccccnatggtaaaaaaaggggngggtacaaaactaaagcaaacaaaagggcnggngcgggttcncnggacnggaaaataattggttgggaaggnaacncacnaataanagcncnccaagaacgaatacttcnccggggggaataagccgtccttcctggtccccccccccntcctggatggganaagaaccttgtcgttccaactggnaatggaaagcaaaacaatccaaatccggggtntccantaaaccccccttgggaaaaaggnaaaacaaggttggaacgtnaaaantccaccaaaaatgctcctaaaagaaacccaatgccgcncaaaccgncaagganaattgagcggcccccgggtcctggttccctcaatggccctccncntggancccccttcccaaaaacggccaaaag

SEQ ID NO: 90363 - DNA, 190 bp, Triticum aestivum
  unsure (1)..(190): unsure at all n locations
  Clone ID: PAT_TA_90363
gaattnactaatgattaacgtggncncggncgagggantaatcncnagttttttttttttttttttggcgcgggaaanaagttttatttctgccanancnttgtggncacacancaacatgacttacnaaaagcggnagaggatacaaaggnaggaagtagcaagcatgggcaacacaaagcacgcacgt

SEQ ID NO: 90364 - DNA, 265 bp, Triticum aestivum
  unsure (1)..(265): unsure at all n locations
  Clone ID: PAT_TA_90364
gaaatcactaaatgattctagcgggcgcccggcaggtctaaatcnccaagttttttttttttttttaatantaaaaaancctgtttcaatatcaacttaaacataaaatggggnaatgtntatatgcccnaacgaaaaactgcagaacgatactaaaatccaccgtncaatgaaagacacattattcnaagcaagaataagtaggngntctaaatctatcanttagtcnacacctcgggcggngancacgcctaatcnaattccc

SEQ ID NO: 90365 - DNA, 331 bp, Triticum aestivum
  unsure (1)..(331): unsure at all n locations
  Clone ID: PAT_TA_90365
gaattcactantgattccagcggncgcccgggcangtcnagctccngcggnatggaaatggnggncgaaaanaggggntgcggntgcacccantgcaagtgtggnaccaanctgcggntgctcctgctgcanctgctagatnattgatnatcgatnatgcatgcaccgcgcgtgcagcatcgatnatatcgatntactactaccataccaatgttaccgctacctgatngaggggcttatctatgcacctgacctgcatcaacantcagggggcattccatncntgttgttaaaaaggccccctaaataaaatctcccctggtttaactaa

SEQ ID NO: 90366 - DNA, 461 bp, Triticum aestivum
  unsure (1)..(461): unsure at all n locations
  Clone ID: PAT_TA_90366
accctcgggtcgcaggggttntnaaaaatctcggtgattgacgggtnaaacctccccaaggnnttctcctggagcaacggggtcaanatncaatggcgcgancccanctggcccgncgnctaacancaagccaacgacgtnaggggccaaagcttgcagcgggaacaggagggtnaatgtcntnttctgcccnagatgagctnctctntcatatgcatgcgtgccatgccacgggcgaccaaaatactatctggaagtgttatactatgtcctccccgaaaagctaaactaattgtncttccaatttccaaggtnataaagggcgtncgaatatgtnccaagtggccngataaaagtcaataaaatacagggtagggaaaaaaaaaaaaaaaatcgagnctanttaactggccggggnggggcgcccnaaattccaanttcccccnggcggcaatgggggg

SEQ ID NO: 90367 - DNA, 482 bp, Triticum aestivum
  unsure (1)..(482): unsure at all n locations
  Clone ID: PAT_TA_90367
gaattcactantgattaacgtggtcgcggccgaggtctaatcccgagnntttttttttttttttttttttttttttagcccacagttgaagaatacagagacaattctcttgcaaattctctgttatgtttaacanatgaagaattcgaaggcatcttactaatcagntnagcaactacttcccccgtcccanaatgtaagacgttttttgacactancatagtgtccaaaaacgtcctatattatgggacggggggagtaatattcatgacactcatcctcatacataggccaaggcatgtctgggtacaagttttgtggnattacttccgtttcacatattaccacccatcacgtgaaactagctttaacaacatttcagacatctcttaaaatcagaccgcgggntgacttctgcagggtgccattccaaaaaanttctcgaacaatttccaagccattgggggaaccgtcataagcac

SEQ ID NO: 90368 - DNA, 507 bp, Triticum aestivum
  unsure (1)..(507): unsure at all n locations
  Clone ID: PAT_TA_90368
gaattcactaatgattaacgtggtcncggncgangtcttccgcgagcccatcgggaaattnttaaancggagangaaacaagaggngggggntnaagggagaggagacgagaaaatgggtgggggcatggaggtgaacaaaaaacggtggatttangagtggaaanccgggcggggaaaaactcnagctcaacttccgctttaaccgccgcaanctcgccgtcatcgggctcttcgggctcgccgtccccatcctcgtctaaaanggggatcgttcgcgaattccaaatncaaggacgaagacnccngccggncgttacaagaaattcctgttaancgtcgccctccggtgggttgtcgaaaatcccnancccgtctgcangggtttcggtcaangggaagaaagaaaccccaaatcnggtttgttttcccgtacctggtttaantcaanacccggcggtaattttgttctcannaattgcgcgaatatgtgtttaaaanaaaaatt

SEQ ID NO: 90369 - DNA, 264 bp, Triticum aestivum
  unsure (1)..(264): unsure at all n locations
  Clone ID: PAT_TA_90369
tgattaacgtgggcccngccgangtgcggccggtctcaagggttggacccaaanattgatcanctgccncncgcanatacnagcttttaaattgntnactactaaactgtagttattatcacgggtgaatacatgtattctttttaaagcgagaatggtgntagttacttgtntcnancacgtcnanatgtnaacctgcaggncttcaagtctttttatataaaaaaaaaaaaaaaaactcnagactagttcacctggccgggn

SEQ ID NO: 90370 - DNA, 431 bp, Triticum aestivum
  unsure (1)..(431): unsure at all n locations
  Clone ID: PAT_TA_90370
ggggggggcggcggaaattcacacaanatganttttccaaacggggccgcccccgggnanagggtttttttttttttttgnnaaaaaaanaatggnanccccnttattataacnaacaaaagggnatgttcctgggtttaaaaaaaggggagtacaatcaaccggccaangnncattttcacgcncaaacatcacattttanacctcggggcggcgaccangcctaatcnaattcccccgngnccggcanagggggggcgggggaagcaagccaangtncnggggccaaaatcgncccanaagnggggnccgtantaanaaatcaacnggggcgggcnttttaanaacgtcntggactgggggaaaaaaccctgggngggtaacccanacttaatcgncctttggaggaaaaaaacccccctttcgcccaa

SEQ ID NO: 90371 - DNA, 573 bp, Triticum aestivum
  unsure (1)..(573): unsure at all n locations
  Clone ID: PAT_TA_90371
naattcnctaantgattaacgtgggcccngncnagggaccaaattaaaagcaaagctcccttcctgcnattgcagttntctgcacttttggngctgggatacccncaatgaatctattgatgaagggnanaatgataatgtgttngtnaaaatgcaaagagagaaaacagctcaaggcactttccgccgaaggntgaatatgccaaccaancttcaagtcantggttgaaaagcaaaagcaangaagcantgccttgtcctttngnaaaagccgntatacaagggaagccttgngggaacaaattatcgaatcaagttacatacacgggggcaaaatggggtttcaagganagcaaaaaagcggcatcaanaatttccttcctttctacattcaaaaggggtaaatggactgcnacccttggaatgggagggtagggcaaaaccccatccctgcggtgacgaatccaaagttgtggggcatggggtggagaacaatcaatcaacatctgaaacaagcccatcctaaaacaaaacaanaaagggngggggngattgangaaataatgacctggg

SEQ ID NO: 90372 - DNA, 502 bp, Triticum aestivum
  unsure (1)..(502): unsure at all n locations
  Clone ID: PAT_TA_90372
gaattcactagtgattagcgtggtcgcggccgagggggnttttttttttttttttttttttttttttttttttttttttttttttttttttttttttttttttaaaaagttttaaaaaactctgcanaannatctctgaaacatccaacagaacaaacacgatntgatntttaaggnatctganacnctgananaaanaagatattgcananaaaanagttntgaacttntgatgttccaaaattaggntaacccttaatantaccanaaagctaaagcttcatgtcaanaccttcacttcttggncttntttggtgccgctgctgcctgaancgggagctgcaaccgctggggctggngnatgatntcncgggccctgngccaatctctccncccccctggaaatcttcccncnccccgggttgccttgcnnttgggggcgcttgggcccnaaactggtcanaagangggtctctnccttgccttctcaanccttgggctt

SEQ ID NO: 90373 - DNA, 483 bp, Triticum aestivum
  unsure (1)..(483): unsure at all n locations
  Clone ID: PAT_TA_90373
ggcaggtcccantccatcccccgtcgctctcacgctcttcgtgntcgccgcctcccttcgcgtgctgcctcatggcttccatcgccggatctgccgtgtccttcgccaagcccgtcaaggcaatcaacacnaactcgctctctttctctggtgcaaggaggggnaatgcatttcttcntctgcagccagtgccgatgagatttgctgtttgctgctcaccaaagcaggatacagtggagaaggtttgtgaaattgttnagaagcancttgctgttcctgaangcantgaantttgcggtaccaccaanttctctgaccttggagctgattcactgggacacnggcnnagattgtgatgggcctcccnngagggagttccanatcanccgtgggagggagaanantgccgcanggcaaattgcgacaagtttnaanatgctggcaacgctcaacnaacaaagcttgtctctgcgaangtatctt

SEQ ID NO: 90374 - DNA, 349 bp, Triticum aestivum
  unsure (1)..(349): unsure at all n locations
  Clone ID: PAT_TA_90374
gaattcactaangattaacgtggtcgcggccgaggtcctccaggaacancgagatccagggctcgagatccagatcccggccaggcagcaatggcagggacggtgactgtgnctgtnatcgtcggtgccatcgangccgctgctcaaggncgagctggncatcgngatcccgaccacccgcantctcgncttccttggggatgtggggccccttcttccaggcgtaccatctcatcancgnccagggacggngaccccagcaaggtcatcaanggttcccggagggcttccactacaaggtttacaacccgcaacgacantcattcgcattctcggncccaagggctca

SEQ ID NO: 90375 - DNA, 537 bp, Triticum aestivum
  unsure (1)..(537): unsure at all n locations
  Clone ID: PAT_TA_90375
gaattcactagtgattagcgtggtcgcggccgaggtcccatctgtgcccttcangccctgatggagggcatccaaatcctcaccttggaggatgttgtctctgaggctgatatctttgtgaccaccaccggaaacaaggacatcatcatggttgaccacatgaggaagatgaagaacaacgccattgtctgcaacattggtcactttgacaacgaaattgacatgaacgggcttgagacctaacctggtgtcaagcgcatcaacatcaagccccagactgaccgctggggtcttcccgaagaccaagaccggcatcattgttcttgctgagggtcgtctgatgaaccttgggatgtgccactgggccaccccaactttgtcatgtcctgctcaatcactaaacaaggttattgctcaaccttgagttgtgggnacgaagaaaggccaccgggcaaagttacnaaaaanaaaggngtacgttctccccaaagcancctcnaacaanaaanggcncgggncctccaccttgggcaagcn

SEQ ID NO: 90376 - DNA, 284 bp, Triticum aestivum
  unsure (1)..(284): unsure at all n locations
  Clone ID: PAT_TA_90376
gaattcactagtgatttcgagcggccgcccgggcaggtctagtctcgagnttttttttttttttttttttttttttttttttttttttttttttttttttttttttttaaattcccaaaaaaaagtttaangattattttaattcttananagcgaccganatagctaggagtagtatgcananatggncactacncacnanctanggtttattcaggaacataacacatacagccncncacacataaatnggnggggnatnacctcggccgngacnacgctaa

SEQ ID NO: 90377 - DNA, 512 bp, Triticum aestivum
  unsure (1)..(512): unsure at all n locations
  Clone ID: PAT_TA_90377
gaattcactagtgattagcgtggtcgcggccgaggttactcccctgcctcccccanagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgaggggggtgatgaccaagccgtgaaggnggttgacattgttgacaccttccgtcttcaaggagcaacctgcttttgacaaagaaacantttatctcccaaaatgaaagcgctacatcaaagaaactcccctgccnaagcttgaangggaatnacctaaaatggctttcaaanaanaaatggttgnngtccgccaacaaaaataatcntccttaacaaancccaaaggaacc

SEQ ID NO: 90378 - DNA, 538 bp, Triticum aestivum
  unsure (1)..(538): unsure at all n locations
  Clone ID: PAT_TA_90378
gaattcactaagtgattaacgtggtcgcggccgaggttgggaatgtacactgtggacgatgtgagatattgctgatgcatccttttggggctcctgctgttaaatgttctttgtgtctttttgtcactgaaattggagagcggaacgttcgtcctcggatatcagtcgagcaggttacacctcaccaacaagagctggctaaccaggtctaggtgaagctaatcaatattgggtcctgtatacgtggtttactgtaatcccaagaaacttcaaatgccatctataaaaacaaaaggaaaacttgaaatgctggtgtggaaattcttgcagtttttggnatgggcaatttgctcccctggagatgtaaaagttcaaatccaaccctgtaaccgtgggggataaagagaggggaanacaatactaagtgtngcctggaatccaaanccctaaaaaaaaaaacaaacctcccgttgtancnccgaaannttttttccggggggtataataaaacancaaattttagnggttggtcncctcn

SEQ ID NO: 90379 - DNA, 263 bp, Triticum aestivum
  unsure (1)..(263): unsure at all n locations
  Clone ID: PAT_TA_90379
gaattcactaatgatttccagcggncgcccgggcaggtttttttttttttttttttttaactaagtttaatttcaggcaactaactggacggtttcaagtttcataatccanatacattttcctccaggattggntatactgtacaaggagtcactaagagctagacaaccaagagaccaacaaaaaaactcaanccataatggncaaggnaatttagtcactaacatctatctggggagcctaacaaacaaatcaagagagg

SEQ ID NO: 90380 - DNA, 497 bp, Triticum aestivum
  unsure (1)..(497): unsure at all n locations
  Clone ID: PAT_TA_90380
gaattcactagtgattancgtggtcgcggccgaggtgcattctaccaccgcaccgcacgagtgaagtgagagctttgcacgaaaagttcatcagcgaccatgaagggcaccaagctcgcggngatnctcatcctccangccgtcctggtcatgggagtcctctcacacgtgaacgccgactatttccccaagtgctgcaacaactgcaggtccttctccggggtcgacgtctgcgacgacgcccaacccaagtgtccccaaggctgctcggcgtgccgcgtggtgtccacaagccccnaaatgtgggggctgcgcgggtatnnaaatccaaccgtcgacgggaacttgcgggtgggacctgcaaanaanttactggatcggtttaatgccgggaangatatgtttccgcctaaaaaaaaaataaaaacttcaaagggaagattgangnagggtcaatcntgcctaattgctngtgtttgttgggcaaanaatgctta

SEQ ID NO: 90381 - DNA, 476 bp, Triticum aestivum
  unsure (1)..(476): unsure at all n locations
  Clone ID: PAT_TA_90381
gaattcactagtgattaagcgtggtcgcgggcgaggtctcgagttttttttttttttttttaggtaaatttttactgccctgtacngtgtnctcaaaatatcaatgaaacgttcatagtagggggctaacatgtantactacaagtgngttggtaatatgataacgtgatgtattaacgcaagcacgccttttatttataggggcccgttatatctaacgtacncccttttattgattccgtggtgcngacgttgaaacagcccttcaatggggccaggaaagggtggatctngggtaagnttaataacctgcccggggcgggcccgcctcgnaattcgaaattcccngcgggnccggccaatggtcgggcccggggnagcnatggcgaacgatcnggggccccaanttccgccccctataagtggnagcccntatntaacaaattccacctgggncgtcggtttttaacaaccgt

SEQ ID NO: 90382 - DNA, 514 bp, Triticum aestivum
  unsure (1)..(514): unsure at all n locations
  Clone ID: PAT_TA_90382
gaattcactagtgattagcgtggtcgcggccgaggtcccaggtcataaacccaagtcggactcgccttcctcctccccaactactcctctcctctcctccgcgcatcgcaccggggtcacctgaggtagatcacacacacaatggtgaaggctgtggctgtgcttactggcagtgagggtgtcaagggcaccatcttcttcacccaggagggagagggcccgaccaccgtgacgggaagtgtcaccggactcaaggaagggctccacggcttccatgtgcacgctcttggcgacaccaccaatggntgcatgtcaactggaccacacttcaaccccgctgggtcatgtgcatgggggcacctgaagatgaaatccgccatgctgggtgatctttgggaatgtgacagctggagtggatgggtgttgctaagcatcaatattactgactgccaatatccccccttactgggnccaaattcaaattgtttgggccgttgctngttgtcgttccaag

SEQ ID NO: 90383 - DNA, 280 bp, Triticum aestivum
  unsure (1)..(280): unsure at all n locations
  Clone ID: PAT_TA_90383
ttcgagcgcgggcagtgcanggtggccggcaaagcatggattgcgcgaagacaggcggngagcatggagatctcccttttttcttttttcttcacgcgtgtgtgnaagggagaagacgactcaatcgctgctatccaagaccgtttatttgtaccacggatccaaacgcctgggcaagcgnggaccgngccaaaaacttccgggcccgggtgccgccgggcgcctangcgtcgcccaaanaaatcggtcctaanaccgntgtggtnatggcgcgttggcg

SEQ ID NO: 90384 - DNA, 576 bp, Triticum aestivum
  unsure (1)..(576): unsure at all n locations
  Clone ID: PAT_TA_90384
ttgattancgtggtcgcggccgaggtagtctcgagntttttttttttttttttttgggtttttttcnccaacaacaataaactaaaccaattcatgatctgtccggatctgcattacaaagggcacaaagtgttttccaaagccaacgagtaagngttgctgttgtgcaanacctaaaccaaatgtcactgcangttgcttattacngggtaaattggnntaaaaaacgacacaaaaaacaagggatncctcacgcagggagctgggcacactcctgctccgnggagcaaagtctcggggcggaaccaagctgtaaaatcccaaaaaaaaattaaactntgttcaaggggcgggtgggganacacctncgtcaatcaaaagcgttcttcncctgggngaatntttcctctgcccnttggnggangaactttcntccnaatgcctnccaaccnantgaaccctggccccggggtgggnaatcnaaaatttcnccccgggccnccnatcggtgggncgggggangnattgcgaacnatccggggnccnaaatncgccctaanannggagggcggtatt

SEQ ID NO: 90385 - DNA, 491 bp, Triticum aestivum
  unsure (1)..(491): unsure at all n locations
  Clone ID: PAT_TA_90385
cgaggtcatcatcccatcccccaagtcataaacccaagtcggactcgccttcctcctcccccaactactcctcctcgcctccgcgcatcgcaccgcaccgggggtcacctgagatcacatacacaatggtgaaggctgtggctgtgcttaccggcagtgagggtgtcaagggnaccatcttcttcacccaggagggagatggcccgaccaccgtgacgggaagtgtcactggactcaaggaaggggctccaccggcttccatgtngcacgctcttggtgacaccaccaatggctgcatgtcaactggaccacacttcaaacccnctgggtcatgtgcatggggcacccggaaagatnaaaatccgccatggctgggcgatctttggnaaatgtnaccaactgggnanccggattggtgttgctanacatcaatnttactgactgcaatattccccccttnctgggnccaaaanttcanttggttgggccgt

SEQ ID NO: 90386 - DNA, 521 bp, Triticum aestivum
  unsure (1)..(521): unsure at all n locations
  Clone ID: PAT_TA_90386
gaattcactagtgattagcgtggtcgcggccgaggtcctcccctgcctgccaacccccaatctcccgtcgcagccctcgaatctcccccgagcatcgaccatgtcggcctactgcggcaagtacaaggatgaagctcatcaagaacgctgcctacattggcacccctggcaagggtatcctcgctgctgatgagtccaccggcaccatcggcaagcgcttcgccaagcatcaatgttgagaacgttgaggacaaccgccgtgccctccgtgagctcctcttctgcacccctggtgccctccagtacctcaagcggtgtgatcctcttcgaggagacctgtaccaagngcaccaagggtggcaagcccttcgtcgacatcctcaaggcgggcaatntcctccccgggaaatcanggtgggacaaagggtnncatccaagcttggctgggaaccnaacgggtgagaccaacaacccaagggctttttgnttaaccttggnnaagcccctggcgccaaattact

SEQ ID NO: 90387 - DNA, 512 bp, Triticum aestivum
  unsure (1)..(512): unsure at all n locations
  Clone ID: PAT_TA_90387
gaattcactagtgattancgtggtcccggccgacgtgnattctaccancgcaccgcacgagtgaagtgagagctttgcacnaaaagttcatcacgcgaccatgaagggcaccaagctcgcggcgatcctcatcctccangcngtcctggtcatggnagtcctctcacacgtgaatcgccgantatttccccaagtgctgcaacaantgnaggtccttctccggggtcgacgtntgncacgacgcncancccaagtgccccaaagggctgctcggcgtgccgcgtggtgtcgacnaagccccgaaatgtggcgctgcgcgggtatnaaatccaccgtccgcggcacctgcgggggggcccctgcaagaaagtactgatccggttcaatgccnggcatngntatgttccgcctaaaatannataaaagctcaaggcgagattgtgcancgttcatcgtngcctatnccntttgtggtgtgggnaacaatgnntantaccaagnatntcgtctnn

SEQ ID NO: 90388 - DNA, 486 bp, Triticum aestivum
  unsure (1)..(486): unsure at all n locations
  Clone ID: PAT_TA_90388
ccgaggtcnagtctcgagttttttttttttttgattcaaccaaaacacaaccacaccaatttcacgattaccattacaaagcaaatcccacaattatcagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcaatgcatgctctcgccaacaaagaactgaaggggcctttgagcttgctaaggaagatacttttgtggcggnctcaaacaattcntcttggaaagcatctaaggtcatcccccttcaaagcctttgggnagagagggttcttggatgttaccncctcatgtngagaagataa

SEQ ID NO: 90389 - DNA, 425 bp, Triticum aestivum
  unsure (1)..(425): unsure at all n locations
  Clone ID: PAT_TA_90389
gaattcactaaatgattccagcggccgcccgggcantccggcgagggctgcatctgcngcgacaantgcaagtgcaacccctgcaactgttnagctgcatgcactcgtacgtacgtgtgttggtgtgagagtatacntgaataacnagcgtctgatctgntggagtccaacaanggtgcgtgtgcgtgtgcgtgtggtttgcttgctcgctctcccatgntctgcccatggggtccttgtgtgtatgtgtgtgtgcangtgtccctgtaattgcttcatctatccccactatggatggagtgatgaatatgtnagaatgaaagattttcctaattaactaaaaaaaaaaaaaaaacctcgggccgcgaccangctaatccaatttcccccggcnggccatggngggccggggaagaaattntaac

SEQ ID NO: 90390 - DNA, 351 bp, Triticum aestivum
  unsure (1)..(351): unsure at all n locations
  Clone ID: PAT_TA_90390
nncgnaggtcgagntttttttttttttttttttttttgccaccagcgcacaatcantacttantcacngaggaaattccgggntatnngaacancanncattaccatgctttttctcgagagaaaaaacacatttgctaagacacggnatactggtatacagnattngttggccacacacacangcatnggtantntcaagctgctcaccacntcatgacacttttatttcattttacagcggancatatcaatgctggtggtgaagccgatcagtacttcttgcatggcccaccgcangttccgtctaaggaggttttcaaanccccgcaacnncanatttcgggggtcc

SEQ ID NO: 90391 - DNA, 583 bp, Triticum aestivum
  unsure (1)..(583): unsure at all n locations
  Clone ID: PAT_TA_90391
ggaattcantaagggntaacgggggcccnccgngggcccnaggtttttttttttttttttttttangcccaaatggnaaaaacccttantcccccntcaaatcaaaaaaaatcctttggaaaaaaaattttaactaaagncccanacggaaaaanccaatantcccccctcaaattaaaaacttaatcttttggaaaaaaaattttaacaaatagtcccaagcaaaagatacatttantcccccctcaaattaaaaacttaacaatttacttggttcaacaacaatagtaaaacanccttaaaaggttcctcaaataagaaggctaaatcaacgtgaggtcctccgtcctccttggtaactaaancaaacannttaaccntttanggccctgggacctggcccgggggcggggcggctccgaaaatcgaaantccccgcgggccgncaatgggnggggcggggaagcaatgcgaaagtccggggcccaaantcgccctaaaagggnggtcggaantaaaaantcancggggccggtcggttttanaaacgtccgtggacnggggaaaaaancctgggnggtnn

SEQ ID NO: 90392 - DNA, 475 bp, Triticum aestivum
  unsure (1)..(475): unsure at all n locations
  Clone ID: PAT_TA_90392
ggccgngggaaaatagttcaccgatttgaaaaaataacnaattttgnaaactatagtacacngatttgaaaaatgctcncagatttttaaaaagaagttcactaaacatgttgcaaagaactaaaacaattcaagaaattggggaaaagtcncactaanaaagtcagcaacaacagaaaaaaatcncgggtttgcaaaaatttcatgaaatttggnaaagagtttgcaaagttgacttgtttcncaaaattaagaaaaaaaaacttggtttttttaaaataccnaaattgcactattttaaaaaaatcaaaaaagggaaaaagaaaagaaactgnnaaaataangagaaaagaaaaattanaaaagngagaaaggngataaaaagaccangtngaaatcgggcaagacaaaaccgccagaaaaagggaaaaaataancggtttgngggtacanttggccaacattaaagtgggaa

SEQ ID NO: 90393 - DNA, 432 bp, Triticum aestivum
  unsure (1)..(432): unsure at all n locations
  Clone ID: PAT_TA_90393
ncncnagtttttttttttttttttantccacaaantgtataaaantatgcgtccgtgcaaanacaaagccnccgatagcaatcacaaacgaacaagctttctccgagccaagttcgcncatgaacatggncatacacaaattcttangaacaagtnaagaaaagataaatggggaaggnaaacccaaagcaatgtcaaagttgacaaaactgcaatggnactttatatatggcctgtcntgagtgagctgtttaaggcttgccgggctcctcccaacccggggggttgaaaggcgatgaanctgacgcactgcanctgggcgcaagttgtcgaatcccgatgaatgcgggcaataacccgtcaggggaactccctccttgacctcccccancccccgttgatnnacttgtgtggnggtcnggggaacccgaa

SEQ ID NO: 90394 - DNA, 466 bp, Triticum aestivum
  unsure (1)..(466): unsure at all n locations
  Clone ID: PAT_TA_90394
ctantctcgagggnttttttttttttttttttttttttttttgtcaaaactgaacaatgtattgactacccancctgcatttaagcagggaaacatatncacatcatttnttcatggtgagcctggnggnanagagcatccaaaacancantctacaagccagtccangttgtaaaactcttntgctacctgnacacggaggtccgggatgacctgntcggcttccctccananaatcnccgtttcctcgtcgcananaaagtgccccagggacttnaacgacnaggaggaccnanggagantcctcnaaaccgcgagcaattcccgcaangtcnattttctctanggttgtcanggtnggcnaaactcttccttggnaagggctggtaagggttaatgnanctgngaaattttccaaagtatttttancccnccttaaaggntgnaanaacggangggngggagg

SEQ ID NO: 90395 - DNA, 533 bp, Triticum aestivum
  unsure (1)..(533): unsure at all n locations
  Clone ID: PAT_TA_90395
gaattcactaatgatttccagcggccgcccgggcaggtttangcnatactgttcctgcatacctacanaaaaatttgtttcctaatattttgnacgaggaaaagttttgggcacatccggncagancaatcacaaangcttatnaaaagacggncaaggntattctgtcacanantccacanttgggacaaggnggctccacngctgtnactgccanccttataaanggcagtaanctgtgggnagcnaatgttggggattcnccagctgttcttcttnaaagaggtgggggcatanaaatgtnaattnntcacnacccnaatgcagaacgtggggctattgnaaaaaaagggggntttgtttcaaaaatgccacnaagangttcccacaaactgtggtcantngggncgtgtccanaacntttggnggacangaatctaaaaacacctttnttatcaanaacctgatgttnnaattnttaaanatccatnaanacgctgagccaattntnctttctancanaaggagntttg

SEQ ID NO: 90396 - DNA, 292 bp, Triticum aestivum
  unsure (1)..(292): unsure at all n locations
  Clone ID: PAT_TA_90396
gaattcactaaagattccaagcgggcncccgggcangnctganctgagtccaaaaatttcttatctcncanaaaaantttccaaacanttgacacanttctgataggncccnccnatgtgaanaaaangncgtgggctcngtaaaaaaaggtcccgcgagggnggntttctctgccacctcaataaaaaagcaatgataggntaaaaanaaagctcnattcacttggcaaaattttgggcccctccgttcaacnctganactgggaaaagaaaggttttggntancaaggtc

SEQ ID NO: 90397 - DNA, 539 bp, Triticum aestivum
  unsure (1)..(539): unsure at all n locations
  Clone ID: PAT_TA_90397
gaattcactaaatgattaacgtggncgcggccgaggtgaactaaatcncgagntttttttttttttttttttttttttttttttttttttgggggcgacgaaacattatttccattaaaanaaatacctacaaagtttgtntgncaaanacaaaagcacgtatcctganaaatttggggataccanaaagtcacagagtacttatgtgggangcctgaatcaaacgactccattgttggcaaactacaacaaagtncactaccactgnnggatgggataatngcacantaacaagaactacancaaggngagaggnagtccttggggnatctgttncaacccancctaatcatacaaaacttnaggtcttcagnaccaaggaaaagcaacgggnancaattnaagcaacctcccancgattttcacccccaaaaaagggnaagttgtgtgaantttccacaatccctangaaaaacccccggncgggttaananncaaatgggagntggccaaggcctcnaatcctggggaaatttgcc

SEQ ID NO: 90398 - DNA, 225 bp, Triticum aestivum
  unsure (1)..(225): unsure at all n locations
  Clone ID: PAT_TA_90398
gaattcactagtgatttcgagcggccgcccgggcaggtctagtcccgaggttttttttttttttttttttttttttttttttttttttttttttttttttttttgggaacaangtcnaactttgcttattcattcaaatcanatcccaanagggtcancnccgattattacnccaaacaataaatacaanaggngntaggtaaacctcggccgngaccacnctaa

SEQ ID NO: 90399 - DNA, 520 bp, Triticum aestivum
  unsure (1)..(520): unsure at all n locations
  Clone ID: PAT_TA_90399
gaattcactagtgattagcgtggtcgcggccgaggtattttttagtatttttctgataaataagaaaagggtgcacgatctcgacgaattacttctgaataaatttagaaatcatatggaagaaccatagcatttcgcgactcattggtaaatcaactttgattctctataaaccaagaatgtgagaccattaacacggttaaagctaaactgcttgaagtccaggcaaaaagaggtactctttctacaactatattagtattagtaccgaatttaaacgggaaatagctaatgtaaaatttatctgatatagaacactcatatcgataaaatggtttgaactatttactanaaaaaaaanggggcaccctgccccttttttaaccaatgccgaatcgacgaacctatgtataaaaaaagagaaattttttggatttgaagaaaaaaaaaaaaaattcnaataaatttcaattttcaattaattaagtaagttttcctaaggaaatggaattaataaang

SEQ ID NO: 90400 - DNA, 518 bp, Triticum aestivum
  unsure (1)..(518): unsure at all n locations
  Clone ID: PAT_TA_90400
gaattcactaantgattaacgtggtcgcggccgaggtcgagcgcctcctcctgtctcgccctcgccccccgtcccctcgtcggggcccgatctaattcaanatnaatcctggcgggagtgctggtggtggncaaagttctctgggttacctgtttggagatggtgagcctgcaaagcccgctgcagcaccaactgcgaagcccgcacctgctgagaaacnaacaccggcagctgctgatgtatccaagcanattccagctggcattccatgtagccgggcgaacaaatactaccgtgcagatggncagaacacnggcaacttccttacngaccgtccttcaaccaaggntcatgctgctcctggcggtgggtcctccctgggctaattgtttgggnggaagtgatgttaatgatctgcctaatgaacgaacgaagaattgggctgtatctctgttatccanntggggaaaactgggaagtgtttggtttcancaatttaacaaccgcntcgatntant

SEQ ID NO: 90401 - DNA, 537 bp, Triticum aestivum
  unsure (1)..(537): unsure at all n locations
  Clone ID: PAT_TA_90401
gaattcantaaagattaacgtggtcccggccgaggtcttctcgcanccgcccccgtgtctcccgtgcgcaccttntcnaagcctcccccatggggggccanctcaccgacnancaaatngccnagttcaaggagggcttcancctcttncacaaggatggggacggttgnatcancancaaagagcttggtaccgtgatncggtccctcnggcanaaacccaccgagggggggctgcaggaaatnattaancaaggtnacncgggcggggaaagggaacaaccaatttccccagttncttgaaacttatngggaggnagattnangacaccgactccngggaggagctcaangangggtttccgcntgtttnncaaaggacaaaaaagggtttatntccgcngggggngnttgcgccaacctnaatgaaccaaacctcccggganaaaactgnctngccaaaggagggggggccanaatatttcnggaagggggnnnttgacggggaanggcnaaattaaataaaaggggttctcnn

SEQ ID NO: 90402 - DNA, 533 bp, Triticum aestivum
  unsure (1)..(533): unsure at all n locations
  Clone ID: PAT_TA_90402
gggnattcactaaatgattaacgtggncncggccgagggttttttttcacaacaanttccaaacatgcaacaaaccagttttattcnagngcaagtagctagtatatacaccagatggnatcactgtntaaggncgtgcatggcggtagagtaacttgtgatgatacnttacatacattacataagaggcatgcattgatgccgcanatantatatgcgtctanggcgccgttccgttacataaaacgatcgatccttgcattgttttggaagangaagcccgcgcacgggtgtaaataaggctgggcacctgccggggggacaatanaanccgtaaaantttgctgcacggacgaaccgggtaagggttaacaaagcggggnccgggaaaacaaggggggtaagggcccttnctaacaatgnccanaaaaantgggggtcgtgggcanncgggtccanaggaanacnggggctgttcnatatnaccccgggggnccacnaccaaaagaacnatntgncggggcaacctgggg

SEQ ID NO: 90403 - DNA, 524 bp, Triticum aestivum
  unsure (1)..(524): unsure at all n locations
  Clone ID: PAT_TA_90403
gaattcactantgattagcgtggtcncggccgaggtgtcgtgcgaacactaaggagacgcttctgatgcgtgccgtcgggacaacataacagatcggtgcttttcaaaagcttcggaaagagagacgacttatgacaccacggaagagtaagaactctcgacgcgatatgtcgtcggagcttttctgaaagcgtcaagatgcttgccactctcattcatcatgggtgatctaagtagcatgaaattctagagacctgctaagtgattctgctcttccctgtaaaatgatgactangtgctccacttgggttgtgctacgccgggttgagctttaaaacctgtcggtagatttgctcaagtatggctttgttctcatactccttcgactttgatttgctttcaactaagtaaacactgtataaggactttgatgaaaaaatgtggttgatcgggttggaccngcactgcactggcaaaggtgtgggaacantctatcctaaaacaaanttcgttgtccaactcaa

SEQ ID NO: 90404 - DNA, 256 bp, Triticum aestivum
  unsure (1)..(256): unsure at all n locations
  Clone ID: PAT_TA_90404
aggttttttttttgaatcatgttcttgttgttttctccttgctgagagtgtattatgtgcgtagtgtactcatcatgatctctgaagctatgcttacaagttgcatcattgttttcttgaaaattgaccctccaaattcatgttctcttataaccgatcctgtaaaatcttccttggattttaaatgaaagtttcacaccatgcccctttgagataacangtgggaacattacaaggnttaantgancctccnacc

SEQ ID NO: 90405 - DNA, 494 bp, Triticum aestivum
  unsure (1)..(494): unsure at all n locations
  Clone ID: PAT_TA_90405
gaattcactaagtgattancgtgggtcgcggccgaggtctagtctcgagttttttttttttttgcattcacatacgaagcatgctttctcgagacatgttggtacatgaacatggacatacacatattcttaggaacaaacaagaaagataaatggngaaggaaaacccaaagaatgtcagagttgacaaaaccgcaatggcactttatatgtggcccgtggtgagtgagctgtttaggccttgccggactcctcgcagcccggtggcttgaaggcgatgaaagctgacgcactgcacctggcgcatgtttntcnaatccgatgatgcggacgtacgcgtcagggtactccttcttgacctcttccacctcgttgatcacctgtgtggcgtcggtgcacccgaacataggcagcttccacattgtccaagtacccggccatcgtangtacccanggggatgccgttgtgctcaacggaagatgnaacccaaccn

SEQ ID NO: 90406 - DNA, 499 bp, Triticum aestivum
  unsure (1)..(499): unsure at all n locations
  Clone ID: PAT_TA_90406
gaattcactagtgattagcgtggtcgcngncgaagtcctccaggtcgtcntgntcatgggantcctctcacacgtgnacgccgattttttccccaagngctgcancaaatgcaggtccttctcgggggtcgacgtctgcgatgacgcccaccccaagtgtccccaatgctgctcggtgtgccgcgtggtgtcgacgagccccgaaatgtggcgctgcgcggatatgaaatccaccntngacgggacctgcngtgggatnctgcangaagtactgatcagttcatnccggcatgatatgttccgcctaaaatanaaataaaagttcaggggatatgagcaagcgtcatcgtgcnctaancggtgtnttgtgtnggccancaatgctttataccaagtaagtccgtcncttcnnccgctgtgttttctcntctccnanaaaaaaagnntgggggttgcttggttgntcaactaanccgggnntantcctccggttgaagga

SEQ ID NO: 90407 - DNA, 488 bp, Triticum aestivum
  unsure (1)..(488): unsure at all n locations
  Clone ID: PAT_TA_90407
gaattcactantgattancgtggtcgcggccgaggtgagagagagaactagtctcgagtttttttttttttttttttttttacaaagcatcatcgcaacagttatttataaagttgtttctctcatacttaatattatagagttagaactgttgagcaatgaacaatcatgcaacagttacataagtcgatacaaaagcacacgtgagaagacaggcatactccagtataaaaagacagggcgggacanaattaatctagacaggtccgttttgttggatcggagcacctggtgnaccagttcgtccggagcacaggatacgttcaagctccccttgccctctcatcctgtcccctctctttttaatccaatggctggctganggttggatnggagcaactggtgcacgagttcgtccggagcacaaggaaacgttctcanttngacccataccaatccgtttccaaaatttttaaaacnattgccaa

SEQ ID NO: 90408 - DNA, 438 bp, Triticum aestivum
  unsure (1)..(438): unsure at all n locations
  Clone ID: PAT_TA_90408
gaattcactaatgattaacgtggtcncggccgangtgtcncnantttttttttttttggagaaatctttatacnaattgcagaagatanatgtngagtacaaaaggcgagcangaaanacaaaatggggagtaattaattaattcttgttcttggcatctatggcggagcggcgganatgggttctccggttcacttggcgcggcggcanaaggtgatgccgtcnccgacggggaagctggcanatctcnacgcnctggtcggcggcgaaggccttgttgagctcnaggacgaaatcncggtantagcggatgtacttgcncaagggggcgtcggcggggaacacaacggagccgttccaaaaggtgttgtctaaccnaagangccgccgacctgcccggggcgggccaatccaattccccccggccgccatgggggg

SEQ ID NO: 90409 - DNA, 554 bp, Triticum aestivum
  unsure (1)..(554): unsure at all n locations
  Clone ID: PAT_TA_90409
gaattnactantgattcnagcgggcgcccgggcangtntgagatncgacatgaacggccttgagacctaccctgggtgtcaagcgcatcaccatcaagccccaagacctgaccgttggggtcttcccccgagaccaanactgggcatcattgttcttgctgaaggggtccgtctggatgaaaccttggnatgtgccaactgggccacccccaacctttggtcatgtccctngctcaattcaaccaaacccaaggttattgcctccaaccttggaagtttgtggggaaccnaagnaanggccaagtgggcaaaggtatngaacaaaagaaaagggtggttacggtttctcccccanaagcnacctgngaacggaagaaaagggtccgccgggncccctcccaactttggggcaaaagcctccnggcggcccaaggccttganccaaagcctcaaccaaaaggtccccaaggtcntggactaacaatttantcaatcccccaaaatttgaagggggtcccnttaanaaancccctngcggggnttttacccgggtt

SEQ ID NO: 90410 - DNA, 440 bp, Triticum aestivum
  unsure (1)..(440): unsure at all n locations
  Clone ID: PAT_TA_90410
gaattcactagtgattagcgtggtcgcggccgaggtcctcccctgcctgccaacccccaatctcccgtcgcagccctcgaatctcccccgagcatcgaccatgtcggcctactgcggcaagtacaaggatgagctcatcaagaacgctgcctacattggcacccctggcaagggtatcctcgctgctgatgagtccaccggcaccatcggcaagcgcttcgccagcatcaatgttgagaacgttgaggacaaccgccgtgccctccgtgagctcctcttctgcacccctggtgccctccagtacctcagcggtgtgatcctcttcgaggagaccctgtaccagaagcaccaagggtggcaagcccttcgtcgacatcctcaanggggggcaatgtcctccccgggaatcaagggnggacaanggtaacaatcgagcttgn

SEQ ID NO: 90411 - DNA, 447 bp, Triticum aestivum
  unsure (1)..(447): unsure at all n locations
  Clone ID: PAT_TA_90411
gaattcactaagtgatttcgagcggccgccgggcaggttttttttttgacacaagataatccgatagaataacagggcagaatctcttgattcaaccaaaacacaaccacaccaatttcacgattaccattacaaagcaaatcccacaattatcaagaaagttttcaagacactcaacatctgacagttactgacaccaacattggagagtcgactgacaaccatagataagagcaaaaatactgaagacagcatanattttagcatacagtgcgattagcacttgacctctttcagcccatgtgcaaagtacaggaaagttggntcagcaagctccctccttgtagtaggcgaacaccaacgccgccatcatcatgcatgctctcgccaacaaagaaactgaaggnccttgaagcttggctaaagaagatactttgggggnggncn

SEQ ID NO: 90412 - DNA, 226 bp, Triticum aestivum
  unsure (1)..(226): unsure at all n locations
  Clone ID: PAT_TA_90412
gaattcactagtgattagcgtggtcgcggccgaggtcgacccttttgcttccgctgctgcagcagctgacgatgatgatttatataagctaaatcctttcgcgttcgtagatgttgtgctccggtacgcagtacacggaagaactatgttcttaagttaatattgtgatgcacagttaatcgttctgcccgttaaaaaaaaaannagnaaaaaaaaaaaaaaaaaa

SEQ ID NO: 90413 - DNA, 435 bp, Triticum aestivum
  unsure (1)..(435): unsure at all n locations
  Clone ID: PAT_TA_90413
gaattcactantgattagcgtggtcgcggccgaggtgaaccatagcatttcgcgactcattggtaaatcaactttgattctctataaaccaagaatgtgagaccattaacacggttaaagctaaactgcttgaagtccaggcaaaaagaggtactctttctacaactatattagtattagtaccgaatttaaacgggaaatagctaatgtaaaatttatctgatatagaacactcatatcgataaaatggtttgaactatttactagaaaaaaaaagggggcaccctgcccttttttaaccaatgccgaatcgacgacctatgtataaaaaagagaaatttttttttggatttggaagaaaaaaaaaaaagaattctattaattttcattttccatttaatttagttaagtttttcntaaaggaaaattgaaaan

SEQ ID NO: 90414 - DNA, 433 bp, Triticum aestivum
  unsure (1)..(433): unsure at all n locations
  Clone ID: PAT_TA_90414
gaattcactagtgattagcgtggtcgcggccgaggtctagtctcgagttttttttttttgctgttacaacaattcttctattaaagcaaataaacttagcggagcgaataatttctcttaagcaagacggcaacgctgtgctgatgatgagattgttccaattcctacaatccccatagcaattagtggcaagcaataatatgagctcgtgtctgccccacctttggtagcctcacatcaagtatcctactactactgcagactagagcaagatttattcatctgttgtccgcaactaatcataaccaaatttactattcaatgggattgaatgataatctcaagtnatccctgcctgcctgattggaagtgctcactgggnatgcacacacacactgacctgttacgcactgggnttaactatcagaggcgt

SEQ ID NO: 90415 - DNA, 430 bp, Triticum aestivum
  unsure (1)..(430): unsure at all n locations
  Clone ID: PAT_TA_90415
gaattcactagtgattagcgtggtcgcggccgaggnttttttttttttttttttttttttttttttttttttttttttttttttttttttttttttgaacnaagggagtaccatggatntanattttttcttgaagacccanaanaatgaacccananccatgaaatgggcttgcttcanaaactgtncagtaataaaaanaaaaaaaaccnaancattcanatgaaaagcccananaaacatcaacaagnattctggacacnggtacggtccccccaagtagacgattccaaggattttgaactttacaancttttancaggtgcaagagggnaaaaaatattcaccggaanaccgtcctngctttttccaaancaaanaggactgganggcataactttcaccctgcnacaaaggatnatggggaann

SEQ ID NO: 90416 - DNA, 437 bp, Triticum aestivum
  unsure (1)..(437): unsure at all n locations
  Clone ID: PAT_TA_90416
gaattcactagtgattagcgtggtcgcggccgaggtcgtatatagtcgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgaagctgtttaggccttgccggactcctcgcagcccggtggcttgaaggcgatgaagctgacgcactggcacctgacgcatgttgtcngaatccgnatgatgccggacatacnccgtcagggtactccttctttgacctcctccaacctccgtttgattacctggtgnggngtncag

SEQ ID NO: 90417 - DNA, 460 bp, Triticum aestivum
  unsure (1)..(460): unsure at all n locations
  Clone ID: PAT_TA_90417
gaattcactaagtgattagcgtggtcgcggccgaggtgagagagaaananagaactannctcgagttttttttttttttttttgcaacttaagcaggatattcttannctctcaaaaaggcaaccaaanacacatagaccgntccatggatggatctatcanttaaccatgcagcaacttcgcatcacacacacacacacanacacacacananagcagcagttcatacagtgcataaatncggcnatgtnattaaaacagtncacacatatntgtgnancaacttggccaagtatccntacccntntttacaacacncatacacacttcttcatgcatatgcatacaatatgttatattacgngaagaggaaggttcaagtttnttgnaggngcaantttgggaaactcttgggagggntngganggttcaangggaaantnaaagttcnacacggncc

SEQ ID NO: 90418 - DNA, 437 bp, Triticum aestivum
  unsure (1)..(437): unsure at all n locations
  Clone ID: PAT_TA_90418
gaattcactagtgattagcgtggtcgcggccgaggttcgagttttttttttttttttttttacggaatgtgttcatttattcattcattattttcaccaggcattgcttacaggcatatatatgtatgtagtcagaagagccaattcattgttgtacttgtagggtgaaaaacaaaataaataaaagtcgagttagttgatctgagtctgaatctgagatggtattgcttgatccatgtagtaggatatgtgcttagctggnaagaaacaaacagacagacgggcccattcatcaatgttgaggagttgttcagccacccctggaattggaattgggagttggnagttgaaattggggtcccttggagcttgaacaaccgaaattctttgtccgnncgtggggcatccggtcccctgnnggttccccaaactccttn

SEQ ID NO: 90419 - DNA, 343 bp, Triticum aestivum
  unsure (1)..(343): unsure at all n locations
  Clone ID: PAT_TA_90419
gaattcactaatgatttcnanagggcgnccgggcaaagngtcaaannttttttctttttttttnaaagttngngaccnaacntggcnaaaccctntttgcanattncaangggaagacaaccccccccacaaaagcaaanctantttggntaggaatcccctttncaaaaccnaataaaangttccatgccaccnaatggggcacttctctcanaggaggggaangtgtttccaattacaagcttaaactnaggtaaaccanccctcananagcaagggacaaaatgggaggggncgnagcccacccttcccnatgtttgtantccttggggaaagaccttgt

SEQ ID NO: 90420 - DNA, 442 bp, Triticum aestivum
  unsure (1)..(442): unsure at all n locations
  Clone ID: PAT_TA_90420
gaattcactagtgatttcgagcggccgcccgggcaggtctcctccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaanaactgcaggtccttctcgggggtcgacgtctgcgacgacgcccaccccaagtgtcccaagggctgctcggcgttccgcgtgggtgtcgacgaagccccgaaatgtggggctgcgcgggatatgaaaatccnccgtcgacggggacctgcggggggaccctgcaaagaagtactgattggttcaatgcccggcaaaatgaataatgttccgccctaaaattaaatnaaaaagctcgngncnaagatgagcn

SEQ ID NO: 90421 - DNA, 268 bp, Triticum aestivum
  unsure (1)..(268): unsure at all n locations
  Clone ID: PAT_TA_90421
gaattcactagtgatttcgagcggccgcccgggcaggtttttttttttttttttttttttttttttgcancatcctaatagagtatttgtntctatgtcaattaaanggactaaaaattaattaaagtatttcaaatttaaaatttgaaaatgggggggtagncctatgcattgtgcatggtttacttaaataaaacttaaaaatagagtgaataaccaagatttcttgccgatactctaanaaaaacctcgggcgcgancacgctaa

SEQ ID NO: 90422 - DNA, 425 bp, Triticum aestivum
  Clone ID: PAT_TA_90422
gaattcactagtgattagcgtggtcgcggccgaggtttggttgaggttttcctagtagtcatgtagagtactataatgtagtaaaagtttggttaataaccgtgtagagctctcttggtttgaactttccataatgaatttactgttgcattaatctactttgatcttattgtgtgaacttatcagcgaggataaatctgtgtttgaactttccacagcgaatttactgttgcgttaatctatttgatgttattgtgtgaacttacccactgaggataaatctgggtttgaacttttcacaagcgaatttactgttgcattaatctactttgatgttattgtgtgaacttatcactgaggataaatctagatatgcaccttcccatttgaacctatgcaagatattctcaagtattgtaccaagc

SEQ ID NO: 90423 - DNA, 422 bp, Triticum aestivum
  unsure (1)..(422): unsure at all n locations
  Clone ID: PAT_TA_90423
gaattcactagtgattagcgtggtcgcggccgaggtgagaactagccccgagnttttttttttttttttttttttttttttttttttttttttttttttttttttaaaaaaggncgncgattcggnattggttaaaaaagggnagggggcccccttttttttctagtaaatagttcaaaccattttatcnatatgagngttctatatcaaanaaattttanattanctatttcccgtttaaattcggtacnaaaacnaaaanagttgtanaaanagnaccnctttttgcctggacttcaagcaagtttanctttaaccgggttaanggggcncaanattcttggtttaanaaaaaacaaagttgntttaccaatgagtccncgaaaanctgcccgggngggcncccccaaacnaaattcccn

SEQ ID NO: 90424 - DNA, 434 bp, Triticum aestivum
  Clone ID: PAT_TA_90424
gaattcactagtgattagcgtggtcgcggccgaggtgaactatttactagaaaaaaaaagggggcaccctgtccttttttaaccaatgccgaatcgacgacctatgtataaaaaagagaaattttttggatttgaagaaaaaaaaaaaagaattctattaattttcattttccatttatttagttagtttttcttaatgaaattgaaattattaaagagggcaaataaaaataaagaaacaactttgctgaccatgatatatttttatctaggcggaagaagtcctcttaatatttatcctaagtcttatataggtttcggtatattgaaatataaacataaaaacgaagatagaggataggctcattacttaaaaaaaaaagatatgggaaataagctattaaaaaaaaaaaaaaaaaacccgacctgccccg

SEQ ID NO: 90425 - DNA, 226 bp, Triticum aestivum
  unsure (1)..(226): unsure at all n locations
  Clone ID: PAT_TA_90425
gaattcactactgattancgtgggnccccgccggaggtattcantgcataataatgggtggnaaggttgcggccatgaaattngtttggtgcatggaantaaatcccatggggttggngtttttaaaaaaacttgtttanggaaaanttnctcttattgggccaaataaacgcctattancctttcttaacaacgattncaaaattggggggtttttttttcatga

SEQ ID NO: 90426 - DNA, 324 bp, Triticum aestivum
  unsure (1)..(324): unsure at all n locations
  Clone ID: PAT_TA_90426
gaattcactagtgattagcgtggtcgcggccgaggtttttttttttttagaaattctgatgatcggtcttaactcttaaagcaagtatcacatctgtggacagattgagattgggttacaatattgtagatttgtttgacatgtatttgtcatgcttataggcagttccctgtcctattctttacacaaattattcccgtgtagccttatggataggccagttgctccaagaaatacagttttactgaatctaaaaaaaaaaaaanaaaaaaaaaaaaaaaaaaaaactcgagactagttctctctctcacctgcccgggnggn

SEQ ID NO: 90427 - DNA, 232 bp, Triticum aestivum
  unsure (1)..(232): unsure at all n locations
  Clone ID: PAT_TA_90427
gagaactagtctcgagnttttttttttttttttttttttttttttttttttttttttttttttttttttttttttttttttaaacccaaaatcggttcattaancaanatgcattcactttanaaaaancatgaantatgngganaaanaggcncttgttcaaattnttanatgaatgacgggngaaaatgcncaaaacgtntgnnggaaacctcggncgcgacnannctaa

SEQ ID NO: 90428 - DNA, 187 bp, Triticum aestivum; identical to SEQ ID NO: 90295
  Clone ID: PAT_TA_90428

SEQ ID NO: 90429 - DNA, 401 bp, Triticum aestivum
  unsure (1)..(401): unsure at all n locations
  Clone ID: PAT_TA_90429
gaattcactaatggattaaccgtggtcccggncgangtccgccgtcatcggngtcttctacganatnngggcccangaagccttcctccanaagctggagccatacctggagatgatagcggatntgnaggacaaggaggagaaaatggggatgatggacccnaggggcgcanagggaaaggncaacgtgtactaccgctacgtgggggtctntcaanaacccgccccttgctcgggaaggtgtcatcctgggaccatccctcaaaaaaggggtcccgcacccntnttccaaggggaaccaancctgggnggcttttccccnggaagggccggtcccaatntaccnaanattnggganaaanaaangccnaaggggcccccctcccngnanggggtntcca

SEQ ID NO: 90430 - DNA, 286 bp, Triticum aestivum
  unsure (1)..(286): unsure at all n locations
  Clone ID: PAT_TA_90430
tccggcgagggctgcagctgcggcgacaactgcaagtgcaacccctgcaactgttaagctgcatgcactcgtacgtacgtgtgttggtgtgagagtatacgtgaataacgancgtctgatctgatggagtcgagcaagggngcntgtgccgtgttcgntgtnggtttgcttgctncgctctcccaatgctctgncccatgngtgttccctngtngtgtaatgntgtgtngtgccatgtnttcccctgtaattgcttnaatctatccccacctagggcntgggagtt

SEQ ID NO: 90431 - DNA, 463 bp, Triticum aestivum
  unsure (1)..(463): unsure at all n locations
  Clone ID: PAT_TA_90431
gaattcactagtgattagcgtggtcgcggccgaggtcggatccatccatccgcccctcgctgccgctgcatctcgtctccaccaccccacttgcccccggacccaggaggatcgtcggagatgtcggacaccgatgagcaccacttcgagtccaaggccgantccggcgcctccaagacctaccctcagcaggccggcgccatccgcaagggtggacacatcgtcatcaaggcccgtccctgcaaggttgttgaggtctccacctccaangactggggaaggcatggtcacccaaagtgtcactttgttgccattgacatctntaatggaaagaancttgaggatattcncnccttcatcnccacaanttgtgnccgtcccccatgtttnaccgcccnatgatttatangttgattgancaatcaactggatgttggatatntcncccttctaaactggatag

SEQ ID NO: 90432 - DNA, 280 bp, Triticum aestivum
  unsure (1)..(280): unsure at all n locations
  Clone ID: PAT_TA_90432
gaaattcaactaagtgatttncaagcgggccgcccggggcaagtccgncgggcgggcnggggtnggcgtccctaacaaacgtngttncgccgttcgcaaggcccngggctcaantccntccgtnccgcgggcagctttcaaagtggctcaagtncaanctctccgagntnccgcttncggtngttctctgaanttnncgtgccctgaaccttcaacccttcaangtttcaaancgtggcccttcccntgaaactnaacctcntccncccctaatatacat

SEQ ID NO: 90433 - DNA, 240 bp, Triticum aestivum
  unsure (1)..(240): unsure at all n locations
  Clone ID: PAT_TA_90433
gaattcactatgtgattagcgtggtcgcggccgaggtcactagtgnantgagagctttgcacgaaaacttcatcagaaaccatgaagggcacnaagctcgcggagatcctgatcntccaggccgtcctgnncaagggacnccactcacacgtgnacgctgattttttccccaantgctgcaacaactgcaggtccttctcgggggtcnatgtntgtgatgacgctnacccnaagtgtccc

SEQ ID NO: 90434 - DNA, 231 bp, Triticum aestivum
  unsure (1)..(231): unsure at all n locations
  Clone ID: PAT_TA_90434
gaattcactagtgattagcgtggtcgcggccgaggtgaagtctcgagtttttttttttttttttttttttttttttttttttttttttttttttttganatgttgtgcaataaanactccanagggtagtanattgntgacaaatatacaacacgcaacgattttgcanctttgaaaaaatcaccnaatatccgaanaaagcttgcatcaaatttaccaaacaacaacctg

SEQ ID NO: 90435 - DNA, 244 bp, Triticum aestivum
  unsure (1)..(244): unsure at all n locations
  Clone ID: PAT_TA_90435
gaattcactagtgattagcgtggtcgcggccgaggtctagtctcgagtttttttttttttttttttttttttttttaaaaacaancatctacggnaanagtcattaaaaanccacacaaaatatgaccatcagnttccgaaggatttcaaanacantanaanaaccganataaaanagnatanggaaaanaacaccaccncacttaanccaataataatgcnattatttctgggcaaaagcaaa

SEQ ID NO: 90436 - DNA, 207 bp, Triticum aestivum
  unsure (1)..(207): unsure at all n locations
  Clone ID: PAT_TA_90436
ccgaggttcggcggcggcggcagcgaagaagaagaagagaagaanaagaaagatgatctacgacgtgaactcccccctgttccgctccttcctcanccagaagggnggcgcgtcctccgacaagaggaaantggaatgagnagaagccgaaagaccagangttcaaggccaacganaacaagnctgtaatgaacgnatgaancattc

SEQ ID NO: 90437 - DNA, 354 bp, Triticum aestivum
  unsure (1)..(354): unsure at all n locations
  Clone ID: PAT_TA_90437
gaattcactagtgattagcgtggtcgcggccgaggttttttcgtaagactgaggtataggtagggctaaaaaaagcaaaaaaaagagtcaaatcgcaccatctctataataagtaaatgcctttttttctcctgaggttgtcggaattattcgcaataaaatattggctacaattgaggaggtcttatcaatgaaatttccatttacacgggatctaggcataattcccaacccattctatatagaattgttttcattccttcacaaaataacatcaaatcgcacacctggcccggggcggccgctcgaaaatcgaattccccggcgcnncccatggnngccgggagcatccac

SEQ ID NO: 90438 - DNA, 466 bp, Triticum aestivum
  unsure (1)..(466): unsure at all n locations
  Clone ID: PAT_TA_90438
gaattcactagtgattancgtggncacggccgaggtcaacaacagagagcattctaccaccgcaccgcacgagtgaagtgagagctttgcacgaaaacttcatcaagaaaccatgaagggcaccaagctcncggcgatcctgatcctccaggccgtcctggtcatgggactcctctcacacgtgaacgccgattttttccccaagtgctgcaacaactgcaggtccttctcgggggtcgacgtctgcgaangacgcccancccaagtgtccccanggctgctcngcgtnnccgccctggtgtncacgancccccngaaaatgtgggcgctggcncnggatnttaaaatccacccgtttgaanggnacctgnggggtgggacccnggcnnagaaagtnattgatcgggttaatncccggcatnanaatgtttccccccnaaaaataaaantaaanaanctcnaaggc

SEQ ID NO: 90439 - DNA, 267 bp, Triticum aestivum
  unsure (1)..(267): unsure at all n locations
  Clone ID: PAT_TA_90439
agcgtggtcgcggccgaggtctcgagttttttttttttttttttttttttnttttttttngccaccaacgnacaatcattanttattcacggaggatattccggatatctgaacaacaagcatcaccaatttttttctnnaagtgagaaancncagcgangaanacacggaaatanttgaatacatatttggtggtncaaaaactacaggcagnnggcangatgtangctgcacanctcaattgnagcntttantttcgttttatgc

SEQ ID NO: 90440 - DNA, 491 bp, Triticum aestivum
  unsure (1)..(491): unsure at all n locations
  Clone ID: PAT_TA_90440
tcnancggcngcccgggcaggncntgggnggtcttcatnattcgnaaagcgctcgacccaaaggggcacatcagagaantcgtccctggcgagctcngcngagcacnctgtggatangcaatctatangcctgcaanngaaaaantganccgtcntcgtcttacgcaagtcgatggnggctcaactgtatattatgttcttgccgaantttcntgtgngggctaaagnggttccactatcgntgtgtaatggtgatntacgttcctttgngctgggananctaagagttttatttgttgggtgttancgccactgccgcttctgggttggtgtacttctgtanactgggaggtgtatgtttnacangcangatggggctaattcccgagntctttttgtgggaatcgnggncnagaaaaacaangccacctggggtttctgntggttccnccgntggcgcngggaaangtttaatgggaacaacanaaatt

SEQ ID NO: 90441 - DNA, 423 bp, Triticum aestivum
  unsure (1)..(423): unsure at all n locations
  Clone ID: PAT_TA_90441
cgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatgttccgcctaaaatgaaataaaagctcagacganatgagcaagcgtcatcgtgcctatgcgtgtgtgtgtggccaacaaatatgtntaccaatatgccgtgtcctcgtcgctgtgttttctctctcnaaaaaaaattggngttgcntgttgttcaaatatncggaatatcctncgtgaaataaattatnatttntncgttggtggcaa

SEQ ID NO: 90442 - DNA, 443 bp, Triticum aestivum
  unsure (1)..(443): unsure at all n locations
  Clone ID: PAT_TA_90442
agcgtggtcgcggccgaggttagtctcgagttttttttttttttttttgcattcacatacgagcatgctttctcgagacatgttggtacatgaacatggacatacacatattcttaggaacaaacaagaaagataaatggagaaggaaaacccaaagcaatgtcagagttgacaaaaccgcaatggcactttatatgtggcccgtggtgagtgagctgtttaggccttgccggactcctcgcagcccggtggcttgaaggcgatgaagctgacgcactgcacctggcgcatgttgtcgaatccgatgatgcggacgtacgcgtcagggtactccttcttgacctcttccacctccgttgatcacctgtgtggcgtccggtgcaaccgaacaaaaggaagcttccanattgtccaaataccgggcaatcgtaataccccaaggg

SEQ ID NO: 90443 - DNA, 393 bp, Triticum aestivum
  unsure (1)..(393): unsure at all n locations
  Clone ID: PAT_TA_90443
agcgtggtcgcggccgaggttggtcttcggtctctctgtttctttttgtatgatgatgatgattgatagatgtgtgtatagtactgctgcacattatattaattattatactggaatgagagagaggagatgctggccgatggatagttggatacttgttgtgcctgcatcttggtttgtaaaaaaaaaaaaaaaaaaaaactcnacctngccccggcnnnttcggtactcanaccccanaaaggaaaataatgggatgtgagaagtcttaacnttgatcgattggttatttccgtattgtaaattgtataaagctgcttaanacccaanctaanctgaccnncttgggtcnattnantaaccctttggccaanttcnggaactaaattccaa

SEQ ID NO: 90444 - DNA, 426 bp, Triticum aestivum
  unsure (1)..(426): unsure at all n locations
  Clone ID: PAT_TA_90444
ttcgagcggccgcccgggcaggtagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcnacgaagcccccgaaatgttggcgctggcgcggatattaaaaccaaccgtcnaagggaacctgcggggggccctggaaagaagttatgnttggntcaatggcaacaatgatatnttcccgccctnaaatngaattaaagcncaagaccn

SEQ ID NO: 90445 - DNA, 363 bp, Triticum aestivum
  unsure (1)..(363): unsure at all n locations
  Clone ID: PAT_TA_90445
ctctgggtagctagagagggagatgatctcggaggtcaganagcagttagatccaaaaagactcatagggtttgttctctttcgccgatggaganatggncnagtccagtccatgttcttgtgcggcgtcgccttcantcgataatcaagaagacaagggcatgcatgcatagatcaacgcngnnaatgagggannaatnactcaagcacgtgtnngtctagatcactcctgnctatnctgcttgatttgcngcttcnccctctccttggattgttttgtacttaaggcatanggaagnncagtgtgggnaggttncatgagaggctatctancaatnncatgcaacatcnntggtgggngca

SEQ ID NO: 90446 - DNA, 280 bp, Triticum aestivum
  unsure (1)..(280): unsure at all n locations
  Clone ID: PAT_TA_90446
caagcggccncccgggcaggttttttttttttttgttttctcaaaattacatgagaactattattgtcttgaattatgtanatgagancanatccttgtccagctacanaagaaccaccancataacatgantcanttacaaaagctgcttcantantctctttctcaaaaagagctatatcaangccccaaacananactcttgnntccccagccagncnacttggcngcngccttgccgttcccanaagnaaagacagcatcagatgggttcagctcg

SEQ ID NO: 90447 - DNA, 395 bp, Triticum aestivum
  unsure (1)..(395): unsure at all n locations
  Clone ID: PAT_TA_90447
agcgtggtcgcggccgaggtgagagagagagaactagtctcgagttttttttttttttttttttttttttttttttttttttttttttttttttttnggcaancgatagtatatattaaagncgnanagcgttganacttcctttgcaggaantcnattaaaatccntgncnggacantgaaaantcagagaaagaaaaaagaagaacacggaaaagaaaggaaaaaaaaaaagntgttgggagnncnaaacttcgatttctcattanaaaaaatctntcatccntgacgatnactgacctgcccgggngggggntcnaccgcccgggcaggtcatcccaccccnaancaataaaagacgttcttaataaacggccgggtnaanaaaanggggtt

SEQ ID NO: 90448 - DNA, 409 bp, Triticum aestivum
  unsure (1)..(409): unsure at all n locations
  Clone ID: PAT_TA_90448
tcgagcggccgcccgggcaggtccaatccagccccctccgatcgaagcgaagtcaaggctctttcgtcctcctcctcaagatgcanatctttgtgaagaccctcaccggcaagaccatcaccctcgaggttgagtcctcggacaccatcgacaacgtcaaggctaagatccaggacaaggagggcatccctccggatcagcaagcgtctcatcttcgctggnaagcagctcgaggatggccgcancctggctgactacancatccannaggnatccacactccaccttggntgctcanactccgtggtggcatgcaagatnttcgnccaanacccctgacgggtaagnccatcacccctgggagggntngagttccnctgaacaccattcnacaaccgtnaanggccaa

SEQ ID NO: 90449 - DNA, 490 bp, Triticum aestivum
  unsure (1)..(490): unsure at all n locations
  Clone ID: PAT_TA_90449
agcgtggtcgcggccgaggtggtccaccaaccttgactggtacaagggccccacccttcttgaggccctggaccagatcaatgagcccaagaggccctccgacaagcccctgcgtcttccccttcaggacgtgtacaagattggtggcattggaactgtgccagtggggcgtgttgagactggagtcatcaagccaggcatggttgtcacctttggtcctactggcctgaccactgaggtgaagtctgttgagatgcaacatgagtctctcctggagggcgcttcctgggtgacaacgtcggcttcaacgtcaaaaacgtgggccgtcaaaggtctcaaagcgtgggntatgtcgcttccaactccaaaggacgaaccctgcccaaaggganggtggcnaacttnaancgcccaangtcatcaatcatgaaaccanccctgggccaagattaaacaaatgggctacccccccgggtgctgggnctgccan

SEQ ID NO: 90450 - DNA, 296 bp, Triticum aestivum
  unsure (1)..(296): unsure at all n locations
  Clone ID: PAT_TA_90450
agcgtggtcgcggccgaggtctcgagtttttttttttttttttttttttttttttttttttttttttttttttttttttttttttttttttttttttanaangaaaaanggggttcnaaaatcaaaaaaatatganggtntcccaggtaggctanaancantaaaaaaaaaaatatntttcaaaanaagcnaaatcttaaaannggaatcccggngtcacttgctancatgcaaaaanaacgaaacatcanaanccctaggtacccnaaacccttcccccgtcggaanaaacgggt

SEQ ID NO: 90451 - DNA, 376 bp, Triticum aestivum
  Clone ID: PAT_TA_90451
agcgtggtcgcggccgaggtggcttttccatggccattccaagatatattgccatgcaacttccaccgcttccttttgatgacttgagcattcattgtcattgctttgcatgatcatatagctgacatagtagttgtggctcagcaaccatgcatcatttttatgcatgttacgctagatcatctgccagaggcattcatatagagtcatattccgttataggtatcgggttgtaatttttgtttctgttgagttataagtaaatagaagtgtgatgatcatcatttttagagcagtgccccggtaaggaaaggatgatggagactattattcccccacaaggtcgggatgaagactccggacatttgggagaaat

SEQ ID NO: 90452 - DNA, 467 bp, Triticum aestivum
  unsure (1)..(467): unsure at all n locations
  Clone ID: PAT_TA_90452
agcgtggtcgcggccgaggtgaactagtctcgagttttttttttttttttttttaacttttttagtttttatttcatttttggaaattttttgttttatttcttttcttttgtaagggtaataccgatgtcactaatccattgtttttagaaaacactttgtgaaaatctcactataatatactcagttatgctttagtttttttctgctttctgtttctatgtgtttttatttttcctttttttgctttattggttattttttgtttttgtgggtttttggctgagtgcaattttggtgcaaaattgtgcgcaatttgtttttaattttctttcttcttaaaggaaatacattanttcatttacactatggtntaaattantagtaaaatggtgacaaacgcaccaataanattaantccttggccaattcaagaaaagtgcaatttcaaatgcaaaaanttgtgg

SEQ ID NO: 90453 - DNA, 359 bp, Triticum aestivum
  unsure (1)..(359): unsure at all n locations
  Clone ID: PAT_TA_90453
tcgagcggccgcccgggcaggtggaaggggatatctattggtcctcctttatggtaaactcgatctagatttcttctgttgcctcagtttcttttggcactccctgtgctttcttgtggaggagtgtggcctgttttcccaagaatttgagagaaaggaggggacccagtattttctaagaggccaatggcgcaaccacgcattcctgcatttggggactgggagaacagcgaggacgtcccttacacccagaagttcgagggtgcacggaagaacaaaaaaacaggcntttactccaatccaaacganccaggacatcancaaccccgaccccccncgcangtcaccgctgaaaccca

SEQ ID NO: 90454 - DNA, 197 bp, Triticum aestivum
  unsure (1)..(197): unsure at all n locations
  Clone ID: PAT_TA_90454
aggcgtggtcgcggccgaggtttttttttttttttttttttttttttttttttttttttttttttgatcaanaaggtggtggttcatcanatgagacanctcaaggtacactgatacantannaataaccananaatggtttcttttanaaacaaancttaaacagggggaanaatacatctcacctgcccgggcgg

SEQ ID NO: 90455 - DNA, 451 bp, Triticum aestivum
  unsure (1)..(451): unsure at all n locations
  Clone ID: PAT_TA_90455
cggcgcctccacttctctgctccctcctctcctcgcgcgcagggcccggcgaaagggaagcaagatgtacaccgccaggaagaagatccagaaggacaagggcgtcgagccctccgagttcgaggacaccgtcgcgcaggctttctttgacctggagaacggcaaccaggagctcaagagcgacctcaaggacctgtacatcaacactgcaatccagatggatgttgttgggaacaggaaggccgtggtgatccatgtgccataccgtctgcgcaagcccttcaggaagatccatgtcaggctcgtcagggagctcgagaagaagtttagcggcaaggatgttgtctttgttgcaacaagaangatcgtgagggcaaccaagaagggttctgctgttcaacgccctcgcaacangaccctgacagctgttcaatgatggtatcntgggngn

SEQ ID NO: 90456 - DNA, 397 bp, Triticum aestivum
  unsure (1)..(397): unsure at all n locations
  Clone ID: PAT_TA_90456
cgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatgttccgcctaaaatgaaataaaagctcagacgagatgagcagcgtcatcgtgcctatgcgtgtgtgtgtggccaacanatatgtataccaagtatgccgtgtcctcgtcgctgtgttttctctctcnagaaaaaattggngtngcctgttgttcaaatatccgggaatancctccggtgaat

SEQ ID NO: 90457 - DNA, 468 bp, Triticum aestivum
  unsure (1)..(468): unsure at all n locations
  Clone ID: PAT_TA_90457
tcgancggccgcccgggcaggtgananaggagaactagtctcgagtttttttttttttttttttttttnacttnaagtttaccgatttcctttttaatttctctttttctttgttttttccttttttgtcattttcatgttttttattttttcnatttttttatttcttcatttttttcacatttttcaaaactaatccaaaattaaaaaatgttcaatttttgaaaactgtnccnganttcaaattttgggcanaaattcagaaaatgttcattttttaaaaattgttcatgtatcaaaagatgttcacgttttaaaacaattgtttgcaaatttaaaaaaatgtgcatgttttcatttttcaggactcngaaattgttcangttcaaatttttggtcaacaaattaccntcggccgcggaccaagccctaaatcgaaattcccgcgggccngccatgggcgggccg

SEQ ID NO: 90458 - DNA, 181 bp, Triticum aestivum
  unsure (1)..(181): unsure at all n locations
  Clone ID: PAT_TA_90458
tcgagcggccgcccgggcaggtcggcggggaagantgggnanaagcgtccgcagcancancgntttgccttcgtnaccaanagcgaagttgatnacctcgangatgggtacanatggagnaattatggncagaaagncgttaanaacagcnctttccnaagganctactatcggtgtacca

SEQ ID NO: 90459 - DNA, 464 bp, Triticum aestivum
  unsure (1)..(464): unsure at all n locations
  Clone ID: PAT_TA_90459
ccgcccgggcaggtcccagtccatcccccgtcgctctcacgctcttcgtgctcgccgcctcccttcgcgtgctgcctcatggcttccatcgccggatctgccgtgtccttcgccaagcccgtcaaggcaatcaacacgaactcgctctctttctctggtgcaaggaggggcaatgcatttcttcgtctgcagccagtgccgatgagatttgctgtttgctgctcagcaaagcaggatacagtggagaaggtttgtgaaattgttaagaagcagcttgctgttcctgaaggcactgaaagtttgcggtnacaacaanttctctnaccttggagctgattcaactgggacacggtcngagaatgttatgggccctcnaanggaggaagtttcaagattaagcgttggaggganacganttgcgcaaaggaaatttgccaacanttggnaagaatnctggcnaaccn

SEQ ID NO: 90460 - DNA, 275 bp, Triticum aestivum
  unsure (1)..(275): unsure at all n locations
  Clone ID: PAT_TA_90460
ggcaggtctcgagttttttttttttttttataaatatctttatttaggtaanaaaataacttcgttacctagttattttattaactttttgaatttaaccaactaaacccattcttaatttttaattatttcaanganataaatttttgaaaanttaacgaanttcagtattttttctcantcgttttatcttattctttcanaaagangataagaactgggtttggcgaatccggnaacaattttataggaaaaattgncgtaatnaaattgaa

SEQ ID NO: 90461 - DNA, 243 bp, Triticum aestivum
  unsure (1)..(243): unsure at all n locations
  Clone ID: PAT_TA_90461
agcgtggtcgcggccgaggtgttgcttcttttggccaaccatcctttgggcccctggtatgaatncgaaccaataatgttnaatggaagatngaggtatccttggtcnattngangatggcttncaacccnctngtngtaaggtagggggaattanttgctccantaatttgggattcngatnaattctttattncaatttgacttccnggccggtaaaaaaaaaaaaaaaacctggcccggg

SEQ ID NO: 90462 - DNA, 255 bp, Triticum aestivum
  unsure (1)..(255): unsure at all n locations
  Clone ID: PAT_TA_90462
tcgagcggccgcccaggcaggtgaactagtctcgagtttttttttttttttttttttttttttttttttttttttttttttttttttttttttttttaagncaganaanaaattaaggagctgatancttatcttttaaaagatgaanagttacaggnganaggcacggntaaagaaagagacacatttatttganaaaacaanatgtgatcaattaggagnggggacttganacctcggccgcgaccacgctaa

SEQ ID NO: 90463 - DNA, 554 bp, Triticum aestivum
  unsure (1)..(554): unsure at all n locations
  Clone ID: PAT_TA_90463
tcgagcggccgcccgggcaggtcttgaaatctttttgggttcatcagatttggaggatgtcttgcaactgtggatccggttgcagctgcggctcagactgcaagtgcgggaaggtgtaccctgatctgacggagcagggcagtgccgccgcccaggtcgccgccgtggtcgtcctcggcgtggcgcctgagaacaaggcaggtcagttcgaggtggccgccggccagtccggcgagggctgcagctgcggcgacaactgcaagtgcaacccctgcaactgttaagctgcatgcactcgtaccgtcgtacgtacgtgtgatggtgtgagagtatacgtgaataacgagcgtctgatctgatggaagtcgaacaagggtgcgtgtgcatgtgcgtgtggtttacttcgctcgctcctccgcctaatgctncgcccctgggggtccctggggtgtaangtttgtgcaagtgtccctgtnattgcntcaaccaaccccactatgggatggngtgatgaatatttaanaatgaatggatttactaaattactaaaaaaa

SEQ ID NO: 90464 - DNA, 251 bp, Triticum aestivum
  unsure (1)..(251): unsure at all n locations
  Clone ID: PAT_TA_90464
tcgagcggncgcccgggcaggtctcgagttttttttttttttttttattcaagcnacgaatatgcgtacatagncacanagagtacagantcannactcactccacgcngggtgatgacaacataattnacggtntactatgggaaaataggaaaagtacntnattttcaagantcactcgcttacttgcngaaatactcancgaccgcttcagnccatcgatgtaatanctgtcccgtcgaanctganga

SEQ ID NO: 90465 - DNA, 428 bp, Triticum aestivum
  unsure (1)..(428): unsure at all n locations
  Clone ID: PAT_TA_90465
agcgtggtcgcggccgaggtccgcaccgcacgagtgaagtgagagctttgcacgaaaagttcatcagcgaccatgaagggcaccaagctcgcggcgatcctcatcctccaaggccgtcctgggtcatgggagtcctctcacacgtgaacgccgactatttccccaagtgctgcaacaactgcaggtccttctccggggtcgacgtctgcgaagacgcccaacccaagtgcccaagggctgctcggcgtnccgcgtggtgtccaacaaccccgaaatgttggcgctgccgganattaaaatcaacgtncacnggaactggcgnggggcccngaaaaaattatgntnggntcaatgccaacattatnttttcgcctaaaatgaaattaaaagctaaaacgnagantggcaaacgtcctnccngcctaatg

SEQ ID NO: 90466 - DNA, 431 bp, Triticum aestivum
  unsure (1)..(431): unsure at all n locations
  Clone ID: PAT_TA_90466
aagcgtggtcgcggccgaggtctcctccacacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtccaagggctgctccggcgtgccgcgtgggtgtcgacgaacccccgaaatgtggcgctgcgcggatatgaaatccaaccgtcgacggnncctgcggnggaccctgcaagaatactgatcggntcatgccggatatgatatgttccgcctaaaattaataaaaanctccggccgaaaataacaangtcatccggcctantgggg

SEQ ID NO: 90467 - DNA, 477 bp, Triticum aestivum
  unsure (1)..(477): unsure at all n locations
  Clone ID: PAT_TA_90467
agcgtggtcgcggccgaggtcaaggccgagcgtgagaggggtatcaccatcgatattgccctctggaagttcgagaccaccaagtactactgcaccgtcattgatgcccctggtcaccgtgacttcatcaagaacatgatcaccggtacctcccaggctgactgtgctgttctcatcatcgactccaccactggtggttttgaggctggtatctccaaggatggccaagacacgtgaagcacgctctccttgctttcactcttggagtgaagcaagatgatctgctgctgcaacaaagatggacgccaacaactcccaaagttactcaaaagggcgcgtttacgaaaaaattgngaangganggtctcttcctaacctgnaagaaaggtccgnntaaaaacccttgaaaanggttcccnttcgtcccccaatcctccggggtttcgnggggtgganaaaaattattgagnanggccn

SEQ ID NO: 90468 - DNA, 186 bp, Triticum aestivum
  unsure (1)..(186): unsure at all n locations
  Clone ID: PAT_TA_90468
agcgtggtcgcggccgaggtgtcgcgagttttttttttttttttttttttaagttgcanacgtttctgcanaaactantaaaactttttttttaataaaggngattcctcnccgttcancgacgtaaatgtaccantacacacgtgggaggtctggncanccanttatttggtcanaaagtacttc

SEQ ID NO: 90469 - DNA, 205 bp, Triticum aestivum
  unsure (1)..(205): unsure at all n locations
  Clone ID: PAT_TA_90469
agcgtggtcgcggccgaggtcggcagcatcctcctccgtcgccaccacatccctcttccccatctctcctcatgcatgcccgagcccctccactgccgccgccggcaccttcgctgttccgccgttgaggggagcagcagacaggacgcgaatttgccagcgtctcaaagagaagagtctcnatcgagnagccncggngccaccc

SEQ ID NO: 90470 - DNA, 244 bp, Triticum aestivum
  unsure (1)..(244): unsure at all n locations
  Clone ID: PAT_TA_90470
aagggcgtggtcgcggccgaggtttttttttttttttttttttttttttttttttttttttttttttttttttttttttttttttttttttaaccggaaaaatgcaaattntttnttaaagcccanggggganaaaaaatgnttgttacggnattccttttantaaaccccccccagctatttanantaaaatagggacgggnaaagaaacccttngatnggggngctgccaatncnagggaac

SEQ ID NO: 90471 - DNA, 465 bp, Triticum aestivum
  unsure (1)..(465): unsure at all n locations
  Clone ID: PAT_TA_90471
tcgagcggccgcccgggcaggtcacctctctcaaccaagccaaggccaagagctgagtgaagcacccgcggccatggagggcaaggaggaggacgtgcggctgggcgcgaaccgctactcggagcaccagcccatcggcacggcggcgcagggcggcggcgcggacgaagaaggactacaaggagccgcccccggcccccttcttcgagggcggggaactcanctcctggtccttctaccgggccggcatcgccgagttcctggncancttcctcttcctctaaatctcggtgctcancgtgatgggcgtggtgggcaacccctcggggttcaagtgcggganggtcgggacccaaggnatcncctggagctttcggggnatggtcttcngggctccnctaatggaaccgccgggatttccggggggcanaattaaaccccgcggnnaacnttggggttgttctt

SEQ ID NO: 90472 - DNA, 253 bp, Triticum aestivum
  Clone ID: PAT_TA_90472
tcgagcggccgcccgggcaggttactgatcgactcatgccagcatgatatgttccgcctaaaatgaaataaaagctcagacgagatgagcagcgtcatcgtgcctatgcgtgtgtgtggccaacaaatatgtataccagtatgccgtgtcttcgtcgctgtgttttctctctcgagaaaaagttggtgttgcttgttgttcagatatccggaatatcctccgtgaataagtaatgattgtgcgttggtggcaa

SEQ ID NO: 90473 - DNA, 236 bp, Triticum aestivum
  Clone ID: PAT_TA_90473
tcgagcggccgcccggcaggtctagtctcgagttttttttttttttggaaaaggttgatgtatatatataagcttctgaaccatcaggacacttgcacatgccaaaaattacagtggggtagacaccctttgggacagtgaacttaaactaaaaatctgttttttttttctttcttttctttacctttgacagtgaaatccaactaaatatctgacctcggccgcgaccacgctaa

SEQ ID NO: 90474 - DNA, 492 bp, Triticum aestivum
  unsure (1)..(492): unsure at all n locations
  Clone ID: PAT_TA_90474
agcgtggtcgcggccgaggtccgccgtcatcggcgtcttctacgagatcggcgcccacgacgccttcctccacaagctggagccatacctggagatgatagcggatcggaaggacagggaggagaaaatggggatgatggacccgaggggcgcaaggggaaaggcaagcgtgtactaccgctacgtgggctctctcaacaacccgcccttgctcggaaaggtgtcatcctgggancaatccgtcaaagggggtcccgcaaccgttgtccgagggaaccaagcctgggagnttcctccggggaaggccgtncaatgacgaacaatgggaagaaagaacgcgaaggcccgtcaagagggtgaacaagcaanagatntcaagcatgttccggccttttcaacaaaatanacantgattaataactaaggtcnantcncccgcctaaattacntgctggttacaagctnataaagtatgttcnatggttnaacaat

SEQ ID NO: 90475 - DNA, 498 bp, Triticum aestivum
  unsure (1)..(498): unsure at all n locations
  Clone ID: PAT_TA_90475
agcgtggtcgcggccgaggtaaatccacacccaatctcgtctccgatcgactcgagagctcgtcgaatcctcctcccccatcgtctcaagatgcagatcttcgtgaagaccctcactggcaagaccatcactctggaggttgagagctctgacaccattgacaatgttaaggctaagatccaaggacaaggagggcattcccccggaccaagcagcgcctgatctttgctgggcaagcaagctggaggacggccgcaccctggccggactacaacatncaaaaagagtccaaccttcancttggtgctccgccctncggtgggtgggatgcaantttttggtgaagaccctcaaccnggaaagaccaatcaactctgggagggtngagaagctcctgacnacaatttgacaaatggttaagggnctaaaattcaanggacaaaggggngggnaattccccccgggaacaaacaaacngcntgattttttggtgggaaa

SEQ ID NO: 90476 - DNA, 245 bp, Triticum aestivum
  unsure (1)..(245): unsure at all n locations
  Clone ID: PAT_TA_90476
agcgtggtcgcggccgaggttttttttttttttttttttttagaataacagggcagaatctcttgattcaaccaaaacacaaccacaccaatttcacgattaccattacaaagcanatcccacaattatcagaaanttttcaaagacactcaacatctgacaagttactggacaacaaacattgggngaagtccgcctggacaaccaataagataaagagcaaaaatacctggaanaacaagaat

SEQ ID NO: 90477 - DNA, 478 bp, Triticum aestivum
  unsure (1)..(478): unsure at all n locations
  Clone ID: PAT_TA_90477
agcgtggtcgcggccgaggtaaatccacacccaatctcgtctccgatcgactcgagagctcgtcgaatcctcctcccccatcgtctcaagatgcagatcttcgtgaagaccctcactggcaagaccatcactctggaggttgagagctctgacaccattgacaatgttaaggctaagatccaggacaaggagggcattcccccggaccagcagcgcctgatctttgctggcaagcaactggaggacggccgcaccctggccgactacaacatccagaaagagtccaaccttcacctggtgctccgcctccgtgggtgggatgcaanatttttgtgaagaacctcaacgggaaagacaacactctggggggttgagaagctnctgacaccaattgacnatgttaaggntaaagattcaangacnaaggagggggaatcccccgggaccnancaagcggcctggattcttggctggnaac

SEQ ID NO: 90478 - DNA, 471 bp, Triticum aestivum
  unsure (1)..(471): unsure at all n locations
  Clone ID: PAT_TA_90478
agcgtggtcgcggccgaggtggtccaccaaccttgactggtacaagggccccacccttcttgaggccctggaccagatcaatgagcccaagaggccctccgacaagcccctgcgtcttccccttcaggacgtgtacaagattggtggcattggaactgtgccagtggggcgtgttgagactggagtcatcaagccaggcatggttgtcacctttggtcctactggcctgaccactgaggtgaagtctgttgagatgcaccatgagtctctcctggaggcgcttcctggtgacaacgtcggcttcaacgtcaagaacgtggccgtcaaggatttcaaagcgtgggtatgtcccttccaactccaagggacgaaccttccaagggagggttgccaactttaacggccaagtcaancatcaatgaaccaaccctgggcaaaattangaaatngntnacccccccggnngctggg

SEQ ID NO: 90479 - DNA, 406 bp, Triticum aestivum
  unsure (1)..(406): unsure at all n locations
  Clone ID: PAT_TA_90479
ccgcccgggcaggtgagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatattaaatccaacgttcacgggcacctggcgtggggccctggcaaagaaattactgnttcggntnaatgccaannaatgatatttttccgcctaaaattgaataaaagc

SEQ ID NO: 90480 - DNA, 227 bp, Triticum aestivum
  unsure (1)..(227): unsure at all n locations
  Clone ID: PAT_TA_90480
gagcggccgcccgggcaggtgagtttttttttttttttttttttttttttttttttttttttttttttttttttttttttttttttttngatcaaaaaancctttttttananggaaaggaaaaaagcttatttgctacngcattaattgttanatccaactgaanacggnnggtcttgantccactgngaaaatttgaanagntaacctccccgngacnacgctaa

SEQ ID NO: 90481 - DNA, 465 bp, Triticum aestivum
  unsure (1)..(465): unsure at all n locations
  Clone ID: PAT_TA_90481
tcgagcggccgcccgggcaggtctagtctcgagttttttttttttttttgcagttcaacctctgtttattcatcattaccagtaccacaaacaaaacacaaagttggaactacttgctgattgaattagatatagtattacaaaatagtcatagttttgatggggacactccataaatattcgttctgcaactaatgttccttatcgatgcaattgaaccttcttttctaactagtgttcatacctctgcaactgatgatagacaaaaataactaaattgttttgcatcagggaataaaaaagggggtaaacaatgaaaaatatgttctatggcaaaccacatgtcaacatttgtgcaactggttggnccttaannccgcaactggttaatttggcaaagnggtgcaaccaaccnacttaaactttggccaatgcaaggcgtaaggatgactaatcaatgntcag

SEQ ID NO: 90482 - DNA, 423 bp, Triticum aestivum
  unsure (1)..(423): unsure at all n locations
  Clone ID: PAT_TA_90482
tcgagcggccgcccgggcaggtgaactagtcncgagtttttttttttttttttttttttttttttttttttanaaanccnaattattcttgattatggattgaataagggatgttatggnttgaatgtgtaaaaaaagcannatattgataaaaaggntgtattccaaantcaaaagagcgattggnccncaaaaataaaaaacttgttctgttctttttttttgaattagaacaaacataaactaattgggtanaaaaggagcanaaaaagatctgtggattatactccctttctttccaaggtttgtnaaaaaacctcgggcgcgaccacnctaatcgaattncccgcggccnccaagggggggcgggannaatnctacgtcgggnccaanttccccnaaaagggaggcnntattaaaaat

SEQ ID NO: 90483 - DNA, 162 bp, Triticum aestivum
  unsure (1)..(162): unsure at all n locations
  Clone ID: PAT_TA_90483
tcgagcggccgcccggggaggtttttttttttttntttttntgaatccaaanatcacgcattanatattaatagcaattttatctgacganggtttcacnagcacatgngaacattactacngaccacagtagtaaacanttcgaanactgntcgacncaaa

SEQ ID NO: 90484 - DNA, 502 bp, Triticum aestivum
  unsure (1)..(502): unsure at all n locations
  Clone ID: PAT_TA_90484
agcgtggtcgcggccgaggtctcgctcgccgcctccgatccaccggcccaccaccgcgccggcggcatggcgaatcagctcaccgacgaccagatcgccgagttcaaggaggccttcagcctcttcgacaaggacggagatggttgcatcaccaccaaggagctgggaacagtcatgcgttcgctggggcagaacccaacggaggttgagctccaaggacatgatcaatgaagtcgacctgatggcaacgggcacaattgacttcccaaaagttcccaaacctggatgggcccgcaaagatgaaaggacaactggactcaagaagggaagggagctcaaagggagggccnttcaangggtggttttgacaaagggaaccaaaaaacgggntttcaatctctgctggcttgaagctcccgccaacgttaatgaacgaaaacctccggggaagaaagctnaaccgaccnaaggaaggtgggnccaanatnattccgttgaaagc

SEQ ID NO: 90485 - DNA, 464 bp, Triticum aestivum
  unsure (1)..(464): unsure at all n locations
  Clone ID: PAT_TA_90485
agcgtggtcgcggccgaggtacgaaccctaaccctaaccaagcaggcggcaagagagatgttggtccagaagatgccgatggccgccggctacgggggctttcccctcatcccatcgttccaggcggacaaggagcaggcggaggcggtgttggccgtcagggccatcaaggccaaggcggaggaggcgtcgttgatcctcaaggcggggtgcggctccaagaggaaggcggaggaggacggcggcgaggtcaccgtcaaggccaaggccaaaggccgcggaggaagaggcggcatctttcaccaccntcaagggcaaggcanaggangactcggaccnaagacncttnaatgggacgatgtttattttatggccaagaatcacggnaanaccaaccccccccatttctaaaaaantnaaggtnttntttcccaacattcaagttcnggggattaacaaccctc

SEQ ID NO: 90486 - DNA, 490 bp, Triticum aestivum
  unsure (1)..(490): unsure at all n locations
  Clone ID: PAT_TA_90486
agcgtggtcgcggccgaggtcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccacccgtcgacggcacctgcggtgggaccctgcaagaagtactgatcggttcaagccggcatgatatgttccgcctaaaataaaaataaaaagctcaaggcgaaaatgaagcaagcgtcatcgtgcctaatgccgtgtgtggtgttgggcaaacaaatggcntaataccaaagtaatgttcgtnctccttccgnccgctgtgtttttctctccccaaanaaaaaaattnggnggtttgccttgtttgttcaaacctaatccgggnaatatnctnc

SEQ ID NO: 90487 - DNA, 203 bp, Triticum aestivum
  unsure (1)..(203): unsure at all n locations
  Clone ID: PAT_TA_90487
tctacgcggncgcccgggcaggtcnantctccagttttttttttttttttgcagntcaaccccngnttnttcancantaccantaccacaaacaaaacacaaagttggggacnacttgcngnttgtattacatatantattacaaaatantcanaattttggtggggagaccccnaaaatattcnttctgcaaataangttcc

SEQ ID NO: 90488 - DNA, 264 bp, Triticum aestivum
  unsure (1)..(264): unsure at all n locations
  Clone ID: PAT_TA_90488
aagggcgtggtcgcggccgaggtttttttttttttttttttttttttttttttttttttttttttttttttttttttttttttttttttttaaccngaaaaangcanattntttattatagcccangnggganaaaaaatgcttgttacggaattcnttttnttaaaccccccccncctngttanantaaataggaacgngcangaacccttgcangggngctgccatgcaaggaacgagggactactggnctatntgtantgc

SEQ ID NO: 90489 - DNA, 467 bp, Triticum aestivum
  unsure (1)..(467): unsure at all n locations
  Clone ID: PAT_TA_90489
agcgtggtcgcggccgaggtttttttttttttgaccaaaacataaccacaccaatttcacgattaccattacaaagcaaatcccacaattatcagaaagttttcaagacactcaacatctgatagttaccgacacaacattggagagtcgactgacaaccatagagcagagcaaaaatactgacgaccgcatagattttaagcatacagtgcgattagcacttgacctctttcagcccatgtgcaaagtacaggaaagttggatcagcaagctccctccttgtagtaaggcgaacaacacgccgccatcatcaatgcatgctctccgccaaacaaagaactgaanggtcctttgagccttgctaaagaaagatactttgtgggagactcaacattcttccttgaaaacatctaaggtcatccccccttcaagccttgggaanaganggttcntgganttancgcttc

SEQ ID NO: 90490 - DNA, 236 bp, Triticum aestivum
  unsure (1)..(236): unsure at all n locations
  Clone ID: PAT_TA_90490
agcgtggtcgcggccgaggttgtaaactgagtggcgaattgttcatcatctaagtcatgagtttgttgcgttacgttttcaaattacaaaatttctccggaaaaaaaaaaaaaaaaaaaaaaaaaaaaaaaaaaaaaaaaaaaaaaaaaaaaaaaaaaaaaccncgggacctgccnggggggccgcnaancaaattcccncggccgcnatgggggcnggnanaatgcaacntcggn

SEQ ID NO: 90491 - DNA, 177 bp, Triticum aestivum
  unsure (1)..(177): unsure at all n locations
  Clone ID: PAT_TA_90491
ncgaggttcttaattcantancanatttcaaactanttcctgtattgcanaanattactaatattgctgtattagcatgttttcatggcttgttgatnattgatcatanttgncgtcantaaaaaaaaagtgctaaatctcanattanaaatattangaaanaatttgcctgantcc

SEQ ID NO: 90492 - DNA, 443 bp, Triticum aestivum
  unsure (1)..(443): unsure at all n locations
  Clone ID: PAT_TA_90492
agcgtggtcgcggccgaggtgagaactagtctcgagttttttcttgtcgccccacatgcaaggaggcacggtagacttttccttgcgacgatgatgggctaatcgattgcttggtcacatattttccattgtttggacttttggggacttgttattttttaagtgtttgtggttatccgaatcaggtggacgtcgcccacgaactcgtccggctgaaagtgatagctgcgtacgcatctgcaagcaatgctctgccgtgacctctgattttttgtgtaagtgtttggacgtatctgtctttgttctgcaactagtctaaatgacacctctggtttttctacaccgcgtttttgttcctgttctagatgcttctggatgccaatatctcaaggtaacatncgtcgtgttaatantgttaggagaaaaatattgtacaaggggga

SEQ ID NO: 90493 - DNA, 450 bp, Triticum aestivum
  Clone ID: PAT_TA_90493
agcgtggtcgcggccgaggtttctgatgtgccaggcatcgtaaaactcctgtgcctagaatctgcctggaaaactcccgtgcctggaaaccgcctggtattaggtaaaaccacaaaactccgacagcgatggcaatgcgagcacaaacgagtatcaaggatgaagcgtttgggatatttgagatatcggaaacggttatatagggacaactatatgcatcaaggctccctattcccgacggtttctgggtcgtgtgggaaggaccaccctatcgccgtaactcactaggcgacggttccaaatgcagtcgtggaaaggggttaaaaaccatttgtatagcaccgacgggtaccagtgattattagaacattgtcccatgtgaagaaaggatgatggagactattgattcccgcacaaagtcgggatggggctccggacgaaaaataaaaa

SEQ ID NO: 90494 - DNA, 172 bp, Triticum aestivum
  Clone ID: PAT_TA_90494
agcgtggtcgcggccgaggttttttttttgccatcaacttgttgctctcagcaatcctttattgattttccaagcttacttatgtttaacgagatactacagcagtgcacaagggtttctaggtaatcaattccaatctcagcccagaacaactcctaacctgcccgggcgg

SEQ ID NO: 90495 - DNA, 469 bp, Triticum aestivum
  unsure (1)..(469): unsure at all n locations
  Clone ID: PAT_TA_90495
ccgaggtctagtctcgagttttttttttttttgattcaaccaaaacacaaccacaccaatttcacgattaccattacaaagcaaatcccacaattatcagaaagttttcaagacactcaacatctgacagttactgacaccaacattgggagagtcngactgacaaccatagataagagcaaaaatactgaagacagcatanattttaagcatacaagtgcgattagcacttgacctctttcagccccatgtgcaaaagtacaaggaaagttggggtcaggaagctcccctcccttgtagtnaggngaaacaccaacgcccgccatcatcaatgcatggctcccggccaancaaaagnaactggaaggggtcctttgagcttgcctaaagaaagatacnttggtgggcggnctcaacattcctccttggaangcatcctaggncnaccccctnannggctttgggaagg

SEQ ID NO: 90496 - DNA, 185 bp, Triticum aestivum
  Clone ID: PAT_TA_90496
agcgtggtcgcggccgaggtttttttttttagtgtgttttttcactctttatatacgatgattacttgtgctatctcttttttatttatgatactgcaacattcaattctccctggctgaaataggttacatatacacccaaaccgacaacaacaggtggacctccttgctaccatagcaaaccg

SEQ ID NO: 90497 - DNA, 467 bp, Triticum aestivum
  unsure (1)..(467): unsure at all n locations
  Clone ID: PAT_TA_90497
tcgagcggccgcccgggcaggtcaatgatgtcatcttctccattgtttgccaatgcaccccctgagaagaaaggtgtcaagaactttgcgattgacttcctcatgggaggagtgtcagctgcagtttccaagactgctgcagctcctattgagcgtgttaagctgcttatccagaaccaggatgagatgatcaaggctggcaggctctctgagccatacaagggtattggtgactgctttgggcgcaccatcaaggatgaaggctttggctcactgtggagaggaaacactgctaacgtcatccgttacttcccaactcaggctttgnactttgcnttcaaggattacttcaagagggtgttcaacttcaaanaagggcaaaggttggttactgggaagtggttcggtgggaaccctgcctctgggtggggcaanctggngcntccccccggttccttccgtggtan

SEQ ID NO: 90498 - DNA, 546 bp, Triticum aestivum
  unsure (1)..(546): unsure at all n locations
  Clone ID: PAT_TA_90498
ccgaggtgtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacncatctcctgggtactacgatggccggtattggacaatgtggaagctgcctatgttcgggtgcactgacgccacacaggtgatcaacgaggtggaggagtcaagaaggatacctgacgcgtatgtccgcatcatcggattcacaacatcgtcagtcagtcgtcagctcatgccttaagcactggctgcaagatcgganggctaacactactcacaaggcatatat

SEQ ID NO: 90499 - DNA, 292 bp, Triticum aestivum
  unsure (1)..(292): unsure at all n locations
  Clone ID: PAT_TA_90499
ccgaggtgtctcgagttttttttttttttttttttttttttttttccattggttaccattaaaacgtatatagtcgacatattgtataatattatgcgtccgttcatatacatagccaccgatagcattctcatacgagcatgctttctcgagccatgttggtacatgaacatggacatacacatattcttaggaacaaataagaaagataaatggngaaggaaaacccaaagcaatgtcagagttgacaaaactgcaatggcactttatatatggcctgtcgtgagacctg

SEQ ID NO: 90500 - DNA, 236 bp, Triticum aestivum
  unsure (1)..(236): unsure at all n locations
  Clone ID: PAT_TA_90500
ctccccggcctcncccanagctcgttagggttttctcttttttcgggggagaaatctcaagaggcggnaccatgctcgtgtnccaggacaagctttccggcgacgagcttctgtcggattcgttcccttacagggagctggagaacggcgtgntctgtgaagtcgatggtnattgggtcgntcaaggagcngntggtgtggacattntggnnaatccctctgctgacggtggtggt

SEQ ID NO: 90501 - DNA, 392 bp, Triticum aestivum
  unsure (1)..(392): unsure at all n locations
  Clone ID: PAT_TA_90501
ccgaggtgaactantctcgagtttttttttttttttttttttttttttttttttttgaagaattctcaanccccancaacttcacaacaccanattttacanataaaggannatgcatcatccanntacagcttcnatctgaaccacacatnaggatgttcttcatancagccatacattcgtgagactgcccaccacntacgcactttttangttgccnanggcattacggacgaacgactcttcccatggntggcttactantcgttgccggnganggggctnnggtcgtcgcacatgttaaggtnccggtagacaactctggcaaggncaccnccgntgacngggcnggcnaatanaccanatgttggaaaatcnccncccnggccgca

SEQ ID NO: 90502 - DNA, 537 bp, Triticum aestivum
  Clone ID: PAT_TA_90502
aggtttcgaatcatcaaaggcattgctaccggcttgctctatctccgtgagaagtgggagaagataataatccatagagacatcaaggcaagcaatgtactcctggatggtgaaatgaatgggcggcttggtgactttggccttgcaaggttatatgatcatggcactgacgcacaaaccacacatatggttggtacaaaggggtacctagccccggagctactgcggacaggtaaggcatcccctcttacagatgtttttgcctttggcatgttccttcttgaggtcgcatgcggtcaaaaacctgtcaagataaatgcagagggaaatgaagttttcttggtagattgggtactcgagcattggaacaacgaagcgcttatcaagacagtggatacaggctgcaatgcgacttcagcattgatgaagcatcctcgtgttaaagctgggactttgtgcttcaccattccaagttaaggccaagatgcggaagttagcatactcacgtacatgcactgccgactaggaaacgactag

SEQ ID NO: 90503 - DNA, 408 bp, Triticum aestivum
  Clone ID: PAT_TA_90503
ccgaggtccgagtttgcttgcatgatagtcaacattggggcgcacgtgggcacacagccgtagcattgtgtttaatttctggcataagcaacaccatcaactcgaccagatacgagttgacaaagaggtgaatatcatgcgggtttgaaaaatgctctcgtggattgctttctgcctcgcatacatatcgaccacaaggccacatctctggcgtcggccccgctcgccgattgtgggttggcccagtaagggacatgttgaggagcagttttgcatcaattttctttgtttcttctttctttttcttgattttctttggttttctttgtttctttctcagttattattcttgtatgatgcactccctctgtaaattaatttaagacgtcttagatcaaaaaaaaaaaa

SEQ ID NO: 90504 - DNA, 495 bp, Triticum aestivum
  unsure (1)..(495): unsure at all n locations
  Clone ID: PAT_TA_90504
cataaacccaagtcggactcgccttcctcctccccaactactcctctcctccgggcatcgcatcgcaccgggggtcacctgagatnacatacacaatggtgaaggctgtggctgtgcttaccggcagtgagggtgtcaagggcaccatcttcttcacccaggagggagatggcccgaccaccgtgacgggaancgtcactggactcaaggaagggctccacggcttccacntgnacgctcntggcgncatcancancggctgcatgtcaactggnncacacttcaaccctgctggncatgtgcatgnggcaccaagaatatgnnatccgccatgctggtgatcttgggaaatgtgncaaactcgancggatngtgttgctnacatcaatgttnctgactggcatatcncccttactggccangtcacttgttggncgtctgtttcgtcnacgntgactccnatgatcntggtangggtggccatnntctttcaag

SEQ ID NO: 90505 - DNA, 174 bp, Triticum aestivum
  Clone ID: PAT_TA_90505
ccgaggtctcgagtttttttttttcaaaattaaattaaattattgaggagaagagaagctcatatttttgcctcagccccaccggaaagtccaatacaccctcgtcaccagttacaatttatcaatgatataggttaccatctgctccctcgttttcacattaaaaaaaaaaaa

SEQ ID NO: 90506 - DNA, 160 bp, Triticum aestivum
  unsure (1)..(160): unsure at all n locations
  Clone ID: PAT_TA_90506
attttctacaaggaggtccaagccggtattctctcnactaagttccatgtgattgatcaaccctgggnggggaaaacaacactgttaatttgtcgggatttcccnatcctnaaattttatatagcatgaaggaaataaaatacgttttcacaaaaaaaaa

SEQ ID NO: 90507 - DNA, 566 bp, Triticum aestivum
  unsure (1)..(566): unsure at all n locations
  Clone ID: PAT_TA_90507
aacaacagagagcattctaccaccgcaccgcacgagtgaagtgagaagctttgcacgaaaaagttatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgccgatatgaaatccaccgtcgacggcacctgcggtgggcctgcaagaagtactgatcggctcatgccagcatgatatgttccgcctaaaatgaaataaaattcaagacgagatgagcagcgtcatcgtgcctatgcgtgtgtgtgtggcaacaaatatgtatacagtatccgtgtctcgtcgctgtgtttctcctcgagaaaaantggtgttgcctgttgttagatatccggatatctcgtgaataagtatgattgtcgttggggaaaaaaaaaaaa

SEQ ID NO: 90508 - DNA, 539 bp, Triticum aestivum
  unsure (1)..(539): unsure at all n locations
  Clone ID: PAT_TA_90508
ccgaggtgtcgcctcctcctaaaccactctccctatccccgtgtccagaatctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactggtgtgaatgttgcggttatggttggtggattcccaggaaggaaggaatggaaaggaaggatgttatgacgaaaaatgttcaatctacaaagctcaagcatctgctcctgaagtcatcagccccaattcaaggtttggttgttgcaaccacaaacacaatgcccatctgaaagagttgctcatcatcctgagaaaacacagtgttngnccgctaacacaaangcatcgt

SEQ ID NO: 90509 - DNA, 546 bp, Triticum aestivum
  unsure (1)..(546): unsure at all n locations
  Clone ID: PAT_TA_90509
gttttttttttttttttttgctaaatatccggtggaactgtactgtaggaaagcacaaaaattcagacaataaaacctaatacaatcctgtaggacactggtcacatcatacaacaactacaagccaattctgcccacaacaggcacagacatttgcagcttattggtgaaacaaaacaaacatctgcagctacagctgcacggtcatgaaaaatacattatacaatgcggaatgcagataaagcggcctcttccaccaaattgtgcatctagtcggatgcatcataaatacagtcaggtacacttcatcttgtgcacaatattctgctgcatggcatcgatacaactgaagaaagcaacccgccagatcttgcacaaaaacaatgctccaaaccataccagaaaccaaatacattccagcaatcaccgagtagtacagcagagtgtttcagttcatggtgatatccttgcccatccatcggtgggtacaccnaattattgtgcatatctaagggggacacagatccagatatgtctagatcatgg

SEQ ID NO: 90510 - DNA, 541 bp, Triticum aestivum
  unsure (1)..(541): unsure at all n locations
  Clone ID: PAT_TA_90510
ccgaggtaacggaaccaacaaatcccaagctaatctcgtctccgatcgactcgaggcttgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattccccctgaccagcagcgtctcatctttgctggcaagcagctggaggatggccgaaccctcgctgactacaacatccagaaggagtccaccctccaccttgtcctgcgtctgcgtggtggcatgcagatcttcgtgaagaccctcaccggcaagaccatcactctggaggttgagagctctgacaccatcgacaatgtcaaggcaagatcaggacaaggagggattccccggacaacancgctgatnttgccggnaacactggagatgcccaccttgnggntaaantcnaaggntcacctcacgggggcccncncgtgggggaaanantnccgggttnncggngtt

SEQ ID NO: 90511 - DNA, 311 bp, Triticum aestivum
  Clone ID: PAT_TA_90511
cagtgctgggctactttgcaatccatatgatactatcatgtacggtttgtcaccgtaagaagcccgaacggagatttgcagcgagaaggcccaaggcacatctgaagcgtagctatactatgtgagagctattgctcatctgagctatgacctatttatgtcttcctatctctagatctcaaatcagtttgccctgctctgcctccttgctcaagggcttcatcaaaaagcttccctcttttcagattcctaaactctagttgatgtaatcagatgaataacctgcatccacttggagcaaaaaaaaaaaa

SEQ ID NO: 90512 - DNA, 547 bp, Triticum aestivum
  unsure (1)..(547): unsure at all n locations
  Clone ID: PAT_TA_90512
ccgaggtgtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacnagtggaggagtcaagangagtacctgacgcgtattcgcatcatcggnttcgaaaatcctcagtgaatgcgtagctcatccctnaagcaacgggctgcaagatccggcaggctaacactcctcacacagncatattaag

SEQ ID NO: 90513 - DNA, 206 bp, Triticum aestivum
  unsure (1)..(206): unsure at all n locations
  Clone ID: PAT_TA_90513
ccgaggttttttttttttttttttcgacangagaactggttctcatgttattgagtnggcacacacaatcatcacatgtgtttattcacggaggtaggtgaacaagtactagcancaccagcctttcncganagataaaacacattgaccangacacnactatngcattatacatacngttggccgtatantacgacccacacaca

SEQ ID NO: 90514 - DNA, 466 bp, Triticum aestivum
  unsure (1)..(466): unsure at all n locations
  Clone ID: PAT_TA_90514
ccgaggttgtccctttgtgacccggcatcttgagctgcaaatagatataacaaggccgtgccatgaacttggcataagccggccgcccaaacaaggcgtgatacggctccagatcttcaccacctcaaaggttaacgtctcggatcgggaatcatgctcgtccccaaaagccacctccagggctatcttaccaacatgatatgctgatttgccaggcaccacaccatggaacaccgtattagacggtctgagatccttgtctgttagtcccatgcgacggaatgtctcatagtacaggatgttaatactgctccctccatccatgagtaccttggtgaatttataacctcccacntgagggtctaccactaatgcaaactggcccnnttgtcaacccgggggggggggttatctccngctcaaacataggngctccnacancntaatatgcggtacggctggttaa

SEQ ID NO: 90515 - DNA, 301 bp, Triticum aestivum
  unsure (1)..(301): unsure at all n locations
  Clone ID: PAT_TA_90515
ccgaggtcacgaaccccctccgccgccgtcctcgcgtcttctcctgcgcatctcggaggtgcttcctagtttccacgatgaagctgatcgcagcctaccttctcgcctacctgggcgggaactcttccccaagtgccgctgacgtcaggaacatccttgactcagttggtgctgaggctgatgaagaaaagcttgagttccttcttgctgaactcaaaggcaaggacatcacagaagtgattgcatctggaagggagaantttgccgctgtgcttcagggtggggtgcaatngctntgnga

SEQ ID NO: 90516 - DNA, 187 bp, Triticum aestivum
  unsure (1)..(187): unsure at all n locations
  Clone ID: PAT_TA_90516
ctagtctcgagtttttttttttttttttttttttttttttttttttttttttttttttttttttttttttttggacgattagcanaaantggngccgtaggnaatctccanaaaggtatgaaaantctgaaccgaaanctgtgggaaanggntacatgangagtacaattanatctgaanaatatgg

SEQ ID NO: 90517 - DNA, 541 bp, Triticum aestivum
  unsure (1)..(541): unsure at all n locations
  Clone ID: PAT_TA_90517
ccgaggtttttttttttttttttttttttttttttttttttttttttttttttttttttttttttttttttaaanaccaanatcccaaatncattcanccaaaaaatcgtattanaaaaggnanttggnaaaanaatgccctgtttancnggctgcaactgccttaacncaaggctttgggcnatcanancaaanacnantatgtgtatgtatgcaggtaggtaacngaaaacaanaatgtangtatgtncncccccaanacnagtaatttttcaacaanatccnccaacaancgggggggnancaccggatctatctaacttccnntgcctcgcaaatgtaggtggcanananatccatggagtgctggatggccncgnaggctcctccgacggcangaatcttgacggcaccccntgtcccgttctccgnagcccnaaaaaaccngtggtncggcaagcggtggganggaacccttgattcttaaggcggacccaggtgaccnccggcggcnccaaaangaatccnggcncaangggtt

SEQ ID NO: 90518 - DNA, 258 bp, Triticum aestivum
  unsure (1)..(258): unsure at all n locations
  Clone ID: PAT_TA_90518
ccgaggtgagaacctcgccgaccacctcgccgaccccgtcaacaacaacgcctgggcctttgccaccaacttcgtgcccggcaagtaagctgctaggtgttgtgttatgtctggaaaccgaccgtgcacgtacgtacgtacgcgatcaagtgtgcgcatgcatgcgtgcatgcagctgggtttcgtttgtactacaaccatgcatgatgtaaagtacnaaggttgaatgcaaaaggctgttgttagaaaaaaaaaaaa

SEQ ID NO: 90519 - DNA, 526 bp, Triticum aestivum
  unsure (1)..(526): unsure at all n locations
  Clone ID: PAT_TA_90519
tcgagttttttttttttttagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagcgcacccgaacatagcagcttccacattgtccantactggcatcgtagtaccaggaatcgttgtgccacggaagatgaacccaccttgctgaactcgagcaagcaccactggagcggntagtatn

SEQ ID NO: 90520 - DNA, 534 bp, Triticum aestivum
  unsure (1)..(534): unsure at all n locations
  Clone ID: PAT_TA_90520
ccgaggtctcctgcgcctccacttccatcgcctcccaagatcgcagatctgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactggcccgcgctcttcgccaagctcctggagaagaggagcgtcgatgacctcatcctttccgtcggatctggtggaggtggtgctccagctgctgctgctgctgccccggctgctggtggtgctgctgccngtgaagagaagaaagaagagaaaaaggaggaggctaaggaagagagcgatgatgacatgggcttcagcttgttcgactaagcattcaattccagttctcctgtggatcntttatgctaaggattggtatctangtgcttangtcnantttgcggatttaaatgtttgagaccaagtantgtcatgagtacgcaaacaccttggatggct

SEQ ID NO: 90521 - DNA, 240 bp, Triticum aestivum
  unsure (1)..(240): unsure at all n locations
  Clone ID: PAT_TA_90521
tttttttttttttttttttttttttttttttttttttttgagtacatgtcaaactggngcccaattcaactacacaaganacgtacatatatatcaagtganacataacangacatgatcatttctanaacttgatcancnagacagantatgaaccactgaanatnatccccacngaattgcatcanttttgttananctggatngnacatganacanaatttatttccttttcctcga

SEQ ID NO: 90522 - DNA, 292 bp, Triticum aestivum
  unsure (1)..(292): unsure at all n locations
  Clone ID: PAT_TA_90522
ccgaggtctcgagttttttttttttttttttttcntttaagaaaaaatcancaagatttcaagaatttaactttaatttancncaacancangnttggnctttcntcaactcctcngtttcntgcggntaacantaacgaaacgtgtgtcnantccgtgacanatactanaatcaagtatacttangacgancgaacaatcatgaaagtactacaacaccaaaccaaaatgcnggaantccaaactccaaancangtacgtccggnanggngctgcncnaaaacacccnggg

SEQ ID NO: 90523 - DNA, 517 bp, Triticum aestivum
  unsure (1)..(517): unsure at all n locations
  Clone ID: PAT_TA_90523
ctcccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttgatgaccaaggccgtgaaggtggttgacattgttggcaccttccgtcttcaggagcaacctgcttttgacaagaagcagtttatctctcacatgaagcgctacatcaagaactctctgccaagcttgaangggatgacctaaatgctttcaagaagaatgttgagtccgccacaaagtatcttcctagcaagctcaaggacttcagttcttgttggcaaagcatcatgatatgcggcnngtgttccctacacaaggaggagctgct

SEQ ID NO: 90524 - DNA, 485 bp, Triticum aestivum
  unsure (1)..(485): unsure at all n locations
  Clone ID: PAT_TA_90524
gcacaaacatgtctgcctctgtcatggcntcnactggttctgacnaagccatctccctctccacngtnagaacgagcgaaactccgaggtttgcnaccatcngcgaggccatcgctgctcagtantagccatnaataaggcgaagaatgtccagactgcccaaccctactggcctggaggtggagtggagttcaaggaaggcntcnangcgtccggaagggtagccaangggaatggtgtctaccagtttgccgacangtatcgagcaaangttgntgggtacagcccantanatacaccangaagaatggtccccaaagtggtgangtttatnctggangaaagacggggctgtttctccgggcaaanactcntgctggnatcngctgggcggtgnncgcttgttcacantantagtgncttgnttcntgaanctgtncngcaaacangttcnattcancangttaatgncgggttacancgca

SEQ ID NO: 90525 - DNA, 325 bp, Triticum aestivum
  unsure (1)..(325): unsure at all n locations
  Clone ID: PAT_TA_90525
ctgtatacctcactaggggccgacgagctgcggcaagtaaaaatgtgcattgatattggcctagactgtgtcaagtcaaaccctgaaaagagacctacagctggggccatcatgctctggcttgacaaagagagcaaaccggtcccantttcaagggnaggtgcaggantgctgcnaanactcgggccctaaaantancaacagggggggccncnccaaaaaaaggnaaagggggattccngaacnaacttnnggtggaaaaattacaccngcccgggttnttcccnggaaaanatnaangggggtccaaaaacccggngttacc

SEQ ID NO: 90526 - DNA, 541 bp, Triticum aestivum
  unsure (1)..(541): unsure at all n locations
  Clone ID: PAT_TA_90526
gctactcccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgggggtgttgatgaccaggccgtgaaggtggttgacattgttgacaccttccgtcttcaggagcaacctgcttttgacaagaagcatttatctctcacatgaacgctacatcaagaactctctgccaacttgaaggggatgactagatgcttcaagaaaagttgatccgccacaaatacttcttacaagcnaaggacttanttcttttggcagacatcatgatgatgcgctgggtcccacacangaggactgcgatcacttctgtcttnaatggctaaanagcagtcaanccacg

SEQ ID NO: 90527 - DNA, 542 bp, Triticum aestivum
  unsure (1)..(542): unsure at all n locations
  Clone ID: PAT_TA_90527
ccgaggtttttttttgcaacttcgtcactttcgtgtacccatcggacggcagccctttcgggggttccttagggaccgattcactctgcgtagattgactgaacgcagaaagccttccactggcaggcgatcgtgtttttcacaggatttctcgttactcatgtcagcattctcacttctgatatctccaggtcttgtcaccaaaaaccttccccgattgacagaacgtcccgctactgacacttgaaaaagctgctttcaaggctcgtcgcttcggtgaancacttganccctgananattttcggtgccatggnctagacagtgngctattacctncttnaaggggggggntnaaaccaaccncgnggtgaaaccgccatacttcnttcaacnaatgattgcttgggacttagcgtanatgggntgttcccctcgactttggtctaacaccaacagtcgtcgtcaaggatgangccgtatcggagttcactgccgggcggcgctcaatcaatccgcgncgcatggcggcggagatgcacn

SEQ ID NO: 90528 - DNA, 546 bp, Triticum aestivum
  unsure (1)..(546): unsure at all n locations
  Clone ID: PAT_TA_90528
ccgaggttcgagtttttttttttttttttttttcaaaattatccccttcctacgtcccgtcacagcgggggacattttagaacctgactgaggatgaccaatcaggtacagtatgttcagcacacgcgccgacagcaaagaaaactgaagcaatggaactattccttccatttattcccccttgaccagttaatcttacaaaattcttccatcaaaaaatacatccttctaacgctgaccgacgtaaactactgcctcgtcgtcgcggcgacacctagattcatcggattccttaggttcgtacgtacagtgccttaattagttacatgatggactccaatgggatgatccaatggnacctatatgtacatatggagcagcgcaggacaccggtggagtgggcgaggactcgcttgctgttatcaccagcaggcatcgactgctgagctagaaaaggggttggcaagaaaaatggctgtggtaatctcgctgacaantgcgatttcggagccggcanacccatcncgtacttcttgcgccanaggt

SEQ ID NO: 90529 - DNA, 279 bp, Triticum aestivum
  unsure (1)..(279): unsure at all n locations
  Clone ID: PAT_TA_90529
ccgaggtttttttttttttttttttttttttttttttttttttttttttttttttgnngttntttttttttttttttgatccaaaatgattattatacanattttaaantaggcaaaggtttanaatgtanacnanaatttccaccnccaanaatttanatcatgtggngaaccctnaantaaatgcaaatacngaccncaaaaancttccaancaanantttcnatnaccgatggttgcactacttaaaangcaatgtcatgcnacctgcccgggngg

SEQ ID NO: 90530 - DNA, 468 bp, Triticum aestivum
  unsure (1)..(468): unsure at all n locations
  Clone ID: PAT_TA_90530
gtcataaacccaagtcggactcgccttcctcctcccccaaactactcctcctcgcctccgcacatcgcaccgcaccgggggtcacctgagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttggtgacaccaccaatggctgcatgtcaactggaccacacttcaaccccgctggtcatgtgcatggggcacccgaagatgaaatccgccatgctggtgatcttggnaatgtgacagctggagcggatggtgttgctaaatcaatgttacggacgcananccctacnggcaaattaatngtggccnncntttcccnaaggggnccnnttttttgngggggg

SEQ ID NO: 90531 - DNA, 399 bp, Triticum aestivum
  unsure (1)..(399): unsure at all n locations
  Clone ID: PAT_TA_90531
ccgaggtattttataagagcaactgtagcaggatgaaaatgaccacaatttatggagcaacatcatctacctttatcatactcatgatacaaattttctttcaaagatcaacaaagcaatatgaggctgaaagcaaggtaaataaggtttaacgacaaccagagacgatggcgaagcataaactctgacacgacgatggattttaacaggtccattaaactgactggtggcactctacttcntgatcttcttcttggggctcangnngcttgctgttacnaccttntacttcanangtcaacaccctnggtgcaggcncacanggaatccgctttnncaanaatgggtgtgaccattggggnggaacccttcnccnggtnagggttaccnantggtcgg

SEQ ID NO: 90532 - DNA, 546 bp, Triticum aestivum
  unsure (1)..(546): unsure at all n locations
  Clone ID: PAT_TA_90532
ccgaggtttttttttttttttttttttttttttttttttttttttttttcncaagggcacaacaaatcaatcacttcgattacagccatgaataacaaccccaaccataagccacaataaagccttgcaaccaaattaccccatttcagctctttttttagttgaatttacagtttttcagtacaattttagctacaatttgtacataaacaatgtgcaaattatacaagccaaaagcccccaccctgttggctgcatgttcaagcggtaaccaggaatcgagttccatttaacacatgcaggcacagtgttatgcanattgtggcgagaaccatagacttatcactcatatacctcatggctcgcagtccgctgtcgaacgcggtgtccccactctttctcgccccatcgtgcagcttccacagcacaaactcaagaaatgacctcaccgtctcaaatgtcaccctcccaagtaacatcaagcacaaaattccggttgcntggnactgccaaatgtgccnaganacngtctcaaccaccttccca

SEQ ID NO: 90533 - DNA, 579 bp, Triticum aestivum
  unsure (1)..(579): unsure at all n locations
  Clone ID: PAT_TA_90533
ccgaggttcgagttttttttttttttttttagaataacagggcagaatctcttgattcaaccaaaacacaaccacaccaatttcacgattaccattacaaagcaaatcccacaattatcagaaagttttcaagacactcaacatctgacagttactgacaccaacattggagagtcgactgacaaccatagataagagcanaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctcgccaaacanagaactgaaggtccttgagcttgctaacgaagatactttgtggcgggaccaacaatcctnctngaaagcatctaaggtccatccccttcaagcttgncaganaggttcctgatgtancgcctcaatgtgagaagaaaactggctcctggtcaaaagcaagttgcncctgaataacgggaaggtntcaanangtcacccaccttcnnggccgggtcanaatgg

SEQ ID NO: 90534 - DNA, 534 bp, Triticum aestivum
  unsure (1)..(534): unsure at all n locations
  Clone ID: PAT_TA_90534
ccgaggtaattaaaaaacaacaaccggagaatgaagtgggagcacggatggaagcatgaggagggatcaggcaagccggatccgattcgtcccaggccatcattgccttgccttcttcctgttcgccaacccgccactcaccttgcgacatgccggcgttgctagatcgctgcagaagacattacggcaaaggcaactcgctcatcccttcatgcatctattccatctatttattaccatccaattggattaataataatggtgtttttccaaattttgggagtanttcacaatccgtttgagaaatggtaattccaatgaaaacccnanttttaacgggggtcangtccaattgcaaantaanattacggtgattttaagttttggatggtttccaaatttccaatccatggacnattttaaatggtgaanttttggattttaanncatggcaagataacattacttgaaanncccncctatgttaaaacaattgaacngggaacccngggaaaatttgtccaaggccccccc

SEQ ID NO: 90535 - DNA, 332 bp, Triticum aestivum
  unsure (1)..(332): unsure at all n locations
  Clone ID: PAT_TA_90535
tctctctctctctctctctctctctctctctctctctctctctctctctctctctctctctcgtctcgagttttttttttttttttttacacacgaccgactaccctcaanttangagggtcttgtgactcttgtancanttgcacnactganaanatntcangaacaagtancaagtttgagtatcccatgatggntgcaancttgtaagtatagattcctgnnatacaagctgaataaancccaatcttgactgaccatgcaaatcaancaagctgttgctcntaagatttttttctcacttgaacatagagantcanagganncgggca

SEQ ID NO: 90536 - DNA, 569 bp, Triticum aestivum
  unsure (1)..(569): unsure at all n locations
  Clone ID: PAT_TA_90536
ccgaggtcttaactcgacttaggttcatctccttagccatccggagaccatggagcaaggcttcatactcagctgcattgttagtacaagggaacattaagcggagaacgtaacaaaacttatcacctcatggggaaattaatacgactccagcccccgagccttccaattgcctggatccgtcaaaatggatggtccaatatgtgtgatccggcttttcttcaggtgcttgcatttctatccaatcattgatgaaatcaacaagtgcttgagacttaaccgccgtctgaggcacatacttcaatccgtgcggcccaagctctatagcccacttgggaaatccggccagtcgcttcccgggttctgggatgatatcccccaaaggagcagaactgaccaccgtaattggggtgcccttggaagtattgcttaagcttccggcttgccataaaaacccgtacacagcttctgccaatgccggatactttgcctggnctcaatgagtactcgctgatataatagaccggacaatnaancggatgctccttactctctcttctctctctntg

SEQ ID NO: 90537 - DNA, 203 bp, Triticum aestivum
  unsure (1)..(203): unsure at all n locations
  Clone ID: PAT_TA_90537
gaattcactaggtgatttcganncggtcgcccgngcangttttttttttttttttttttttttttggngatgtnngcaaaggacccttcaactatctttanaacaaaactggnanaacaaggtaccgtgcaaatatattactgagcatcattatanatgtcttggtcccnanaaatgangtggtanatttgacncgtgcccga

SEQ ID NO: 90538 - DNA, 367 bp, Triticum aestivum
  Clone ID: PAT_TA_90538
ccgaggttaaattaaaaactacttttaaactcaaattattcacaatctagggtttgaagcaaatttgaacaaattcttatttaaatcattcaaatttgaaaactaatgacacaaacagaaactagacaaaatttgaacctaatgcaaaaaagaatcactcaaagatgtcaaatatcctaaaagatataagcaattcaaacagaaattaaaaacaaaaaacaaatagaaaaacaaaaaacaaatttcagaacccctatagtcgtggttggtggctccaactgcctttagtcccggttgtaacctttagtccggggtggagacacttaccggggactaaaggtcccatttgaaccgggactaatacctg

SEQ ID NO: 90539 - DNA, 608 bp, Triticum aestivum
  unsure (1)..(608): unsure at all n locations
  Clone ID: PAT_TA_90539
ccgaggtctctctccctcgacggaccctcatcctcaccgccatggctccgcctccgccctccggctacngacgaacgaaaccgtgtctgccggagacacgcacgaagccggcacatgtgtggtggtgctcgccgtcggtccgtctcttggtgcgaccaagtgcttgcatgtttacatgagtaggtatgatatggatcgagccgaggattcaccacacaaccttcggtttcccangtttctctgctctgggttgccgatggatggagacgagcttcnttcttctggccggtagatctggttatgatccacaaattcggtttttgatcngctaccgtacgtataatatgtcttccctccatctcgtgcatggaaatatgtttgntgttaganacngccggttatggacacggntctcatcacacgantcacaagtcctangctttcgagatgcaangcaattttttagtcgacaaanggttaagcganataccacggacnccctaaaatttccgatncntttaactcgaaaatctctcgccggncggcatcaaaangcgcaatacaagncnatntaccannttggagctanttaatnggtgtttgcccnn

SEQ ID NO: 90540 - DNA, 613 bp, Triticum aestivum
  unsure (1)..(613): unsure at all n locations
  Clone ID: PAT_TA_90540
ccgaggttcgagtttttttttttttagaataacagggcagaatctcttgattcaaccaaanacacaaccacaccaatttcacgattaccattacaaagcaaatcccacaattatcagaaagttttcaagacactcaacatctgacagttactgacaccaacattggagagtcgactgacaaccatagataagagtaaaaatactgaagacagcatagattttagcatacagtgcgattagcacttgacctctttcagcccatgtgcaaagtacaggaaagttggatcaagcagctccctccttgtagtaggcgaacaccacgccgccatcatcatgcatgctctcgccaacaaagaactgaaggtccttgagcttgctaagaagatactttgtggcggactcaacattcttcttgaaagcatctaggtcatccccttcaaagcttggcaagagaggtcttggatgtancgcttcatgtgagagataaactgcttcttgtcaaaaagcaggttgctcctgaagacggaagtgtcaacnatgtcnaccaccttcacnggcctggtcatcaacancctcatcatcaacaacaacctcagcatagggatggctcaag

SEQ ID NO: 90541 - DNA, 588 bp, Triticum aestivum
  unsure (1)..(588): unsure at all n locations
  Clone ID: PAT_TA_90541
ccgaggtctcccccttcccctccaacgccgggggcggatccacccgccgccgcctgaaatcccttccccctcctcccgccactaggggacctgcgccgccgtagccgtttcccttcttcctcgcaaacaggtcaccaggtctcctccctccctccctttgagattttgaagtaaggagagaggccgaaccatggggaagagaaaggcggctgctaagccaccacctaggaagaggatggacaagctcgataccgtcttctcctgcccattctgcaaccatgggagcagcgttgagtgccggattgatttgaagaatctgattggtgaggctaactgtcaaatctgccaggaaagcttcagcaccactgcaaatgatacaagcgaatggatcnatgagtgcgagcgcgtcaacactgttgaagatgatgatgggtgcatgagcatgttgtaactataatacccgtatggcctcaatgtgttgatgtcatttacgccaacgtnaggccatatctgtnntaacattgtaacaatgtnctgggccgatncaaacttagtagnaatttgtccgtgcttaaacacaacgatgan

SEQ ID NO: 90542 - DNA, 362 bp, Triticum aestivum
  unsure (1)..(362): unsure at all n locations
  Clone ID: PAT_TA_90542
acaagcttgacacnactgagaagggcggncanttcagcctcnacattcctcaagcactccaccatcgtggtcaancccagaggtgttctanagcagcgccgtnccggacgtacntgntctggantttggacttccagcattttggtttggngttgtantactttcatgatngttcgcncntcctaagtatanttgattanagtatcggtcacanagtatacacacntttcnttaatgttatccgcaagaaacatagganctgaataaangccaaacctgtangctgcgataaattaaagntaaatcttgaaancctgnatnatttttccataanacaaaacctcggcccgcgaccacgctaa

SEQ ID NO: 90543 - DNA, 312 bp, Triticum aestivum
  unsure (1)..(312): unsure at all n locations
  Clone ID: PAT_TA_90543
gaattcactagtgatttcgagcggccgcccggcangttcgagtttttttttttttttaggctccaaacataangaagtgcatacatgntaacancagtgataaagtgacagnatgacaagaggatancccatgaaagtcncaggcctctcagctaangtactcataataccaacatttgataaatataaggtgatagctactagttcctcattcctcttcctcatcaccancggngtcgccgccaccacttgccntcttctggntcnttctcttcaccctgcctgcagggcctccgnccgagtggacttgtc

SEQ ID NO: 90544 - DNA, 341 bp, Triticum aestivum
  unsure (1)..(341): unsure at all n locations
  Clone ID: PAT_TA_90544
gaattcactagtgattagcgtggtcgcggccgaggtgagttttttttttttttttttttttttttttttttttttttttanttaatcaggggaaattttatttaggggggcctgtttacaatcatggcatggcacctgactgctgatgcaggtcaggtgcatagataaaggccctcgatcaggttgcggttacatggtatggtagtagtagatcgatatgatcgatgatgcacncacggcacggtgcatgcatatggtcgatgatcgatctancanctgcagcaggagcanccgcanctggtgccgcacttgcactgggtgcagccgcagcctgcccgggc

SEQ ID NO: 90545 - DNA, 608 bp, Triticum aestivum
  unsure (1)..(608): unsure at all n locations
  Clone ID: PAT_TA_90545
gaattcactagtgattagcgtggtcgcggccgaggtgcagatcgctcgagccctccgccgccgccgcgacttcagctctctccttccttctccgatccaagatgaagttcattgctgcctatctgcttgcttacctctctggcaacgccagcccctctgcagaggacctgacatccattcttgagtcagttggttgtgaaattgacaatgagaagatggaactcatgctgtcccaagtgaagggcaaggacatcaccgagctcttggctgctggtagggagaatttgctgcggttccatctggtggtggtggtgtggctgtttcagctgctgcccctgctgctgggaggtgctgctgcccctgcagctgagtcaaagaaagaagagaagntcctggagaaggaagagagtgatgatgacatgggcttcaatctgttcgactaattgtggggatcctgtgtccgaatatcatccntgggcaggaaactagatcaatgatgtttangccttaattagctgaattgtgaaacccgggaagacaatgtttgatatgtattaacccctgttgctggttgaattacngggaancatacnttcaancaattttgg

SEQ ID NO: 90546 - DNA, 278 bp, Triticum aestivum
  unsure (1)..(278): unsure at all n locations
  Clone ID: PAT_TA_90546
gaattcactagtgattancgtggtcgcggccgaggtcaagcaggagcctgcctagtcgatcagccntgctcatcccatatcatccacgcnaggttagttacctanttaattaggtagcctgcctagtcgatcagctgtaacacacatcacattagtttaangtacgcnagtcggcnagtgatggctgctggcgcatgcagtgcttctccttctcctccttcncgccantgccccattcggcgtttgccgggtgggccagaaagtgggtgggccaagag

SEQ ID NO: 90547 - DNA, 441 bp, Triticum aestivum
  unsure (1)..(441): unsure at all n locations
  Clone ID: PAT_TA_90547
gaattcactagtgattagcgtggtcgcggccaggtgtctcgagttttttttttttttttttttttttttttttttttttttcataaacatactgtagtatanatgaacatttaattgcacggaatatataaggaagaacaattacattttgctanagtacgtattcacncgtttaattaattgcgcanaagtgcagcgatatctccagccatcgttgcaananccgtctgttccaanntgnggaaanananggtaccctttgnaaggagcttgtttngcagcttgttttggngagtaccnttgcttcgacgtttttnagcttcncctttanagngggnaaaagattggccacacagaaacncaagggtataccttgcaaggatgggaagaaattgtcnncatanacagcgaantannggttccanggggtcagttcattaa

SEQ ID NO: 90548 - DNA, 300 bp, Triticum aestivum
  unsure (1)..(300): unsure at all n locations
  Clone ID: PAT_TA_90548
gaattcactagtgattagcgtggtcgcggccgaggtttttttttttttttttttttttttttttttttgtnttttttctttnttttttttttttttttaccacnagtactgatntcanancccaaacggnanatagtacantggncatcanaanaanacccaagctanatatcatattaccaaaaatgggttcaatttgccganattgnaaaatcttcaaactaanaccctggaaaaacncaaagttcaaaaangtcttggnttccttcaaaggnttagtcccccttgnggnggaaggng

SEQ ID NO: 90549 - DNA, 298 bp, Triticum aestivum
  unsure (1)..(298): unsure at all n locations
  Clone ID: PAT_TA_90549
gaattcactagtgattagcgtggtcgcggccgaggtgttttttttttttttttttttttttttttttttttttttttnttttttttttgacgatggatacatgcacaatanatcncgtgcatgatagaaaatcatttctgtttcttcaancaatcccaaagtcgtgtccanagtggcaggtgcagctcaaggagaccacgggtccacggcttaacaaccanatgcancgtggccttgagccggacggacaacccatacagctcnctcatgcccancttcgccccggccgccgccgccg

SEQ ID NO: 90550 - DNA, 393 bp, Triticum aestivum
  unsure (1)..(393): unsure at all n locations
  Clone ID: PAT_TA_90550
gaattcactagtgatttcnagcggccgcccggncaggtctgatcctccaggccgtcctgntcatggggatcctctcacacgtgaacgccgactatttccccaagtgctgnaacagttgcangtccttctcgggggtcgacngtccgcnacgacgcccacccccagtgccccaagggctgctcggcctgccgcgtggtgacgcccagccctcacaagacgttccggtgcgccgacatgaagagcaccggtcgacggcaacctgcngcgggccatgcaanaagcactgatcgttcanggcttcaggcncagactaggtgtgtcccctaaaataaagctcanatgangatgaagcangtcncggtgcctatgcttganntgtgggttcttgccatt

SEQ ID NO: 90551 - DNA, 254 bp, Triticum aestivum
  unsure (1)..(254): unsure at all n locations
  Clone ID: PAT_TA_90551
gaattcactaatgattccaagcgggcgcccgggcangtaactaatcccnaatttttttttttttccgcttacatgtacgattaatcaaggnatatatatacacacagggagccaccanagnccgcnaaggggngcgacttcaccggngacatgcctgagattgagagtactcctcccanctgtaaaaactaagggctgtncgggcactaattancaactcgggccgcgaacaagctaatcnaattcccccnggc

SEQ ID NO: 90552 - DNA, 520 bp, Triticum aestivum
  unsure (1)..(520): unsure at all n locations
  Clone ID: PAT_TA_90552
gaattcactantgatttctagcgggcgcccgggcaggtatccatccgcccctcgctgccgctgcgtctcgtctccaccaccccacttgnccccggactcaggaggatnntcggagatgtcggacaccgatgagcgccacttctagtccaaggncgactccggcgcctccaagacctacccgcagcangccggngccatccgcaagggtggggcacatcgtcatcaaagcccgtccctgcaaggttgttgnggtctccacctccannactgggaagcatggtcacgcaaagtgtcactttgttgccattgacatctttaatgggaaagaancttgngganatcgttccttcatcccacaantgtgncgtccccatgttgaccgccangattatcaactgattgacatnaactnatgatggnnatgtnagcccttctaactgagagtgggaaacacaaaaggatggacctgaaancttcccncngatgnaggttcttgccttggnaanattaaaaacngggg

SEQ ID NO: 90553 - DNA, 564 bp, Triticum aestivum
  unsure (1)..(564): unsure at all n locations
  Clone ID: PAT_TA_90553
naattcaccaagtgattnaacgtgggccccgncganggtttttttttttttccgtaaagaaatctgtattaacaataccaaactggacgcccgacaacccctgggagctgacgggtgccccttcaaagcaagaaataatccacanaagaatagtttggnaacatcaaacaaacttcanctcaaaagaagcaagtcaaagggcacaatgacactaaggctgtgttgttataaaaattcatcaaaatttcaatcctaagcacgcatgatctaacaaaaaaaagacgggcgaatganggggctcaaatattgtcncctaagggtccgttaaanaaaacctaatatcntcctaataatgttcaanccaacaacangggtttttaccttctcccgaagctggagtnctccctgtgtccaacctggggggatnccaaggnaaaacttgcanaggacaaattaacntttccccaaccaacannttttagcaatttttccttgaaccttcttcacngggaggccaaacttttccccttggccaaaanaaggccnccgaacgggcaanccccg

SEQ ID NO: 90554 - DNA, 521 bp, Triticum aestivum
  unsure (1)..(521): unsure at all n locations
  Clone ID: PAT_TA_90554
gaattcactaatgattaacgtggtcgcgggcgaggtttccactcttgtcgccctantttccgtcatatcggtgttatgttcccggnttttgcgttccttacncggttgggttataatgggaaccccttgaccattcgctttgaataaaantcctccancaagggccaaccttggttttaccattcggcaccnancctctttttcccttgggttaggccancccaaaggntatctttattttaaacccccgggccantgcttgtctaactgttggctcccgtacncttaacttatctgggtgtgccctgagaaanagatatgttgcaaatnctaacangattgtcggcacaaccggtgggcctgccgggacctnttttaacaaatgtccaaagaagtcttgttaacggggattctgagcccggatnnggtccntcccncctaaaaaggaaaaancctcccntnatcctganaaaccntgtganggggggaaanttngggaaaacccccccaagggtttttnn

SEQ ID NO: 90555 - DNA, 524 bp, Triticum aestivum
  unsure (1)..(524): unsure at all n locations
  Clone ID: PAT_TA_90555
gaattcactantgatttccnagcggncgcccgggcaaggtgacttgtcctccaatcnactttggntggagttcgaaaaaggaataaaaataaagtaaattcaaggaagagctttctttttttttttaacaaccccttggcangncgtggaatgcttttgttctccncctattccatatggaatacaatcaagttaaaataagaaggaatangggaatattcgatcgttcactccaaaaaagaaggncctattgaaaaagaaattatccaaaatagaaagaagtttttttttttttcaattcaaatggttaattaacccctantcaaaaatttccttgaaaaacnaaattcaatttttcaatcaaangggggtaagatgatcaanntcctaaaantaatacccttacncaattgacaaattccacaacaaaaccccctgattcgggaattangggacncaaggtancaacctgatgnanccaccttcctttanacctccggtacctaacccaacctggnttttag

SEQ ID NO: 90556 - DNA, 537 bp, Triticum aestivum
  unsure (1)..(537): unsure at all n locations
  Clone ID: PAT_TA_90556
gaattcactagtgatttcnagcggccgcccgggcangtgccacccctctccactgaggccctcctaaagcaggtcgactacctgatccgctccaagtgggtgccctgcctcgagttcaagcaaggttggcttcgtcttccgtgagcacaacagctcccccggctactacgacggtcgatactgggacaatgtggaagctgcctatgttcgggtgcaccgacgcaacgcaagtgctcaacgaggtggaggaggtcaagaaggagtaccctgacgcctatgtccgtgtcatcnggcttcgacaacatgcgccaagtgcaatgcgtcagcttcaattgccttcaagccaacaagctgcgangggaatctggcaaaggctaaaagtgcaangtttgaaagtaacgcnatatacaatgccatgttagttcancattttgtccggcagccgctgcctttctccggnttttaccttctcgtaccnactcaanatgtgaatatatgangtataatnatgttaagccacctaccaaacgttaggtg

SEQ ID NO: 90557 - DNA, 470 bp, Triticum aestivum
  unsure (1)..(470): unsure at all n locations
  Clone ID: PAT_TA_90557
gaattcactagtgatttcgagcggccgcccgggcaggtccgcaccgcacgagtgaagtgagagctttgcacgaaaagttcatcaacgaccatgaagggcaccaagctcgcggcgattctcatcctccaagccgtcctggtcatgggagtcctctcacacgtgaacgccgactatttccccaaagttgctgcaacaactgcangtccttctccggggtcgacgtctgcgacgacgcccaacccaaagtgcccaaagggctgctcggcgttgcgcgtggtgtccaacnagccccgaaatgttggcgctgcgcgggatatgaaaatccaccgtcgacggcacctgcgggtngggcccttgcaaanaagtacnggattgggctcatgccaacnatgatatgtttccgncctaaaaatgaaattaaaagntcaanaccaagattgaacaagngtcatccggngcctaatgcgttt

SEQ ID NO: 90558 - DNA, 561 bp, Triticum aestivum
  unsure (1)..(561): unsure at all n locations
  Clone ID: PAT_TA_90558
caattcactaatngattnaagcggncgcccgggcaagtgcantccccantttttttttttttttaattgggacgaaaaaaagcaaattcaaaatggntcgatgttcccaaaagggggggtgcttaatttcatgacaatctccacancaatcactctgtcaagctccccaagagagtttcaagaaattactggcaaaaccaaaatgacaaaaagacttccagatgtagaacttctgggtcaacacttcanaactantccctcnacnaagacgcngatntggncccttctcaancatgtcgtaaaaaggatngcgtcctccctcctggctcggttccagtggatgcaaccttccacaatancaaccaagcaancaagccccaangggnggggttccaatggaaanattttcctttnaacaaagccttcgggccccnttgagggggccccaaggttgaaattctggccggcctngccaaacctggctaaactggnttgggncncaaaatggccaaaaatgnccntnccccccccccgggggganaaagggnnaaaaaacccnnc

SEQ ID NO: 90559 - DNA, 328 bp, Triticum aestivum
  unsure (1)..(328): unsure at all n locations
  Clone ID: PAT_TA_90559
gaattcactaagtgattancgtggtcgcggccgaggtgtctcnaagtttttttttttttttttttttttttttttttttttccattggntaccattaaaacgtatatagtcgacatattgtataatattatgcgtccgttcatatacatagccaccgatagcattctcatacgagcatgctttctcgagccatgttggtacatgaacatggacatacacatattcttaggaacaaataagaaagataaatggggaaggaaaacccaaagcaatgtcagagttgacaaaactgcaatggcactttatatatggcctgtcgtgagacctg

SEQ ID NO: 90560 - DNA, 274 bp, Triticum aestivum
  unsure (1)..(274): unsure at all n locations
  Clone ID: PAT_TA_90560
aattcacaattnataaccgtggccccgnccgaggnnaaaaatccnatcttcttcccnnaaaaataaaacaatcnaaatntttttccccccccccccngnggnatgggaaaagnanctggctcctttttccccttggttcccccccccgccccgttnacaacaatnggctttgggnaaatgctnaaaaggtngggcccngcacccccccaaaggcnggaannagggaanggttaacaattgggaagctncncccaancccggcaaaggacgcccg

SEQ ID NO: 90561 - DNA, 366 bp, Triticum aestivum
  unsure (1)..(366): unsure at all n locations
  Clone ID: PAT_TA_90561
ccgaacctngcanaggcgggccgccaaanttcaccaaattgaattaaaccgtgggtccnccggnccgaaggtttttttttttacacaactaaatcacatcaaaanttaagaatatgtttgttctgaacattcaccancgatatggaaaatataaccaaagtatctatcccgttttccccgagtcacgaattcaaacaagcgggacgtccttanaaaccataaatgcaaacgacnggtccaagaacaagtttcccaagatttcatgacaaggacgggtggacgcctggtacaaaaatgcaaaatccccaccaaaaacttantcanctcctgggcacttcccgaatgactngactgaactggactggt

SEQ ID NO: 90562 - DNA, 294 bp, Triticum aestivum
  unsure (1)..(294): unsure at all n locations
  Clone ID: PAT_TA_90562
ccaactgcaaggngggcgcccaantnancaaatnaatnaacctgggcccccggcgaaaggcaacaaacccctcccgccgncgtnctcgcggnctntcctgggcaatctccgggggngnttcctaatttccaacaatgaaanntgattgcaacctaacttctccncctanctgggcggggaaatcntccccaaattccctgacgtcaanaaaanccctnactcaattngtggtgaagntgatgaaaaaaaaaacnttgagnttcctttttgctggnactcnaaanggnaaaggga

SEQ ID NO: 90563 - DNA, 699 bp, Triticum aestivum
  unsure (1)..(699): unsure at all n locations
  Clone ID: PAT_TA_90563
tttacgggggncactaataagaaatactcaaaggctatggcantcccaaacgccggtgggggaggctccncccaanaatnggtcgaacctgcaagggggggccggcgaatttcactaatggattaancgggccggccccgggcanggtanaagaaactaatcncgaagttttttttttttttggggaagaagatgggntttantacaactccggggatccccttanaataggtggagattacatggntaaaatcaaacaaaaatacnaggaaatatatcaaagccacaaagatagcatcaatcaacgaaaaatgcgcggtagggaaagatttagcccaagaaacaacccatggactaaaaaactaagtangtggggattcatttgcccttcttganaggaccccaagcttggggcaagaagcagcaccaatcaagagggtcaccgggncaacgatgaatgcangttcttttacctgctggggtgggtaaaatggggaaacttccntgtttcacaaatgggaagtttgaagggtattgcnangctgccccccctcanccgttatcaaaggggggcccaaattggcaatcaagttctaagtaattttgaggagggggaatccaaggcaanaatttncctaagccttccttgcccacctaatcaanaactggcaatggcnagcaaccaaaaatgttcntgnc

SEQ ID NO: 90564 - DNA, 665 bp, Triticum aestivum
  unsure (1)..(665): unsure at all n locations
  Clone ID: PAT_TA_90564
cactaatagaaaactcaaagctatgcatccancgccgtttggggaggctctcccaatatggtccgacctgcaaggcggccgcgaaattcactaatgaattaaccgtgggccccggccgaggtttttttttttttaaaccaataataatgccattatttctngggcaaaaagaaaangccggcctctccaaaccctcaaaaagggctcaaaaacataaccaataataacaaaatcctccgccctaagagaacagcatgttaaggataatagaaagggaaacaaggataagtttgataaaagttcccgtttgggtgcccgctggctcccgaactcaaggctcaanggcaagncccgctaagtcaatgctgggacaacaactantaaccgggtaagcccgcaaggcttgttaagggaccctcaaattggggattgctnaatggtagtcaagactgggggacttggtggaagccttngtcaancctgggcgcccgagcnttgcccaaaagtgggagggggcggcgaaccnttctccgtccaaagttgctttgggggaaaaaaagcaanaacctttcnttctcaanaacttgccaactngggcctccctccgnttccannaaactcaaaagcttgaggcaaataaaccctgggtttggtggaatgaagcc

SEQ ID NO: 90565 - DNA, 568 bp, Triticum aestivum
  unsure (1)..(568): unsure at all n locations
  Clone ID: PAT_TA_90565
gaaatnactagtgattancgtggtcgcgggccgangttttttttttttttttttgttccaagtcacccaanatcaatagcccaaatgacaagtgataaaagttcaagagtagcacaataangaattgacatgaatgggtgcacacnaaacangtggatcanaagatcatgtgcttatttanaataagaanatttgcaaatcctgcattcctggaaaaaggttcccaanatctgttacgacgttggtccgggcgaanatgacatcctagccctggnngcccgatgattccgcaacgcaacacggggcaaccaagcggntccaaggtgctccttgctcaagctcatggtccanccctttgccaaggatcatcaagncgtcaaccaatgggacgaacaaacaagcaacgggccaaacaaatttgaattttgggtccaagtaaaggggggantaattgggnagtcaagtaacatttgatgttagcaancaaccattccggccccnagctgtncacaattttccaangattcaccaagcaatgggggggatttcaaccttccggggtggcccc

SEQ ID NO: 90566 - DNA, 256 bp, Triticum aestivum
  unsure (1)..(256): unsure at all n locations
  Clone ID: PAT_TA_90566
gncactaatagnaatactcaaagcttatgcatccaacgcgntggggaggctcctcccaatatgggtcngacctgcanggcgggccgccgaaattcaactaaatgattntccntgggccncngccggangggggggccccctaccgttccgtgttacntgttaancgtccctgttccgttcnntttgaatgaaatgganantcacngcaagcattggagntcattcaatgccatttntcaaaagganaaaaaaaaaa

SEQ ID NO: 90567 - DNA, 507 bp, Triticum aestivum
  unsure (1)..(507): unsure at all n locations
  Clone ID: PAT_TA_90567
naattcactantgattaacgtgggcncggncgangtggtgccttctcctccaacgtcggtggcccggcttctacgcccgaccaacttccttgggaagaagctcaanaagcangtgacctcggccgtgaactaccatggcaagagctccaaggccaacaggttcacagtcatgggagcggaaaacctcnacgagaagaggaacacggacaagtggaagggtctttgcgtacgatatctccgccgaccaagcaggacatcaccaagagggaagggcatcgtggactcgctcttcnaggcgcccacgggcgacgggcacccacgaggncgtcctcanctcctacgagtaacgtcaagccaangggactcaagaagtacgacntcnncaacaacaatggggagggcttctacatcgctcctgctttnatgggacaancttgttgtccaatctcctccnaggaactttnatgaacctggccnncatcaaagantccaactcatccttgggtg

SEQ ID NO: 90568 - DNA, 299 bp, Triticum aestivum
  unsure (1)..(299): unsure at all n locations
  Clone ID: PAT_TA_90568
gaattnantaatgattaacgtgggcccnggcgaagnggaacccaacncctgcgtcatctgctgattggggcncgccgctcccttgtacattttgtagctgggcgtgtgctcngcagcctgccggtcnattatgcctgctanggtgatngacggngtgcgccatanntaaggncangtaaggattttgcncccgtgatccggcntcaantgcttntgcatcngcttaaattanaaaantgcagatatgggatttaaaaaaaaaaacctnccccggncaatggtccnntttttttagacca

SEQ ID NO: 90569 - DNA, 510 bp, Triticum aestivum
  unsure (1)..(510): unsure at all n locations
  Clone ID: PAT_TA_90569
gaattcactaagtgatttcnagcggccgcccgggcaggtgtctcnagtttttttttttttttanttcggttcttttttatttaaaccttccccttctttatctttagttttatctacttatcaataagtatctaccgggntcgaactcgaatttgntcgccttccatacttcacaagctgcgggtagttcaggactccatttgcaagctgctcgggnaaatttcattaccttcgcgagcaagatcgccgcccttcgttacgaagcttgtacacaggcttctaaagccactccgattagctgctgcaccaagtgcatttccccaaaggatgtcctaaagttccctccaccaaattgtaatacanaaatcgtccccaaaagnatttcggtcaagagctggnataatgccaaaacaatgaattaccaacctgaagctaccggtataacaacctgggnatgggtacccangtccctgagtgaaaaaagataaccgcggagcaacgatctttttn

SEQ ID NO: 90570 - DNA, 187 bp, Triticum aestivum
  unsure (1)..(187): unsure at all n locations
  Clone ID: PAT_TA_90570
caataataaaaaantcaaagntttgcatccaaagcggtggggagntcttccaaaatggtccaactgcanggnggggcgcgaattnantaatgattaagcgtgggccccgccnaaggncgcccaaggctaatctccantttttttnnttttttttttttttttttttttttttttttttttttcactt

SEQ ID NO: 90571 - DNA, 459 bp, Triticum aestivum
  unsure (1)..(459): unsure at all n locations
  Clone ID: PAT_TA_90571
ctttcacaaaggaatgcgaagagaactcaatgggtcttatcctattcattgaataaatttcttttttattagagtatcggcaagaaatcttgggtattcactctatttttaagttttatttaagtaaaccatgcacaatgcataggactacccccccattttcaaattttaaatttgnaatactttaattaatttttagtccttttaattgacatagatacaaatactctactaggatgatgcacaagaaaaggncaggatagctcaattggtagagcagaggactgaaaatcctcgtgtcaccagttcaaatctgggtcctgggnagagaaaaaaaaaaaaaactcgacctcgggcggcgaacacgctaatcgaaattcccgcgggccgccaatgggcgggncggggagnaatgcgaangccggggccaaanttcgcccctataggngaggtcgtatt

SEQ ID NO: 90572 - DNA, 488 bp, Triticum aestivum
  unsure (1)..(488): unsure at all n locations
  Clone ID: PAT_TA_90572
gaattcactaantgattaacgtggtcgcggccgaggtgtctcnagttttttttttttttttttttttttttttttttttttttttnnggcnttaccaaanangtatacncaatatctttatatattaanaaaanatgcccancaatcccttggntgngatgcggtacttangtncaaagggtaaaaatatcaaatattaaattggnatgcttaaaangngtnaaggnagctgccgtcntcantccccnccgttgggtcnaaattnttgggantctggtcggtgcatcctgccggcacangaaaaanancttgntgtgnccctttaccgtngaaggaaanantcttcatcgcatcctggttagnaacaaccaaagctgcctgggctcaagtatgggtcagnaaactgcacacncctgacattgtccctgctcctggacgaacangtgnccgtnctccancaancttctccaccgtcaacnttgggtgng

SEQ ID NO: 90573 - DNA, 606 bp, Triticum aestivum
  unsure (1)..(606): unsure at all n locations
  Clone ID: PAT_TA_90573
atgggccaacctggcaaggcggggcggcgaaaatcancaantggatccaggcgggccgccccggggcaaggtgagaacctannccccgagtttttttttttttttttttggccaatagggaaagctataatgtttattcaaagggcancaataagaaaanccccaattttgnaagggtctacctacctttcaattgggctttcgggaataaataagaagtaattccgggaataagcaagccaaaaatccntggggaaaaatcctaaagttaaanggatcaaataagggnttgggntaaaatnaattttagggnagggtattcctcaatactggacacaaatacaagggacaaagtaatatngtggaaatctanccctttcaanaaaatccgtaaantaaancccttgtaantggtttggttgggnntaaaggtccaaactttcccttggaccaaaactggcgaacctccgggccggcgaaccaacgcctnaatccgaaanttccccggcgggccgccaatgggnggggccgggggagcaatgnnaacgttccngggcccnaantcccccctaatangggaggccntantaaaaaattcnnctgggg

SEQ ID NO: 90574 - DNA, 663 bp, Triticum aestivum
  unsure (1)..(663): unsure at all n locations
  Clone ID: PAT_TA_90574
cactattagaatacncaagctangcaccaaagggggtggggaggctcctccaaaanggcngacctgcaaggcgggcggcgaatttaacaagtggatccgagggggccggccggggcaanggccncgagttttttttttttttttaaaaacaagaagttcaacttaancaaactggagtggtcctggacaaaccctcaacaccaataacatacacaacaactcaagangtttacgaagaatacccaatccttttacgaagaatacccaaccgtgatggnccaangggaagcctggggtaacctcctaacaaagggnccntaatgggataagtaatggtatataagcaaaaatttaaacganccatactttcgggaaaccaatttttccttccggggcgaacgcttggtccctccctcaaagaattggtgtagggacttgggtggtcaacgcaagcaaaaaaccaacttccttttgaatttggccttgggggggcaanaaagnattccaanccctcctcagtcctgggaatctttggccaagggggantcaagtaatccttgnncaaatccccaagcctttttctcaancccctggncttttggttggaataataaacaagtggaaccccatcaagcaaaaangctgggggncgttggacgtccc

SEQ ID NO: 90575 - DNA, 675 bp, Triticum aestivum
  unsure (1)..(675): unsure at all n locations
  Clone ID: PAT_TA_90575
cgggggacactaataggaaatactcaaagctatngcatccaaacgcgttgggggagctcctcccaataaggggtccgaacctgcaaggcggggcggcgaattcactaagtggattttcgaagcggnccgccccggggcaanggttttttttttccnactcccgacgaatctgtcaaattttaattggaaccaaggttttcaatgcaggttaagggacatgtaactgatggcatgcaaagccgggaatttcaacacaacactcctaaagcatcgtttttccttttttctctccccttaaaatacaccccttcttttggaggcaaagattctggaccaaataggcgccaaatcaccacacaatcttattcaagtctggcgtccaaacttttacaattttccaaggtcaaaccgccgaccttttgaggttggtcgttcctaagttcaaagctangcgnagaagcttccgaccgaggggaaagcgacnaaaaatgggatctgggacctcctccggtccgaaccgtcgaagaaagagggggcaacaatgcaacaaancaagaagaacttgatgcccggtggctggctccggccgaaaccgngagangagtnggtaatnacaananaaggttgcaacacgaaatccgcccgggngggcaatcccgaaggggaatcacaang

SEQ ID NO: 90576 - DNA, 574 bp, Triticum aestivum
  unsure (1)..(574): unsure at all n locations
  Clone ID: PAT_TA_90576
ggcgcgaaattcaactaatggattanccgtgggcngcggncganggtcttgggcgggcanattcgtgtcgttctaccctaagtcnttggtgtgtggtttaggggtcgatcgagttaaattatcccgcatgcaagttcatgggtgttgtggcctgggtgccggtaaggttccacnangcaagaagcaanagtggggtgaactgatattgtgtgcggtccgtactaacgttcgtgtctatgtaacgtgccgtgctttatcctataaattatcctccgttaaaaaaaaaaaaaaaaaaaactccgaagaactanacctgccccgggggcggncggctcgaaaaatcgaantccncgcgngcccgccatgggcgggccgggggaagcaatggcgaacgtcggggcccaaantcgccctataggtgaggtccntaattacaaantcaactgggnccgtcggttttanaaaccgtccgntggactggggaaaaaaccctgggcgtttaccccaaccttaatccgccctttgcagcaanaatcccccccttttcgcccagctgggggtaataancgaaaag

SEQ ID NO: 90577 - DNA, 496 bp, Triticum aestivum
  unsure (1)..(496): unsure at all n locations
  Clone ID: PAT_TA_90577
gggggncggcggaantcactantggattaaccgtgggcccngggcggagggtnccaanggcccctaatggctgccaaancttngagaagantgggctggttccacaaaatcgagggataatccgtccgaagcggccaanncgaagcctgctacanagcgtttgcccatgggcggcaactggcgtgatcgaattttcaactttacttttgcccggctttttccccgtctccccgccccgggcangaaacgtggtgcgttccaaaaatgggnaatccacaattgccccaaactcaaaggcgaagttaaatttttgtaggggggtggcctttggccaatgttatttttttanctgcaaggtcgggattctcanccggcaactccgctgggnggcctcccctccaactggcccttgtnaaattaaataacgccctgcaagcctttgggntgantgattaatnactaacgngncctaagaaaaaaaaaaaaaaaaaaaaac

SEQ ID NO: 90578 - DNA, 584 bp, Triticum aestivum
  unsure (1)..(584): unsure at all n locations
  Clone ID: PAT_TA_90578
gaantcaactnntgattaacggtgggtccgcgggccgagggttttttttaaagaaaaatgcctcctaataatggcaataacaagcaaggggtataacccaaantaatgtggtccttccgtgtaactatacacttaataaaacatcaagttattcacaatgtccaattttacattgccatcaataacatacnaatgtacaataaagaattgtttttgagggaacacatggaaaacaagaagttccttcaaatttctggcttttgggttttgggataactccccttgggcccgaatattggttggaccccaaancctcacaatttgtggctgncccaagnctcctaatccgcttggctcaaaagtcaaccgggacaatccccaatggnagaagttcaaaanccgtttctgtcgggtatcccaaanggggcctttgcaaaacttcaaaggcntaacaaatttgccaaatggcctttaaaaatttttccggggngntganggaggtaatcctttcatcccctaattngtcaatgaagtncctggacangtnttaaagtttggggcaaagccangtttcanaangcntg

SEQ ID NO: 90579 - DNA, 515 bp, Triticum aestivum
  unsure (1)..(515): unsure at all n locations
  Clone ID: PAT_TA_90579
gaattcactantgattcnagcggncgcccgggcaggtcagatnttcgtgaagacgctgaccggcaagaacatcacgctcgaggtcnagagcagcgacaccatcgacaacgtcaagggcaagattcangacaaggagggcattcccccaagatnagcaagcgcctcatcttcgccggtaagcagcttgaggacggncgcacccttgctgactacaacatccanaaggagtccaccctccacctggtgctccgcctcaggggtggcatgcagatatttgttaagaacctcaccggcaagaacatcacgcttgaggtcgagtcatcccgacaccattgacaacgtgaaggggaaagatcaaggacaaaggagggnatcccaccagaccaagcaagcgnccnatcttttgctggtaaacaactttgagggacggtccgcaacctcnctggnctacaaacatccaaaaaaggnggtccaccctcccaccttggtgcttccgccctcaaaggggtggtatg

SEQ ID NO: 90580 - DNA, 445 bp, Triticum aestivum
  unsure (1)..(445): unsure at all n locations
  Clone ID: PAT_TA_90580
gaattcacnagtggatttcnagccggccgcccgggcaggtccnaggttttttttttttttttgtcnaanagggnaagctatatgttattcaagggcatcaatagaaaacccaatttttgtaggtccnacttactttcaatggnctttcgggaataatangagtaattccggaaatagcangccaaaatcttggggaaaaacctaagnttaatgatcaaatagggtttgggataaaataaatttaaggaagggatattctcatactgacacaatacaagggncaagtatatgtggaaatccaancctttcanaaattcgtaaattaaacccttggaattggtttgggtggggattaaggtccnaacctttcctttgacccaaaacctgcngagccgccgggaacttttancnagatggaaantaggggaaaggaccaggcaggata

SEQ ID NO: 90581 - DNA, 489 bp, Triticum aestivum
  unsure (1)..(489): unsure at all n locations
  Clone ID: PAT_TA_90581
gaattnactagtgattaacgtggtcgcggncgaggtacaacaaaagagcattctaccaccgcaccgcacgagtgaagtgagagctttgcacgaaaagttcatcancgaccatgaagggcaccaagctcgcggngatnctcatcctccangccgtcctggtcatgggagtcctctcacacgtgaacgccgactatttccccaagtgctgcaacaactgnaggtccttctccggggtcnacgtctgcgacgacgcccaccccaagtgccccaanggctgctcggcgtgccgcgtggtgtcgacgagccccnaaatgtggcgctgcgcggatatnaaatccaacgtcgacgggacctgcggtgggncctgcaaagaagtactgatcggctcatgncancatgatatgttccgcctaaaatgaaataaaagctcanacgagatgagcaagcggtcatccgtgcctatgcgtggtgtgtgtggncaacaaatan

SEQ ID NO: 90582 - DNA, 479 bp, Triticum aestivum
  unsure (1)..(479): unsure at all n locations
  Clone ID: PAT_TA_90582
gaattcactagtgattagcgtggtcgcggccgaggtgatattgctaagatctaacaagtatacattattaactctagtttcagaagccatatgccatttgatatacccgattaggtggcagcatgtctacattccaataatattctctagtggtgttgactacattgatgctccgactccctacatgatgggacttcattcaggtgttgacacatctacagtgacgatggatggtgtagtggtggttgatctcgaatacaatcggataacaaccacggnagacattcctcctatacccgaaagcgaacatagtttcttgcgtggtgagatattgaaactactacagcccaatgttgtgggcattgattacatgaaaatcaatcttgggagtatgggtgactattctttaaggaccgcgacaaaatcatgggggcaagatcatgattttcaagcttaggctgatattccttgagaatctt

SEQ ID NO: 90583 - DNA, 486 bp, Triticum aestivum
  unsure (1)..(486): unsure at all n locations
  Clone ID: PAT_TA_90583
gaattcactaatgatttccagcggccgcccnggcangttagtctcnanttttttttttttttttcngggctggacgananccttgggggctgtctaagcttttttttttttttttttgggtgggtgtgagttgatttgctgggccccgtantacttgttgnttgatgctggntaggtgcctangccagtctctctcnccttggntcgcagtctcangcagtttttttttcnagnttcncaaaaataaaagtanatttgtttttctttaaaaatcaacggngngttgtttttcnatgggaaacaccggngttgttgttttttttttgagaaaacactggngtttggntgtgacnggtgtggagagtaactagagcgcnccnggtgagtggataaaanttcaaaaaaccaaacacacnaataggccaaaatagaaantaaaatggtccatnanaaggggaaaatgatagggaantcctgaagcnaaag

SEQ ID NO: 90584 - DNA, 248 bp, Triticum aestivum
  unsure (1)..(248): unsure at all n locations
  Clone ID: PAT_TA_90584
naattcantaatgatttccagcggncgcccgggcaggttttttttttttttgnaagtaaaataaaatctcacaaacgataccaattcttgggtttataaattctccacangnatccanacatacatgagtacataagatgaaactcangggnacnagcacccatggtttattggtatangngaagcancccntgtgngaaaacaaaaattcntccccgacgtgggtcnaancctggttgctggngaag

SEQ ID NO: 90585 - DNA, 579 bp, Triticum aestivum
  unsure (1)..(579): unsure at all n locations
  Clone ID: PAT_TA_90585
gaattcantaatggattaacgtggncccgggccgaagggntttttttttttttttaattcggttcctttttaattaaaccctcccntcnttaaccttaagtttaaccaantaacaataatatccaacggctcgaactccgaatttggtcgccttccaaaacttcaaaaggctgggggtantttaaggactctatttgcaagctggctcgggtaaattcaataccttcgcgaagcaaagattgcgcccttcggtacgaagcntggtacaacaaggcntccaaaagccaactcnattaagctgccngaaccaangtggcaattccccaaagggatgtccctaaaagttccctccaacaaaattggtaatacaanaatccgtccccnaaagaantttcggncaagaggctggnaatatggccaaaacaatggaataaccaacctggaagctaaccgggtaataaacaacctnggcaaagggntaaccaaatccccngaagtggaaaaaaanaaaccggcgaagcannnaattttttttcaaataaaaatcaatcggcgcaaatnaaatcaaanaaaaccntg

SEQ ID NO: 90586 - DNA, 470 bp, Triticum aestivum
  unsure (1)..(470): unsure at all n locations
  Clone ID: PAT_TA_90586
gaattcactantgattaacgtggtcgcggncgaggttcnagnttttntattttttttttttttttnttcatttnatttttntaagggtttcaaatttctaaattattttaanctcnaatctcnaatnaanaccccacatcaatgnncaatttntcctctaatctctaatnacccctcaacattccaaattatctnnntcccagatgganacccatcctctcacnacnccagnctgagcaagcttaaattctgggntaaaatcccccccgtttccaaatcngcacctgttgttttcctgatnataanaacgatgtcaaacctatatctgnccgggngggnggctcnaatcgattccccccggacgacaagggggggcnggngaaatacgntgtccggcccaacttccccaaaaaaatggggtcgtnttaaaaattaaaaggggggtcntttttaaaacgtcggggatcngg

SEQ ID NO: 90587 - DNA, 469 bp, Triticum aestivum
  unsure (1)..(469): unsure at all n locations
  Clone ID: PAT_TA_90587
gaattcactagtgattancgtggtcgcggccgaggtatcaccaagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggnagggtcttgcctacgatatctccgacgaccagcaggacatcaccagagggaagggcatcgtggactccctcttccaagcgnccacgggcgacggcaacccacgagggcgtcctnaagctcctacgangtacntcagccagggactcaagaagtacgncntccaacaaacaacnattgggaggnttcttat

SEQ ID NO: 90588 - DNA, 710 bp, Triticum aestivum
  unsure (1)..(710): unsure at all n locations
  Clone ID: PAT_TA_90588
gtggacactatanaataatcaaagctatggcatccaaacgcgttggggaagctcctcccaatatgggtccgaacctggcaaggggggggcggcgaatttcaactaagtggattaaccgtgggtccgccngcccgaaggtgaagaanaagcgaaanactggaattccctcctgcaccaacaacatgcaacaagccgggntaccaacatcgctccccaacaacccaacaaccaacaacttctttgggccgtgctgcaaggggctaaatttaaaagctacatgttctcctcccccgggacaactcctcttggcaatctaanccatcccgtctccgggccccgccaatggtgggaggntctccgccgggcccttgcccactttgctcccatggggaatcctccaaatnggcaaccgtcngggcaaagaataatacaaactaaangggacggggacaaagtttcntttgnaactggggngaatgaccngtnccatgaacaagccgaaactgggnccaagtatgggagtcgtttcaanaaatggccaatgttatggttggtttaanaatccaaacaaaangctccnaaaaaggagatngggtggccaancaattgggttnaagcaatgaccctcccataaacnaaagcaaannggnaaacgcgatgggnaagtncttgggnaacttgaaacctcaaaagttcttntaaagcctctn

SEQ ID NO: 90589 - DNA, 449 bp, Triticum aestivum
  unsure (1)..(449): unsure at all n locations
  Clone ID: PAT_TA_90589
gaattcactaatgattaacgtggtcncggccgangtccgccgcccgcgcctcctcctcgcccaaagnaagaagcttgtgaaaattctctaaagctgaagaaaatggttctgaagaccgagctttgcgttttancgggcagaanatttacccagggaangggatcaagttcaatcgttcggattcgcaagttttcctcnttgccaactcaaaaatgcaagcgctacttcacaaaccgcctgaagctgcaaagcttngctgggcagcaaatgtttnagggaagnancaacaaagaagggcatccatgctgaaggtgccaaaaaanaaggngccgcnccaacaaaaaancccgttacttcaccggccgnatttgnttggtgccanctcccggnaagttatccanaaanaaaaaggggcggaggaaaccctgaaagtccgttgttgcnggccc

SEQ ID NO: 90590 - DNA, 205 bp, Triticum aestivum
  unsure (1)..(205): unsure at all n locations
  Clone ID: PAT_TA_90590
gttgggaactcnccccaaaatgggccaacctggnaggggggcgncaaattaataatnaataagggnggccnccccggcnaaggggttaaaaanggagnaaaccccggcccncaaaagnaaaaaaaatttttnncaaagctnctggnaanaaaatttttnttgttaatgnaacctaaattaacaaatggtgtaancaacttttggg

SEQ ID NO: 90591 - DNA, 603 bp, Triticum aestivum
  unsure (1)..(603): unsure at all n locations
  Clone ID: PAT_TA_90591
cgcgaaattcactaagtgantaacgtggtcgcgggncgaggtcaagtatatactttccttttcaagaaataacataagtcaagtatatgctttctgcaagaagcaacctaagctggctggtactattggaatcctaacaaggtatttaaacaagatacaggatagaacttacaaagcaagtggagtaaggactccatatgggaagattcataacacaagtcaacaccttgcaaatantttcccaactcaatccggangtaagaaccaaattggntcaaaacnagcatggttccttggttttatccaaaaataaatgggggnctaaactggcgaactccaaacaataagncccatcaagcaagtacnanaatttggancttacnaaanaataaancnantgcaangaaattggttnggnttttaanaaacnggaccncaagnttcaacnaaacaattttaccaagattccaanttcccttcccaatttggcaggggttccatttaaacccaaaagggggcnccanggggttcccgnaaacnnccaaacccaaacanggtggggggggggggnggnatttcnctcccaggggggccaatttnttt

SEQ ID NO: 90592 - DNA, 550 bp, Triticum aestivum
  unsure (1)..(550): unsure at all n locations
  Clone ID: PAT_TA_90592
gaattcactaatgatttcgaagcggccgcccgggcangtccgcaccgcacgantgaagtgagagctttgcacgaaaagttcatcaacgaccatgaagggcaccaagctcgcggngatnctcatcctccaagccgtcctgggtcatgggaagtcctctcacacgtgaacgccgactatttccccaagtgctgcaacaactgcaagtccttctccggggtcgacgtctgcgacgacgcccancccaagtngccccaaagggctgctcnggcgtgccgcgtggtgtcnaaccaagcccccgaaatgtggcgctgcgccggatatgaaaatcaccgtcgacggnaactgcgtngggccctggcnaagaaagtatgatnggntcaangcaagcatgaaaatgtttccgcctnaaaaatgaaataaaaagctcaaaacgagaatgaagcaagcgtcatcgtggcctaatgcggtgtgttgtgttgggcnaacaaaataatgtntaaccaatatgccgtnttcctcctccncctggngtttttctttctcnaaaaaa

SEQ ID NO: 90593 - DNA, 183 bp, Triticum aestivum
  unsure (1)..(183): unsure at all n locations
  Clone ID: PAT_TA_90593
ggtgacactaatangaataatcaaagctatgcatccnaacgcgntggggagctcctccaataattggncnaaacctggcaagggnngggccgcgaaatcaactaaatggaantaaccgtgggtccnccgggccgaaggggaaaaaaaactaantcctccgaagtttttttttttttttttttt

SEQ ID NO: 90594 - DNA, 211 bp, Triticum aestivum
  unsure (1)..(211): unsure at all n locations
  Clone ID: PAT_TA_90594
gaattcactaatgattcnagcgggcgnccgggcangtggagaagaaaaaaaagaactantcctcgagtttttttttttttttttttanatttcaacattttttttaaaacgttaagcgtattcagtccggaaaagttaaagaaatgntcccaatttcaaactcnattttttaactcgggcggcgaacaacgctnaatcgaantccccgcgg

SEQ ID NO: 90595 - DNA, 474 bp, Triticum aestivum
  unsure (1)..(474): unsure at all n locations
  Clone ID: PAT_TA_90595
gggtgggggagctctncccaatangggccgacctgnaaggggggcgggaantcantaatgatttnagnggggcggcccggggnaaggggtcaaaatncctcctgtggcgtccgaaaggctgtggccgaaacccgacccgaggaantgtgancggatgggttcgggnttaaccccnaacattcctaaaatatcctcaacttcccaantaagcctccccgancatatttaatctcaaacggccggattntggatnnggnggggacaaagttanccctttaaccaaaaacccaattggatatntatataagggtcaaccctaaggatgttaggaagctttttccaataattcccaaattccggcgggcaacaatctttctcggggatttcaatccttggagccaaacaactncttccaacnnggttcaatccaatncaaanngattccctgccttccccttgaattccccaaccaaa

SEQ ID NO: 90596 - DNA, 517 bp, Triticum aestivum
  unsure (1)..(517): unsure at all n locations
  Clone ID: PAT_TA_90596
cccatccccaagtcataaaanccaaagtcggactcgccttcctcctccccaactactcctctcctccgcgcatcgcatcgcaacgggggtcanctgagatnacatacacaatggtgaaaggtgtggctgtgcttaccggcagtgagggtgtcaaagggcaacatcttcttcatccaagaaggagatggcccgaccaccgtgacnggnaacgtcactggactcaaaggaaagggctccaacggntttcacgttgcacgctccttggtgacaccancaaacgggctgcatgtcaaactgggacaacacttncaaaccctgctgggtcatgtgnaatgggggcancaaaaaagatnaaatcccccatgccnggtgattntngggaaatnntacaaaccttgnagccngntgggtggtttgctnacaaacnaatgtttactggactggcaataatccccccttacngggnncaaaattcaantntttngccgttncngttttncttcaacggtgacncttg

SEQ ID NO: 90597 - DNA, 275 bp, Triticum aestivum
  unsure (1)..(275): unsure at all n locations
  Clone ID: PAT_TA_90597
gaattcactaatgatttncaacggccgcccgggcaagtccggtaagttggttnccaaagacggnattcttaaagnaatatggncttacagcgggcactacctccctacaaagggagaacttcaaggaagttcatcaatttcttggnggagaacaatgtcgatntaactaacgtcaacaagtgtttccgtnggacgacgacaaatacccatccgntcaaaaaagagctcaaacgagcctactgaaattgggaagngatgacgaagaaaaccacccg

SEQ ID NO: 90598 - DNA, 367 bp, Triticum aestivum
  unsure (1)..(367): unsure at all n locations
  Clone ID: PAT_TA_90598
gggccaacctgcaaggcngggcggcgaaatcaataatngaantaaacngtggncccccggcngaagggtttttttttttttattaagacaantataaaacagggnccaggataatattaacgatggcttatttacancttacaaccaanaattaacatacataacacatccacacatgatacatttcccgcggaaacannaaccaaataacttatttttcctcaaaaacanacccaatgccntaatttgttccngcaaattaactgggnagggatgttgaagaccntgcgtgggtttttaattncaagtaaggggtaaattanaaagctaaccctaagcccaatccttggggaaacctccggccacc

SEQ ID NO: 90599 - DNA, 526 bp, Triticum aestivum
  unsure (1)..(526): unsure at all n locations
  Clone ID: PAT_TA_90599
aaactatatacctacataatacanccaagggccccaccgtgatggnctcgtcgggcaactccgttgctccttttcaaggggtcaaatncancgccgggctccccgtnanccgccgctccaacggggctaacctcgggcaacntnaagcaacggtggaaggnttaagtgcatgcaagtgtggcccaaccagggcaataagaaatttcaanacctgtcctaaccgccaacgctnaancaaggagggcctcctcaaacaaggtcgactaacttgattcngctccaaanttgggtggcctttgcctccaagtttaacaaaaggttgggttttatcttcccgtngagcaanaaacgcaaccccctggggtanctaacaatnggccgggtattgggacaatgtgggaaacttgcctaatgtttccgggtgcaaccgacncccacccaaggtnattnaaccaaggtggggggaggtcaaanaaagagntanccctgaccccttttntccncaattatccngattccaaaaaan

SEQ ID NO: 90600 - DNA, 735 bp, Triticum aestivum
  unsure (1)..(735): unsure at all n locations
  Clone ID: PAT_TA_90600
tggacactaatnngaaaaactcaaagnctaatgcaatccaaacgcggntgggggaagctctcccatatgggtccaaacctgcaaggcgggccggccaaatttcaactaattgattttccaancggggccggccccgggcaanggttttttttttaacaaaacggggaaacatcacnttttattggttacnaagccaattacgatngtcaaaaagntttcaaacaatgggcaatnggtgggaaaagatgatgatgttacaaacaatcctancgggtaagtgggtaagattcgataagcccccaacccacaacgggacgnagcctggggaaggctggctctcaaagcactaatcaaggtgaaccccgctngcaaaccttggggtnggnacaacgcgggagaacccggtaacgcccggtcctcgattaaaaagatggggggctnagaaacaatttcttctcngttacgacaaccaagcccgttgggattccctcccctcccactttgagcngggggccgggtcctcaacctcctaaatcctaaagaagtcctnccggctcggtnaaaaaagattaatgangcctgacctggcaaangaagggatgccaccaaagaattnttggggaatcccttggcttaaacaancctttgcaattggtattacngggaataaaaccctcaanaaacaagaacccttttgnnaaggtaccggcnccaaanaaattcccctnggggnaa

SEQ ID NO: 90601 - DNA, 634 bp, Triticum aestivum
  unsure (1)..(634): unsure at all n locations
  Clone ID: PAT_TA_90601
ggtgacactatanaaatactcaaagcttatgcatccaaacgcgtttgggaaactcctcccaatatngtccgaacttgcaaggngggccggcgaatttaataatngatttaacgttggtccccgggcccgaagggtcccgcaaccgcaacgaattgaaantgaagaacttttgcaacgaaaaaattnaatcaagcgaaccaatgaaaggggnaaacaaaagctccgcggggngattcctcatcctcccaaaggccgttccttgggtcaatggggaatcctcctcaacacgttgaaacgcccgactaatttcccaagtggcttgcaaacaactggaangtcctttctcccgggggtcgaacgttctggcgaacgaacgccccaaacccaaaagtgnccccaaaaggggttgctccnggcgttgcccgccgttggtgttccaacaaacccccgaaaatgttggcgctgcgcgggtaatnaaatccaancgtccaacggcaacttgcgggtngggccctggcaaagaaatanttggattngggntcaatgncaacaatgaatnttgtttccgncctaaaaatgnaaataaaaagctcaaaaccaanatgaggaannggtcaatcngnggcctaatgcg

SEQ ID NO: 90602 - DNA, 461 bp, Triticum aestivum
  unsure (1)..(461): unsure at all n locations
  Clone ID: PAT_TA_90602
gcgaaattantaantgantccagcgggccgccccgggcaaggtttttttttttttttttttggtccgccaagcgggaagaaggtggccgttttaattacatnacacanaccaattggctaacaataagggttggttttattaaaatcacacacgtanccaattgccaaacaaaaagggtttggnctccccnccgaaacaacnaaacaattttgaggcctggcccaanncctcaagtgcaagctcccntngagggaaagtcccgcaatgattcaaaccaagaaancaacttttccaanccaatctggggtcaaanggaaaaganggggaatttttggnggttcaaaccccccggnaatgggccctgggctngcccttaaaaatcctttccaacctaantttcnttgggtaancaanctcaaatggcttcaancggctccnttgttaaaaaancgtcaagtgg

SEQ ID NO: 90603 - DNA, 348 bp, Triticum aestivum
  unsure (1)..(348): unsure at all n locations
  Clone ID: PAT_TA_90603
ncaattcactaatgattaacgtgggtcgcggnccgaaggtgggaagatnaaaaaaaccaatgatgaatggnggccnaagtaagtatataccgtataatgttttcccatgaagtttaaagtttttgttgaatgccantccgacatccgatgcacaccacgnaactgattgctcngtcntaatgaaagacctcttttgagtaagaaagtggtttangangaaatttgttgtnacaattgantaaatttcctgtcnccgttgttgtacgaaataaaacaatgatggattccacnctggaangaacaaataanagacccntaaangaattttctttctgggcnccanaacac

SEQ ID NO: 90604 - DNA, 283 bp, Triticum aestivum
  unsure (1)..(283): unsure at all n locations
  Clone ID: PAT_TA_90604
gaattcaccaatngaataacgtggtccnccggcnaaggtgaaaaactaatccccagttttttttttaacactaatgagaaaattgcttgccgtgtatgancgattccgacgaatcctttttttttcccccttccaaggtgaagnaaanangtgcttggttttttaaaccggccacnggtaaaagacaatactggtacaanaccacgtangtacactgggagtggggggtgcttgaaccngggtataatgaatgcaaaatgaattaaataagggntttaacaac

SEQ ID NO: 90605 - DNA, 387 bp, Triticum aestivum
  unsure (1)..(387): unsure at all n locations
  Clone ID: PAT_TA_90605
gaattcactaatgattgcgggccccccgggcaagtcctgtgtgttataaanggctaagttataagantaatataacntcnatnaataagggatngatttcnnagtcngcgtagcttcanaaaaaatttgcaaaagnttccgcataatttccttcggattgagccaacatcccgtttacgggcggttcaatctaatcaaaaaatctccgttccaaaaaccgtacatggangggtttcatctcaatacgggctcctncccttccggtcaataaataagtaacnaaagcgaaaataatnctattngaatcaaaaataagaatttaggccccgtcctcaantatgaaacccgaaaangggggctgggtaatttttccaaagnaaaatctcc

SEQ ID NO: 90606 - DNA, 573 bp, Triticum aestivum
  unsure (1)..(573): unsure at all n locations
  Clone ID: PAT_TA_90606
cggggacactaatagaataccaagctatgcatccaacgccgtggggaagtcccccaataatgggtcgaactggcaaggcgggccggcgaaattcaactaatgattaaacgtggtcccgggccgaaggtgtctcgaagttttttttttttttttcccctctcttcccttctcctcatcaaacatccctcaaacctttgccctccctcaagtatccttcttctcctcctcaacttcatcgtcaagaaaatttccttctcaagtgggccttctcggtccaacaaggaagatgggggtaagctggataaaaactcaagagtggctttcttaactanaatccttggatggcgggggctccctcaaaggtantccaatcctgggtcgtccttggagggaagagcaacaatcntgggtacccctgccgaagctgctccccaagacgtatcaacgaagtggacgggtgaaagggagccaaccgggcctgaagactccccanaacgtaactgnctccgtcngtcgnttggtgccnttgggtgggnggaacgaacnaaccctcctccgggcgaacnaaggtaa

SEQ ID NO: 90607 - DNA, 576 bp, Triticum aestivum
  unsure (1)..(576): unsure at all n locations
  Clone ID: PAT_TA_90607
caattcactaatgattaaacgtgggccccggccgaaggtgtcaaattaaaccggttttgggacttgggtcncaaccccaaagatctgggtcgaancactgggagttttcggccaagagangcatcctcaatgcgggaaaatgtacttctcactgaaacaagccctacgtttcaattcatttaacaactgggggaggaggggttgtccaagggatctcacttgggtacctccggaacaatgatgtttgatttgcaaaggatgctgcaagggattcactttngacgaaaccctcctggggggttcacaagtatcgattctccaangaagaagcaaaaattgggnctttgctccaaactgaacccttttgttttgcggggggcaaaaacaacgtcctgccctgcacatctctatggggccaaataaaagtgtatggtaaaaaattttttnggcaangggtaaanggaaggtaaaaaatgttttttcaaattancccgtaatccccgnaccccggggtggaaancctanaatgccggtatgtccgngtaaanggtgggggggggnaaaaaaaagcaacac

SEQ ID NO: 90608 - DNA, 587 bp, Triticum aestivum
  unsure (1)..(587): unsure at all n locations
  Clone ID: PAT_TA_90608
attgattttcgaagcgggccgccccgggcaagtccaagttttttttttttttttttgatagaagaccttggaacataagataggattgtgcccaaccaatcaagaaagggcaatcaacatccaccaaacataatagccgcataagtttaccccaaaggngacttcaacaaanctccctaaaaagtaaaataacacaacctctcaatgggcatcactaagattgcaaaaanggtaactcngtaatttacaatgccnaattctggattttgacaagatgattgagggctcaacctcggggcgcgaaccancgctaaatcnaaantccccngcgggccggccaatnggngggccggggaagcaatggngaaccttccggggcccaaatttccgccctnanaaggtggaggtcggtattaanaattcaacnngggncggtccgtttttacaaacggtccgctgactggggnaaaaancctgggcgnttcccaacctttaatcngcccttgcnaagaaaaatccccccttcccccaacctggggggttaaaanccgaaaaaagggcccncaaccganttgccccttccccaa

SEQ ID NO: 90609 - DNA, 592 bp, Triticum aestivum
  unsure (1)..(592): unsure at all n locations
  Clone ID: PAT_TA_90609
gaaatcactaatgatttccnagccggncgccccgggcaaggccaagtttttttttttttttttggtccaataaggaaagctatatgttattcaaagggaacaaataaaaaaccccaattttgnaggntctacttacttttcaantgggntcgggaaaaataagagtaattccgggataagcaaccaaaatccntggggaaaatcctaaagttaaatgatcaaataaggtttgggntaaataanttaanggaaggatattcctcaataccngacacaaatacaaagggcaaagtatatggggaaatcccaacccnttcaaaaaantccgtaaaataaaacccctggtaattggttggttgggattaaaggtccnaaacttttccttggancaaaactggccgangccgcggggaactttaacgaagaatgaaaatagggggaaaggccagaagantngaattagaaccttaaaanggntaaattgaaagtggacttggcctcccaaaccaacctttgggtgggggtccnaaaaaaagggaataaaaaataaanttaaattcaaagggaanngcttccnttttttttttaaaac

SEQ ID NO: 90610 - DNA, 580 bp, Triticum aestivum
  unsure (1)..(580): unsure at all n locations
  Clone ID: PAT_TA_90610
ccgacctggcaggcgggccgcnaattcactaatngattatccggccgcccggggcaaggtccggggcaaggtccnaatccccgagtttttttttttaattcaattgtttatttaccccttatccaaaaatttccttgaaaatcgnaatttcattttttcattcaanngggggttagatgatcnaagttcttaaaaattattactttactcaattggacaaattccacaacaaatcncttgattcggaattagggacncaaggtancaacctgangaatccacctttccttttacacttccggtacctaacnccaaccttgttttttaagtattaaccaaaaaanaaccggagggaattatggaatttccaanaacttaagggtaaatggctttaccnancaataaggtngggggtagtaaaaanaaaaaaataaaangggaaatttaacnccntccangncttactttaacaaagntanttttgggntttccancgggggggnctttaaccaaaaaaccccaanccnctaatttattggggttgaacaaaaanancnccttaatttggaantggccgggg

SEQ ID NO: 90611 - DNA, 219 bp, Triticum aestivum
  unsure (1)..(219): unsure at all n locations
  Clone ID: PAT_TA_90611
gaattcactaatgattgagcggncgcccgggcaagtgttctttgttggngaaagcatgcatgatgatggcggcgtggtgttcgcctacnacaaagagggagctgctgatccaactttcctgtactttgcacatgggctgaaagangncaagtgctaatcncacngnatggtaaaatccaaagccgtcctcanataantttgctcctanccaaaggggtg

SEQ ID NO: 90612 - DNA, 267 bp, Triticum aestivum
  unsure (1)..(267): unsure at all n locations
  Clone ID: PAT_TA_90612
gacaatataagaatactcaaagctatgcatccaacggcgttggggaagctcctcccaataatgggtcgaactggcaaggngggccgcgaaattcaactaatgattaacgtgggtccccggnccgaaggtgtctgaaggaacaataacaaaaaatttccttccggtcccctcaantttgtttgtaccaaaatgtactttgaccctaaaaaccctgacaatanttgagtggggnaaaaanaanacccaaaatngcncaaagaaacaaca

SEQ ID NO: 90613 - DNA, 600 bp, Triticum aestivum
  unsure (1)..(600): unsure at all n locations
  Clone ID: PAT_TA_90613
gaattcactaatgattttcnancggccgcccngggcaacggtgaaccctgttggggcgaacggntcctaacctcctgttaatccggggtctcctcctaaaanccaatnccgtccgggggacggnaaatccccngcnaagcaagcggctgggggngaagtaaaaatnggaaagcgccgcaacaaaaacaaaaaggggaatcgggngcctggggacgaacccaaaaatcccaagggggggggcggncccactgtggggcaacccctgtttaagattccacaacccnagccgggggnaanaatgccanttttcnaaactaaantttatggaacnattttnatnctgaaccaaattaaacaaacnccngtttttaanaaaaaaancaaaaattccnattttggaanaancnaaacctngtttaacctnnnatgggggngggggcaantgtttttttttacnacnaaaccanagtttttcnngattgtntaaggggntcaaaaaaagggggggaaacccntanccaanantttttttttcnaaaaaaaaggggttnccccccncctttntttttaatnaacccaccccngggncccaaaattgtt

SEQ ID NO: 90614 - DNA, 565 bp, Triticum aestivum
  unsure (1)..(565): unsure at all n locations
  Clone ID: PAT_TA_90614
aggngacactaataaaatactccaagctntgcatccaacgcggtggggagctcccccaaaatgggccnaactngcaaaggcgggcgcgaaatcactaaatgaatccaacgggcnccccgggaagtccccaaaaattgatgtgtattccaagtcnaaaggagctgctgggaatcaacnaaaatgctcnnaatgggggangttaatggtgctgtaatcaaaagaccaantgccccaaatgcctccangaaagattccgaagtaattccangctgttattgtcgtacatgtaaagaggtcaaatgcgaaagacggnataaaaaaccgctatgatgacaatggctgcgggtataaattgatcaaaaanggaatccaaaaaaggaactcnagttttttgggcgccnattggccgagggaaattgaganggatttgaattttaccaaaaataagtttcaataactccctggaagtattataaaataccaatagggcgaaaattggngaatcnaaagnaattaaatttaanaaaattggggttttaacntanaaggcctttaanntcccccc

SEQ ID NO: 90615 - DNA, 349 bp, Triticum aestivum
  unsure (1)..(349): unsure at all n locations
  Clone ID: PAT_TA_90615
gaaatcancaattgattaacgtgggccccgncngaggnttggctaancttnganggnggatatggngggaaaagncaaaatggggggtgtcaccaaaaaaaacaagacctatntatgtgttttgaataaaacaatgtttantcccanaaaaacaatgcttgatgtgnttgaaaaaaattttgctccttatgcctcgcaatatacnaacaagggtacctataaaaacaatccggtagtccctangtttaatgcacgatatgtcaaaataagattccaaataatgtgggaacatgttggnaaggggtttcaataaaaggaataaatgtcctaagtttggttggtcctaaaa

SEQ ID NO: 90616 - DNA, 436 bp, Triticum aestivum
  unsure (1)..(436): unsure at all n locations
  Clone ID: PAT_TA_90616
tccaagctaatggcaatcccaaacgccgtttgggggaaggctcctccccaanatngggccgaacctggcaanggcngggcggcggaaattcaacnaagnngaattaaaccgtggggccnccgggnccgaaggttttttttttttttttgggnaaacctgaaagcaananaaaaatgttcaaaggggggnggggaacaatacaacgaatcaagggaaccggcnangattctggactngggagaaaagtanccaaaaaactccttaatatatcctaatccnaaacgcccgcctccgaccnaanaatgggaaccctggggcaaganggcaaaatggaaactttcaatttccnccgacgaattaaaancaaaaaatgganccgggcaattggnggcaancaagttttaaggccaanngggnaatcaantccaagttggtc

SEQ ID NO: 90617 - DNA, 558 bp, Triticum aestivum
  unsure (1)..(558): unsure at all n locations
  Clone ID: PAT_TA_90617
gaattcaactaagtgaataaccgtgggtcnccggccgaaggtctantccncaacatttttttttttttttttngangcactggaanntattcnttcccaanttattcccccctgaccaagttaatcctaaaannattcgtccancaaaaaaatanatccttctaacgctggaccggaccgtaaactacnngcctcgtncgtcgcgggngacaactaanatttgatcnggggttcccttaangtacgtacgttacaagttcctttaanttangttacatgatgatggggccccnaaggggaatgatccaaacgggaacctaatnatgtacnataatgggngcnaaccgcaaggagcaacgggtgaaanaagatgggccggacnnaanctccccntgcgggttntcaacaaaggcaaagggnaaagnccatccgncctgnctgtngctaaaanaaggggnntggggnaagggaanaaaaaagggntaaaatccccccgganncaaagtttgctttngatncttgcgggaggctccggncaaaanaccccaaanccccgtc

SEQ ID NO: 90618 - DNA, 488 bp, Triticum aestivum
  unsure (1)..(488): unsure at all n locations
  Clone ID: PAT_TA_90618
gcgaattcaataatgatttcnaagcgggcgcccgggcaagnccgggcaaggcctagtcccnagttttttttttaaatcaaatggttanttaactcctaatcaaaaatttcccttgaaaatccaatttcaatttttcaatcaaaggggntaagatgatctaagtctaatattaaataccttacncaaatggacnaattccacaacaaatcctcctggattcgggaattaagggactcaaggttcaatccggatggaatcccacnttccttttacacctcccggtancctaactccnaacctgggttttttaagaattaacctaaaaaanaacctggatggaaattaaggaattttnccaaaaaccntaaaggnnaaatggcttttaccaaacnaaaatggttggnggtaggtaaaaaaaaaaaataaaantgggaaatttaaccncctttcaangcctanctttaaccaaagttaatttttgggttttc

SEQ ID NO: 90619 - DNA, 579 bp, Triticum aestivum
  unsure (1)..(579): unsure at all n locations
  Clone ID: PAT_TA_90619
ttacggtgacaactaataagaatantcaaagcctatgcatccaaacgccgttggggaagctcctcccaataatgggtccgaacctggcaagggcggnccgccgaattcactaantgattaaacgggggtccccggccgaaggtgggggctttcccgaacaataatgggtgtacccgattgacaaaattgatatcatcaactgctggnatggggaaaagcattaactactgatgggtgggttctgtacaagaagtgctaaaagttgttgatcaacaacgtctaaacaagcgctgggntacgttttctctgncctctctgccaaccctatcttgccaatgncgcaatttctgctggnaaactacctgggagggagaatccntcnattctcgctaacctaaaggagcaatgttgccgcttcctgcaatgcaaggactgtcnagatgcaccaaagaactttgagatttcctaaccaatgccctgtcaaccggattcgtcntcccttaannctgaaanaaaancgaactgggntctnctgggccanctggaccctaaaattnttccttgaaaaccnattgcccg

SEQ ID NO: 90620 - DNA, 571 bp, Triticum aestivum
  unsure (1)..(571): unsure at all n locations
  Clone ID: PAT_TA_90620
ggtggacactaatagaatactcaaagctatgcatccaaacgcgttggggaagctcctccccnatatngtccaaccttgcaaggcggggcggcgaattcaactaagtggatttaacgtnggtcngcgggcccgaaggtcaaaattgtttggttcatcctcatctcaagcgtttatcctccaacccttttcaaatcactaacccaaaccggagtactgaaacatgggcgaatgaagaaggngggtaacaagcaaacgccatgtccttgggcgttcataactcctaagttggtggggtccttggtagcccctaaaagcaaaacccaagcaaagcacaaggcatcccaactgttgttgccatcctaagaactcggtccctaactattttcaagtggccgcggaaaaatctgacaagcaccggtcctcctgaagtgttgccgggtggctttctggctgggctataatatccaaaacgaacgcctgggnttttgagntgcaangtctnggctataattggatataaaagactggaactggcaaaggccaaccaaactactggcaaagaatttgggtg

SEQ ID NO: 90621 - DNA, 208 bp, Triticum aestivum
  unsure (1)..(208): unsure at all n locations
  Clone ID: PAT_TA_90621
aaggggcgaactggcaaggnggggccgggaaatcactaatggatttcccaagcggnccgccccngggcaaggnggaaaaactaancctcgagttttttttttttttttttgnaaggggacaaaaaaaagaaaactcgggcctccacaacaaaaaaaacnaaaagcctttacaaagtacgaacngtttaatactggacaatctggagcc

SEQ ID NO: 90622 - DNA, 597 bp, Triticum aestivum
  unsure (1)..(597): unsure at all n locations
  Clone ID: PAT_TA_90622
aacctggcaagnggggcggcgaaaatcactaatgaataacgtgggcccnggcngaagggttataaggattaacaataatctgggggggaaaaatccaacttcgggggncacctgcttctaacgttggcaactcctcaaactgnagcanctccctaatcatctgttnaatcaaccacttctcgtgtgcctgcaaagaccttcttatgaaatcttctgaagctcctaactaataaaaaacccacatggggactgccaactctaaatgnttccacacaaggaaaataaaaaaggggggtcaaaatgcttcaaatggcctccctaacctcccaacanggnggnaactaacnttattccctcaancaaataattcctgggatntaaanaancactcnnaaaaccggggaggtcaaagtgtttctanaacctcaactccccaaanttggggtcaaaaannttcaanaccccaatatcccangaactggangaanatttaaccannccctaagggaaaaaggaagtccttccaccnaannggggtcccaaattggggaangtgggaattcnaaaggngngcaagaacctggcaagcccaaggna

SEQ ID NO: 90623 - DNA, 592 bp, Triticum aestivum
  unsure (1)..(592): unsure at all n locations
  Clone ID: PAT_TA_90623
gacactaatagnaatactccaagcctntgcntcccaaacgcnttggggaagctcctcccaataatggtncgaactggcaanggngggcgcggaaattcactaanttgaattaancggtggtcngcnggccgaanggttttttttttnangcaaaaagaaagcaatatgatnaaccaattgggtactggagaaatgggnaaagcaacatgtggtcctaattttagcaaaacaaacgccngtgatnaagggagtaagtgcttcactnctcnaatgccttgaanttaccaaccacgcngagctaaagatacacaaacaaangccgggcaaagntgtctccgtccactgcccttgttccaatacgttgaggccaatctcaagctgaaactncctctaaccnggtgggttgcacttgtcctgaatanggagaaagggatggctccccccaaaaaggccgccggtcnggccgttcngnaaaagggaagcggttaaaatggaaccngcgctggntnggagggacaaaaacccccccatggggaacnggngnccaangggggaaccccnaangaaggcncctccctgcnccnaagggatt

SEQ ID NO: 90624 - DNA, 251 bp, Triticum aestivum
  unsure (1)..(251): unsure at all n locations
  Clone ID: PAT_TA_90624
tggggaactctcccanatnggccgaacctggaangnngggcggcgaaantcaacaaatggattaacgtggnccncnggcgaaggccccaagttttttttttcaaaaataaattaaatttattgagggagnaaaaagaaagctcaaaatttttgcctcaaccccaaccggaaaagtccaaatacaacctcngncaccantttacaanttancnaaggataataagntaacaacctgctccctccgttttcac

SEQ ID NO: 90625 - DNA, 734 bp, Triticum aestivum
  unsure (1)..(734): unsure at all n locations
  Clone ID: PAT_TA_90625
tgacactatagaatactcaaagctatgcatccaaccccgttggggaagctcctccanaatggtcnaacctggcagggcgggccgcgaaattcactaantgaattaaccgtgggtccccggccgaaggtttttttttttttttttttggataaaaaaccngggaaaaaacaatatcgcaaaattcccaataaagatgttgggttancacacaaggaacaagggataacaaaactaaacgatgtccttgttcaacaacaaantgctgggaacggggaaaacaactaataagtaaaagatataataagattctcaaaggcaacaagtccgccgaacaagaaccctaagcaaacgaagcaacgaacaanccccnnccgggggggnccttgattcttccttcctcgggcgattcttgggagaatgaagccttgggnccttgaacgaaccaattgggcnttcctcccgaacangnaancccccttgcccgaagcaanccttgaaantaacccgaactggcgaanaacgtccnaccaacnggggggccnttgtcaaccaancgggnctcctggccggcctttctccgggccgggtaaccaaatggaaccaaaaagccctcccccaaccgtttgaattcgtcccggaggttgtaaaaaaacctggtttgcctgaaaccttggtggggaaattaaccncaaaaaccgganccnttgcccgaaanttaaccccgggaatgggnn

SEQ ID NO: 90626 - DNA, 505 bp, Triticum aestivum
  unsure (1)..(505): unsure at all n locations
  Clone ID: PAT_TA_90626
ggcgcgaattcactanatgattaacgtgggcgcggncgagggttttttttttttntttcangaaagcangaaagctccnccaaaaataatctctnaactccctnactaatctcttnattgtttcangaaagtatggatatataaaaaaaatagcaagatatttacancacaaataggagtgacctacgtaaacaaatcagcttggcagcacaactaanaaagccagngacctatgctgcaganaacancaaaccaaaccttaanactacaaagaattaaacatccaacntttntnaaaaaaaatggnaagaattcanggtggcanttcntcnaaagccgatganaatgggaggaagtgaatacggggngctcccgntgctgctggtggtggtggccccttgnttcatcaattggnaggcccncaaattcaagaagggcttcangngcaagntcatcnacaacaacaccaacaataagggtgggccccccnancatcnttagtcgg

SEQ ID NO: 90627 - DNA, 625 bp, Triticum aestivum
  unsure (1)..(625): unsure at all n locations
  Clone ID: PAT_TA_90627
gaattcactaatgattancntggtcncgngccgaggtgatagtaatagtcaatagcaaagaantcacaatggtcatggagaangctgcgggggcaatcaangcaagggaaagtctttgaagaaagggaaanaatgaagcaaggcgggcnaaanggatganctgggaccgccangnagcaagctngagaanaaanaagnccccggcttggagaaaagcgctcgcaaaactcttgctgccaatcaatctcnggangctgggggaaagaaagaaancaacaanaagaaacgaaggagcaaggaaatggcttggancgaaacaaaggcgctttcgataagtccgaaagccggtccgctccttcaatgtcctcaatnagggtgaaggactcccgaattgaatccccgccnatcctgggcgcttgaaacaaagccacaaaaaanattcaaaccgnacttggggaacccctccnggcccggtctgggattttcgctcctgggacaaccgcaaanggngcaaacccgattatctnactccccccgggtngggctcaattgtngggccaaatnaaancttattccttccaanggggtcanncgtttgggattnnncttggggcnacccccnatn

SEQ ID NO: 90628 - DNA, 667 bp, Triticum aestivum
  unsure (1)..(667): unsure at all n locations
  Clone ID: PAT_TA_90628
gcactaatagaaatacccaaagctatgcaaccaaccgcggtggggagccccccaataatgggncgacccgcaangggggcgcgaaatcactaaatggattaaccgtgggcccnggncggaaggnggggaactngaaaccccacaaacttaaaaaggccgacggggttttccctttaacnaagaaatttcantgntggcaagtaatggacaaggtagaaagggactcncnccttgtcccccggtccggattaatccaacttttttaaaaagatctcgaaaaactttggaatttggaatttgaagaaatttggattaatcaataattccgantgggggtgggnttcacaataatgaaaaaaaattatggatatgaagnttttatggagttttttaatttcaataaatcaantaacaaattcnaaatttcaattttttaaaaaaaagataaaggaacccanaattaataaattatnaataataataatggaggtttctggtggaattaaancngnttggcctaaaggtcaagtaaccnaaaacgtggtttaattaaaatggtatnaaagggantaaaaaaccccccccttccncctaaattttagaaattagaaagggaantncaactaaacaaacaacaaccgtaattaaccncganttcngtaagaan

SEQ ID NO: 90629 - DNA, 613 bp, Triticum aestivum
  unsure (1)..(613): unsure at all n locations
  Clone ID: PAT_TA_90629
ggcgcgaattcaataatgatttccgaagcgggccgcccgggcaaggttacctactcctaaaggtcaaaagcaaagccctttaattcaattccttattcttacattaaaattcttacattaaaagaatggaataaaatctccccaaagtanggattccgaacctacgaacaatcaagtttacaagccgaccgctcctaacactgagctactggagggaacaaaggggggggattccgacctccctaanaagtttnaactcccggctctcaaaccccaaggaaacaatnatgagtcccgaagccttcctttcgttaactccccaataaattttccttcgtaagtgggctcccgtttccaatggcctcaatttcaaaangggaaagccccaaaagtnggntccaatttcaaatcctaantttcaactttcccnaagcanctttccctaatcaantttaaatantccaacccccttttggggccttaattggacnaanaaanagaatggtcaantttaaaaannccaaacccccttttcnaaaanaaagggggaaaaggnaaagnaaanttctcaatcgaaaacnatcngnagaaaattgtgnaatatanaaaaaac

SEQ ID NO: 90630 - DNA, 542 bp, Triticum aestivum
  unsure (1)..(542): unsure at all n locations
  Clone ID: PAT_TA_90630
gaattcaataaatgatttcnancgggcgcccgggcangttttttttttttttttttttttaacagcancagcaaagagagttttctacaactcggncaacagactaataacaagcaaagtctccggtggtctgcgaataaaaccgaccaaccccaaacccaacaaaaaagtaaagtaagcaccaattatccatgtctccccctccctactaacccattacaaaaaattgggtcccctttaaaaccatctacaagctcgtcatgggtcctcgtcgtcgaagccgccgtcgggcgccctccgccgcccgggagctccgccggacctctggtacacgggccgacacgaagggggttgcaacaacgggccncccaacctccctttggagcttcctcctccgtaagtcctccctttctcgggccggtctgggtttctcgtccaagccaactccaaaagcctccnttgnggggggctccctccaactttctccttctcctccnctctccaannttggtccgccaagcttgtcctttgtcnccgacggg

SEQ ID NO: 90631 - DNA, 176 bp, Triticum aestivum
  unsure (1)..(176): unsure at all n locations
  Clone ID: PAT_TA_90631
aataatcaaagctatgcaaccaaacgcgttggggaagctctcccaatatnggtcnaacctgcaaggngggccgccaaattcaactaatggantaaacgtnggccccggccgaaggtggtnataacctggctattttctcaagattaatcaaaggatctcctgttcttccgggttaa

SEQ ID NO: 90632 - DNA, 557 bp, Triticum aestivum
  unsure (1)..(557): unsure at all n locations
  Clone ID: PAT_TA_90632
gaatttactaatgatttccagcngncgcccgggcaaggccagttttttttttttttttgntaaaaaccttgaacaaaaataaaatggtggccaccaatcagaaagggaatcaacatccaccaacataatagccgcataagttaaccaagggggacttcaaaaaactcctaaaagtaaatnaaanaacctcctcantgggatcactaagaatgcaaaaaggaactccgtaanttacaatgccaanttctggantttgncaagaatggatngagggtcaactccggccggggaacaacgnctaatccaaantccccgcgggccggccaatggggggggccgggaagcaatgccnaagtcngggccccaaantccgccccnanaagtgaggtcgctaattaanaaattcanctggggccntcgtttttanaaacgtcctggactggggaaaaacccctggnnggttacccnaacnttaaancgccnttgnaagnaaaatccccccntttcgccangctgggggtaaataacnnaaaaagggccgccaccngantngcccn

SEQ ID NO: 90633 - DNA, 563 bp, Triticum aestivum
  unsure (1)..(563): unsure at all n locations
  Clone ID: PAT_TA_90633
gncggcgaattcactaatgattaacntgggcnccggccgangtctttggcggncaaattcgtgtcgttctaactaatcnttgtgtgtggtttaanggtccatcgaagttaattatccgcatgcaagttcaatgggtgttgtggcctgggtgccggtangttccaacnagcaanagcaaaagtgggtgaactgatattgttgtgcgtccgtactacgttcgtgtctatggtaacgtgcggtgctttatctataaaattatccctcgttaaaaaaaaaaaaaaaaaaaactccaagactaaaaccttgccccggggcgggccgctcngaaatcgaaattcccccgcgggncgccaatggcgggccggggagcaagncaacgtcngggccccaattcccccctaatagngaggtccgtattaanaattcaaatgggccggtccggttttanaaacgtccntggactggggaaaaaaccctgggcgttaacccaaacttaatccgcccttgcagnaanancccccctttccccaaactngggggttaataaccnaanaagggcccgc

SEQ ID NO: 90634 - DNA, 527 bp, Triticum aestivum
  unsure (1)..(527): unsure at all n locations
  Clone ID: PAT_TA_90634
gacactatagaaatactcaaaagctaatgcatccaaacgcgtttgggaagctctcccaannatgggccgaacctgcaaggcgggccgcgaattcactaagtggattaaccgtggtcgcgggcccgaggtcccgccggcgaaaaagaagctggaagaaagcgaagtggccctttttgggctggatgggaagttaatcgtcctctgttttttggccgcgggtgatgggccttgccccctggatgcaaactttgacaagtaaaaaaagtcgaaataaagtgttgacaagcgggtggcccgtaatttttgtaataagctttctgttggtttgtgcaaactcaaattcttcaatcccgtgggactaaccacctttgggagacaatgggggatggaactctttgtgaatggggnaaaaactggtagaaacccggtattctcaactcccccttgacgaagaaaactctacaaggcctgcctttaattttgaagccttccttgggaaactaatggttttttttcctaaccccaaa

SEQ ID NO: 90635 - DNA, 547 bp, Triticum aestivum
  unsure (1)..(547): unsure at all n locations
  Clone ID: PAT_TA_90635
gaattcactantgattaacgtggtcncnggccgaggggcaaacaccaagacaacaagagttcaagtgagtttggnaccgatggaggaccaacaagcaaaagtntctcaaggccaaagttcaacctgtttgtcaaagcangtgtccgccggcattgggatgggcggtggcacacaatcgataatcaagtcctgtcaatggcctcaacatgtttcttaaaagnctttggtggnctccttttcatcaacancanctcgttcngagcgctcgtccctgcttgtttacctggcaatcaaaaaccctgtcgtggtacgaacttctacaaactacgacatgggagtcccaacaaattttgccaaagctcttcanccaatgttttcaaaaaaaacctggggccctaattcgggnggcggctggctccttccntccctgggggggatngaagnaactccaatccccaaagggaggggnanctccnaagangaaaaggggcgncnaaaagggcaaagaanaaacctngaangcccangccaaaccaaagncaaaggg

SEQ ID NO: 90636 - DNA, 544 bp, Triticum aestivum
  unsure (1)..(544): unsure at all n locations
  Clone ID: PAT_TA_90636
cgcgaattcactaatgattgcgggncgccccgggcagggcctagtctccaanttttttttttgttttnaanaaatataaanntgaaattatgactnacnaagnaaaatgattcaactttttttttttttatttntataanaanctttatttagggangaaaataacntcngntacctaggtattntaataactttttgaanttaanccaacnaaacccaatcttaacttttaantatntcaatgagataaatttttgaaaaattacgaatttcagnaggtttttccttaaatccattttaatttattccttcaccaaaagagataaganattgggctngggggnaacccggaaaccannttttattagaaaaaattggaaagtaaaaaattggaangtaaaaanattgcaaatttcttttcntaatngggaagnatacanatcaaatatgncaaggggtaatcccctccctccccccacttccaantttattaatgtcaancggggaatttggggccctnaancctaaatcccgacanccaaca

SEQ ID NO: 90637 - DNA, 511 bp, Triticum aestivum
  unsure (1)..(511): unsure at all n locations
  Clone ID: PAT_TA_90637
gaattcactaagtgattaacgtggtcgcggccgaggtaagctatatacctacatagtacagccatggcccccaccgtgatggcctcgtcggncacctccgtcgctcctttccaagggctcaagtccaccgccggnctccccgtcaagccgccgctccaacggggctagcctcggcagcgtcagcaacggtggaaggatcaggtgcatgcaagtgtgggccatcnagggcatcaaaaaattcgagaccctgtcttanctgccaancgctcaacacngagggcctcctcaaacaagtggactaccctgatccgctccaaagtgggtggcctttccctttgagtttaaacaaaaggtcggggtttcaatctttccgtntagcaaaaaatgcggtctccccggggtaactaacaaanaggnccgccttactgggacaaatgttgggaaaacctgccctatgtttcggggttgcaaccgcnccccacaacaaaggggattnaaaactnnggtgggg

SEQ ID NO: 90638 - DNA, 484 bp, Triticum aestivum
  unsure (1)..(484): unsure at all n locations
  Clone ID: PAT_TA_90638
gaattcactagtgatttcgagcggccgcccgggcaggtctagtctcgagntttttttttttttttttttttttttttttttttttttttttggaanaaagacatattgtgngtgtgattatcattcnagcattgctatatacaagggggagaatatcatacggaaaccaacattcgatngaaaccctatagcaatgcncnaataatggtttccgtattaaaacgacgtcgtattaaagcgacgttgtttaataagccattcattctatcactttgtatgagccatanatgctttgatcatgggttcctacgaagaagttggntgtaaaatgggcacacgctcanccantccgttattatcccatgggaaagctagcgaaanaaanaatgtttggcataaaaagatttattcaaagcaaactaaaaatccccgncattctcaaactaagctcctttnatccggggcnatcaaaaacaagattggg

SEQ ID NO: 90639 - DNA, 479 bp, Triticum aestivum
  unsure (1)..(479): unsure at all n locations
  Clone ID: PAT_TA_90639
gaattcactagtgatttcgagcggccgcccgggcaggtctgatcctccaggccgtcctggtcatggggatcctctcacacgtgaacgccgactatttccccaagtgctgcaacagttgcaggtccttctcgggggtcgacgtctgcgacgacgcccacccccagtgccccaagggctgctcggcctgccgcgtggtgacgcccaaccctcacaagacgttccggtgcgccgacatgaagagcaccgtcgacggcacctgcggcggggccatgcaaaaagcactgatccgttcaaggcttcaagctcaaacgaagtgtgcccgcctaaaataaaagctcaagattgagatgagcagtcatgggggcctaagcttgtgtgtggggtcgtgctntacggncaaacaagtatgttataatggctaatcgtcgtgtccttgggcaatgtgtttttctcctcctccgaanaaaaggntggggtgg

SEQ ID NO: 90640 - DNA, 260 bp, Triticum aestivum
  unsure (1)..(260): unsure at all n locations
  Clone ID: PAT_TA_90640
gaattcactaagtgattgagcggccgcccgggcaggnttttttttttttttttttttttttttttttttttttttttttttttttttttttttttttttttttttttttaagggnaaaaanggntnattcatttnnncccgttcanaaaangtttgnttcaattanattcttaggggaggcancccantgggngtttacnttacacancaanaactanaattntttantatnaaacggggggattgcnccggttgntgac

SEQ ID NO: 90641 - DNA, 224 bp, Triticum aestivum
  unsure (1)..(224): unsure at all n locations
  Clone ID: PAT_TA_90641
gaattcactagtgatttcgagcggccgcccgggcaggtgagagaactaagtctcgaggttttttttttttttttttttttttaggaaaacaattactattcattaattgcctgaacaagtaggtcaggcacatcanacgtacacatcggctaggactggagtacagcaaggagttgacagttcactcacgcatacggacgcgacctcggccgcgaccacgctaa

SEQ ID NO: 90642 - DNA, 409 bp, Triticum aestivum
  unsure (1)..(409): unsure at all n locations
  Clone ID: PAT_TA_90642
gaattcactagtgattagcgtggtcgcggccgaggttcgagnttttttttttttttttttttttttttttttttttttttttttttttttttttttttttttttttttttttttaaaacnancttaaaancttcccnaaaaaaanangcanctttccangtgttcggttcgggggttgnggnatganaggnancaatcanaattanatatggttanttggnanaagctaanaaanaaaaaaactgtccaaattttgtcttgggntngaaaccaaatttttatgcaaaaaagggcccgacgaggggaaatnaaanntttcaaaaggnaaaaggggcccaaacgtaagctgnttcncaaaaagttttaaaactgaaaaacnccttnctggtttgnaaaaaaaaancccctc

SEQ ID NO: 90643 - DNA, 450 bp, Triticum aestivum
  Clone ID: PAT_TA_90643
gaattcactaagtgatttcgagcggccgcccgggcaggtgtctcgagtttttttttttttttttttttacaagcaaaccaaaatcatgtggtcctatggtttgatatttaacatgcaggttggcttgtacacgctgagatgagttatctaatagatcattgcagcacatgctgagacttcaatatccaaccatcaagcctgagcattatcatgtgcattgacttgtactacaatatcatgtaatagtacattttcatcaactcgatattcatcggtactaagtatgcgtggacaataagttcagatttgtagcagcacacgcacgaaacttgcagattttttcactggacttgcaaaactttgaaacttgaacttgacaaaaccgggcgatccctcccttgagctaagctggtatcctggccgcgaccacgccaatcgaattccccgcgg

SEQ ID NO: 90644 - DNA, 513 bp, Triticum aestivum
  unsure (1)..(513): unsure at all n locations
  Clone ID: PAT_TA_90644
gaattcactaagtgattaacgtggtcgcgggcgcggtcctctcccctcgcctcctcgtcctccccctcctangggatcgccggagaggaatcgcgacgagggcttcctcctatcagttaaatcaaagccatggagcacaaggagaccggctgccagtctcgggagggncccatcctttgcgtcaataattgtggcttcttcggcagcgcggggaccatgaacatgtgctccaagtgccacaaggagatggngatgaagcangagcangcaaagctgggcgcctcctctttcgacagcatcgtcaacggtggcgatgccgcgaaagaacatcttgctgctggnaacanggnggtgggagttgctcacgttgaggggaanacgcttattaacgcaaannctggtgatatcgctgggccaanccaaggggngaattgncaaacccaaaagggccaagccgggtgnancaactncanaaaanangggcggggctgaccgggattcnaantgccggtg

SEQ ID NO: 90645 - DNA, 509 bp, Triticum aestivum
  unsure (1)..(509): unsure at all n locations
  Clone ID: PAT_TA_90645
gaattcactagtgatttcgagcggccgcccgggcaggtttttttttttttttaccaaataggtatactcaatatctttatatattaacaaaacatgcccagcaatcgcttggatgcgatgcggtacttaggtacaaaggataaaaatatcagatattaaattggcatgcttaaaaggtgtaaaggcagctgccgtcgtcactcctcgccgttgggtcgaagttcttggcagtctggtcggtgcatcctgccggcacaggcaaagtaccttgctgtgcccctttacctcctcctatgcaagcaagagatggtgggtgtgtatggagaatgttctaaccgtagaaggaaacaagtcttcatcgcatcctggttagcatcacccaaaagctgcctgggctcaagtagggtgtcagcaaagctgcacacgcttgacattgtcctgctcctggacgagcatgtgccgtacctancancttccccaactgtcatctttgggttgctcaaaaggtn

SEQ ID NO: 90646 - DNA, 455 bp, Triticum aestivum
  unsure (1)..(455): unsure at all n locations
  Clone ID: PAT_TA_90646
gaattcactantgattaacgtggncgcggccgaggggaactaatcncgagttttttttttttttttttttttaanaaggnagaatcncttggttcaaccaaaacanaancacaccaatttcangattaccattacaaagcaaatcccncanattatcanaaagttttnaagacactcaacatctgacagttactgacaccaacattggggagtccgnctggcaaccatanatnagagcaaaaatactggnagacagcaaanatttttncaaacantgcgattantacttgacctctttcancccaagtggaaagtacaggaaagttgggtnaacaacccccnccntgttgtaggggganaacaagccgcccatcaacangcaatggctcnccccaacaaaaaaaactgaaagggccncttganntttggctaaaaaaaaaaaaanttgtgggggg

SEQ ID NO: 90647 - DNA, 458 bp, Triticum aestivum
  unsure (1)..(458): unsure at all n locations
  Clone ID: PAT_TA_90647
gaattcactagtgattancgtggtcgcggccgaggtcgaagcaaaaaaagcatcgtctcgcctcgtctcgtcgaggaatcaacagccatgggcggnggcaacgcgcanaagtccaagatggcgagggagaggaacctcnagaagctgaagggcggcaaggggagccagctcgaggccaacaagaaggncatgaacatccaatgcaaagatatgcatgcagactttcatctgcaccacctctgaagcaaagtgcaaggagcatgcccagggaaaagcatccgaagagcgaagctcgtccaagtgctttcctcacctcaagcaatgatatctgccaatcagcaggggagagagatnaaaagagaggagagagnagaagaanctgttcataaatcccancttaccaattatcaatgtttccccaaatgaaccngantntttgaccntaaancctttggggg

SEQ ID NO: 90648 - DNA, 451 bp, Triticum aestivum
  unsure (1)..(451): unsure at all n locations
  Clone ID: PAT_TA_90648
gaattcactagtgattancgtggtcgcggccgaggtccccgctccaaagccctaaccctagccatctcctctccccccagccctcgtcgagcgcgcgttttccaggagcttcaggtgccggcggngccatggcttcggagaccgagaccttcgccttccaggccgagatnaaccaagctgctctcgctcatcatcaacaccttctactccaacaaggagatnttcctccgcgagctcatctccaaagccctccgatgcgttggataagatnaggtttgagaagcctgactgacaanancaagctgggtgctcanccagaagctgtttatccatattatccctgacaaggncacgaaaanactcaactcttatcgacagtggtattgggtntgganaaagtcaaaacctccgtgaaanaaaccnttgggaacaantgcaangggcctgggna

SEQ ID NO: 90649 - DNA, 367 bp, Triticum aestivum
  unsure (1)..(367): unsure at all n locations
  Clone ID: PAT_TA_90649
gaattcactantgattaacgtggncncngccgangttttttttgcacaaggatgctcatattcaaaacagatgaccatacaaagatacagtagtaaacaacaagtttcaaatgtacatagatttattaacagcgagatcctttaaagcacacaaatcctccactgctgctgcagctgatggnaagctangagaagccccnaatctgaaggnaganacattgctgccagtgaggaattaaccacacaacttttgccttcaatatcaagantcacatgtgnatctgccaagtctttcttatacatcaagcaanagtgaatgcattggtggctaaccacagtttcacccnncaacaatggtaagcgtccg

SEQ ID NO: 90650 - DNA, 391 bp, Triticum aestivum
  unsure (1)..(391): unsure at all n locations
  Clone ID: PAT_TA_90650
tcgagtttttttttttttttttagttgacanattgtataatantangcgtccgtgcatatacanagccaccgatagcattcacatacgagcatgctttctcnagccatgttggtacatgaacatggncatacacatattcttaggaacaaataagaaagataaatggggaaggnaaacccaaagcaatgtcagagttgacaaaactgcaatggnactttatatatggcctgtcctgagtganctgtttaagccttgccggnctcctcncaacccggtggnttgaaggcgatgaaanctgacgcactgcacctgacgcaagttgtcgaaatccgatgatgccggcaaaacgcgtcaggggaagcccttccttgaactccccccaacccccgg

SEQ ID NO: 90651 - DNA, 214 bp, Triticum aestivum
  unsure (1)..(214): unsure at all n locations
  Clone ID: PAT_TA_90651
ncaattcactattnattagngtggncgcggncgaggnttttttttttttgcggtacggnccattttantaccatatcaattgatgattanacgagacgagaccaagancacccaggcggcaagggaaaacacacactacatacgcctgtgtgtttgnnacccctcttgccacccannaaccancggcgatntaagagatccnangcaccctgat

SEQ ID NO: 90652 - DNA, 255 bp, Triticum aestivum
  unsure (1)..(255): unsure at all n locations
  Clone ID: PAT_TA_90652
gaattcactaatgattaacgtggtcgcngccgagggtttttttttttttttttttttttttttttttttttnaaaacancanatggnaaanaacaccacctcacttaaaccaataataatgccattatttntgggnaaaagnaaangccgnctctcccaaccctcanaaggntcaaaacataaccataataacaaatccnccgcctaaaanacagcatnttagatnatanaagggaaacangatagttggtaaaa

SEQ ID NO: 90653 - DNA, 364 bp, Triticum aestivum
  unsure (1)..(364): unsure at all n locations
  Clone ID: PAT_TA_90653
gaattcactangtgattagcgtggtcgcggccgaggtctctctctgtctctctctctctctctgataatcttcagttctgtcgcacgcatccaacatacaaaccttgttggtccctctccctctatctctatctctctctctctctgtctctgtctctctctctctctgacaatcttnagttctatcgcacggatcaacacacaaaccttgttgattcctctctctctctctctctctctttctcgctctctgacaatcttcagttctgtcgcacgcatctaanacacaaaccttgttggtccctctntctctcncncnctggcactccctggtctccctctctctctcctctgataatcttna

SEQ ID NO: 90654 - DNA, 445 bp, Triticum aestivum
  unsure (1)..(445): unsure at all n locations
  Clone ID: PAT_TA_90654
gaattcactagtgattaacgtggtcgcggccgaggttgatnaccaacacagccgcgcatccaccgttgctagcaaggtcgaccaagcagcaccgagatggntgctgccttctcctccaccgtcggtgccccggcttctacgccgancaacttcctcgggaagaagctcaaaaagcangtgacctcggccgtgaactaccatggcaaagagctccaaggncaacaggttcacagtcatgggagcggggaaacatcnaccgagaagaggaacacaagacaaagttggaagggtcttgcctacgatatctcccnacgaccaccaagacatcaccaagaggggaagggnatcctngggctccctccttccanagcggcccacggggcggacgggnaaccacnaanggcggttcctcaanctncctaacgaanttaccgtatgccaaggg

SEQ ID NO: 90655 - DNA, 260 bp, Triticum aestivum
  unsure (1)..(260): unsure at all n locations
  Clone ID: PAT_TA_90655
gaattcactagtgattagcgtggtcgcggccgaggtgagaactagtcccgaggttttttttttttttttttttttttttttttttttttttttttttttttttttttttttttttttttangggaattgtancttgtncccnaaaacngccaaanatatganaaacttggaancnccacnaaatcnaggngngacaangacacaaaaatcanaanaccattctgtcaaaactgaggcaagtaantaacngtcntgaagct

SEQ ID NO: 90656 - DNA, 396 bp, Triticum aestivum
  unsure (1)..(396): unsure at all n locations
  Clone ID: PAT_TA_90656
ctgagcgttatgaggaaatggtcgaattcatggagaaggtggccaagaccgctgatgtaggtgagctcactgttgaggggcgcaacctgctctctgtggcttacaanaatgtgattggtgcccggagggcttcctggaggatcatctcctccattgagcanaaggaggagagccgtgggaacgaggcctatgtcgcatcaatcaaggagtaccgtaccaggattgaaaccgagctcagcaagatctgtgatggcatcctcaagcttctggactcccaccttgtcccctctgccactgcancaaagtccaaggtgttctatctgaaaaatgaagggtgacctaccacaggtaccttgcgggagttcaangcgnggtgcctgaaaaggaaaannaaan

SEQ ID NO: 90657 - DNA, 301 bp, Triticum aestivum
  unsure (1)..(301): unsure at all n locations
  Clone ID: PAT_TA_90657
gaattnantaatgattaacctggtcccngccnaagtntcaccggncaaaaaaacggntaaattgggctgggcaanacccgngtccccncntttaaagggcaaaaaaaaancggggaattncanctgggggggggggtcaccccgnnaaggggggtaaattntgccacttnaaaaaaaaaaaacttgngggggancttcaaaaccnaacttanactccactccccccggggaaangggcctccntttntttttttnaaaagggngnaattcaaacctccncccaaaaggngaaaaaaagggg

SEQ ID NO: 90658 - DNA, 363 bp, Triticum aestivum
  unsure (1)..(363): unsure at all n locations
  Clone ID: PAT_TA_90658
gaattcactaagtgattaacgtggtcgcggccgaggtcctctcccctcgcctcctcgtcctccccctcctangggatcgccggagaggaatcgcgacgagggcttcctcctatcanttaaatcaaagccatggagcacaaggagaccggctgccantctcgggagggccccatcctttgcgtcaataattgtggcttcttcggcaagcncggcgaccatgaacatgtnctccaagtgccacaaggagatggcgatgaagcaagagcaggcaaanctggtngcctcctctttctncancatcatcaacnggggggatgncgcnaaaaaaaatcttgctgctggnancaacgcggtggnagtttg

SEQ ID NO: 90659 - DNA, 415 bp, Triticum aestivum
  unsure (1)..(415): unsure at all n locations
  Clone ID: PAT_TA_90659
gaattcactagtgatttcnagcggccgcccgggcaggtcgagttnntatttttttttttttttttttttnaacaaatagctttattnagggaanaaaataacttcgcctacctagntattttattaactttttgaatttaaccaactaaacccattcttaatttttaattatttcaatganataaatttttgaaaaattaagaatttcagtattttttcttattctttttatttantctttcagaaagagataagaattggtttggtgaancggaaacaattttatagaaaaattgaagtaaaaattgaaggaaaaattgcaatttcttttcttagggaanatacacaacaatangcatgggtaatcncctcttccccacttccantttattatgtcancggggatttgggccct

SEQ ID NO: 90660 - DNA, 543 bp, Triticum aestivum
  unsure (1)..(543): unsure at all n locations
  Clone ID: PAT_TA_90660
gaattcactaagtgatttcgagcggccgcccgggcaggtgatcctcaccttgggaggatgttgtctctgaggctgacatctttgtgaccaccaccgggaaacaaaggacatcatcatgggtcnaaccacatgnaggaaagatnaaggaaacaacgcccattgtctgcaaacattgggtcactttgnacnaaatgangattcgnacatganacgngccctttgaanaacctaccctggggtggttcaaagccgcaatcaaccnatcanaggcccccaaaaactggaccggtttggggtcttcccccccgaangaccaaaggaactggggnatcanttgtttcctntggctggaagggggtccgtnctggaattgaaaccctttggggntgttggnccacctggggccaaccccccaagccttttgttcaattggtcccttggcctccaatttcaaccaaaaccaagggtttantttggccncaagcctttgaagtttgctgggaaccgnagggnagggcccaantnggncaaaagttattgaag

SEQ ID NO: 90661 - DNA, 434 bp, Triticum aestivum
  unsure (1)..(434): unsure at all n locations
  Clone ID: PAT_TA_90661
gaattcactaantgatttcnatcggccgcccgggcaggtgctactcccctgcctcccccagagctcgttanggttttctcttttttcgggggagaaatctcaagaggcggcaccatgctcgtgtaccagaacaagctttccggcgacgagcttctgtcggattcgttcccttacagggagctggagaacggcgtgctctgggaagtcgatggccattgggtcgttcaaggagcangttgatgtggacattggagccaatccctcctgctgagggtggtggtgatnatcanggtgttgattgaccanaccgtgaaggtggttgaaaatgttgacaccctccntcttcaanggagcaancctgcttttnacaagaagcaggtttatctccncaacaatgcaagcgccacatnaaagaaacctcctctgcccaagcc

SEQ ID NO: 90662 - DNA, 337 bp, Triticum aestivum
  unsure (1)..(337): unsure at all n locations
  Clone ID: PAT_TA_90662
gaattcactagtgatttcaaccggccncccgggngatcangnacnattantacttgggcgagatcnangcgaccacnanacccaccaaggtcaagtacacgccncccaagcagtcgcactacaacnaggacaaganccccgagttngtcatcaagatcctccanttcttggtcccccncncgatacngggcctggccgtccccgtacgnatctacaccaaggcggagtctgtctaaacaccgtcgatcttanaccattcagtccagtcagtcattcggtgagtgtccaaganctgantaagttttantgggganttgcatattttgngtnccaaacg

SEQ ID NO: 90663 - DNA, 428 bp, Triticum aestivum
  unsure (1)..(428): unsure at all n locations
  Clone ID: PAT_TA_90663
gaattcactaatgattaacgtggtcccggccgangtcgttttnttntncgatttaccaacaangatgtcactgcacaaattgtgtntgctaccaatgctgggganattgtgatggccgctgccnactcccatgaattgccnccccatggtcttgaagttggcctcaccaacnatgctgcaagcctactgcactggtctgcttttggntcntcctgtgctcaaaaaccgtgatcttgatgaggagtattaaagcaatgttgattggcacnggtgaggacttctctgttgagccntctgaaganangaggnctttccgtgcgcctttggatgttgggccntattaggaccaccaccgggaaaccctgtgtttggtgccccctaaaagggagctttttgntgggggggccntnaaaattccccacaaatnn

SEQ ID NO: 90664 - DNA, 466 bp, Triticum aestivum
  unsure (1)..(466): unsure at all n locations
  Clone ID: PAT_TA_90664
gaattcactaatgatttcgagcggccgcccgggcaggtcnaccacaaagcggcggcggcggcggcggcagcggaagaaagaggagaganctccagccatggtgcacgttaacttctaccncaactatggtaatacattcaagaaancaaggcgtccttatgagaaggancgtcttgatgcagaactnaagctggtcggtgaatatggactnangtgcaaaccctngagctctggagggttcaatatgcactgangcacgnttcntnatgcctgcaagacacttgctcaacaccnggnttttnaaaaanccccctccccntatctttttagggggncgncgggcccttcctccngttcgccatnanaccngcctacgnntcctccctttgcttganggggncacgnataaacccttgtattttatagtcccttggnccctttacatgtntnaagnaaaatntncttt

SEQ ID NO: 90665 - DNA, 284 bp, Triticum aestivum
  unsure (1)..(284): unsure at all n locations
  Clone ID: PAT_TA_90665
tcgcgggccgaggttttttttanaacaaaggtgagnatacaacaattgatgttgncaccaatanaaatgtgacattctgccagattanatttccttttanctccagncatggaaattctgtntgaacaangacatgatcttatntcagggaagagaatctaanaatgaatataaataataatgtacangtgntctcccccnaacgggacatatngagtggcaggcacntnattcttctccnccacctaaacaattcttncgaggnctgatcagttcgagacctg

SEQ ID NO: 90666 - DNA, 497 bp, Triticum aestivum
  unsure (1)..(497): unsure at all n locations
  Clone ID: PAT_TA_90666
gaattcactaatgattaacgtggtcgcggccgaggtccccgctccaaagccctaaccctagccatctcctctccccccagccctcgtcgagcgcgcgttttncaaggagcttnangtgccggnggggccatggcttcggnagaccgagaccttcnccttccaggccgagattaatcaactgctctcgctcaacaatcaaaaccttctnttccaaacaagggagattttcctccggggaggtcaatctcaangnctcccgatgcgttgggtaagatnaagggtttgagagcctgactggacaaaagcnaagctgggtgctcanccangngctgtttatccaaattaatcctgacaagggcancgaacaaantcaactccttatcnacagtgggtattgggtatgaaaaaatcaagacctcgtgaanaacnntggtacaaatgcaaggnctgggaccaaaggattttatgganggactgggttgccgggggccgaatgt

SEQ ID NO: 90667 - DNA, 515 bp, Triticum aestivum
  unsure (1)..(515): unsure at all n locations
  Clone ID: PAT_TA_90667
naattnantaantgatttncaagcggncncccnggcangtcccgttagcaagctacgtgctgccgattgccnccggtactcccnagaatcggtcancaaaanggntttttttgcaacaaggactatgttgcaataacgacggncanagntgctanccgcacatgcttgttttttgcaaaaatgtttctgcaanaaagattctgttgcaaaaaaaaaactgcaacattanctttgttgcatggnttctgtaacangatcattgttggaaaaatgtctctgcaacaatgnctccgttgcaaaggggaaagaaacnttcgggtggtcaatgggngcngagattcttanaggtcnttaaggggggcngggncctttaaaaaanaatccgcccgggcggaccgggtaaacaaancccccctcaagtaattaaaatgtttgggcaaaaccaaaacaaaggttggtgtngttgcnaaacccggcnaaatttggggttttttgncccgntggcggnnaanaaa

SEQ ID NO: 90668 - DNA, 495 bp, Triticum aestivum
  unsure (1)..(495): unsure at all n locations
  Clone ID: PAT_TA_90668
gaattcactaatgattcnagcggncgcccgggcaggtaanaacananagcattctaccaccgcaccgcacgagtgaagtgagagctttgcacgaaaagttcatcaagcgaccatgaagggcaccaagctcgcggngatcctcatcctccangccgtcctggtcatgggagtcctctcacacgtgaacgccgactatttccccaagtgctgcaacaactgcaggtccttctccggggtcgacgtctgcgacgacgcccaacccaagtgccccaaagggctgctccgggttgccgcntggtgtctacnanccccnaaatgtggcgctgcgcggntatnaaatccaacgtccacggggacctgcggtggggcctgcaanaantactgatcgggtcatgcnacaagatnatgtttcgcctaaaattgaaaataaaaagctcaaaccaanatgagcanngtccatcgngcctatgccgtgtgtttnntgggcaaanaaaa

SEQ ID NO: 90669 - DNA, 434 bp, Triticum aestivum
  unsure (1)..(434): unsure at all n locations
  Clone ID: PAT_TA_90669
gaattcactaagtgattaacgtggtcgcggccgaggttttttttttacacaactaatcacatcaaattaagaatatgtatgtctgaacattcaccaacgatatggaaaatananccaagtatctatccgttttcccgngtcacgatttcaanaacggacgtcttacaancanaaatgcaacnacnggtcgagaacaattcccacatttcatnaaangaacggtgacgctggtacaaaatgcaaatccccacnaaaacttattcagctcttgggcacttccgaatgactgactgactgactggngtaaaaccancgtggntanacagacaccgccttggggtanatccgtacggngacggncaagcccagtatcnccaggggggaccaaacaacnggngggatcttttatgacgaactccnggggcttgtcctgg

SEQ ID NO: 90670 - DNA, 526 bp, Triticum aestivum
  unsure (1)..(526): unsure at all n locations
  Clone ID: PAT_TA_90670
gaattcactaatgattaacgnggncccngccgaggggtccccagtttttttttttttttttttttgncattaataaangancccggatttcccttggtcaacaaaaaaaaaaaaatgtnagcaancattanaatagttccgacaaagtanacgagggcccctcaggagtacaagatnaaanntccccgtggcaanaacggggggcacaacgtacgatcnaaagcancancaagtaaaactaatttnttaatggnaacaagtangaactaagtnaaagcagntaaattaaaccccgggtggggccatgcaagcaaagggaacnacccgggttcccaccatttaattcgctcccaccaagcancctgaaatggggtcctggatctcncccctaaacgcaccttggggcaaacccgttctaaaggccggaagggngtangggggangttnaaacccaaaccattcctgnggggatgnccgggaaaaaaaggtcggggctttnnncccccccantgccgccccnccnggg

SEQ ID NO: 90671 - DNA, 156 bp, Triticum aestivum
  unsure (1)..(156): unsure at all n locations
  Clone ID: PAT_TA_90671
ggcaggtctcgacttttttttttttttttcntcncaaanactccgaattattanttctgggaancangttccttccatcaacaagcnagatggatttattcggtataaaanccgttcatcaagaaanaatgaaaaagggatnggtanaaacangtg

SEQ ID NO: 90672 - DNA, 343 bp, Triticum aestivum
  unsure (1)..(343): unsure at all n locations
  Clone ID: PAT_TA_90672
tnttttntatttatttntttttttttttttgaaaggtaagggggnacatattacaaatgacanangcnacacacaatatctcaagttgngagtttatattttcngtgaacaaaaacngcattttctttttgtaaaagcgggnactagtgnncaagcncattcttttttccttggctttctttcntgatttcacttcactttgncaccttccttgaggtctccaatggattccncagnggntttgtcattnccnttgttttccttcttgggntttcttcaactccgccncctctttntccctgggntttctttgcntcaacccnccttggncncttcttccgcc

SEQ ID NO: 90673 - DNA, 304 bp, Triticum aestivum
  unsure (1)..(304): unsure at all n locations
  Clone ID: PAT_TA_90673
naattnaataatgattaacgtggtcncgggcganggccncttaaaggnctgaagtccaggggattaacaactgatnaaaaggaagtcaaaccctggnncaaatgttgcttnaggttcctcccaanaagaattggatccccccccctttttggtcaataattttaancaatnattctggtnanaactcaatggttnactaactggcaatatttgggccttggcaaaggtnaatttggtgcaacttggggttnaacttaatccaaaccaattnaagtnggggtnaaaaaaaaaanaaaaaaaaaaa

SEQ ID NO: 90674 - DNA, 307 bp, Triticum aestivum
  unsure (1)..(307): unsure at all n locations
  Clone ID: PAT_TA_90674
cggccgaggtcctcccttcttgctgagctgagcangccccttctctctcaactttgggctcgaggcaatggcggngctcgctccnacnaaaangctcggcanccgggtcaacttctncggctcctccaagtacgccacagagggaccaactgctggngnacanaaaatagnntccctctttgntcgcttcaanaaaaaacctgccccnaaagccgaagcccgccccccgtggggcacctcnagcggtangnatccacgaanaagctcgccnantgggncggacctggacaaggangnttttnatttt

SEQ ID NO: 90675 - DNA, 250 bp, Triticum aestivum
  Clone ID: PAT_TA_90675
ccgcccgggcaggtcaccagcccgaaatgaagcactttagcctgtcagtgactcgctattagcaactgttgtggtcaagtgcaaacctatttcaagcattcagtaatgttgtcgcgtccataattcagaggatatcataaagtacctcttattgaaagaaccatgtgatgtttgatggcttgctatatatgtgatggttgatggctaaaaaaaaaaaaaaaactcgagacctcggccgcgaccacgctaa

SEQ ID NO: 90676 - DNA, 422 bp, Triticum aestivum
  unsure (1)..(422): unsure at all n locations
  Clone ID: PAT_TA_90676
gncgcgaattcactaagtgatttcnangcgggccgcccgggcaggtaaaaactccangcctagttgccctcgcgtgacgcgctganggtgaggaangatgccgagaacctcaccgaggctcatcccgtcgctgccccgttcgaagaagcgggttangtgccgnccgcccggccgacatgcaagagggcgacangtaccggtggggtnctggttccccgaattgggaaccctgttcgggccctggggcggnantcccgcgaattacttcgtangcccaatcccaaacngggncaatcttcctccgttgaagcctgnccccaaagttctgggcaaccancaatgaactttaaaantcctcctaggcccttcccgcncaactggtggcnaaccggggcnacggtttccnanccccggccaattcc

SEQ ID NO: 90677 - DNA, 304 bp, Triticum aestivum
  unsure (1)..(304): unsure at all n locations
  Clone ID: PAT_TA_90677
gaattcactagtgattagcgtggtcgcggccgaggctcgagtttttttttttttttttttttttttttttttttttttttttttttttttttttttttttttttttnaaaaccaccttaanancntcccganaaaaatatgcanctttccaagngttcggntcggcggntgnggcatgacaggcatcantcacaattacatatggttacttgggaaaanctaataaataaaaaaactgtccacattttgncttgngagtccaaaccaagatttttatgcaaacagcgggccnacnacnggggca

SEQ ID NO: 90678 - DNA, 496 bp, Triticum aestivum
  unsure (1)..(496): unsure at all n locations
  Clone ID: PAT_TA_90678
tttttttttgangcagcaggtaccacttctataaccgacggtaatcttgtacactgggaanatctaagtctgtnaacaaacnaacacaagtattgtacaaangcctcaaagtccagcggggaaagcaagcaaatttgcgtcccaacaaatcaaatataaaacctatttcatccncttcgatacttctttcagcattttggggcgaancgnaagggcgananctggtaggatnangtcatcactactcgggcagncatgggacccgggttcttccctcaaaatctccttattcaactaatacccctgaaaggaataaggagtggttggcatccaanncggccggtncgnggcggtttccccccggcctcccaaaccctngaantaaccnaaccaacccggtcaattcaattcggtncggnccgttcaattcanccnaanagtttccgtcnatccccccggcctncaatccttcagacaatccaatcngttggncntg

SEQ ID NO: 90679 - DNA, 436 bp, Triticum aestivum
  unsure (1)..(436): unsure at all n locations
  Clone ID: PAT_TA_90679
gaattcactagtgattagcgtggtcgcggccgaggtctcaatcccgcaacctccggcgaggcgggcggcggaggaggagtgcgcgagggtctcttctcttctcaagctccaatagcatgtggaagagaatcccttataaggaggtccaactccttctccactagcggggtgagactaaacttcccaccccttgtcatgacacccacatgggcccttagagatttttctgaaattgtaagatgggcctaaagcccaccccatatttcaacatttatgctctcctttagccaagctaaaagaagttggggcatggttgaatcntgggcagagctcanagctgggatgtgaggcactgctggaccctagatggatgcaaggtcgacaaggcattgctgaaccctacatgggatgttttggtctgctaaatgggactggg

SEQ ID NO: 90680 - DNA, 269 bp, Triticum aestivum
  unsure (1)..(269): unsure at all n locations
  Clone ID: PAT_TA_90680
tcgcgggcgaggtcaccagnanatncgcgcatctaccgttgctagcangggtcgnccaagnagcaccgagatggctgctgccttctcctccaccgtcaggtgccccggtttctacgcnggaccancttccttgtggaagaagctcaagaagcangtgncctcnngccgtgaannaccatggnaagagcnccaanggncaacagggtttacantcattgggaagcngggtcgancctctatcgaggaacnaaggnaacacgtgnccaaag

SEQ ID NO: 90681 - DNA, 172 bp, Triticum aestivum
  unsure (1)..(172): unsure at all n locations
  Clone ID: PAT_TA_90681
gcgccccgggcaggtctcgaagtntttttttttntttttntaantaaaagcttacacaacatagccaanaagganancgttcnggacntggngctgcngccgaggcngnntgtgccatgcaatcacnattgcccaacaaactaagattncataacgccaacattgantgaca

SEQ ID NO: 90682 - DNA, 414 bp, Triticum aestivum
  unsure (1)..(414): unsure at all n locations
  Clone ID: PAT_TA_90682
gaattcactagtgattancgnggccgcggccgaggtttttttttttttanaccaataataatgccattatttctgggcaaaagcaaacgccngcctctcccaaccctcacanggggtcaanacataaccatantancaantcctccgcctaangagacagnatntatgataatagaagggaaacaggataggttgtntantagttcccggttgggtgccgcnggctctcgactcaaggcttcaaggccatccgcnnagntcatgctgtgancacaacctnaggttacctggttaagcccgcancgtnttgttaaagggacccctcananttgggcgatggccnanattgtanngtccacnactgnggaacttgggttgtacnccttnggnccaagccctggggccgtcccggaa

SEQ ID NO: 90683 - DNA, 435 bp, Triticum aestivum
  unsure (1)..(435): unsure at all n locations
  Clone ID: PAT_TA_90683
gaattcactagtgatttcnaagcggcccgcccgggcaggtctgntcctccaggccgtcctggtcangggggatcctctcacacntgaagcgccgactatttcccccaagtgcctgcaacangttgtaggtccttctccggggggtcgacgtctgcggacgacgcccacccccaagtgccccaanggctgctcggnctgcgcgcggtggtgncgccccangccctcacaaagacgtttccgggtgcggccgacaattganagnagcaccggtcggncnggcatccttggcggcnggggccatggcaagaaaaggnaactggatnccgtttngggggntttccaggggctcanaacngangggtnttgctccnccctaaaaattaaacacccttcantnntgtaccaatgcaagcaagttcattgtggtngccctaa

SEQ ID NO: 90684 - DNA, 396 bp, Triticum aestivum
  unsure (1)..(396): unsure at all n locations
  Clone ID: PAT_TA_90684
gaattcactangtgatttcgagcggccgcccgggcaggtgagagaganagagaactagtctcgagtttttttttttttttttttaaacttcaacattttttttaaaacgttaggcgtattcagtccggaaagttaaaagaaatgttctcattttcaaactcnattttttacntcggtcggcgancacgcctanatccgaaattccccgcgggccgccaatgggcngnccggggnanccattgacgaccttcgnggcccnaatttccgnccccntaacaagnnggaggtcggtatcnancaatttcanntggggcccggtcggtttttancaaaacnntcggtgtncctgggggnaaaaanccccttgtggcgttttacacctaaaactttaaaatc

SEQ ID NO: 90685 - DNA, 565 bp, Triticum aestivum
  unsure (1)..(565): unsure at all n locations
  Clone ID: PAT_TA_90685
gaattcactattgatttcggagcggcccgcccgggcaaggtgttttttttttttttttgtttgtttcgangaaagatatcggccggnttctccttctattgattcttttcccgatcgagatgtaccgggatccaatgtgtcctacatacaatangattctggttcaatggnnttanacgaaaaaatgtgcaaagaagcctctaatttggccctctgccaattctaatggagtcgccttcccttttttgccgaacctccgggcccggcgaaccaacggctaaatccanaatttccccnccgggccggccaatgggccgggncggggnaggcaatgtnggancgttccggggccccaaaattccgccccnaattangttgangtccgnagtttaacaaattttcaacctgggggccggtcngtntttttaacaaancgntctgtgnacttgggggnaaaaaaacccctgggcggntttagcccaaagccttaaagtccgcccctttgccanagnaaacaatccccccccttttccgcccaanggcttggggggtaaaataagtcgng

SEQ ID NO: 90686 - DNA, 452 bp, Triticum aestivum
  unsure (1)..(452): unsure at all n locations
  Clone ID: PAT_TA_90686
attaagcggccgcccgggcaggtcaaaaacggcatcaagttcggcgaggccgtgtggttcaaggccggcgcccagatcttctccgagggcggcctcgactacctgggcanaccccaacctgtgtgcacgcgcagagcatcctcgccatctggngcggtgcaggtggtgctcatgggcttcatcgnagggctaccggtgttgggtgggggggccccctcgggggaagggcctcggantatcatctacccaaggcgnggggcccttcgacccactttggtcctcgccgaacgaacccctgnncaccgncccgcccgattcctcaaaggttgagagcgacgcctcaangaancggggcggccctcggccaatggttcctccaattgcttcnggccttccttcngttgncaagggnccaatccgtcanccgggggaaaagggggcccaagttttga

SEQ ID NO: 90687 - DNA, 156 bp, Triticum aestivum
  unsure (1)..(156): unsure at all n locations
  Clone ID: PAT_TA_90687
gaaattcacnaantgattcgntgcggncgccccggccangtncnccaagttttttttttttttttacaaancaagaaagnncacttatccaaaccgggggtggnctggtcancccctcacaccatacatatcncatnaacttcangcagttttacc

SEQ ID NO: 90688 - DNA, 447 bp, Triticum aestivum
  unsure (1)..(447): unsure at all n locations
  Clone ID: PAT_TA_90688
gaattcactagtgattagcgtggtcgcggccgaggtgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccaagagggaagggcatcgtggactcgctcttccaggcgcccacgggcgacgggacccacgaggncgtcctcagctcctacgaagtacgttagccanggactcaagaagtacgacttcgacaacaccatgggaggnntctaaatcgctcctgctttcatggacaaacntggttgttcatctctccaagaaa

SEQ ID NO: 90689 - DNA, 474 bp, Triticum aestivum
  unsure (1)..(474): unsure at all n locations
  Clone ID: PAT_TA_90689
gaattcactantgattaacgtggtcgcggccgaggtattgatattgccctgtggaagttcgagaccaccaagtactactgcaccgtcattgatgctcctggtcaccgtgacttcatcaagaacatgattactgggtacctcccangctgactgtgctgtgctcatcattgactccaccactggtggttttgaggctggtatctccaaagatgggcaaacccgtgagcatgccctccttgcttcactcttggngtgaancaaatgatntgctgctggtaacaanatgggncgccaacaactcccaaagtactcaaaagggcccgtttncgaaggaaattntcaaagggnagtctctttcgtaacctgaaagaaaagggcggntaacaaaccccggacaaagggtccccntttgttcccancctcctgggggtttgagggggggacaacnatggatttgagaagggtncnaccaan

SEQ ID NO: 90690 - DNA, 432 bp, Triticum aestivum
  unsure (1)..(432): unsure at all n locations
  Clone ID: PAT_TA_90690
ccgcccgggcaggtctaatctcgagtttttttttttttttttttttatcnggaagatgtacaattgctaacacgaatgcatggtttgatggntacacaatgagtganttacaaccaagtanacattttcttgggacnaatnaacacatttcccatatgtatcaataatntttgctcaaaatantaaaataaaaaaaacgttatcacaaacatatatgttcactcacgcgtccaagaacttacgatctacganacttgttcagtattaaaaggcggngtgctatatctgccatcgatggtctttgntccacgtcaagggttgagacactccactgccanccctggnaagatttttgaaaagaaggctccaaggtccttcctgccaancanaaantttcnattggtcaaaacaaaccncgggntggctcccngt

SEQ ID NO: 90691 - DNA, 422 bp, Triticum aestivum
  unsure (1)..(422): unsure at all n locations
  Clone ID: PAT_TA_90691
cccatccccaggtcataaacccaagtcggactcgccttcctcctccccaactactcctctcctccgcgcatcgcatcgcaccgggggtcacctgagatcacatacacaatggtgaaggctgtggctgtgcttaccggcagtgagggtgtcaagggcaccatcttcttcatccaggagggagatggcccgaccaccgtgacgggaagcgtcactggactcaaggaagggctccacggcttccacgtgcacgctcttggtgacaccaccaacggctgcatgtcaactggaccacacttcaaccctgctggtcntgtgcatggggnaacaaaagatgaaatccgccatgctgggtgattttgggaaatgtgacaactggagcggatggggtttgctaaacaatcaatgtttactggactggccaa

SEQ ID NO: 90692 - DNA, 221 bp, Triticum aestivum
  unsure (1)..(221): unsure at all n locations
  Clone ID: PAT_TA_90692
gggcgcgaattnaactaatgattaacgtgggccccnnccgangggttcaaanttnntggaccaaactgccgatnaaagttgggngaacgcgcaataannaacccgcctctttccgctcgggtacgggctcaccaaccaaaaggggaacgaaagcaagtactaagccaaggccgcttnacatacatagacaaacaaggangggtacancactaatgggatgg

SEQ ID NO: 90693 - DNA, 447 bp, Triticum aestivum
  unsure (1)..(447): unsure at all n locations
  Clone ID: PAT_TA_90693
gaattcactagtgattagcgtggtcgcggccgaggtccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgaaccccgaaatgtggcgctgcgcggatatgaaatccaccgtcgacggcaccttgcggtgggccctgcaagaaagtactgattggntcatgccancnatgatatttttccgcctaaaatngaaataaaaanctcaacccaanatgagcaacgtcatccntggcctatt

SEQ ID NO: 90694 - DNA, 266 bp, Triticum aestivum
  unsure (1)..(266): unsure at all n locations
  Clone ID: PAT_TA_90694
gaattcactagtgattagcgtggtcgcggccgaggtgtctgaggaccataccagaattttcttcggtctcctcattttgttgtaccaaatgtacttgacctanaaccctgacagtagttgagtggaaaaaaaaaaaaaaaaaaaaaaaaaaaaaaaaaaaaaaaaaaaaaaaaaaaaaaaaaaaaaaaaaaaaaaaaaaaaanccaaacctgcccgggggggaaatgaaanttcccncggccnnaangggggccggnaaaaagcaa

SEQ ID NO: 90695 - DNA, 439 bp, Triticum aestivum
  unsure (1)..(439): unsure at all n locations
  Clone ID: PAT_TA_90695
gaattcactagtgattagcgtggtcgcggccgaggtcgacaacggtcccgttcacccccaactgggcaccactactaatcatcgggaaaggaaacatagtaacgttgagagtccccgtcgaactcccacttgagctcatacgtgtctcctggagtggaatcatcaggccctgcatctggtgtaatagtaatctgtgaagccacagggactcaagcaatctcgcaccctcgcggtcaagactatttaagcttgtnggtaaggaaaggtaaatataggtggagctgcagcaagcgactagcaaatatggtggctaacttattcgcaaaaggagagtganaagaggaggcaaaagcacgagcgaagaaactanagaacaacctacgcaaacatttactccaanaccgtgtccaacttcccggactcccgccgagaaagaggc

SEQ ID NO: 90696 - DNA, 507 bp, Triticum aestivum
  unsure (1)..(507): unsure at all n locations
  Clone ID: PAT_TA_90696
tgcgcganttcactagtgattancgtggtcgcggccgaggtgngagaactagcctcgagtttttttttttttgtaaaacagatcaaacggattattaccgaaatgnnttgaactgnttcaaanacccaacatgcatntttttgcagttgggcnctttcataancngatttaangatcagttagtccaccatactttttctttacggaaangataatgaggatggctcccgggtgcgctgaatgantttttttacntangatcnancctaggggngncaatcaccaanggngtttcaacaggganggacntacccttgtacttnagggtcctgccccccggggccctaaaattanaagncataccctnaagctgaaaatgggagctcctcctaanccgnttccaacctggcaancgaggtttngaacctannngaagaacttcaatcagcaacccttnacaangcttcantannaaacgcagcacnnnagcgttttttttgggagggg

SEQ ID NO: 90697 - DNA, 177 bp, Triticum aestivum
  unsure (1)..(177): unsure at all n locations
  Clone ID: PAT_TA_90697
naattcactantgatttcnngcggccncccggggcaggtgttnacttcagttgcttantcngtcctgtctgcacacactgaagagcaatatgggtggnaaggttcttctgaacgagtgnngtcttggnggggcttgtttcacctgagtctcntgcaggacgcctggtgatagttgtt

SEQ ID NO: 90698 - DNA, 185 bp, Triticum aestivum
  unsure (1)..(185): unsure at all n locations
  Clone ID: PAT_TA_90698
gaattcactantgattatgcgtggtcgcggccgaggtgagagaactagtctcggagttttttttttttttttttttttttagaanaatacttaacaactttattactgcctcagtcgctcatctttgcggtgctgcttatactttggtggagcgatagacttttgtccacgacctgcccgggcgg

SEQ ID NO: 90699 - DNA, 430 bp, Triticum aestivum
  unsure (1)..(430): unsure at all n locations
  Clone ID: PAT_TA_90699
gaattcactaantgattagcgtggtcgggccgaggtgtngcctcctcctaaaccactctccctatccccgtgtccagaatctaccccccggctccaatggcggcgaaggaaccgnngcgcgtgctcgtcaccggcgccgcaggacaaatcggatatgctcttgttcccatgattgccaggggagttatgcttggtgcanaccagcctgttattctgcntatgctgggatattgaatttgctgctgaagctcttaaaggcgtcanggatggagttgatcgatgccgcatttccacttctcaagggagttgttgcaacaactgntngttgttanggcttgcactggccgtgaatgttgcggttattggttggtggattcccccanccaaggaacggaaatgnganagganangatggttnatgncccaaaaa

SEQ ID NO: 90700 - DNA, 342 bp, Triticum aestivum
  unsure (1)..(342): unsure at all n locations
  Clone ID: PAT_TA_90700
gaattcactagtgattaccgtggtcgcggccgaggttccggatccatccatccgcccctcgctgccgctgcatctcgtctccaccaccccacttgcccccggacccaggaggatcgtcggagatgtcgngacaccgatgacgcaccacttcgagtccnaaggccgnctccngtgccaccaangacctaccctcagcaggccggcgccatccgcatgggtgganacatcgtcatcaaggcccgtccctgcaaggntgttgaggtctccacctccaaacactgggaangcatgggtcaacgcacagtggtcnctttngntgncaatttgacatnctttancggg

SEQ ID NO: 90701 - DNA, 449 bp, Triticum aestivum
  unsure (1)..(449): unsure at all n locations
  Clone ID: PAT_TA_90701
gaattcactaagtgattagcgtggtcgcggccgaggtcgacnagatcaattaaagtaaagtgggtataacttgaatttgtgggagactatacntacgtgagatacattaggaatagaaaaagattttctttttgaatgaattgaaagcgctcttagttcaagttcggtagaacgcgggtctccaaaacccgatgtcgtangttcaaatcctacagagcgtgattccatctatcttatgtcgaagcagagtaaaataacttaacaaaattgaattgtaaccnccaatttcaantttgacctcctctctggtctggaggaggtcaaatcaaaaaaatgnctcaatcaaagatccaactgatncccacnccctgtattgcanatacgcagtcaccgaataattcccgccnnacagtattaggaaattacggcctaagaacgagttccaangg

SEQ ID NO: 90702 - DNA, 321 bp, Triticum aestivum
  unsure (1)..(321): unsure at all n locations
  Clone ID: PAT_TA_90702
gaattcactagtgattagcgtggtcncggccgaggtcctctcccctcgcctcctcgtcctccccctccaaggggatcgccggatgaggaatcnnnacgagggcttcctcctancagttaaatcaaagccatggagcacaaggngaccggctgccagtctcgggagggccccatcctttgngtcaanaattgtggcttcttcggcagcgcggcnaccatgaacatgtgctccancgtgccacatnganatggngatgaacaaaggancantgcaaaagctggcccgcctcctctttcgacagcatcatnaccggngggggat

SEQ ID NO: 90703 - DNA, 497 bp, Triticum aestivum
  unsure (1)..(497): unsure at all n locations
  Clone ID: PAT_TA_90703
gacttcactagtgatttcnatgcggccgcccgggcaggtgtctcnagtttttttttttttttttttaaanagcaaccngtatgcattcatatgatcaagtactctaattggaccccttacannncaaataaatanctcgccaggactatatacaaanctggggtacatnnnaggagaacaagaagctgccaccatcctctctggctggnacaggatcnangtttcatttctantancatggcaatgcnactagaantgcntgcctgcctgcctggccngcctaagntggcnaacaccctntaccttggccatantccaaagctngaanggccngggcggccttncancttacaacctacantccccntcaacncaacttttanttcccaactggccnttcaancaggaggccttacttcaacctccanantccanggcaaaccccctnggctccactcncaacaaataanagattcaaagtgggncccagccttngt

SEQ ID NO: 90704 - DNA, 243 bp, Triticum aestivum
  unsure (1)..(243): unsure at all n locations
  Clone ID: PAT_TA_90704
gaattcactagtgatttcgagcggccgcccgggcaggnttttttttttttttttttttttttcctgcaaaccccaattaattaaaanaggngattaaagacacatntaccaagggaatagctgcaagattacatatcncaaattcanaagatatattcngcaagnttacatatcanacatctanacacttaaatanaataacgtgttggcattattccacatggcagaanaaatgagaaatgg

SEQ ID NO: 90705 - DNA, 460 bp, Triticum aestivum
  unsure (1)..(460): unsure at all n locations
  Clone ID: PAT_TA_90705
gaattcactaagtgattaacgtggtcggcggccgaggttcgagtttttttttttttttttanaataacagggcagnatctcttgattcaaccaaaacacaaccacaccaatttcacgattaccattncaaagcaaatcccacaattatcagaaagttttcangacactcaacatctgncagttacctgncaccaacattgggggagtcgactggacaaccatagataangagcaaaaatactgaagacagcatangattttagcatacagtgcgattaagcacttgncctctttcangcccatgtgnaaaagtncaggaaagttggggtnaagcaagctccctccttgtagtaggngaaaaacnacgccgccatcatcatngaaggnnccccgccaaaaaaaagaacanggaagggncccttgngccttgnctaaanaaagaaanttttgtggggngggg

SEQ ID NO: 90706 - DNA, 278 bp, Triticum aestivum
  unsure (1)..(278): unsure at all n locations
  Clone ID: PAT_TA_90706
ngaattcacnagtgattangcgnggtcgcggccgangttttttttttttttacagccatttccacatcttttttttaagtaangagcctatcctcnagcctcntttttagtgttnacatttcaatanaccgaaacctatanaangactananaantgttaagaggacncttccgcctagataaaaatatatcatggtcagcanagttgtttctttanttttacgttgccctcnttannaagcttcaatttcantaaganaaanctaactaaataaatg

SEQ ID NO: 90707 - DNA, 472 bp, Triticum aestivum
  unsure (1)..(472): unsure at all n locations
  Clone ID: PAT_TA_90707
ccgaggtttttttttttttttatnnctatttccantatcttttttttaagtaatgagcccatcctcnancttcttttttatgtttatatttcaagacatcgaaacctatganaagactagataaatgttaagaggacncttccgcctagataaaaatatatcagggncaggcaaagttgtttctttatttttatttgcccnctttaataacttcaatttcactaagaaaaactaanctaaagaaatggnaaatgnaaatnaaatagaattcttttttttttttcttcaaanccaaaaaatttctcttttttatacatagggncgnccgattccggnantgggnaaaaaaagggcaggggggccccctttttttttcccantcaaatagtncaaaccattttatcgatatgagggggtccnccatcnaganaaatcttacatcagcctcctcccggtttaaatttcgggacaa

SEQ ID NO: 90708 - DNA, 502 bp, Triticum aestivum
  unsure (1)..(502): unsure at all n locations
  Clone ID: PAT_TA_90708
gaattcantaatgattaacgtggnccgcggncgaggncnaattttttttttttttttttttttaganggcaacacaactaacagngtagatnacatnccanctcagatcctgacaagtccagnaaaatcncaaacactactaaattttcatctgagtacaccaanaaaagggatgngtgattcacaaaacatttcacgattttgggggaaaagatacaacgntgaccaaaagctcaacantctgcccaccaaagtgatctaagncagcaacaacctccctcttaaagccttcncctaggtcctgcctganaagctccctcccctcntggatcctggggaagcaatgacctttgaaactgnccaagtcattgaagngatgccctcctcctccgggacaaacaanattcctgccccatggagctgtttttcccacntggggcttcaaaatnaancttcccccantggcttttgataaangttgcccntcttaanggatncgcct

SEQ ID NO: 90709 - DNA, 449 bp, Triticum aestivum
  unsure (1)..(449): unsure at all n locations
  Clone ID: PAT_TA_90709
gaanttcactaccgattancggccgcccgggcaggnctcgagttttttttttttctanagcnatttccanatcttttntttaagtaatgagcctancctcnatcttcntttttatgtttatatttcantatancgnaaccnacataagactacnctaaatattaagaggactcttccgcctatgataaaaatatatcatggccangnaaagttgtttcttnatttttatttnccctccttaataatttcaatttcattacgaaaaactaactnaataaatggaaaatgaaaattaanagaattcttttttttttcttcaaatccaaaaaatttctcttttttatacataggtcgtccgattcggcattggtnaaaaaagggcacggtgccccctttttttttctacgtaaaatagntcaaaccattttntcgagaatgaggggcnccta

SEQ ID NO: 90710 - DNA, 499 bp, Triticum aestivum
  unsure (1)..(499): unsure at all n locations
  Clone ID: PAT_TA_90710
gaattcactaagtgattaacgtggtcgcggccgaggtttcattaattataccaccattcattgtcgacagcaaaaggatgtacacttctcaaattggtcatcgcccaaaagaaaaatctagacaacaaaagatagacgaacaaactagttttaggtaaatggcactcgacgtgacgattcatcgaactcatctataattgcatttgttgatattccaagccgcaatttccttttcaatataaattacgaggcaatcccttagaaatccatcttccattttaagtccgaagccttgtcttcacaagtttcatggcagaaaatgcacgttctgtcgttgccgttgaaaccgatagagtaagaacaagtcgaatcagtctatcaatcaaatgatattcatccggatttcctgggttgctgcaagttgttgacaaagttctgatatacttgtcaaaattttgaaantttggggttagggggtacaacaatttcaaaaatgtcg

SEQ ID NO: 90711 - DNA, 589 bp, Triticum aestivum
  unsure (1)..(589): unsure at all n locations
  Clone ID: PAT_TA_90711
nacaatanaaaatcaagnctatgcaancaaacgggtggggggcnccccnaaagggcngactggaaggnggcngcaaatcnacaaatggantnacgggggccccgncngaggcaagcaantttcnagagaacaanaacaaaanggggtccggggcctgaaaacaactggnaaanangggaaagacnnaccctggttggncccaataagggcntgggttcctcaacnttggngggcngccgggtnaacccctggttcaagaaaaacaagggacaagcngagcaatgggtggggaatnggcctgaaccgcccgttcaataacaattaatnacaagtttgcnagctnaaattccggtttgatngtcngcaanagntttggccttacttaaaaagtaacccantttcaaactngatgntggtaaagaactggtaaagaagntatcaatccntaatacaatattaaaaacgggaccaaagttttggtctcngggnccaccggtttttaatncccnattttgcaatgttgaagncaaacctaantttgttttgcnacaaaaaggagccctaatggntaaataaaccccaaatttgg

SEQ ID NO: 90712 - DNA, 584 bp, Triticum aestivum
  unsure (1)..(584): unsure at all n locations
  Clone ID: PAT_TA_90712
gaattcactaatnatttcnagcggccncccgggcaggtgacnataccccanctgcntccggcggccctggccccaagatnnaggaggtttgactaaacagtccgatgttctgtgacaagagggcggtgaancctgctgcctaanttacaagtattattaaggtcgtgtcctgtcatctgaagactttgaggttgtgatgggttattgtttcgcctccgggtgggtcgggagttattnccagttgcgagtttgggaacattccgtgggttaanattggggcccacnaatgtcaacgtctaagtaaatataattanttcctantntcgttgggggaaaaaaaaaaacctncgggncggcgaccaacncctaaatccgaatttcccgccggntcccccattggcgggccgggggaggcaatgngaacntcggggcccaaattcnnccccctaanangtggagncngtaattaacaaatttcactngggccggtccgnttttanaaacngtcngtggacnngggaaaaaacccctggnnggttancccaaaanttaaatccgccttgncaggaanaatcccccttttg

SEQ ID NO: 90713 - DNA, 482 bp, Triticum aestivum
  unsure (1)..(482): unsure at all n locations
  Clone ID: PAT_TA_90713
naattcacnaagtgatttcgagcggncgcccgggcaggttagtctcgagtttttttttttttttctgggctggacgacatccttgngggctgtcnangcttttttttttttttttttggctgggngngagttgatttgctgggcctcgtantacntgntgtttgntgcnggctangtgcctaggccaantccctctcnctcnccttgggtcncancctcatncagtttttttttcnagnttctcaaaaataaagnaaanttgtttttctttataaatcaacggggngttgtttttccatgggaaacaccggggctgnngttttttttttganaaaacactggngtttggttgtgactgtgtggcgagnagcaacagcgcacccgcgagcgnanataaattcanaaaacgaaacacacaantnggcccaaantagaanttaaaatgtncnatcaaaanggaaaatgataggaaacntgangcc

SEQ ID NO: 90714 - DNA, 533 bp, Triticum aestivum
  unsure (1)..(533): unsure at all n locations
  Clone ID: PAT_TA_90714
naattcactantgatttccagcgggcncccgggcangtatttnngagccnttatggggtgnaatctaaccatccaaatcattatggngaccaactgcatccaaggccacacattgcagtttggncaacacatatccgcaaagcaatctangggagtcnagtgggtgtatccgactatatatcangatgatnaagtgccttatggnaggcggncatcttgaatgctagaacaaggagaatgatttcaggttcctgatgatgaaatgtacaaaggggtccggggaagctgncanttggngtccgcccccaacccangatgtgttaacttcaaccaatctaaaatcaaaagcgcggcggggttgattaaaancgcccgtgtcccgnaaaaagtcctgggggaatggtgggnttgattccttccccctggcaataaaagaaccgggcaattaaaggtggggaatggtgaccttggnttganccttgatgggggctgggcaactgnctaaaatgtggnggtactgtgcctggatcntg

SEQ ID NO: 90715 - DNA, 497 bp, Triticum aestivum
  unsure (1)..(497): unsure at all n locations
  Clone ID: PAT_TA_90715
gaattcactaantgattaacgtggtcgcggccgaggttgntcaccancacagccgcgcatccaccgttgctagcaaggtcgaccaagcagcaccgagatggntgctgccttctcctccaccgtcggtgccccggcttctacgccgaccaacttcctcgggaagaagctcaagaagcaggtgacctcggccgtgaactaccatggcaagagctccaaggccaacaggttcacagtcatggnagcggnaaacatcnacgagaagaggaacacagacaagtggaagggtcttgcctacgatatctccgaccgaccagcaggacatcaccangagggaagggnatcgtggactccctcttccaggcgcccacgggcgacgggacccacgaggnccgtcctcagntcctacgagtacgtcaagncagggactcaagaagtacgacttccacaacaccatggggagggntctaatcgctcctgcnttcatgggagaagcntgt

SEQ ID NO: 90716 - DNA, 516 bp, Triticum aestivum
  unsure (1)..(516): unsure at all n locations
  Clone ID: PAT_TA_90716
gaattcactaagtgattaacgtggncncggccgaggnctaatctcnaganttttttttttttttttttttttnttttttttaaaaaaaaatgcaattccattgcncccaatgatttccgttcaagataanactagtacnattaaatacttgntgntattcncttaggcaaacacaaaattgggatcannggaacaagatctaatccaaagacaancangggtcggcaggaaannccggtntcttaacaacttcactggngcgcanacacttaaaaaacccggtacacncttccccatgggggtcttcacggnagagggacctcacaatctgccnaattcttcttcangggggganaaanggaatttgacacncaattggganttttggtggatttgnttcnccgnccaacgnaaaaggttggcccaaaagaaanacccnatggaaagaancntctttaactgggacntgactggtngctttttnccccgntgaccntggnttccaanaaattcctg

SEQ ID NO: 90717 - DNA, 374 bp, Triticum aestivum
  unsure (1)..(374): unsure at all n locations
  Clone ID: PAT_TA_90717
gaattcactantgatttcgagcggncgcccgggcaggttcnaagatttttttttttttttttttttttttttttttttttnanntgcaatctaaataacttgnatttcacaanaaatcaatctcaaggcacaaggaagtttaccccgaagcanggnnataggaaatncagtaattaaacgacaagacagggntnattgctccgcccgggggataaagaagtctggcangcaaacaananagcaaatggaccatgnaaccaaanaaccttctggctaagaaatanatgccntaattttcttcttgaatggggaagcctttgggnaacctttggncggcccgggtggggggtcctttcttctccaangcccctttg

SEQ ID NO: 90718 - DNA, 518 bp, Triticum aestivum
  unsure (1)..(518): unsure at all n locations
  Clone ID: PAT_TA_90718
gaattcactaagtgatttcgagcggccgcccgggcaggtaagctatatacctacatagtacagccatggcccccaccgtgatggnctcgtcggccacctccgtcgctcctttccaggggctcaagtccaccgccggcctccccgtcagccgccgctccaacggngctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcaacaangttgggtttatcttccgtgagcaaaaacgcatnccctggggtactacgatggccggtactggacnatgttgaagctgctaatgttcgggtgcaccgancgccacgcaaggtgatnaaacgaggtgggagggaggtcaaanaaggagtaacctggacgccgttatgtccaacatt

SEQ ID NO: 90719 - DNA, 528 bp, Triticum aestivum
  unsure (1)..(528): unsure at all n locations
  Clone ID: PAT_TA_90719
gaattcactagtgattancgtggncgcggncgaggnttttttttttctttttttttttggagntgancagncattgggggcaagnactggaacnataatcgaatcancatacatggatttcggcaaaccaaaacctaacctccttttnttttttccaaaaaanacnacnaaagagcctaaatncacattgaacccgcccgcaccanactgggcgcaaacttgnnngccactaatcttannacaaacaccttttttatgtcnnangatttcancgctgagttcaagcggttactaagggtaacaactttaaccatcttnggaacanatcattcctcaactccntggcccgctttgntgcgcgtcncccancatcgncgccgctgatgggnttcatcaancaacccntggtccttaaatccggggaaagcttcctggncntgggnccaatttataaccggccngcnggaactccggngtttcctgggatcangaggnaccnacctcttccaccgggttgnagaanngggn

SEQ ID NO: 90720 - DNA, 466 bp, Triticum aestivum
  unsure (1)..(466): unsure at all n locations
  Clone ID: PAT_TA_90720
gaattcactagtgattaagcgtggtcgcggccgaggtgtctcgagtttttttttttttttttttttttttttttttttttttttttttttttgggngttcangactataattatgactgttcgatggcctgtanganatntgcccgttcaanaanggttntntcantccctgttgttcancancattanatntacaccaactgtaaaaggggaagttctaaaaagaaaggngaaccnatnaaacncttgtcacttgcaatcatcaaatccaanttctcaatcntggatcggngtttatatcatctgcacctcaaaattttcccggactgttccagaaaaaaaaaaacaatctggctggctccaaanggggaaanttntatgtttcnccggccttgttgggaaaacnannggttggcncccccttccggattcnaaccaaaggggaanaanggcaagaccnaccttt

SEQ ID NO: 90721 - DNA, 324 bp, Triticum aestivum
  unsure (1)..(324): unsure at all n locations
  Clone ID: PAT_TA_90721
gaattcactantgattancgtggtcccggccnaggtgagaactaanctcnagttttttttttttttagttaaaccanggagattttatttaggggggnctgtttacaacaagcatggcatggcacctgactgctgatgcaggtcangtgcataaataaggccctcnntcaggtagcggttacatggnatggtaagtagtaaatcnatatgatcgatgctgcacncgcggtgcatgcatgatcnatgatcaatgatctagcagctgcagcaagagcaagncgcagctggngccncacttgcactggggtgcagcaccngcccccg

SEQ ID NO: 90722 - DNA, 355 bp, Triticum aestivum
  unsure (1)..(355): unsure at all n locations
  Clone ID: PAT_TA_90722
gaattcactaagtgatttcgagnggccgcccgggnaggncacancttcacaagncantacacacaccaatatatgtctcctttccagagctatgctacgcatcaatggcttctggtgctcatatgaacatggttgccgtcggcaatgatgctngccatcatgttcatcgctgcncctaatgcaganncagcgcctgcagaaacttgcatcngacaaagaccggaaaagttggncttgccantgactgcatctgcnccaaaaantgtgcttgtggangaaagtgcatcttncnaggttntgangatgntgacatccaaaagtgntttgtcgaatgcntgctgaaaaatgaatgcaa

SEQ ID NO: 90723 - DNA, 564 bp, Triticum aestivum
  unsure (1)..(564): unsure at all n locations
  Clone ID: PAT_TA_90723
ggcgcgaattcactaagtggattaancggtgggtcnccggcccgnagtttttttttttttaaaccaaataataaatnccattatttctggggcaaaaagcaaacgccgcctctcccaaccctcaaaaaggntcaaaacataaccaacaataacaaatcctccgcctaaagagacaagcatggtaaggataatanaagggaaaacaaggataagtttgatagaagttccccgttgggtgcccgctgctcccgactcaaggctcaaagccaagcccggctaagtcatgctgggacacactaatacccggtaaagcccgcaaggcttgtaaagggaccctcaaatttgggatggctaaatggtaagtcaagacctgggggaacttgggtgaagctttggtcaaacctgggcggccgaagctttgcccaaagtggganggggccgcggancttctccgtccaangtggctttggggggaaaaacngtaanaccctttctttctcaanacnttgccaatggggcctcctncggttccaacaaactcaaagctggaagcaaataaaccng

SEQ ID NO: 90724 - DNA, 343 bp, Triticum aestivum
  unsure (1)..(343): unsure at all n locations
  Clone ID: PAT_TA_90724
gaattcactaatgatttcgagcggccgcccgggcaggtcaacaatggaaaangctgcanctgaggttcgggaaaggcaagctgctgaggctcgagagaggcacgctgcttctgnagcggcagcancggcaagagaaaaacagaagtaaaccanatgacctttgagtcctttttttntatgggtgnccggngcaaacaatgcacctaaacaaagggntccaacaagtggnttcctaccgtttaatgctcanaagtcaaaagtangagcgtcaagcaaactcctggcttcaacaatcaanctatgcggggaggggatnaatctacaaacaaatttttngggntga

SEQ ID NO: 90725 - DNA, 690 bp, Triticum aestivum
  unsure (1)..(690): unsure at all n locations
  Clone ID: PAT_TA_90725
acggnggacaactaataagaaataaccaaaagctattgcatccaaacgcgttggggaagcttctcccaataatgggnccgaaccttgcaaaggcggggcgccgaatttcaactaagtgattaaacggtgggtcgccggnccgaanggtcaacctggctttctttgagntttcttccccgaaggaaatttgggtcggncgtaaaaaacccgggggcacccgacggtnggagggaagaaaggnaagcaaccaatctcgggtggctggcttggtcgaccttgctaagcaaacggtgggatgccccgggcttgtgctgggtgacctggcccggggcgggccgctaaatccgaattccccgcgggncgccatggcgggccggggaagcaatgcgaacgtccggggccccaattcgccctaataagnggaaggtccgtantaacaaatttcaactggggccggtcgttttaacaaacgttcgtgaactgggggaaaaanccctgggcggtttancccaaaccttaaatccgcctttgcaagcaaaatcccccctttccgccaagctgggnggtnaataagcgaaaaaanggncgncaaaccggatttgccctttcccaaacaantttggcgcaancccntgaaatggngaaattggacgcnccccttgttaacnggcgcnaatttaaagcgccggg

SEQ ID NO: 90726 - DNA, 478 bp, Triticum aestivum
  unsure (1)..(478): unsure at all n locations
  Clone ID: PAT_TA_90726
gaattcactagtgatttcgagcggccgcccgggcaggtcgacgaattacttctgaataaatttagaaatcatatggaagaaccatagcatttcgcgactcattggtaaatcaactttgattctctataaaccaagaatgtgagaccattaacacggntaaagctaaactgcttgaantccaggcaaaaagaggtactctttctacanctatattagtattagnaccgaatttaaacgggaaatagctaatgtaaaatttatctgatatagaacactcatatcgacaaaatggnttgaactatttactagaaaaaaaaagggggcacctgcccttttttaaccaatgccgaatncgacnacctatgtataaaaaaagagaaaatttttttggatttgnagaaaaaaaaaaangaantccattaattttccattttccatttatttaagttaaggttttcctaaaggaacttgaaattat

SEQ ID NO: 90727 - DNA, 491 bp, Triticum aestivum
  unsure (1)..(491): unsure at all n locations
  Clone ID: PAT_TA_90727
ggcgcgaattcactaatgattaacgtggtcncggccgaggttgatcaccaacacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaantaccatggcaagagctccaaggccaacaggttcacagtcatggcagcgggaaacatcgacgagaagaggaacacaagacaagtgggnagggtcttgcctacgatatctccgacgaccaagcaggacatcaccaagagggaagggcatcgtgggnctccctcttccaagcgnccacggggcggacggnacccacgaggncgtcctcaagctcctacgagtacgtcaagcaaggactcaagaagttacgacttcgncaancaccatggggagggttctaaatcgctcctgctt

SEQ ID NO: 90728 - DNA, 475 bp, Triticum aestivum
  unsure (1)..(475): unsure at all n locations
  Clone ID: PAT_TA_90728
gaattcactaagtgattancgtggtcgcggccgaggtgtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcancacggagggcctcctcaagcaagtcgactacctgatccgctccaaagtgggtgccttgcctccaagttcaacaaggttgggttcatcttccgtgagcaaaaacgcatctcctgggtaactacgatgggcgggtantgggcaatgttgggaagctgnctaatgtttccggtggaacttgacgccaacacaaggtgattaaacgaaggtggggagggaggtcaaaa

SEQ ID NO: 90729 - DNA, 459 bp, Triticum aestivum
  unsure (1)..(459): unsure at all n locations
  Clone ID: PAT_TA_90729
gaattcactagtgattagcgtggtcgcggccgaggtcctctcccctcgcctcctcgtcctccccctcctaggggatcgccggagaggaatcgcgacgagggcttcctcctatcagttaaatcaaagccatggagcacaaggagaccggctgccagtctcgggagggccccatcctttgcgtcaataattgtggcttcttcggcagcgcggcgaccatgaacatgtgctccaagtgccacaaggagatggcgatgaagcaggagcaggcaaagctggccgcctcctctttcgacagcatcgtcaacggtggcgatgccgcgaaagaacatcttgctgctggcagcacggcggtggcagttgctcacgttgaggcgaagacgcttattaccgcacagcctgctgatatcgctggtccaagcgagggggcgattggacaancccaaaggcccaagccggtgn

SEQ ID NO: 90730 - DNA, 445 bp, Triticum aestivum
  unsure (1)..(445): unsure at all n locations
  Clone ID: PAT_TA_90730
gaattcactagtgatttcgagcggccgcccgggcaggttttttttttttttaccaaataggtatactcaatatctttatatattaacaaaacatgcccagcaatcgcttggatgcgatgcggtacttaggtacaaaggataaaaatatcangatattaaattggcatgcttaaaaggtgtaaaaggcagctgccgtcgtcactcctcgccgttgggtcgaagttcttggcagtctggtcggtgcatcctgccgggcacaggcaaagtancttgctgggcccctttactcctcctatgcaacaaagaagatgggtggggtggtgtatgggngaatgttctaaccggttgaangggaccangtcttcatncgcatccttggtntagcaatcacccaaaaagctnccctgggctcaatggtaaggtgntcagcaaaagcntgcaacac

SEQ ID NO: 90731 - DNA, 190 bp, Triticum aestivum
  unsure (1)..(190): unsure at all n locations
  Clone ID: PAT_TA_90731
gaattcactaagtgatttcnagnggccgcccgggnaggtgnaaancagtcnctcggtatgcnangatgttggggnaagngttatttttggttttcttccttatgagtgggggtcggggangggcaatgggncttttcctaccaatctattcccctaggggcatgcgtantngcacttttcttctaaggcc

SEQ ID NO: 90732 - DNA, 180 bp, Triticum aestivum
  unsure (1)..(180): unsure at all n locations
  Clone ID: PAT_TA_90732
ccgcccgggcaggtgccgcctccaatagctaaacaatgtaatgacagaattgtggacagatttgtaactcttctgctgttcgtgaccaatcggtttaattgggggtcaaanaaaaaaaanaaaaaaanaaaaaaaaaaaaaaaaaacctcgagactanacctcggccgcgacnacgctaa

SEQ ID NO: 90733 - DNA, 295 bp, Triticum aestivum
  unsure (1)..(295): unsure at all n locations
  Clone ID: PAT_TA_90733
naattcactagtgatttccagcggcncgcccgggcangtangattgngatcttatccgtgnnngcactttanaaccattttttaagnatttttcgggataaatanntaaaagggngcacgntctcgcacgaanttacttctgaataaatttagaaactcantanngggcgganccatnggcatttcgcganctcattggtaaaatcaacttttgcgttctcctagtaacccanggcaaatgtggngacccattangcaccgggttaaaaagctaanaacctgcntggnangtcca

SEQ ID NO: 90734 - DNA, 283 bp, Triticum aestivum
  unsure (1)..(283): unsure at all n locations
  Clone ID: PAT_TA_90734
gaattcaataaatgatttnnangcggccgcccnggcaggtgcggcggattgctaatccgttgtacaatttttttgtaccganggttccgaatccctctctttcccgcncccttggatcatttgggantttcgaaatggngaaagaantctgacccccggngttttctcataanataaaatgtacggaanacaaatccaataagaaagaaaanaaaaanaacggggattattacnccctcnccgtccanaggantccgtccctggggggtcattangatnaacg

SEQ ID NO: 90735 - DNA, 421 bp, Triticum aestivum
  unsure (1)..(421): unsure at all n locations
  Clone ID: PAT_TA_90735
gaattcactantgatttcgagcggccgcccgggcaggttcgagttttttttttttttttagntgacatattgtataatattatgcgtccgtgcatatacatagccaccgatagcattcacatacgagcatgctttctcnagccatgttggtacatgaacatggacatacacatattcttaggaacaaataacaaagataaatggcgaaggaaaacccaaagcaatgtcagagttgacaaaactgcaatggcactttatatatggcctgtcgtgagtgagctgtttaggccttgccggactccctcgcancccggtggcttgaaggcgatgaagctgacgcactgnacctgacgcatgttggtcgaatccgaagaagcggacatacgcggncagggtaatccttcttggactcctccacctc

SEQ ID NO: 90736 - DNA, 311 bp, Triticum aestivum
  unsure (1)..(311): unsure at all n locations
  Clone ID: PAT_TA_90736
gaattcactaagtgattancgtggtcgcggccgaggttcgagatttttttttttttttttttttttttctttttttttttttttttttttttttntttttttttttttttttaaaancaacttaanancttcnccaaanaaanangcanctttccaagtgttcggttcngnggttgggggatgacaggcancaaccanaattanatanggntacttggcaaaanctaataaataaaaaaactgnccanattttgncttgggatcnaaaccaantttttntgnaaaaancggcccgncgacgggggatcaca

SEQ ID NO: 90737 - DNA, 197 bp, Triticum aestivum
  unsure (1)..(197): unsure at all n locations
  Clone ID: PAT_TA_90737
gaattcactagtgatttcgagcggccgcccgggcagganttttttttttttttttttttttttttttttttttnttagaaaaaaaacatagntccaagaagctcaaataaagcancttgtagagtttctcntcaggggagngagaatacngttctacagttttaccatcacaanagttcatcaccatgtctccaagg

SEQ ID NO: 90738 - DNA, 224 bp, Triticum aestivum
  unsure (1)..(224): unsure at all n locations
  Clone ID: PAT_TA_90738
cccgggcaggtcatgcattgatgggtgttgaaggggccaatcttgnntattcatgngatcttttcttggnnagccgganagactcataatcctttcttacgttaanttcanttantccatgagaaatggnnttattccatggaattcctcaacagacgagggctcantcanagntgacaaacatctaacgcnctactagtantgacctaccnaaccaacagtaa

SEQ ID NO: 90739 - DNA, 387 bp, Triticum aestivum
  unsure (1)..(387): unsure at all n locations
  Clone ID: PAT_TA_90739
gaattcactagtgatttcgagcggccgcccgggcaggtctagtctcgagttttttttttttttttanatggctatgttctatttgtaggagtaaaataaggattangctgtggagagatggctgagtggttgatagctccggtcttgaaaaccggtatagttctaggaactatcgagggttcgaatccctctctctccttttgcttattgaatacgtttgnttctttcantttttttttttctggcccttanctttctttcaaaaaaaaggaaatgaatggntcgacctcggccgcgaccacgctaaatcnaattccccgcggnccgccaatggggggncgggggagcatgggnacggccgggcccaaaattcnccctaaaaggtga

SEQ ID NO: 90740 - DNA, 529 bp, Triticum aestivum
  unsure (1)..(529): unsure at all n locations
  Clone ID: PAT_TA_90740
gaattcactagtgatttcgagcggccgcccgggcaggtatccagcccccctccgatctcgccgagaaatctcctccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggtaaagcagctcgaggatggccgcacctggntgactacaacatccangaaggaatccaacaactccacctggggggctcaagactccgtggtggggaatgcangattcttcgtcaaangacccttgaacggggaangaacnatcaacccttggaagggtgaggtccttcttgacaaccaatcgacaaacntcaaagggcaaagattcaagganaaaggggggggnaatttcccccgggacaaggangggnctcaatttttgctgggaaagnaa

SEQ ID NO: 90741 - DNA, 500 bp, Triticum aestivum
  unsure (1)..(500): unsure at all n locations
  Clone ID: PAT_TA_90741
gaattcactagtgattagcgtggncgcggccgaggtgtctcgagattttttttttttttttttttttttggaaagataaaaactttcaagggcgctanaactttgctgtttcnccaaaanaatcctggcctanaatattcangtgaacttgtaccaagggnttcnngattattanaacaaacctattcctgtgntgaccancncatgtaattctanaaanatagcctattanngatgtcctagctcancacttgngggacagtgacaacaaaagttaacnaagataatgggatcaaaatttgntttctctgtgnntcaaaanaancaatcngtgnncttagggggcntntgtgnattnacaagntggatntggtgcatcctggggggacangtattatggctccaaaatacnccatttgnaaactcccccctttcccctgtgtcaatttaancgaaanccnccgttccaataatccnaccaatanctggttaagtggggg

SEQ ID NO: 90742 - DNA, 395 bp, Triticum aestivum
  unsure (1)..(395): unsure at all n locations
  Clone ID: PAT_TA_90742
ggcaggtccgcaccgcacgagtgaagtgagagctttgcacgaaaagttcatcaagcgaccatgaagggcaccaagctcgcggcgatcctcatcctccaggccgtcctggtcatgggagtcctctcacacgtgaacgccgactatttccccaagtgctgcaacaactgcaggtccttctccgggggtcgacgtctgcgacgaacgcccaccccaagtgccccaagggctgctcggcgntgcccgccgtggtgtcnacgangccccgaaaatgtgggcgctggcgcggnatatggaaatccacccgntcgacgggnaccctgncggggggggccctgcnaagnaagntaacnggatcgggctccatgccaagcaatgaatattgttcccgccctaaa

SEQ ID NO: 90743 - DNA, 493 bp, Triticum aestivum
  unsure (1)..(493): unsure at all n locations
  Clone ID: PAT_TA_90743
gaattcactagtgattagcgtggtcgcggccgaggtcaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggngtgccgcgtggtgtcgacgagccccgaaatgtggcgctgcgcggatatgaaatccaccgtcgacggnacctgcggtgggaccctgcaagaagtactgatcggttcatgccggcatgatatgttccgcctaaaataaaataaaaagctcanggcgagatgagnaagcgtcatcgtgncctatnncgtgtgtgtggccaaanaatgcttaatacantntgtcgtccncttcc

SEQ ID NO: 90744 - DNA, 511 bp, Triticum aestivum
  unsure (1)..(511): unsure at all n locations
  Clone ID: PAT_TA_90744
gnattnaataaatgatttccnncgggcncccnggcaagtcgcngagctcanctccaacgcctcngntgcnttgggntaaagatcaagtttggngaagcctgnctggacaaanaagcaaactggntgctcaancanaagctntttcaatccaacaataatcccctggncnnggggcaccgaaacacaacncacnccttatttnacangttggnattggtatggaccanngtcangaccttgtgaacaaccttgggtaccattncaaagggnctgggcaccaaagggatttcaatgggagggaacttggctgccggggtgcctgatngtngtnccatnaattgggtccaagttttggggtgtnccggtttcctaactcctgccntaaccctccggttggcttgaagangaagtccctttgttgngccaanncaaaggcacnaaccgaatngnccgaagcangtattgttgttggggaagtccccaaggcctgggggggggtccctttcacctg

SEQ ID NO: 90745 - DNA, 399 bp, Triticum aestivum
  unsure (1)..(399): unsure at all n locations
  Clone ID: PAT_TA_90745
gaattcactagtgatttcgaagcggccgcccgggcaggtatttgtggggggaaagctaagatgagagagaatactctgggtagctagagagggagatgatctcggaggtcagaaagcagttagntccaaaaagactcatagggtttgttctctttcgccnatggagagatggnccantccagtccatgttcttgtgcggngtcgccttcaatcgataatcaagaagacaagggcatgcatgcatagatcaacgcggggaagaggnaanaagcacccnnagcaagtgtangtctaagatcactcctggcctaatactgcttganttgctgcttctccctcnccttggatgttttgtntaacaaggcatatggcgtanggtgtgggggnggagtttatncg

SEQ ID NO: 90746 - DNA, 225 bp, Triticum aestivum
  unsure (1)..(225): unsure at all n locations
  Clone ID: PAT_TA_90746
gaattcactagtgattagcgtggtcgcggccgaggtgcccaccggccggagggaagggagaaaanagaaagctagctgcctttgtctttgggccatggcggtgttcaagcanctttgcatggccaatttcaangtaaggcgtccnggtggnggacatcatccanganctnaccaatctcgccgcggggntccacaccgncaaatantttggntggngcaatggac

SEQ ID NO: 90747 - DNA, 439 bp, Triticum aestivum
  unsure (1)..(439): unsure at all n locations
  Clone ID: PAT_TA_90747
gaattcactagtgatttcgagcggccgcccgggcaggtgcgaaataaagcatttaacatgtttatataccatctaccataaggccataattgctgtcatgttttacaaacaaaagcacaaggccatagtagttgccatgttacaaacaatagctgctggcatgttatatccaaagtaaaggatgctaagtttgtcatattacaaccaaaactattagagaagattaagcacaacactagtacttccttctcttcggggggcgaattctaagcttttgaggcttgagggcaatgtcatatngctatcaagggtggcccnccacggttggggggtanggtttctgcgangccctcatcaaccttattccnatggncnaaaaatccntcttttncaatggantggggganaggcccttggggnacnccnccgggnaaaaggg

SEQ ID NO: 90748 - DNA, 476 bp, Triticum aestivum
  unsure (1)..(476): unsure at all n locations
  Clone ID: PAT_TA_90748
gaattcactantgatttcgagcggccgcccgggcaggtatccancccccctccgatctcgccgagaaatctcctccgatcgaagcgaagtcaaggctctttcgtcctcctcctcaagatgcagatctttgtgaagaccctcaccggnaagaccatcaccctcgaggttgagtcctcggggcaccatcgacaacgtcaaggctaaagatccaggacaaggagggcatccctccggatcagcaagcgtctcatcttcgctggcaagcagctcgaggatggcccgcaccctggctgactacaacatccagaaggaatccacactccacctgggtgctcagactccgtggtgggatgcangatcttcgtcaagaccctgaccggnangaccaatcaacctgggaggnttgagtcctncttgacaccatcnacaaacgtcaagggccaagattcanggacaagggngggnattcccccggg

SEQ ID NO: 90749 - DNA, 186 bp, Triticum aestivum
  unsure (1)..(186): unsure at all n locations
  Clone ID: PAT_TA_90749
attatgcgtggncgcggccgaggtctagtctcgagnttttttttttttttttttttttttttttttttttgncaagcanaaattttgcaaacatgtccaaatggntcaancataggtagaaatatttgaggtgcangacatccacccnaatttgngtacacaacgagacatacatatntaacttaa

SEQ ID NO: 90750 - DNA, 468 bp, Triticum aestivum
  unsure (1)..(468): unsure at all n locations
  Clone ID: PAT_TA_90750
gaattcactagtgattancgtggncgcggccgaggtctantctcgagnttttttttttttttttttttttttttttttttttttttttggncaagcacaaattttgnatacatgtccaaatggntcancanaggtanaaatatttgngngcatgacacccatcctaatttgggtacacaagngacatacatntttaacttaacatggnacgatccttttctagaacatgaacanagagccccgngtntgggctgaagtggcccctgntaaataagcatcacnaccaaagcttgnattgggtttgttatctgattgcacaccaaanaaaagttattcccttttggctccaagttatagnggatcttgcccaagnggctcaagggcttgcngccnagcctncaaggntaaaggaggcgncgggaatnaaaaaacnacccccntgcccctaagggagnctnntggttgggg

SEQ ID NO: 90751 - DNA, 229 bp, Triticum aestivum
  Clone ID: PAT_TA_90751
gaattcactaagtgatttcgagcggccgcccgggcaggtggagagcttaacgacaacatgtgttaattatatatatctagctaagagcttttactgtcttggctcttactctggttaaagaaagttttgcttaagcaccaattatacaacaaattttccctgagattaattgtactactgtattatgattaaaaaaaaaaaaaaaaaacctcgggcgcgaccacgctaa

SEQ ID NO: 90752 - DNA, 484 bp, Triticum aestivum
  unsure (1)..(484): unsure at all n locations
  Clone ID: PAT_TA_90752
gaattcactagtgattagcgtggncgcggccgaggtatcaccagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggaaagagctccaaggccaacaggttcacagtcatggcagcggaaaacatcgacgagaagaggaacacagacaagtggaagggtcttgcctacgatatctccnacgaccaagcaggacatcaccanagggaagggcatcgtggnctccctcttccaggngcccacgggcgacggganccacgangncgttctcaagctccnacgangtacgtcagccnaggganctcaaggaagtancgacttccntcancaccaatggggagggnttctacnatcgcctcctgg

SEQ ID NO: 90753 - DNA, 263 bp, Triticum aestivum
  unsure (1)..(263): unsure at all n locations
  Clone ID: PAT_TA_90753
ggcangntttcccnnttttttttttttttttcgcganagnggaangggggcanatattanaacatgngagatgcagcacacaatatctcaggttgaggagtttatattttctgnganacaaaacacctgnattttctttttgggacaaancgggggnactnantggnacaangctcaatcttttttccttggggtttcctttcttggatttcacttcnanttttggcaacattnccttganggtcnccaattgggctctcccc

SEQ ID NO: 90754 - DNA, 537 bp, Triticum aestivum
  unsure (1)..(537): unsure at all n locations
  Clone ID: PAT_TA_90754
cagccccccatccgatctcgccgggaaatctctccgatcgaagcgaagcgaaggctctctcgtcctcctcctcaagatgcagatcttcgtgaagacccttactggcaagaccatcacccttgaggttgagtcctctgacaccatcgacaatgtcaaggcaaagatacaggacaaggagggcatccccccggaccaagcagcgtctcatctttgctggcaagcagcttgaggatggccgcaccctcgcgggactacaacatccaagaaggagtccaccctccacctggttctcaggctccgtggtggtatgcagatatttgtcaagaacctcactggcaaagaccatcaacctggaggntgagtcctcanacaacatttgaaatgtgaagggcaaagattcaagaaaaaggagggtatcccaacgggataagaagcgtctcaatcttttgcgggaaagcaantttgaaggatgggccggaacccttgcagactanaacatccanaaaggnggtccaatncnccaacttggggntcang

SEQ ID NO: 90755 - DNA, 412 bp, Triticum aestivum
  unsure (1)..(412): unsure at all n locations
  Clone ID: PAT_TA_90755
gaattcactagtgatttcgagcggccgcccgggcaggttttttttttttttaccaaataggtatactcaatatctttatatattaacaaaacatgcccagcaatcgcttggatgcgatgcggtacttaggtacaaaggataaaaatatcagatattaaattggcatgcttaaaaggtgtaaaggcagctgccgtcgtcactcctcgccgttgggtcgaagttcttggcagtctggtcggtgcatcctgccggcacaggcaaagtaacttgctgtgccccttttaccccccctatgcaacaaagagatgggtggggtggtgttatgggagaatggttccaaaccgttanaaaggggaaccaagtcctcaaccgnaaccctgggtttagcaacaacccaaangcttgcctgggt

SEQ ID NO: 90756 - DNA, 479 bp, Triticum aestivum
  unsure (1)..(479): unsure at all n locations
  Clone ID: PAT_TA_90756
gaattcactagtgatttcgagcggccgcccgggcaggtctgatatagaacactcatatcgataaaatggtttgaactatttactanaaaaaaaaagggggcaccctgcccttttttaaccaatgccgaatcgacgacctatgtataaaaaagagaaattttttggatttgaagaaaaaaaaaagaattctattaattttcattttccatttatttagttagtttttcttaatgaaattgaaattattaaagagggcaaataaaaataaagaaacaactttgctgaccatgatatatttttatctaggcggaagagtcctcttaatatttatctagtcttatataggtttcggtatattgaaatataaacataaaaaagaagatagaggataggctcattacntaaaaaaaagatatggaaatagctatcgaaaaaaaaananaaaaacacctcggccgcgaccangnctaatccgattc

SEQ ID NO: 90757 - DNA, 503 bp, Triticum aestivum
  unsure (1)..(503): unsure at all n locations
  Clone ID: PAT_TA_90757
gaattcactagtgattagcgtggtcgcggccgaggtgtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcaacaaggttgggttcatcttccgtgagcacaacgcatctcctgggtactacgatggccggtattggacaatgtggaagctgcctaagttcgggtgcactgacgccaaacaggtgatnaacgaagtggaggaggncaaagaaggagtaacctgacccctatgtccgcatcatnggnttcnacnacaa

SEQ ID NO: 90758 - DNA, 446 bp, Triticum aestivum
  unsure (1)..(446): unsure at all n locations
  Clone ID: PAT_TA_90758
gaattcactagtgattagcgtggtcgcggccgaggttttatttcgtttcttttttatttataccttctcttctttatctttagttttatctacttatcaatagtatctaccggctcgaactcgaatttgatcgccttccatacttcacaagctgcggctagttcaggactccatttgcaagctgctcggataatttcattaccttcgcgagcaagatcgcgcccttcgttacgagcttgtgcacaggcttctaaagccactcgattagctgctgcaccaggtgcatttccccaaggatgtcctaaagttcctccaccaaattgtaatacagaatcgtccccaaagatttcggtcagagctggcatatgccaaacacctgcccggggcggncgctcgaaatcgaattcccgcgggccgccatggngggcgggagcatgcgacgtcng

SEQ ID NO: 90759 - DNA, 301 bp, Triticum aestivum
  unsure (1)..(301): unsure at all n locations
  Clone ID: PAT_TA_90759
tcgagcggccgcccgggcaggtcgacnccgantaccgccacttcaacgacatcaaggagctccctcccnaccgcctcgccgtagatcaggcgtttcttcgaggactacaagaagaacgagaatantggaggtggccgtcaaccganttcctgccgtcggaggacgcctangaggccatccancactccatggntcnctatgccacctacatttgcgaggggcctgagaagatanatanatcnggtgatgccgccccgcttgtctgggagtgatgttgatcaaaaattncntcntgtcgaga

SEQ ID NO: 90760 - DNA, 438 bp, Triticum aestivum
  unsure (1)..(438): unsure at all n locations
  Clone ID: PAT_TA_90760
tcgagcggccgcccgggcaggtgtcataaacccaagtcggactcgccttcctcctcccccaactactcctcctcgcctccgcgcatcgcaccgcaccgggggtcacctgagatcacatacacaatggtgaaggctgtggctgtgcttaccggcagtgagggtgtcaagggcaccatcttcttcacccanggagggagatggcccgaccaccgtgacgggaagtgtcactggactcaaggaagggctccacggcttccatgtgcacgctcttggtgacaccaccaatggctgcatgtcaactgggaccacacttcaaccccgctggtcatgtgcatggggcacccgaagatgaaatccgccatgctggtgatcttggaaatgtgacagctggagncggatggtgttgctaacatcaantgttactgactgccatatccc

SEQ ID NO: 90761 - DNA, 327 bp, Triticum aestivum
  unsure (1)..(327): unsure at all n locations
  Clone ID: PAT_TA_90761
tcgagcggccgcccgggcaggtcaaaatttagcacgctacttctatttggccgaanctgggatgngtaaaaaaattaaggngggagaaaggcaagtgtacgntatgtcgttttccgaananggcgggtnnacaactttccnncncgaaaataanaancctccttnagggaaagcncngggtttngcaaggaaagnttaaancaaaaggcttttnccaaattttggcnaaaaanaattacccgcaannaatgttncgttncatngccnaatngcaancaaacggccaaggtttcnanagatttttccaggggggtgttttggggaatt

SEQ ID NO: 90762 - DNA, 221 bp, Triticum aestivum
  unsure (1)..(221): unsure at all n locations
  Clone ID: PAT_TA_90762
tcgagcggccgcccgggcaggttttttttttttttttttttntttttttttttctggcacactctaattanttagnagaggagattaaagacacatatagnaagggaananntgcaagattacatatcncaaattcacaagatatattctgcaagactacatatcacagnatctacacacttccatatnataacnngttnacattattcnncanggaagaa

SEQ ID NO: 90763 - DNA, 272 bp, Triticum aestivum
  unsure (1)..(272): unsure at all n locations
  Clone ID: PAT_TA_90763
atccgtggtcgcgggcgaggntcgagttttttttttttnttttcnagagggatttccatagtcttttttttaagtaatgacgnctatcctctatcttcttttttatngtttatatttcaatattnccgnagacctatagaacactanganaaatattaagaggactcttccgcctanatnaaaactagatcatggncanganagtngtttctttatttttatnttgacctcattnaagaatttcantttcattaagcancnacccaactaag

SEQ ID NO: 90764 - DNA, 326 bp, Triticum aestivum
  unsure (1)..(326): unsure at all n locations
  Clone ID: PAT_TA_90764
tcgagcggccgcccgggcaggtttttttttttttgctttttttttttttttttttttccttgagttgccctcaatttcatttccaaatatgtcngtcatanataattaacncctagcantacttctttccttgcggttgccctcantttcatttccaatacnctgtcgtgcncccgnaagaaaagatgttcaatctcaaancttaatactcttaaacatattncatgactccaanaacagngtatcnnattactcctaattangntgctcattcagtttcaacatcttcattcacaatccttttgtcttttgnagccgccctccaa

SEQ ID NO: 90765 - DNA, 464 bp, Triticum aestivum
  unsure (1)..(464): unsure at all n locations
  Clone ID: PAT_TA_90765
agcgtggtcgcggccgaggtaacggaaccaacaaatcccaagctaatctcgtctccgatcgactcgaggcttgtcgaatcctccttccccaccgcctcaagatgcagatctttgtgaagacactgacgggcaagaccatcacccttgaggtggagtcgtctgacaccatcgacaatgtcaaggccaagatccaggacaaggagggtattccccctgaccagcagcgtctcatctttgctggcaagcagctgggaggatggccgaaccctcgctgnctacaacatccagnaaggagtccaccctccaacttgtcctgcgtnctggcgtggtggcaatgcaagnntcttcggtgaagancctcaaccgggcaaagaacatcaactcctggaggttggagaagctctgacaccaaccnncaatggtcaaagggcaaggattcaaggacaagggagggnaatttcccc

SEQ ID NO: 90766 - DNA, 294 bp, Triticum aestivum
  unsure (1)..(294): unsure at all n locations
  Clone ID: PAT_TA_90766
tcgagcggccgcccgggcaggtctagnctcgagtttttttttgntttaaagaaatataaaaatgaattatgaatagaaagtaaaatgattcaactttttttttttatttttaaaaatatctttatttaggtaataaaataacttcgntacctanttattttantaacctttttgaatttaaccaactaancccattcntaatttttaattatttcaatgagataagatttttgaaanattaanaatttcaaggagtttttccnaagtccnttttatttaactccttcagaaaga

SEQ ID NO: 90767 - DNA, 436 bp, Triticum aestivum
  unsure (1)..(436): unsure at all n locations
  Clone ID: PAT_TA_90767
ccgcccgggcagcaggtggtcagggatcatcagcagagaaacgcgaagtcggctgatgaccgccgagcattgccaggcccatctccgtgggtcctccactccaagtccgcagctcgaccttgggattcccgcctccatgctcctccgccctctgtcccgcgtgctcctccanacctccctctccaagccgacggntccgaccttcccctcgctggatccggtccaccacgagcctcaagccaccctgccgccgctctcgtgtccatgtcgtgcgtggtgtagaggtggccaagcgtgtggaacaggctgcgtcgcaggcgtctgcgcgttgtgcctccgcttcctcaccccggnggagcgccggactgaacagtttcacgccagactactgttttgttgtacaattttcccttcggttctcaantctggggtttgg

SEQ ID NO: 90768 - DNA, 285 bp, Triticum aestivum
  unsure (1)..(285): unsure at all n locations
  Clone ID: PAT_TA_90768
agcgtggtcgcggccgaggtgcccaccggncggagggaagggagnaaagacaangntagntgcctttgtctttgggncatggtggngttcangcacctttgcatggtcaagttcaaggaaggcgncgtggtggaggacatcatccagnatctcaccaagctcgccgcgggagctcganaccgtcaantactttgggtggggcaaggacntgctgaaccagnaggcnntcaatgnagggcttcacccacgtcttcgtcatgatcttccnagcgtccnnanggactt

SEQ ID NO: 90769 - DNA, 445 bp, Triticum aestivum
  unsure (1)..(445): unsure at all n locations
  Clone ID: PAT_TA_90769
tcgagcggccgcccgggaaggtcggngtggaggtgtgcctccgnagttcatccacccaccagcgccatccatcaccancaccaacacccagcgctaccatcatctcctgccgctagcgccaccatcacctccatgccgctagggccactaccacntcgcgcgcactgcantccatctcnctgctgctcctccacctttcttcttgtcctanctctantgctgctcttcttctttttccctagcctctttgtctgctcttccttctccaaatccccaaantgcttctcctcttccttacacgcctactgctgttcttcttctcctatcttgntgcaccactactgatgctcnttgtcctccagcgtnccctctgctgctcccnaacttgctgctgctccttcctcccttaccttgctgcngaactttcttctgaattcngnattct

SEQ ID NO: 90770 - DNA, 226 bp, Triticum aestivum
  unsure (1)..(226): unsure at all n locations
  Clone ID: PAT_TA_90770
tcgagcggccgcccgggcaggtggcangcatgnngtttgtnattgtcagtcagcagaaganttcgattctggttgttctcaagttttccatgttagggntcttacccttttgagngctattatatgngtatangctactttactgaacgataccgggtcntccagngaaattaanttgnacgtaaactgaaaaaaaatcctcggccgagaccacgctancncgact

SEQ ID NO: 90771 - DNA, 429 bp, Triticum aestivum
  unsure (1)..(429): unsure at all n locations
  Clone ID: PAT_TA_90771
tcgagcggccgcccgggcaggtactagtctcgagtttttttttttttttttttttttttaaaaatttaanaacttcattattgccncnagggnacntttccaanagnttctnacttttgcgatgctgcncanactttggttgagtganagagttttgtcaanagttatggaacttatttggttgggggaanagagtacgtncccttatttggaaatgcttaancttgancttgcaaataanttataaagaannggaantgtcacttcattcagacccctcnacaggatgtgcaggagtntcctggcccaaccggtagnggncgagcgagcgannatcgaggccgntgnggttaaacgncncgatgaagncccnanccgtgcncgctcctgtacataggggggttggctcccgtcnggtgaagggggcca

SEQ ID NO: 90772 - DNA, 384 bp, Triticum aestivum
  unsure (1)..(384): unsure at all n locations
  Clone ID: PAT_TA_90772
tcgagcggccgcccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgtgcatgtgtccctgtaattgcttcatctatcccccactatggatggagtgatgaatatgtaagaatgaaagatttacctanttaactactcctaaaatcgctacttcgggttaaaaaaaaaaaccttcgggncgcgaacaangctaa

SEQ ID NO: 90773 - DNA, 386 bp, Triticum aestivum
  unsure (1)..(386): unsure at all n locations
  Clone ID: PAT_TA_90773
gccgaggtgtcgcctcctcctaaaccactctccctatccccgtgtccagaatctaccccccggttccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagntgatcgatgccgcaatttccacttctcaagggaagttggctgcancaacctgatgttgctgaaggcnttgcactggctggttcaatgtttgcggnntaacngcttgcgtgggattnccccaaggnaanggaaagggaaatggg

SEQ ID NO: 90774 - DNA, 500 bp, Triticum aestivum
  unsure (1)..(500): unsure at all n locations
  Clone ID: PAT_TA_90774
agcgtggtcgcggccgaggtgttgatctgtgccttgaccgtatcaggaagctttcagacaactgcactggtctccagggattccttgtcttcaacgctgttggaggtggaactggctctggccttggttctcttctgctggagcgcctctctgttgactatggaaagaagtccaagcttgggttcacagtgtacccatcaccccaggtctccacctctgttgttgaggccatacaacagtgtcctgtccacccactccctccttgagcacactgatgtgtctatccttcttgacaatgaggccatctatgacatctgccgcccgcctccctttgacattgagcggccaacaataaacaaacctcaaacaagncttggttcctcaaggtcaatttcaatcgctggaacaggctttccctngagggtttggatggggcctctgaaatgttggtntcaaatggnattccaanaccaatcttgggngcccctaaccgagggttn

SEQ ID NO: 90775 - DNA, 446 bp, Triticum aestivum
  unsure (1)..(446): unsure at all n locations
  Clone ID: PAT_TA_90775
agcgtggtcgcggccgaggtcggcgcagggcggcggcgacgacaaggactacaaggagccgccccccgcgccgctcttcgagcccggggagctcaagtcctggtccttctaccgcgccggnatcgccgagttcatcgccaccttcctcttcctctacgtcaccgttctcancgtcatgggagtctccaagtccccctccaagtgcgccaccgtcggngtccaaggggatcccctgggccttcngggggnatgatnttctcgctcgtctaatgnacccgncggggatctcaagnggggacaacaaaccaacgggtgactttttgggctgttcttgtggcaaaaaactgtccctgtncaaaggcatcttctnaaaaaaatntgcaaatgccctagggggnaatctntttgtncntngtgtggtnaaaaggggttccnaanaanggctt

SEQ ID NO: 90776 - DNA, 228 bp, Triticum aestivum
  unsure (1)..(228): unsure at all n locations
  Clone ID: PAT_TA_90776
agcgtggtcgcggccgaggtcgagtttttttttttttttttttttttttttttttttttttttttttttttttttttttttttttggacatgcaanagnccanttttattcgagngnaagtagctagtanatacacnagatggtancactgtanaaggncgngcatggnggnanagtaacttgngatgatacgttananacattanataggnggcatgcattgatgcc

SEQ ID NO: 90777 - DNA, 464 bp, Triticum aestivum
  unsure (1)..(464): unsure at all n locations
  Clone ID: PAT_TA_90777
tcgagcggccgcccgggcaggtgtcaaaaccgaatcagaaatctcaagctcagcacagcaacaatggccgagcagaccttcatcatgatcaagcctgacggcgtccagaggggcctcatcggcgaggtcatcagccgcttcgagaagaagggcttctacctcaaaggtctgaagctccagaacgtggagaagtcgttcgccgagcagcactactccgatctgtcctccaagcccttcttcgctgggctcgtggagtaaatncgtccccgggccgggtcngccctntggtctggganggcaaaagcgtcntcnccaatgggcnnaagattaattggggggcaacaacccccttgnctctgagcccgggancaaccgtggggacnttgccntccacatcngnaagaaantcatncaagggagngacncaattnanagtgncaagaaangaaatnccctgtggntnc

SEQ ID NO: 90778 - DNA, 304 bp, Triticum aestivum
  unsure (1)..(304): unsure at all n locations
  Clone ID: PAT_TA_90778
agcgtggtcgcggccgaggtttttttttttgnttttttttttttttttttttttttttttttttttttttttttttttccaaacataggcttcaacntcntanatagagnacccgcaaaaaaaaaaggtccnatanagagnagctggacagagctatacacaananatcgacgtatgtacacnctgcgggggccgatttttggtaggcatcggacgnaagcatcanatgacggagcaggcgggggggttgncgncnctgaagtaccnccgcgcgtctttggacacctgcccgggcggccgttaa

SEQ ID NO: 90779 - DNA, 501 bp, Triticum aestivum
  unsure (1)..(501): unsure at all n locations
  Clone ID: PAT_TA_90779
tcgagcggccgcccgggcaggtctgatcctccaggccgtcctggtcatggggatcctctcacacgtgaacgccgactatttccccaagtgctgcaacagttgcaggtccttctcgggggtcgacgtctgcgacgacgcccacccccagtgccccaagggctgctcggcctgccgcgtggtgacgcccagccctcacaagacgttccggtgcgccgacatgaagagcaccgtccacggcacctgcggcgggccatggaaaaagcactgatccnttcaanggcttcanggctcaagacgaaggtgtggccgccctaaaaataaaagctcaagatgaagaatgangcantcaatggngccctaatgcttggtgnntgggggtnctggctnataccnggccaaananatatgtnttaaatggctntcncgccgngttnntgggcaaatgtngttttcnccnctccanaaaaggggtggggggggggctantaaattttgtcacnc

SEQ ID NO: 90780 - DNA, 468 bp, Triticum aestivum
  unsure (1)..(468): unsure at all n locations
  Clone ID: PAT_TA_90780
ctcccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggacattgggtcgttcaaggagcagttgatgtggacattggagccaatccctctgctgagggtggtggtgatgatgagggtggtgatgaccaggccgtgaaggtggttgacattgttgacaccttccgtcttcaggagcaacctgcttttgacaagaagcantttatctctcacatgaaagcgctacatcaagaaccttctctggcaagcttgaaggggatgccctaaatgnctttaatgaaaatgtttgngtccggcccaaaggaatctttctaancaaagctaaagggccttcantttc

SEQ ID NO: 90781 - DNA, 285 bp, Triticum aestivum
  unsure (1)..(285): unsure at all n locations
  Clone ID: PAT_TA_90781
tcgagnggccgcccgggnaggttgaatctgttgtagtgacccctgcagtaccagntggtggcangcctgctcctactcatcgaaccaactgnggntaaccggaaggtgaagctgtcacntgancgtgangaanntgatanactcagctatagntggccttgagaatggctatacaccagttatgncagcagaatgttcanggggtgtttacttcanncaaggacccattagggtcatgatnnnttttgcaagcgtnttangcccatcgantgncngaacctatgg

SEQ ID NO: 90782 - DNA, 397 bp, Triticum aestivum
  unsure (1)..(397): unsure at all n locations
  Clone ID: PAT_TA_90782
cgagttttttttttttttttttttttttttttttttnaaaaatatctttatttaggtaataaaataacttcgttacctagttattttattaactttttgaatttaaccaactaaacccattcntaatttttaattatttcaatgagataaatttttgaaaaattaagaatttcagtattttttcttactctttttatttattctttcagaaagagataagaattggtttggtgaancggaaanaattttatanaaaaattgaagtaaaaattgaagnaaaaattgcaatttcttttcttaggggaacatacatancaatatgcatgggtaaancctccttcctcccaacttccaaggtattactgncantggggatttggccttaatccntactccc

SEQ ID NO: 90783 - DNA, 513 bp, Triticum aestivum
  unsure (1)..(513): unsure at all n locations
  Clone ID: PAT_TA_90783
agcgtggtcgcggccgaggtgtcgcctcctcctaaaccactctccctatccccgtgtccagaatctaccccccggctccaatggcggcgaaggaaccgatgcgcgtgctcgtcaccggcgtcgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactggtgtgaatgttgcggttatggttggtggattccccaggaaggaaggaatggcaaggaaggatgttatgacgaaaaatgtttcaatctacaaagctcaagcatctgctcttgaagctcatgcaagccccaatttgcaangttttgggtttgtttgcaacccaaccaaacacaatgctctcatnctnaagg

SEQ ID NO: 90784 - DNA, 519 bp, Triticum aestivum
  unsure (1)..(519): unsure at all n locations
  Clone ID: PAT_TA_90784
agcgtggtcgcggccgaggtaacggaaccaacaaatcccaagctaatctcgtctccgatcgactcgaggcttgtcgaatcctccttccccaccgcctcaagatgcagatctttgtgaagacactgacgggcaagaccatcacccttgaggtggagtcgtctgacaccatcgacaatgtcaaggccaagatccaggacaaggagggcattccccctgaccagcagcgtctcatctttgctggcaagcagctggaggatggccgaaccctcgctgactacaacatccaaaaggagtccaccctccaccttgtcctgcgtctgggtgggggcatgcaaatnttcgtgaagaccctcaccggnaaagaacaacaatccgggagggtggagaactctgacaacatccgaaaatgtcaaaggncaaagattcaaggacnaaggnggggaattccccccggaacaanaaancggcctggattttttgccggggaangaacttggagggatgggcgcancccttggg

SEQ ID NO: 90785 - DNA, 180 bp, Triticum aestivum
  unsure (1)..(180): unsure at all n locations
  Clone ID: PAT_TA_90785
agcgtggtcgcggccgaggtcttaaagctccggtggtgaaactttcttcttgtggattcgcccatggcttccgatggaggctggacttgtaatatcacccatgcgtgttattctaaacatggcaaaacatactactagtttgaagcaaaaaaaaaaaaaaaactctcganantactcaca

SEQ ID NO: 90786 - DNA, 159 bp, Triticum aestivum
  unsure (1)..(159): unsure at all n locations
  Clone ID: PAT_TA_90786
agcgtggtcgcggccgaggtcgccaacgctgcgccgcccgccgaactttggagaggagacgcggnnggacgggaagangggatncgagaagganattcctgaaagccggaacnggccccanncccgtcaagggcnaaaggtcaccgtncantncaacgg

SEQ ID NO: 90787 - DNA, 180 bp, Triticum aestivum
  unsure (1)..(180): unsure at all n locations
  Clone ID: PAT_TA_90787
aggtgaactagtctcgagttttttttttttttttttttttttttttttttttttttgaggcanaaccccantacatatatttacagagacgcannggtccngaanattatgcgaactgaanattgtaaanaanctgagtcanaagtactgggaatttaatgattagcagtatcncaatca

SEQ ID NO: 90788 - DNA, 427 bp, Triticum aestivum
  unsure (1)..(427): unsure at all n locations
  Clone ID: PAT_TA_90788
agcgtggtcgcggccgaggtctcgagtttttttttttttttttttttttttttttttttttttttttttttttttttttttttttttaaacccanacaatgtcatattgcatccatccaatcacctananaatgataagggtancncccattgaaaattcaananatggaatcngcaatgtgcatacaagattcatcatcatcgtcgtcgtcatcatcatcatccatcttcaggcaaaatanaacccccaanacactctggtccaaacctgtcnaatggccgtccatttcgctaccctctgntaccantacaanatctaccggaacgaaaactanacaaagttcaacatgnttgcgcaagaccangaacaacganntgtaaaacacaaggggggtcatcancngangggagcnccataacatgtagn

SEQ ID NO: 90789 - DNA, 441 bp, Triticum aestivum
  unsure (1)..(441): unsure at all n locations
  Clone ID: PAT_TA_90789
agcgtggtcgcggccgaggtgcaatacaangaacactaaaagtattaagaaaatacatctagtttcatagacaacctagcgacgactaaagcactagagcaagccgaaggcgcactgccatcatcacccctcccacaacgggccaagcaaaatttgttgtactaaatatagtcgggaagccatcatgctatgctaagaccccacgggaccangggactagaacaacaatcatcgacgatgaatgagaaccatattggnaggatacaacttataggacacacgaacnancattggnttaacggngatcatcaangaccaaatnccggacnngattccanctcgatccgccgaaggacacacatccacaacgccctctaaataccgctagntgcaccgcccggggacnggggttaaggcagaagnagggaccttatccaatct

SEQ ID NO: 90790 - DNA, 260 bp, Triticum aestivum
  unsure (1)..(260): unsure at all n locations
  Clone ID: PAT_TA_90790
tcgcggccgaggtgtctcgagtttttttttttttttttanngctatttccacatcttttttttaantanngagcctatcctcgatcttcntttttatgtttatatttcaagtataccgacgacctanataagacnagataaatntnaaggaggacctcttccgccnacgataaaaanatatcaatggggcaanaaaagggtggntcnttaaatttnaattgcccctccntaanaatttnaaatttcattnnagnacaaac

SEQ ID NO: 90791 - DNA, 318 bp, Triticum aestivum
  unsure (1)..(318): unsure at all n locations
  Clone ID: PAT_TA_90791
ggcaggtgtctcgagttttttttttttttttttgacnaagcacgaggagcaantccacagaggattaaanataatgtattacaanaggctgatagaggacngagttanatagtcagatgggcacacaaccaaagcagncgggatcagcagcatcacngaggttcagacccccangcttaggtcaatcantcangtcattgcgggaacatgatnattngtnggtggattatggacaagngttcttctctctctctctctgtttaatctctcctctcgtgctcttgatttgcggcnngatatcacctgccttgnaggngt

SEQ ID NO: 90792 - DNA, 492 bp, Triticum aestivum
  unsure (1)..(492): unsure at all n locations
  Clone ID: PAT_TA_90792
agcgtggtcgcggccgaggtgaactagtctcgagttttttttttttttttaacagggcagaatctcttgattcaaccaaaacacaaccacaccaatttcacgattaccattacaaagcaactcccacaattatcagaaagttttcaagacactcaacatctgacagttactgacaccancattggagagtcgactgncaaccatangataagagcaacantactgacgacagcntagattttngcatacagtgcngattaagcacttgaccctctttcagcccatgtgcaanagtacaggaaagttnggatcaagcagctcccctccttggtnggtaaggcgaaacaccancgccgcccatcaatcaatggcaatgcttctccgccnaacaaaaggaaactgaaagggtccttggagcctttgcctaaagaaacatactttngtgggnnggcctccaacnnttcttcttnaaaagggaatctnanggtccat

SEQ ID NO: 90793 - DNA, 492 bp, Triticum aestivum
  unsure (1)..(492): unsure at all n locations
  Clone ID: PAT_TA_90793
tcgagcggccgcccgggcaggtcgcccgccatggcgaggccgcagcaggaggctatcgacaccttcatcagcatcaccggggccgncgaggccgtcgccatccgcacgctcgaggaacatgctggtgacctcantcaggcagtcantgcacacttcactgaaggagatagcacagtgaacgcactcaatcanagtattccacctgttantcatgatgnttntggttgctggncggncccacttganaagcacgtttcanaannccgttgtttcctgatagctctgcatngacccttttgcanctaatggggctncccaatttccaagcaacttgttttttgaaaagcggttggttctgcctnggtactcccaaatccgtggattgcaacaaagggtccgcaccccctaanaagagacaatcctaantngaaagttaattgacanncaancaattcaaaatccgggncncttctnggtcnagggntttctgtg

SEQ ID NO: 90794 - DNA, 210 bp, Triticum aestivum
  unsure (1)..(210): unsure at all n locations
  Clone ID: PAT_TA_90794
agcgtggtcgcggccgaggtgcccaccggccgganggaanggagaacnnngaaagctanctgnctttgtctttgggccatggcngganttcanccacctttgcatggncnagttcaaggaanngctcntggtggaggacatcatncaggagctcaccaagntcgccgcggagctnnacnacggtcaaatactttgggtgggtgcanggac

SEQ ID NO: 90795 - DNA, 184 bp, Triticum aestivum
  unsure (1)..(184): unsure at all n locations
  Clone ID: PAT_TA_90795
agcgtggtcgcggccgaggttttttttttttttttttttttttaattaggtaaatcattcattcttanatattcatcactccatccatagtggcgatagatgaagcaattacagggacacatgcacacacatacacacaaggncaccangggcagagcataggcggagagcgacctgcccgggc

SEQ ID NO: 90796 - DNA, 234 bp, Triticum aestivum
  unsure (1)..(234): unsure at all n locations
  Clone ID: PAT_TA_90796
tcgagcggccgcccgggcaggtgcgaggattgcaaagatgtatcagctgagtttcttgaaaatggtcatagtgtaggatgtgtgtgcatgagttcacggaggtaagtgtatgtgcgtatgtatgagtgtctgtgtacatagcgtgttcaaatgaataaatgtttcttttttagcgtcaaaaaaaaaaaaaaaaaaaaaaaaaaaaanaacaaaanaaaanaacccaaaanaaac

SEQ ID NO: 90797 - DNA, 309 bp, Triticum aestivum
  unsure (1)..(309): unsure at all n locations
  Clone ID: PAT_TA_90797
agcgtggtcgacggtcgaggtctcatctctctctctctctctctctgacantcttcanttctgtcgcacgcatccaacacacaaatcttgttggtccctctcnctccatctctctctcgctctctctccctctctgacaagtcattcagttctgtcgcnacgcattccaatacacanaccttgtntgnccccttctcccctcnatctctcntcncgncttctcttctctnganaatctttcancttctggtcnccatcggtatccaatcatnatcannccttgctgtggggnccctcttcctcgcctcc

SEQ ID NO: 90798 - DNA, 454 bp, Triticum aestivum
  unsure (1)..(454): unsure at all n locations
  Clone ID: PAT_TA_90798
agcgtggtcgcggccgaggtatcaccagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacangtggaagggtcttgcctacgatatctccgacgaccagcaaggacatcaccaagagggaagggcatcgtgggactccctcttccaaggcgccaacgggcnacggnacccaacgaaggccgtcctcanctcctaacgangttacttaaggcaagggaatncaangaaattaccaacttncgaanaacaancaatggggg

SEQ ID NO: 90799 - DNA, 371 bp, Triticum aestivum
  unsure (1)..(371): unsure at all n locations
  Clone ID: PAT_TA_90799
agcgtggtcgcggccgaggtgctgccttctcctccaccgtcggtgccccggcttctacgccgaccaacttccttgggaagaagctcaagaagcaggtgacctcggccgtgaactaccatggcaagagctccaaggccaacaggttcacaagtcatggcaagcgggaaaacctcgaacgagaaagagggaacaacggacaaagtgggaagggtccttgcngttacnattatctccngacgnaccaagcaagggacattcaaccaagaagggaaagggcaatncntgggacttcngctncttccaaaggccgncccaangggggcnnacgggaacccnangaagggccgtccctcaannttcctnacgnaggt

SEQ ID NO: 90800 - DNA, 456 bp, Triticum aestivum
  unsure (1)..(456): unsure at all n locations
  Clone ID: PAT_TA_90800
agcgtggtcgcggccgaggtaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcaacaaggtcggggttcaaccttccgtgaagcaaaaatgcgtnctcccgggtactacgacgggccggctacctgggacaantggtgggaangcctnccctatngttcggggtggcaacngacgcccacanaaggttnt

SEQ ID NO: 90801 - DNA, 204 bp, Triticum aestivum
  Clone ID: PAT_TA_90801
aagcgtggtcgcggccgaggtgtttttttttttttttttagataaaactgcatatcttttcttcgcgttaaattccgatgcgaatccatccggctatataataacaaaacgaaaaaacatcagaaggaagtaacagcagcagcaaagagttctctacagctcggacaacagactaataacagcagtctcaacctgcccgggcgg

SEQ ID NO: 90802 - DNA, 434 bp, Triticum aestivum
  unsure (1)..(434): unsure at all n locations
  Clone ID: PAT_TA_90802
agcgtggtcgcggccgagggccaaaggggcggtctcaaacccggcgaggccggcgattcccagggcaaaatcggcggctggccaggcagaccgcaagccgaaagatgttgtgttttcagatgttcagctgaaacagcatggtgctgttggtgatggctcactgaaagaaacgtcgatgatgcaagatcggcgcgaggttggaccgaagggaaacggtctgagcttgaaatcactgggatattcctaatcggcgtattgtccggggtttgaatgatggaaagctcaagcaacacnctggagttntctttccactcggangaacaaagcttgaggttncanagggtgtgctccaacccaagtccttactttgccaaggatgcaaggctnaccggcgaatccaaancacggngttatnaatcaaggnccctngagat

SEQ ID NO: 90803 - DNA, 422 bp, Triticum aestivum
  unsure (1)..(422): unsure at all n locations
  Clone ID: PAT_TA_90803
agcgtggtcgcggccgaggttcgagtttttttttttttttttttttagaataacagggcagaatctcttgattcaaccaaaacacaaccacaccaatttcacgattaccattacaaagcaaatcccacaattatcagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaaagtacaagaaaagttggattcagcaagctcccctcctttgtagnaaggcgaancaacaacgcccgccatccatcatngcatngctcctcgcccnaacaaangaanttgaaagggncctttgagccttggctaa

SEQ ID NO: 90804 - DNA, 439 bp, Triticum aestivum
  unsure (1)..(439): unsure at all n locations
  Clone ID: PAT_TA_90804
agcgtggtcgcggccgaggtgtcgcctcctcctaaaccactctccctatccccgtgtccagaatctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactgggtgtgaaatgttgcggttatgggttggtgggattccccaaggaaagggaaggaatgggaaaagggaaggatgtttatgnccgaaaaatnttttccatnctaacaaaagctccaa

SEQ ID NO: 90805 - DNA, 492 bp, Triticum aestivum
  unsure (1)..(492): unsure at all n locations
  Clone ID: PAT_TA_90805
tcgagcggccgcccgggcaggttcgagttttttttttttttttagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaanctgacgcactgcacctgacgcatgttgtcgaatccgaagatgcgggacatacgcngttaggggtacctccttctttgacctcccccnaccccgttggatcaccctgtgtnggcgnccngtgcaaccgaaacatanggnacctccnanattgcncaataccgggcaatctannaacc

SEQ ID NO: 90806 - DNA, 500 bp, Triticum aestivum
  unsure (1)..(500): unsure at all n locations
  Clone ID: PAT_TA_90806
agcgtggtcgcggccgaggttccaagtgggtgccttgcctcgagttcagcaaggttgggttcatcttccgtgagcacaacgcatcccctgggtactacgatggccggtactggacaatgtggaagctgcctatgttcggatgcaccgacgccacgcaggtgatcaacgaggtggaggaggtcaagaaggagtaccctgacgcctatgtccgcatcatcggattcgacaacatgcgtcaggtgcaagtgcgtcagcttcatcgccttcaagccaccgggctgcgaggagtccggcaaaggcctaaaacaagctcaactcacgacaggccaaatataaaagtggcaattgcaagntttgtcaaactcctgaacaattgcnttgggttttcccttncccaaattaaccctccctaatttggtcccaaaaaaaaatgttgtaagtccaatgttcaanttacaaaaatggtncaaaaaannaatgccctttggngaangcnaccg

SEQ ID NO: 90807 - DNA, 376 bp, Triticum aestivum
  unsure (1)..(376): unsure at all n locations
  Clone ID: PAT_TA_90807
agcgtggtcgcggccgaggtctctctctctctctctctctctctctctctctctctctgacaatcttcagttctgtcgcacgcatccancacacaagnccttgttggnccctctccccctcnctccatctctctctctctctctctctgacaatcttcagttctgtcgcacgcatccaanatacaantcttgttngtcnctctcnatcatctctctctctctctctctctctctctgataatcttcagttctgtcngcacgcatccnaacacacnacacccttgttgggtccatcttcttctctctctcttcnggggaaccttgccccggggtnggggcggatccgaaatcnaaattccccgcggnacgtccatgg

SEQ ID NO: 90808 - DNA, 497 bp, Triticum aestivum
  unsure (1)..(497): unsure at all n locations
  Clone ID: PAT_TA_90808
agcgtggtcgcggccgaggtctcctccaacaccatggcccccactgtgatggcttcctcggccacctccgtcgcacccttccagggtctcaagtcgaccgccggcctgcccatcagccgccgctccagcagcgccggcctcagcagcgtcagcaacggcggaaggatcaggtgcatgcaggtgtggccgattgagggcatcaagaagttcgagaccctgtcttacctgccacccctctccacggaggccctcctgaagcaggtcgactacttgatccgctccaagtgggtgccctgcctcgaagttcaacaaggttgggtttcgtcttccggtgaagcaacaataagctccccccgggatactatgacgggtcgaatactgggacaattgtgggaagctgcctaatgttccgggtggcaaccgacncccaacaacaaggtggctcaaacgaanggtgggaggganggtcaaaaaanggagtncccttgacgccctaa

SEQ ID NO: 90809 - DNA, 452 bp, Triticum aestivum
  unsure (1)..(452): unsure at all n locations
  Clone ID: PAT_TA_90809
agcgtggtcgcggccgaggtacaacacagagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccancccaaagtgtccccagggctgctcggcgtgccgcgtggtgtngacgaagccccgaaatgtggcgctgcgcggatatgaaatccaancgtnnacggnaactgcggtggnacctgcaaaaagtnctgatcggntcangccggcatgatatgttnccggctaaaatanaataaaagcncaagcgaaatnaacancgtcatcnngccctatgcttg

SEQ ID NO: 90810 - DNA, 239 bp, Triticum aestivum
  unsure (1)..(239): unsure at all n locations
  Clone ID: PAT_TA_90810
gagacatcgactgctacagagtcatgtagtattaatgatatgactatatcagccacacttcctagataatattttgttcgtgttacatggtttatatgtcgcagtctatattgatgatactacaactcttgtacaatttataagtttaagccgcccttcctaaaaaaaaaaaaaaaaaaaaaaaaaaaaaaaaaaaaaaaaaaaaaaaaaaaaaaaaaaaaaaaaaaaaaaangctcgt

SEQ ID NO: 90811 - DNA, 309 bp, Triticum aestivum
  unsure (1)..(309): unsure at all n locations
  Clone ID: PAT_TA_90811
accgtggtcgcggccgaggtctctgttcatgtccattaacatcctcantncgacattaggttcattccttggagntgnattgacgtcagctttgaacatgtcttnggtacantttgacaatctgatcgctcanctnaactgttnagcngatgggcaatctcttacctaccggntttctgtntctgattccangggacgtncacangactatnatcacaggaanagnggatanagatctcgatccgncattttttctgcgacctgngtccnggntccgtattccccangtcttacttcatgnacntggta

SEQ ID NO: 90812 - DNA, 483 bp, Triticum aestivum
  unsure (1)..(483): unsure at all n locations
  Clone ID: PAT_TA_90812
agcgtggtcgcggccgaggttcgagtttttttttttttttttttagaataacagggcagaatctcttgattcaaccaaaacacaaccacaccaatttcacgattaccattacaaagcaaatcccacaattatcagaaagttttcaagacactcaacatctgacagttactgacaccaacattggagagtcgactgacaaccatagataagancaaaactactgaagacaagcatangattttagcntacagtgcgattagcacttgacctctttcagcccatgtgcanagtacaaggaaagttggatcancagctccctccttgtagtaggcgaacaccacgccgccagcatcatgcatgctctcgccaacaaangaaactgaaggtcccttggagnttgctaaagaaagatacttngtgggcgggacncaacaattcttctttgnanggcagcctagggcnaccccccttccaagcntgggg

SEQ ID NO: 90813 - DNA, 194 bp, Triticum aestivum
  unsure (1)..(194): unsure at all n locations
  Clone ID: PAT_TA_90813
angcgtgggtcgcggccgangtttttttttttttttttttttttnggaaangatanaaagatgcggctgcatcacccctagatcacatatanacgtatgccaaggctcagggctggntcaatcaaaactccgcaagctnttcttgggttcaaaacnancttttncaaantttncccaagttncnattcaatttg

SEQ ID NO: 90814 - DNA, 498 bp, Triticum aestivum
  unsure (1)..(498): unsure at all n locations
  Clone ID: PAT_TA_90814
tcgagcggccgcccgggcaggtccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccangtgccccaagggctgctcggcgtgccgcgtggtgtcnacgaanccccgaanatgtgggcgcttgcgcgggatatgaaaatccaccgtcgacgggcacctgcgggtgggccctgcaagnangtactgatcggctcatgccatcaatgantatggttccgcccttaaaatgaaaataaaaggcncagacgaagaatgaagcaancggtcnatcngtgccctaatgccgtgntgtgtnttgncaaaccaaaattatgttataccaaatntgccnt

SEQ ID NO: 90815 - DNA, 391 bp, Triticum aestivum
  unsure (1)..(391): unsure at all n locations
  Clone ID: PAT_TA_90815
ccgcccgggcaggtttttttttttttttttttttttttttttttttttttggagtgaacaancacactaatataaggctatacacattgttccagaaaaaagttagaacatcttataatggganaggctcccgtaattgccttaccttattatatgtttcnacattggccacaacgccacatcatcttgcgctgcccaaccttanatcacagggagcacaaaaattatttctcaacactaagcaccantgggaaccaccangccanttccgacgaaactnttttctctcannggtttcntngcatcngacttccgtcgatacaagaaatcgccncggggttcangantaatggcaagggaataatntggacatgncttccnaatgtgcccc

SEQ ID NO: 90816 - DNA, 196 bp, Triticum aestivum
  unsure (1)..(196): unsure at all n locations
  Clone ID: PAT_TA_90816
ctcgaaaattgatgtgtattcgagtcataggagctgctggtaatcaacnatatgctcctattgggtgaatgttaatngtggctggnaacaaanacgcaattggcccaaatngctccaaaaagatnccaaagttattccagctntaattgttcnntcaanttaagannttcaaatnccaaaaacggnnaaanaaccc

SEQ ID NO: 90817 - DNA, 247 bp, Triticum aestivum
  unsure (1)..(247): unsure at all n locations
  Clone ID: PAT_TA_90817
ancgtgggcncggccgaggttcgatgtttttttttttttttctacagctatttccatatcttntttttaantaangangcctatcccctagctncttttttatgtttatanttcaatataccganacctatataagaccaganaaatattaagaggactcttccgcctagataaaaatatatcangggcagcaaagttgtcntcttnactttatnnggccnctttangacnttcantttcanttcca

SEQ ID NO: 90818 - DNA, 486 bp, Triticum aestivum
  unsure (1)..(486): unsure at all n locations
  Clone ID: PAT_TA_90818
agcgtggtcgcggccgaggtgaactantctcgagtttttttttttttttttttttaacagggcagaatctcttgattcaaccaaaacacaaccacaccaatttcacgattaccattacaaagcaaatcccacaattatcagaaagttttcaagacactcaacatctgacagttactgacaccaacattggagagtcgactgacaaccatagataagagcaaaaatactgaacnacagcatanattttagcatncagtgcgattagcacttgacctctttcagcccatgtgaaagtaaaaggaaagttggtttaanaanctccctccntgtngttnggngaaacaccacgccggncaatcatcnatgccatgctccccgccaaacaaangaanctggaangncctttgaggcttggctaaagaanatnncttggtgggggggccccaacaatncttccttnganagncaactaagggcnatcccctt

SEQ ID NO: 90819 - DNA, 350 bp, Triticum aestivum
  unsure (1)..(350): unsure at all n locations
  Clone ID: PAT_TA_90819
agcgtggtcgcggccgaggtttttttttaagaaaatgcctccttaataaatggcaataccagcaagaagtaatacccaaannngttgtccttccgtggaaactaatnacacttnanaacaatcaattnatttnaatntncaattnaaatgccaatcaatnaatanaaatggtcaanaagaanctngtttnggggnacaaaatnaaaaaaagangtnctccaattcccggctttngggtttgggatnacncccttgggncggaaatattggtngccccacccctcaaatttggngctgccaagncctancgcttggccaaangccnccggggnanttnccaangggaagag

SEQ ID NO: 90820 - DNA, 468 bp, Triticum aestivum
  unsure (1)..(468): unsure at all n locations
  Clone ID: PAT_TA_90820
agcgtggtcgcggccgaggtatcaccaagcacagccgcgcatccaccgttgctagcaaggtcgaccaagcagcaccgagatggctgctgccttcttctccaccgtcggtgccccggcttctacgccgaccancttcctcgggaagaagctcaaagaaagcaggtgacctcggcccgtgaactaccatgggcaaagagctccaagggcaacaggttcacaagtcatggcaagcggaaaacatcgacgagaagaggaacacagacaagtggaagggtcttgcctacgatatctccgacgaccaagcaggacatcaccagagggaagggcatcgtggactccctcttccaggcgcccacggggcgaaggcacccacgagggcgtcctcaagctcctaagaagtacgtcagccagggactcaaagaagtacgacttcgncaacaacatgggganggttctaatcctncctgg

SEQ ID NO: 90821 - DNA, 452 bp, Triticum aestivum
  Clone ID: PAT_TA_90821
agcgtggtcgcggccgaggttttttttttttatctggaaataaattgacttacaataccaacctacgtaacattgtttcccatggatacaagcgcaggcacagcttacataagagaaaacaaaatcatccattattgcatcagcttacaaaaatgaaacaaaagcatccattattatgagctcaacatatgcatctagcgtggaatgctagcagatgccatgaactctacctccaagctataacagcctcctgactgcactccggctctctcgcccaatcccgccgcagaagattggcaagcagctctaagtcctttgagttaatgaccttggttgcatctgatcttcattcatcggatctgcctgagatgattccatctgttttgcccgtaggttctgcagttccgtctccaactatttcaaggggggcctttcttcaacaagcagtctta

SEQ ID NO: 90822 - DNA, 168 bp, Triticum aestivum
  unsure (1)..(168): unsure at all n locations
  Clone ID: PAT_TA_90822
agcgtggtcgcggccgaggtcaattncaaggataggcgntnatctatgcgntatnaacagngnttcccagatcagcanattttctngatgctgacttctcctccaccgtcagggtgncgagcntctacgacntttaanttccccttcgaaattctcatcncacatgtg

SEQ ID NO: 90823 - DNA, 491 bp, Triticum aestivum
  unsure (1)..(491): unsure at all n locations
  Clone ID: PAT_TA_90823
tcgagcggccgcccgggcaggtctgatcctccaggccgtcctggtcatggggatcctctcacacgtgaacgccgactatttccccaagtgctgcaacagttgcaggtccttctcgggggtcgacgtctgcgacgacgcccacccccagtgccccaagggctgctcggcctgccgcgtggtgacgcccagccctcacaagacgttccggtgcgccgacatgaagagcaccgtcgacggcaccctgcgggcgggccatgcaaaaagcaatggatccgttcagggcttcanggctcaagacgaaggtgttgcccgcctaaaaattaaaggctcaaaattgaanattgagcaatcatgggggcctaaangccttgtgtngtggggtcgtgctaatacgggccaanangtntgttanaatggcttatccgccnngtcctggggcaaatgtngtttttcnctcnccaaaaaaaagggtgggggggggctantaantg

SEQ ID NO: 90824 - DNA, 233 bp, Triticum aestivum
  unsure (1)..(233): unsure at all n locations
  Clone ID: PAT_TA_90824
tcgatnggccgcncgggcaggtcgaantttttttttttttttttttttttttttttgggaccnttctttctcgtcgaatgtttaccgntcnaaaacanaacacgtttgaatctgatccggaaacaagaaaacatnttcgttgtgcttcttcatatacanaacaccacgccctatcatgatcatcaacagacatccggtntcagcaagcggacctcggacgcgaccacgctaat

SEQ ID NO: 90825 - DNA, 456 bp, Triticum aestivum
  unsure (1)..(456): unsure at all n locations
  Clone ID: PAT_TA_90825
agcgtggtcgcggccgaggttcgagtttttttttttttttttttttttttttttttttttttttttttttttttttttttttttttttttttttttaaaaacnancttaanancttcccnaaaaaaanatgcatctttcnatgtnttcggttcgggggttgnggnatganaggcancantcanaattanatanggttacttggaaaaagctaanaaanaaaaaaactgncnaaattttgtcttgtgatcaaaacnaantttttangcaaanagnggcccnangacggggcatcanagntagnaaaaggaaaaagggcccnaacgttagctgcttcccaaaaagtttnanagctgaaaacnccttcctgatctgnaaaaaaaaatcccncgggcacnacgggggtgnaccttanattttccaaaangatcggaanaaanggnccncgccctcaaagg

SEQ ID NO: 90826 - DNA, 420 bp, Triticum aestivum
  unsure (1)..(420): unsure at all n locations
  Clone ID: PAT_TA_90826
agcgtggtcgcggccgaggttcctctccctcggtcgtcgccttcgcctcccgggaaatcgcctgccgcctcgtctcctagaaactctccgccgccgtccgctgccatgaatcctgaatagtacggacctcctcactccctctcgtctacctaccttgttagagttctggatggaatctctcagtgttgggttttggaggcggccgatctcgccctcgggtgtgtccgatggccaccgattcgtgctcctctcgtgngatctgcgccctcgctggacttcactttgtacnaatnggcggatttangttgtattaaagtttcaatccaatgccgggagaatagaaaantccncggggatgggcctaatcntccgtctcggggcaaacggggattttgttgcctcccnacgttaggncaacgg

SEQ ID NO: 90827 - DNA, 426 bp, Triticum aestivum
  unsure (1)..(426): unsure at all n locations
  Clone ID: PAT_TA_90827
agcgtggtcgcggccgaggtctcgagttttttttttttttttttttttttttttttttttttttttttttttttttttttttccccananacnatttcnaangccacttcncnataatttaactaggtanaccactganggntttgttanagtatttcncgcaangggaaanantatcaggnaaaaccggggcnaananaaccaaaaacnaantctcgtccccccctcgnaaaatctggngttggaagctgccttgcnaaaaaatgtttcccccncctcnacctgtcngctgcaannaanactgatgcccaaagctcgtccttcaaagggctcggtggaaaccggttaaantggcttcccggtccccggcggtgccnnctggccggggggggcnccccaaaccaattnccnngggccccaaggggg

SEQ ID NO: 90828 - DNA, 479 bp, Triticum aestivum
  unsure (1)..(479): unsure at all n locations
  Clone ID: PAT_TA_90828
agcgtggtcgcggccgaggtgttgatctgtgccttgaccgtatcaggaagctttcagacaactgcactggtctccagggattccttgtcttcaacgctgttggaggtggaactggctctggccttggttctcttctgctggagcgcctctctgttgactatggaaagaagtccaagcttgggttcacaagtgtacccatcaccccaggtctccacctctgttgttgagccatacaacagtgtcctgtccacccactccctccttgagcacactgatgtgtctatccttccttgacaatgaggccatctatgacatctgccgccggctccctttgacaattgagcggcccaaaaatacaacaaccttcaaacaaggntttggtttcctaaaggtcattttaatccggctgacaagctttcccttgaaggtttgatnggngctcctgaaattgttgtngtcaatgnaattccanaacaaan

SEQ ID NO: 90829 - DNA, 203 bp, Triticum aestivum
  Clone ID: PAT_TA_90829
agcggtggtcgcggccgaggtgttttttttttttttttagataaaactgcatatcttttcttcgcgttaaattccgatgcgaatccatccggctatataataacaaaacgaaaaaacatcagaaggaagtaacagcagcagcaaagagttctctacagctcggacaacagactaataacagcagtctcaacctgcccgggcgg

SEQ ID NO: 90830 - DNA, 482 bp, Triticum aestivum
  unsure (1)..(482): unsure at all n locations
  Clone ID: PAT_TA_90830
tcgagcggccgcccgggcaggtgctactcccctgcctcccccagagctcgttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagtttgatgtggacattgggagccaaatccctctgctgaggggggggggtgatgaatgaagggtgtttgatgaccaagccggtgaaagggggttgacaattgttgacaccttcccgtcctcaaggaggnaaacttgtttttgaaaagaaancaatttaacncnnaaaattaaggcngtnnaatcaanaaaccnccctgccaaancttngaanggggataacctaaaatnctttnaaaaaaaaaatgnttngttccnccanaaaatn

SEQ ID NO: 90831 - DNA, 443 bp, Triticum aestivum
  Clone ID: PAT_TA_90831
agcgtggtcgcggccgaggtcacaagtgaagtgagagctttgcgctgaaagttcatcagcaactatgaagggcaccaagctcgcggcgatcctgatcctccaggccgtcctggtcatgggagtcctctcgcacgtcaacgccgacttcttccccaagtgctgcaacaactgcaggtccttctcgggggtcgacgtctgcgacgacgcccaccccaagtgtcccaagggctgctcggcgtgccgcgtggtgtcgacgagccccgaaatgtggcgctgcgcggatatgaaatccaccgtcgacggcacctgcggtggaccctgcaagaagtactgatcggttcatgccggcatatgatatgttccgcctaaaattaaataaaagctcggacgaaatgagcaacgtcatccgtgcctatgtgtgtttgtgtgaccaacaaatatgt

SEQ ID NO: 90832 - DNA, 205 bp, Triticum aestivum
  unsure (1)..(205): unsure at all n locations
  Clone ID: PAT_TA_90832
agcgtggtcgcggccgaggtttttttttttttttttttttttttttttttttttttttttttaacatataccatntcaagaananaaaattggcccnaaaacattcagttgctacanaatcaaaaacatnagaagtctacngaagatnacaggtgacggccacncccgtgcttggaccggtcacctgcccggngggccgntcaaa

SEQ ID NO: 90833 - DNA, 534 bp, Triticum aestivum
  unsure (1)..(534): unsure at all n locations
  Clone ID: PAT_TA_90833
agcgtggtcgcggccgaggtttttttttttttttttatttataccttctcttctttatctttagttttatctacttatcaatagtatctaccggctcgaactcgaatttgatcgccttccatacttcacaagctgcggctagttcaggactccatttgcaagctgctcggataatttcattaccttcgcgaagcaagatcgcgcccttcgttacgagcttgtacaacaagcttctaaaggcaacccgattnagcctnctgcaccaaaggtgcaatttcccccaaaggganngtcctaaangttcccccaaacaaaatttgnaataacaagnaatccntccccaaaagaattttcgggtcaaaangtgggnaatattgccaaaaacaatnaaataaccaaccnggaaggctacccgggtaataaanacctgggnaatggggataacccaantccttgaagtngaaaaaagaataaccgccgagcaangaattcttttcaaataaaaatccatccgcncaaatnaaatcnaacaac

SEQ ID NO: 90834 - DNA, 363 bp, Triticum aestivum
  unsure (1)..(363): unsure at all n locations
  Clone ID: PAT_TA_90834
atcgtggtcgcggccgaggagnttttttttttttttttttttttttttttttttttttttttttttttttttttttttttgggcgaaatggcaaatatggatatcagccaacanatggaactgtcaantgtcactttcnaanaactcatatatggagtcacaaangattatacattttgtaaaacaaagaatncaaaaacanttgatggnggcaaaattcaagtgttaaaattttggagggggcaaaaagggaaccgctttcctganggngcaatnaacccctaaatttccccaattttnnccccaacttgccggggggggcgccccaaancaattccccccgnccncantgggggcggggaa

SEQ ID NO: 90835 - DNA, 508 bp, Triticum aestivum
  unsure (1)..(508): unsure at all n locations
  Clone ID: PAT_TA_90835
agcgtggtcgcggccgaggtggcatgggaaggggagtgccgcactattagtccggctccgaacacaaccccagattaggaaccctcagacgtaatcggaggctctgccaccgaaataacatcttcggcccacgaaataatggttgtcattgccccgtggaccgagcccttcttggcctaccttaataggcaagagctccccgaggaccaaaatgaggcacgttgtattgtacaacgctctaaagcctacaaagtccatgaaggagaactctacaaagaaagagccccaccagagtgattcaacaatgcatccccngagggggaagggcgggaactcttaanccgaaatccntttccgggactaacangggcaacaacgccggaaacccgnagctctcaatgagcaagggcntttcggacaatganttttattgggccgactgccccnggggggccnctccnaaaatcnaatttcccnccggccncccattggnggnccgggaaanatt

SEQ ID NO: 90836 - DNA, 512 bp, Triticum aestivum
  unsure (1)..(512): unsure at all n locations
  Clone ID: PAT_TA_90836
agcgtggtcgcggccgaggtggccggagggaagagagaaaagagaaagctagccgcctttgggccatggcggagttcaagcacctttgcatggccaagttcaaggaaggcgtcgtggtggacgacatcatccaggagctcaccaagctcgccgcggagctcgacaccgtcaaatacttcgggtggggcaaggacgtgctgaaccaaggaggcgctcacgcaggggcttcacccacgtcttcgtcatgaccttcgccagcgccgaggacctggcggcgtgcatggggccatganaagcactctgcgttccccgccaccttcatggccgccgctcgaaaaaggtccgtcgtcatggacttnccctttggtcctccttaangccancggccgtcttgccttgatnccgcctcaatttnnctaacaaangcaatgggattgtgccaaactatctaanctatctgctgcaactcctggtgtttttgtnaggagtanccttgangccnccntttctct

SEQ ID NO: 90837 - DNA, 504 bp, Triticum aestivum
  unsure (1)..(504): unsure at all n locations
  Clone ID: PAT_TA_90837
tcgagcggccgcccgggcaggtcccgtgagcatgctacgtgctgccgattgccgccggtactcgcgagaatcggtcagcacagcggctttttttgcaacaaggactatgttgcaatagcgacggacacagctgctagccgcacatgcttgttttttgcaaaatgtttctgcaacaaggatcctgttgcaaaaaaaaaactgcaacattacctttgttgcatgggtttctgtaacatgatcattgttgcaaagatgtctctgcaacattgcctctgttgcaatggggaacgacacgttcggctgctcaatgggagcgaaattctaaaggtcgtgaggngggctggtcttttaaaaaagattcgcccgggccgaacccgtancaactcccttcaaagtanttaaattgttggtcaatcctaagcaatgttgtgtttgtaacnatatccggnaatatttgaatttttttcaaggttgctggctgacatgttcaaaggggcatgcnaa

SEQ ID NO: 90838 - DNA, 271 bp, Triticum aestivum
  unsure (1)..(271): unsure at all n locations
  Clone ID: PAT_TA_90838
agcgtggtcgcggccgangtcaatttcattaaggactttggcaaagataggttgatgttttgaccacgacncnatcctacatggatnagggagaaacacgctacccgacaantantcaaagaaaataatggtccangagatagttnctcaggacagcaacacaatcntctgcatgcaatcagtggatangactangggtttcgnancatcccatggcatanttccgccgtccaccngggtggctntcgncgcagacgannaanccgaatac

SEQ ID NO: 90839 - DNA, 443 bp, Triticum aestivum
  unsure (1)..(443): unsure at all n locations
  Clone ID: PAT_TA_90839
tcgagcggccgcccgggcaggttcgagtttttttttttttagttgacatattgtataatattatgcgtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggngatgaagctgacgcactgcacctgacgcatgttgtccaatccgatgatgcgggcatacccctcaagggacnccttcctgaactcctccaactccttgattacctgggtggggtcagtgcacccgaacaaaaggaagn

SEQ ID NO: 90840 - DNA, 510 bp, Triticum aestivum
  unsure (1)..(510): unsure at all n locations
  Clone ID: PAT_TA_90840
tcgagcggccgcccgggcaggttttttttagatcacaaccaaaacaggcaaaacattctcagttcaacctaggactcgaacagtttacagaaaatggtgttcagtatgtctgcaaacatgacatggacgcaacatctaagaaaatccaacgagtaacatgcagcagctcttcggcctaagctgtggcacccttgcccttcttcttctggagcttcctcatgtagaactccagctccttgccctccaggatgtaccatcaagctctgccacactgtccaagggcgaagacgaaatgcangncancaaccttccaacactgaactgctcctcaatggtgcgaagtccaagtgtaacgtccctggctgggggcttctcaaagcttccccctgggacantggttgcccctnctttggcttccccccggtgggnaagcaaanangnaaacctcancctncttgtccctcanaaaactttccttccttgggancctgcaanaaantttcntnctnc

SEQ ID NO: 90841 - DNA, 412 bp, Triticum aestivum
  unsure (1)..(412): unsure at all n locations
  Clone ID: PAT_TA_90841
agcgtggtcgcggccgaggtatcaccagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacaagtcatggcagcggaaaacatcgacgagaagaggaacacagacaagtggaagggtcttgcctacgatatctccgacgaccaacaggacatcaacaaagggaagggcatcgtggactccctctttcaagcgcccaagggcgaagggaaccaagagggcgttctcaactcctangaatacgtnaagcaagggactcaagaa

SEQ ID NO: 90842 - DNA, 441 bp, Triticum aestivum
  unsure (1)..(441): unsure at all n locations
  Clone ID: PAT_TA_90842
agcgtggtcgcggccgaggtgtctcgagtttttttttttttttttttgcataaaaaggggagtttcttctagagattcctatcatgtctgactttattgattataggcaatagtacatcatccataagacttttcaaaagaaaacaagagggctcatcgacccaaatacatggcatattcttctgtaaaaatacaaattcctaatctcttgggttaaagaaccagcgttctcgcgcgtttataaatcaaagacgggccccaaaaataccaaatatttcttctaagaagacataaagtttgtaggtanaccagctgatgaaggaattttcccggtggcttcctccgtaaaatcctcccccttaacgcaatgtttctttgtnngcaataaaccaaacaataagggtttctggatncaatggaacgtccggccaaactaaaaaa

SEQ ID NO: 90843 - DNA, 385 bp, Triticum aestivum
  unsure (1)..(385): unsure at all n locations
  Clone ID: PAT_TA_90843
ggcaggttnantctgttgtatnganccctgcatcaccacntggtggcaancctgctcctatcatcaaancaattgtggttaancggaaggtgaagctntcacctgacntgatgacaatgntagactcanctatanctggncntgagantggatatacaccanttatgtcagcaaaaggttcagggggtgtttanttcatgcaagantcaacacgccagaacaatgttgcagtgtttaaagcccatccgagtgaggaacctatgnctgaaaacannccaagaggtcatncaatgtctactgaccggngaatgcatgnacaggggaacacttctnaggggaatgttgacctangggaagttgcngnttaaattctccgaacaaccca

SEQ ID NO: 90844 - DNA, 442 bp, Triticum aestivum
  unsure (1)..(442): unsure at all n locations
  Clone ID: PAT_TA_90844
agcgtggtcgcggccgaggtgtcgcctcctcctaaaccactctccctatccccgtgtccagaatctaccccccggctccaatggnggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggaattgttgcaacaactgatgtttttgagggttgcactggtgtgaatgttgcggttaatgggtgggggattccccangaaaggnaggaatgggaagggaaggtgttatgacgaaaaatntttcaatccaaaaaagctcaagcatctgctctttaagc

SEQ ID NO: 90845 - DNA, 447 bp, Triticum aestivum
  Clone ID: PAT_TA_90845
agcgtggtcgcggccgaggtctatttttatagtaaagttattcataaactagtgattcacacaaatttttaaaaattcaaatttaaactattcaaaatttaaaactaatggcactaacagaaagtttataatttttgtgacctaaaatcaaaaagaaatcactaaaaaactataagtatttagttgtaagtataaataaaaaataaatagaaaaaaatttctatttttatagtaaagttattcataaactagtgattcacacaaatttttaaaaattcaaatttaaactattcaaaatttaaaactaatggcactaacaagaaagtttataatttttgtggacctaaaagcaaaaagaaatcactaaaaaactggtagtatttaatttttaggttggaattaaaaaattaaaaaccaaaaaaatgttgaaattaaaaaggaaaaacc

SEQ ID NO: 90846 - DNA, 412 bp, Triticum aestivum
  unsure (1)..(412): unsure at all n locations
  Clone ID: PAT_TA_90846
aacgtggtcgcggccgaggttctcactctctctctctctctctctctctctctctctctctctctgacaatcttcagttctgtcgcacgcatccaacacacaaaccttgttggtccctctctctctctctctctctgtctctctctgtctctctctctctctctctgatantcttcanttctgtcgcacgcatccaanatacaanccttgttgntccctctccctctcnctcnatcnatctctctctctctctgacaatcttcaagttnctgtcgcacgcatctnacacacaagnctttgttgggtcccctctccntctccctcngatctnctctttcctccntccaacctctctctnctcctcnctcctcttgaaaatncttcaagttttggtcggcacggcggttcgaaa

SEQ ID NO: 90847 - DNA, 245 bp, Triticum aestivum
  unsure (1)..(245): unsure at all n locations
  Clone ID: PAT_TA_90847
tcgagcggccgcccgggcaggttgtgtgtgggggtgaacatggtgatgttgttgtcttgaacatttattctcgaattacagtttaatctgctatatgatgcaaagttgatgttatgtactgtgttgaaataaacgaagcaagagagaatgtggagaagttttgttgccatccaaaaaaaaaaaaaaaaaaaaaanaaaaaaaaaaaaaaaanannaattctaaantnanaaaaaaaaaatggtta

SEQ ID NO: 90848 - DNA, 250 bp, Triticum aestivum; identical to SEQ ID NO: 90675
  Clone ID: PAT_TA_90848

SEQ ID NO: 90849 - DNA, 204 bp, Triticum aestivum
  unsure (1)..(204): unsure at all n locations
  Clone ID: PAT_TA_90849
ancgtggtcgcggccgaggttacaagtnaacgncaccaccaccacttccantattggcagacttgtcgtgtctcacnaatctccggtttctgcttcctcactttcaactccgggaatggncatctaccggcccaaaggcnatgcggggctccaataatcctcgntggaggtntcctncttgnaactggttgcccttgnccgtaa

SEQ ID NO: 90850 - DNA, 390 bp, Triticum aestivum
  unsure (1)..(390): unsure at all n locations
  Clone ID: PAT_TA_90850
ncgcggccgaggtgcctcgagttttttttttttttccttctcttccttctcntcatcaacatcctcaaccttgccctcntcagtatccttcttctcctccncancttcatcggcagaaatttccttctcagtggtcttctaggnccacggggagatggngtannctganaaactcannagngcttcttaactagatctttgatgcggcgctcctcangggtatnccatctgggtccgtcttgaggtagagcancatcttgggtaccccttggccgagttgcccnccaacatgtatnacctatttgcntggttnaaagnacccanccgngtcttgannaactccccacaangtnactggtccngccntncgttntcngcttgggagggtga

SEQ ID NO: 90851 - DNA, 455 bp, Triticum aestivum
  unsure (1)..(455): unsure at all n locations
  Clone ID: PAT_TA_90851
agcgtggtcgcggccgaggttgagaaaatccatgcacttcaattggacaggagttttctgccacgtaatcgatgatgcacttcacatgacagaattgtttgttaaaggaactttttggcaagaaatacacaaccgtgtcattcagtgttggacctatgttattggcaagaaatacactaatgtgtagctcactgctgaggtcaagcaagagggggtacatgcacatctgacacctttttctcttccggcgccttgctatttgcatttcccattcgtacctatcatttttcaacaagcattagtattgatgtggtcagcaagagggggtacatgcacatctgacacctttttntcttccggcgccttgctntttgcatttcccattcggtaccctatcatttttcaacaagcaataagtattggatggtgggaatggtacactggnacaattgggg

SEQ ID NO: 90852 - DNA, 451 bp, Triticum aestivum
  unsure (1)..(451): unsure at all n locations
  Clone ID: PAT_TA_90852
agcgtggtcgcggccgaggttcgagttttttttttttttttagaataacagggcagaatctcttgattcaaccaaaacacaaccacaccaatttcacgattaccattacaaagcaaatcccacaattatcagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaaagatactttgtggcgggcccaacattcttcttggaaagcatctaggtcaccccn

SEQ ID NO: 90853 - DNA, 467 bp, Triticum aestivum
  unsure (1)..(467): unsure at all n locations
  Clone ID: PAT_TA_90853
agcgtggtcgcggccgaggtgaactagtctcgagttttttttttttttttttttttttttttgaaganntctcatcccccaccaacttcacaacancacattttacagataanggaacatgcatcanccagctacagnttcgatntgaaccaaacaacaggatgttcttcacatcatnnanacattcgtnnnactgcccaccacgnangcactttttntnttgccganngcattatggtccgaacgactcttcccatggctggnttaggtatccgttgccgggcgaccggggcctgtggtcctctcaacatgtaaagggtatccggtnataccaacgccccggcganggccaccgcccnganttnggcgggngccggcccaagtnacaacncaagatcttttgtngtanggtngccgncccctgggcccccgggttgnctcttttttccnccatnttgcgcngcntt

SEQ ID NO: 90854 - DNA, 417 bp, Triticum aestivum
  unsure (1)..(417): unsure at all n locations
  Clone ID: PAT_TA_90854
agcgtggtcgcggccgaggtcaccagcacagccgcgcatccaccgctgctagcaaggtcgagcaagcagcacagagatggctgctgccttctcctccaccgtcggtgccccggcttctacgccgaccaacttcctcgggaagaagctcaagaagcaggtgacctcggccgtgaactaccatggcaagagctccaaggncaacaggttcacggtcatggcagcgggnaaacatcgacgagaagaggaacaccgacaagtggaagggtcttgcgtaccgatatctccgacgcccaagcaaggccatcaccagagggaaggggnatcgtggactccctcttncaaggngcccactgggngacgggnacccacgaggccgtcctcaagctcatacggngtacgtcaagccaggggactcaa

SEQ ID NO: 90855 - DNA, 474 bp, Triticum aestivum
  unsure (1)..(474): unsure at all n locations
  Clone ID: PAT_TA_90855
ccgcccgggcaggtcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcangaagtactgatcggntcatgccaacatngatattgttccgcctaaaaattganaattaanangctcaagacnaagatngaggangcgtcatccgtgccttatgcgngtgtgtggtgggccancaaacttattgttttt

SEQ ID NO: 90856 - DNA, 457 bp, Triticum aestivum
  unsure (1)..(457): unsure at all n locations
  Clone ID: PAT_TA_90856
tcgagcggccgcccgggcaggtttttttttttttttttaccaaataggtatactcaatatctttatatattaacaaaacatgcccagcaatcgcttggatgcgatgcggtacttaggtacaaaggataaaaatatcagatattaaattggcatgcttaaaaggtgtaaaggcagctgccgtcgtcactcctcgccgttgggtcgaagttcttggcaagtctggtcggtgcatcctgccggcataggcaaagtaccttgctgtgcccctttacctcctcctatgcaagcaaagagatggtgggtgtgtatggagaatgttctnaaccgttagaaggggaancaatcntcaatcgcaatccttggttnagcaatcanccaagaggctgcctggctcaatggtaggggtcaagcaaagctngcacacnccntgggcaattgncccnggcnccctgggacc

SEQ ID NO: 90857 - DNA, 419 bp, Triticum aestivum
  unsure (1)..(419): unsure at all n locations
  Clone ID: PAT_TA_90857
aaaaaaatgaaagaaacaaacgtattcaataagcaaaaggagagagagggattcgaaccctcgatagttcctagaactataccggttttcangaccggagctatcaaccactcagccatctctccacagcctaatccttattttactcctacaaatagaacatagccatataaaanataanacgatttattagnctctagaanagatatcaggatncaagttccttttcgatatatctctggtatactgnatacacggatacaggatcccgctatnccccgcttggngaaataaangagtanataatnctccttctcaacccccataattccaaatnnaaaagggggggtttaagtttaataaaatttngattnaaagagnaggnaaccaagtgggtctccanngattaaaccccctcc

SEQ ID NO: 90858 - DNA, 185 bp, Triticum aestivum
  unsure (1)..(185): unsure at all n locations
  Clone ID: PAT_TA_90858
ctcgagtttttttttttttttttcagtttaaacangacatcagttcattaataatattatnggacccaaatacacttgttgtcatgctccaagnatacaacttntttttaaaatgncccacaatggntgnaaagggncaaatncacatacattttcatttccagcaaanacatggtggggagtca

SEQ ID NO: 90859 - DNA, 480 bp, Triticum aestivum
  unsure (1)..(480): unsure at all n locations
  Clone ID: PAT_TA_90859
ccgcccgggcagactacaacatccagaaggagtccacccttcacctggtgctcaggctccgtggtggcatgcagatatttgtgaagaccctcaccggcaagaccatcaccctcgaggttgagtcctcggacaccattgataatgtgaaggccaagatccaggacaaggagggtatcccaccggaccagcagcgtctcatcttcgctggcaagcagcttgaggatggccgcacccttgcaggactacaacatccagaaggagtccacccttcacttggtgctcaggctccgtggtgggtatgcaagatcttcgtcaagaccctcactggcanngaccaatcacccttgaggttgaggtcctccggacaccatcgacaaangtttanggccaagnatncaaggaanacgggaggggcaattccccccggganccaacaagnngtncttatcttnncctgggcaaagcaaccttgagggatng

SEQ ID NO: 90860 - DNA, 191 bp, Triticum aestivum
  unsure (1)..(191): unsure at all n locations
  Clone ID: PAT_TA_90860
agcgtggtcgcggccgaggtcgtgcatgcagctgggtttcgtttgtactacaaccatgcatgatgtaaagtacgaaggttgaatgcaaaagactgttgttagaaaaaaaaaaaaaaaanaaaaaaanaaaaaaataaaaaaaanaanaaaaacntcgagacctgcccgggnggccgcncgaantcnatttc

SEQ ID NO: 90861 - DNA, 256 bp, Triticum aestivum
  unsure (1)..(256): unsure at all n locations
  Clone ID: PAT_TA_90861
agcgtggtcgcggncgaggttcgagtttttttttttttttctatagctatttccatatcttttttttaagtaatgagcctatcctcnatcttcttttttangtttatatttcaatataccgnaacctatataagactagntaaatattaagaggactcttccncctagataaaantatancatggccagcanagntgtttctttagttttnanttgccctctttaanaagttcagtttcattanggaaancctagc

SEQ ID NO: 90862 - DNA, 294 bp, Triticum aestivum
  unsure (1)..(294): unsure at all n locations
  Clone ID: PAT_TA_90862
tcgagcggccgcccgggcaggtctcgagcttttttttttttttttttttttncaagagctatttccatatcttttttttaagtaatgagcctatcctctatcttcttttttatgtttatatttcaatataccgacncctatatangactagataaatattaaggaggactcttccgcctagnataaaaatatatcatggccagcaagagttgtttctttatttttatttgcccnctttantaatttcactttcaattaagaacaactaactaaactaantggnanaatgagaac

SEQ ID NO: 90863 - DNA, 346 bp, Triticum aestivum
  unsure (1)..(346): unsure at all n locations
  Clone ID: PAT_TA_90863
agcgtggtcgcagccgaggtgtcgagtttttttttttttttttgggtttaaagagcataagtagtatttcaggagagctgnatcagaatgcacannggcttagnaaccgcaatacnaatttactcaaggaaagagctgtacantttacncaagtaagangctgctcgatttcgtcgtcagaccaaactgtaataggatggtgggaattatatgttgntgcgtacacatctncacaactataactctatgtnacaatgncacanaggagtancagctgaaatnttaatttcctcaaggaagacnaggcaatttctgtcatcaagaacnaaactgtaatnnggatcgg

SEQ ID NO: 90864 - DNA, 440 bp, Triticum aestivum
  unsure (1)..(440): unsure at all n locations
  Clone ID: PAT_TA_90864
tcgagtttttttttttttagttgacatattgtataatattatgcgtccgtgcatatacatagccaccgatggcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcaacccggtggcttgaaggcgatgaagctgacgcactgcacctgacgcatgttgtcgaatccgatgatgcggacatacgcgtcagggtactccttcttganctcccccacctcgttgatnacctgtgtgggcgtcagtgcaccccaacataaggagcttccacattgtccaatacn

SEQ ID NO: 90865 - DNA, 448 bp, Triticum aestivum
  unsure (1)..(448): unsure at all n locations
  Clone ID: PAT_TA_90865
agcgtggtcgcggccgaggtgtcgcctcctcctaaaccactctccctatccccgtgtccagaatctaccccccggctccaatggcggcgaaggaaccgatgcgcgtgctcgtcaccggcgccgcaggacaaatcggatatgctcttgttcccatgattgccaggggagttatgcttggngcagaccagcctgttattctgcatatgctggatattgaatttgctgctgaagctcttaaaggcgtcaagatggagttgatcgatgncgcatttccacttctcangggagttgntgcaacanctgatgttgttgaggcttgcactggctgtgaatgntgcggttatggttggtggnttccccaaggaaaggaaggaatggnaangaagggatgttatgacgaaaaaagngtttcaatctacaagagctnaagcatctgctcntgaaggct

SEQ ID NO: 90866 - DNA, 233 bp, Triticum aestivum
  Clone ID: PAT_TA_90866
ccgcccgggcaggtgtcgtgacactcatgagatcggtgatgataaagcaggtggtctagagtatcaacatcattgtagaaaaaatatatgatgttttctaaggttcaccatttttctagacacataagcaagaaaaagtatgtatctccttccattgttatggaagaaagtaaagtgcctggtgttcctcacctttggcccacatcttcagacctcggccgcgaccacgctaa

SEQ ID NO: 90867 - DNA, 209 bp, Triticum aestivum
  unsure (1)..(209): unsure at all n locations
  Clone ID: PAT_TA_90867
ccgcccgggcaggtgaacagtctcgagtttttttttttttttttttttttttttttttttttttttttttttttcaaccactttanacgttgaanccttcaggatgtgaaaataaaaaananatncatggggtgattcatnaaaggggtttcnaaaaccnccgctgctcataggcanacaaaaccaanaagcacccaacntttcaaccc

SEQ ID NO: 90868 - DNA, 459 bp, Triticum aestivum
  unsure (1)..(459): unsure at all n locations
  Clone ID: PAT_TA_90868
agcgtggtcgcggccgaggtcagctagcanaaggtagcgaaacaaataaagttgctatggcggaggctggagctctagatgctttaaccatgtatttatctttaagcccacaagactcgactgaaactgccattatcaatctcttagggatcttatacaaaaatcctgatctgctttactatgaatcctcacttagcactttgaatcaacttgtagctgtcttacggttgggctcaaaaaattctaagcttagtgcancaaggncattgcaaaacttattttggttcaagagagtntaagagatacaaaagtggntaaggaaagctatacnaccaatacttgacatgcnttgagtcaaggactgaaatanaacaacaagncacacctggggctctgatnaactttctgctggnaatatctcnaagggttcaactatgtttggtgttnaaagnaacacac

SEQ ID NO: 90869 - DNA, 434 bp, Triticum aestivum
  unsure (1)..(434): unsure at all n locations
  Clone ID: PAT_TA_90869
tcgagcggccgcccgcggcaggtgatactcannttgggggatgttgtctctgaggctgncatctttgtgaccaccaccggaaanaaggacatcatcanggtcgaccacatgaggaaggatgaatgaacaacnccattgtctgcaacattggccactttgacaactgngatcganatgagacggncttgagacctaccctggtgtcanncgcatcaccatcaanccccagtacngaccgttggggtcttccccgtagancaagtantgngcatcattgtttccttgctngacgggtcnttttgatgnaacccttggtctgtgccatntgggccaccccanncttttgttcatgcctctgcgccatttcaccnaaaccangggttatttgcatcnacncttgaagtttgtgggnatcnaaggtaggccaagctggc

SEQ ID NO: 90870 - DNA, 438 bp, Triticum aestivum
  unsure (1)..(438): unsure at all n locations
  Clone ID: PAT_TA_90870
tcgagcggccgcccgggcaggtgtcaaaaccgaatcagaaatctcaagctcagcacagcaacaatggccgagcagaccttcatcatgatcaagcctgacggcgtccagaggggcctcatcggcgaggtcatcagccgcttcgagaagaagggcttctacctcaaaggtctgaagctccagaacgtggagaagtcgttcgccgagcagcactactccgatctgtcctccaagcccttcttcgctgggctcgtggagtacatcgtctccggcccggtcgtcgctatggtctgggagggcaagagcgtcgtcgccactggacncaagatcattggcgccaccanccccctgncctctgagcccggcaccatcgtggtgactttgccgtcgacatcggcaggaacgtcatccatgggnagcgactcagttggagaagngcag

SEQ ID NO: 90871 - DNA, 332 bp, Triticum aestivum
  unsure (1)..(332): unsure at all n locations
  Clone ID: PAT_TA_90871
agcgtggtcgcggccgaggtaactatgtctcgagttttttttttttttttgcatataatatatatgtatatgtananccggtgntanaattctcatatgcatcctcctcgacctacattggtaagtgcttacatacatatgctcatatagtcacatatggagtanaacgngaagtaaanctgngaaagcaagagcccgcccgacaaatggganctaacatgaaatgtanatcggttacctcaacttncactttangcccttgccnggttcctccaanaactngccgggcgggccaaangaatttcccgcnggtcngcnatgggggggcncgg

SEQ ID NO: 90872 - DNA, 390 bp, Triticum aestivum
  unsure (1)..(390): unsure at all n locations
  Clone ID: PAT_TA_90872
tcgagcggccgcccgggnaggttttttttatttcgtttcttttttatttataccttctcttctttatctttagttttatctacttatcaatagcatctaccggatcgagctccaatttgatcgccttccatncttcacaagctgcggctagttcaggactccatttgcaagctgctcggataatttcattaccttcgcgagcangatcgcgcccttcgttacgagcttgtatacaggcttctaaagccactcgattanctgctgcaccaggtgcatttccccaaaggatgtcctaaagttcctccaagcacnttgtaataaangnatcngtccccaaagatttcggntcatgagctggnatatgccaatnntgaactancacnntgaagc

SEQ ID NO: 90873 - DNA, 264 bp, Triticum aestivum
  unsure (1)..(264): unsure at all n locations
  Clone ID: PAT_TA_90873
agcgtggtcgcggccgaggtctagtcgcgagttttttttttttttttttttttttttttttttttttttttttttttttttttttttacngagagcaagatacacanacacttgaaaacaananacantggttanaacatcaanccaacagtaanctggcatatgcacatcgcatatncacccccanacgggcttacgtngcantccacgacaattatntggtctttggngctcanatatttgntctttancgagcncacactg

SEQ ID NO: 90874 - DNA, 420 bp, Triticum aestivum
  unsure (1)..(420): unsure at all n locations
  Clone ID: PAT_TA_90874
agcgtggtcgcggccgaggtgagagaactacgtcccgagcttttttttttttttttttttggattttaanacatatacgtaaaccacaatctacnaaattaagctctttgatcccaatttcgccctactaantattnaaaatacttcaggnnttaattgaaactatttnganaaaattcaatcctcncaattcctcggcagtcgccccantcgactcaagttccttttggnttgcctttttgnttaantataaccgnagnattgtcatcagnggcngggctnatnataccgtcctcgcaanttgaactcttttacacgtnngtcgcaatctncaagctcgcaagtttacttccgggntcntttcnaanagngaacttgngagnnaactgcnttctcttgttttacnngcacctactaaca

SEQ ID NO: 90875 - DNA, 480 bp, Triticum aestivum
  unsure (1)..(480): unsure at all n locations
  Clone ID: PAT_TA_90875
agcgtggtcgcggccgaggtagaaaatctatttgattgtctctcggccaatatcgatttttagaaagaaaaaacaagaattttcttctttttttattaacattaagaaaaaagaatataactaaaatggaattggcaatataatttttatagacttttgaaagaaaaaaaaggggtttttttgcaaccattatttcttatttcttgcctatatcatatcacggaaacctttcgctttggaacgtggagagatggctgagtggactaaagcggcggattgctaatccgttgtacaatttttttgtaccgagggttcgaatccctctctttccgctcccttggatcatttgggactttcgaattggaaagaattctgacccccggattttctcaaaagaataaatgtnccgaaacaaatccaataangaaaaaaaaaaaaaaacngaattattactccctcgcgtccaaggaattccgtccg

SEQ ID NO: 90876 - DNA, 470 bp, Triticum aestivum
  unsure (1)..(470): unsure at all n locations
  Clone ID: PAT_TA_90876
agcgtggtcgcggccgaggtgttcaacgccgtcccaaaacacttgcttggtattaccaaaccaactgggcaagctcccgtgtgacggacaagcggtgttatgtttggataaataatccaatgctgaatgcatggtatgcagtttgaagaaacaagtaatccaatggacgtaataaaaatgaaggaatgtgccattttactaccggtgatgttaaattagtaaccttgactccaaagggtagctcctcagcttcccgctctggctctgtagtttgttttctttatgttgggcttacctgtgctgcggccctagcccgaagtatttcccttttgcttgttgaatctttgtattcggtaattgtgtgcttgtggaactcaacgatttatctaaaaagtggggcttcatgcctttttgtgaaaaaaaaaaaaaaactcnagacctgcccgggcggccgctcgaatcgaattccc

SEQ ID NO: 90877 - DNA, 444 bp, Triticum aestivum
  unsure (1)..(444): unsure at all n locations
  Clone ID: PAT_TA_90877
agcgtggtcgcggccgaggtcaaccccatacacacacggttcctcagattacgactacgatcgaggaagaggaagaagatacaatatggccctgggagacgactctccgggctcctanatcccgcatgggtcaccatctgatanagaaatgcatgacttcgggatgagcatggagggagtgcatggagggcgctgtccaaagcgccgccgacgttcanccggtcgtcacctccacagtatgggaaaagaagcttgagaaaggagaaaaaanggngtttcnttcnacaagattacaacaaanccaantttgggatttanaaaaaaggggnggccgnaagccagctgcaancaaacaaacaangnacaagcaagcttcctaattgatnaaacaagggggaatgnngtggctgccttaaaatttttanccaattccncccctttttt

SEQ ID NO: 90878 - DNA, 484 bp, Triticum aestivum
  unsure (1)..(484): unsure at all n locations
  Clone ID: PAT_TA_90878
tcgagcggccgcccgggcaggttttttttttttttttttttttttttttttttttttttttttttnacccagacgactttacaaccattgngcaaccaaaaatactgtnnattattcaggctacaaanccgcatttaggcancgaagcaaaacattatacctanacaatgaaccaacaaacaatagccaaccaaaatttccaattgtntncctatcaantataaaagggttctctctctctctctctctttctttccctattgagcccaagccttannacaatttgctaccatcancaangggtaaaatcaccccatccnaaattacgtccctngtgaattcancaccacaaaccctatntaannggccgccaaattttgttcacccccttganaaagtacttatncacngncagnagataanttcacnccctttcgggnganggtccaaaacaaccaatccntttngccncgcctncaancnc

SEQ ID NO: 90879 - DNA, 550 bp, Triticum aestivum
  unsure (1)..(550): unsure at all n locations
  Clone ID: PAT_TA_90879
cgagttttttttttttttttttttttttttttntntttttttttttgcaagaaattccacccacatttatttcngatnggtacaancnaaangagactcaacngacacnctcaaacgtagaaananataacacactcacatgncacacacaagcaattanangcangcaagggagcangnggacatcaaccgcttgnnaccaanaatgcaangagnncacaaatatccancgaaactanagggcttgcatgcacgagcaagctcactagcangccttttccctgncgcattgcacattattcggagcanttttgcctgagcttccacgccttcttcatctggacatgcacnagtggcctcaaaagntanaancagtccactngaacctggattacccgccgaagtatcctgtccggagtggnaantttcaacctttcacagctccgnagcagaatcangaattttgtcaaacntcnaaaccgggnacnacganggagnaatctggcaagcacgggcaataangggacanncgcacaaangagcccngaga

SEQ ID NO: 90880 - DNA, 175 bp, Triticum aestivum
  Clone ID: PAT_TA_90880
ccgaggttcgagttttttttttttttttttttttgccccaccataaactgatttttattcattctcgtggctgacagcttacaattgttccacaatgaaaagaaatcaacagaatatgacctaaatgtggtttatacctgcacaaagcaccagaatatgacctaaatgaaacctg

SEQ ID NO: 90881 - DNA, 566 bp, Triticum aestivum
  unsure (1)..(566): unsure at all n locations
  Clone ID: PAT_TA_90881
gaaaccctagcagatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggntgtgaaatcgacaatgagaagatggaactcatgctgtcccaagtgaagggcaaggacatcaccgagctcttggctgctggtanggagaatttgctgcggttccatctggtggtggtggtgtggctgtttcagctgctgcccctgctgctggagtgctgctgcccctgcagctgagtcaaagaaagaaganaaggcctggagaaggaagaagtgatgatacatggcttaatcgttcacnattgtgggcacttgttcgaagtacaaccttggcaagnaatagatcatgatgttttancttattacnagtngnaaaacggnaagacatgtttgatagtatcanccctggttncggtgattatggtgacaacttgcancaattggcttanangcttgttgaac

SEQ ID NO: 90882 - DNA, 229 bp, Triticum aestivum
  Clone ID: PAT_TA_90882
ccgaggtggagcgtctcgtccgcttcatcagggagctcagcgtcaggtcctctctcaagcccagaattgatggaaactagcacaggctgcagtgatctctcatttacatctcagtactaccagacacatagtcctgtaaaacaatcacattgtttactggtaatttgccgcccatgcttcctcatggcagtggtctgatggacatggtgttggatatcacaataattaa

SEQ ID NO: 90883 - DNA, 437 bp, Triticum aestivum
  unsure (1)..(437): unsure at all n locations
  Clone ID: PAT_TA_90883
ccgaggttcnaggtccatttagatgcncacngantcaaggatnagntgcnccgccccaaaagcncccgccggagangagaagaagacgtcatggccngaggtagtgggaaagtccatcnangacgccaagganatcatccttaacgacatgnctaacgccnacatcgatgtccttcctgctggnncggcgangaccctcgacttcaggancaancgtgtccgnatcatcattgacactgtcnctatcaccccttccattgnttatcangctttgcnancgagatncaaaatggatgcacttatgcattctgatgnanangtagtttcantaaccatggnngantagtacacgctgatcaatgncatgtgtcatgtantatggttaatggnctgncagttatntttanttaganatccggttgcgttangataaaaaa

SEQ ID NO: 90884 - DNA, 536 bp, Triticum aestivum
  unsure (1)..(536): unsure at all n locations
  Clone ID: PAT_TA_90884
tgtctcgagtttttttttttttttttttttttttttttttttttttttttttttttttttttttttttttttttttttttgaaanaaaaaatcncacccanatttatttcngattgatanaaacaaaaaagacacaaccgaccgntnaacgttcncaaacntaaaaaaacagaacacacncanatgacacacacacaaacaaataaaaccaanaaggancaggtgaananccaccgnttgaaaccaacatgcaagaaacacacatntccaacgaactanaggncttgcatgcacaaaaanacctcccacgcgctcatnannaggccttttgcttgangcattcacctgggnacttttgcttnganccgggncttccangccttnttnanttgcaaaggatgaannggccccaaaggggnccacattcactttaactganganttccngaaanaaccggtcggnagnggatcttttnacttcncgaagtcttgaacaccatcanagttcgttgaaacgtcgaaacgnncccctatgg

SEQ ID NO: 90885 - DNA, 530 bp, Triticum aestivum
  unsure (1)..(530): unsure at all n locations
  Clone ID: PAT_TA_90885
ccgaggtcaaacacgatcccctctgcggccggtagtagcacgggcacctctcaaccctaatggcgtcgcagctccctcctggacctaccctctcgtccatctccctctatctcgctgacggtggtggaggtacaaatccttttttttgcgaacagaggtacagatccggtgcctagctgggcgagtacgctccatatacgctccatgtaggtaccgttccatctgcgctccgacggctcttcgccgtctcgtcagcggcggtccggctgctttgaacggacctcgccatgtgctaagctgcagttgcgggggaacaaactcacctcgatgtatgctgccctctgaccagcggaagcatcaggactgcaaatggagagaggagtgttcaccgaagactccttccttatagctgcaagaattctctgcaggataattaantctttgttagcatacactaccgtgcttgtgctcaactgaactcgaacggaggaaagaaaggcttatgtatgtccttaagatagcanactcct

SEQ ID NO: 90886 - DNA, 410 bp, Triticum aestivum
  unsure (1)..(410): unsure at all n locations
  Clone ID: PAT_TA_90886
gtctcgagtttttttttttttttttttttttttttttttttttctctgtattagtgttataagtcaaatttcagtcaagtataaccacataaacaagaacacacatggaaaattattatgttggccaccatgtacagtctcattcaaacatacagatggaacctcgtgtgacaatgaacaaaaggaataagtaagagtacagaacaanggtgttggnatcaataataaaacaattcaaggttccttatttcaatgccatttggttcaattcacaccatganacgtacgtgcaaatgttgcagcancaagtaangggaaaagngatagtccatcgnantgaactttacaggttgngcgaaccctnaactttccnagnnttgttgagngganccgcagnanaaancagcaac

SEQ ID NO: 90887 - DNA, 571 bp, Triticum aestivum
  unsure (1)..(571): unsure at all n locations
  Clone ID: PAT_TA_90887
ccgaggtagaactagtctcgagtttttttttttttttttttttactagcaattggacactgtaaaatccaaatgctaacatatattcagttctagttcgtccagcacatatgcaccagctttgtacagagcttcgctaaattgatcaaaaataatccggatgtaaacattactggcatgcctctcgattggcgggttagctctcaatgaaaccccactctccttgtccagccgcttatagcttctgagcacgccgcaaagccggtgttcccatacatctctacgccctcgccaccgcggcccatctggtcatctgcgatgccatggaatcgtggatgtgcggtcgcgccgccgtcgccatctggcattgatgacatcatggatctgcgactccacagttggagagaacacaaacgcaaggtccatggagnacacattgntggcatctncagacagaacggcgcgcgtcactgccggcggatcnatccgcgcgcatggcgcggacatcactcggccaatccctnatggtnataaatcaggcgtctttnantcnacggaaacctggtacacta

SEQ ID NO: 90888 - DNA, 164 bp, Triticum aestivum
  Clone ID: PAT_TA_90888
ccgaggtcgtcaacatctaagaccacgtaatgtagcgctgtggattcttttgtgctgacagatcgtaatagtactagctgttgtaggcaagttgcaattttgtattactatcgatgattgaattctgtaaatctcatgttaaggttgttttcaaaaaaaaaaaa

SEQ ID NO: 90889 - DNA, 323 bp, Triticum aestivum
  unsure (1)..(323): unsure at all n locations
  Clone ID: PAT_TA_90889
tttttttttttcatncattggtnacggatggatttantgcantcaaaatntcataganagtgatattacatgataanncaacancaatacaagaantatatcatagccacannatagcatcaatcacaanaaatgcttgggaggngnagttttacctttnccncnaatgnccaaaanttnaaggggattnccattnccctttnganaaccccaattttggggcttgggcagaaccatcaaganggcacgggcacganaatgnagtccttnacctgccagggtggtaaatgggaanttcctggtccaaangaaattggggtttg

SEQ ID NO: 90890 - DNA, 573 bp, Triticum aestivum
  unsure (1)..(573): unsure at all n locations
  Clone ID: PAT_TA_90890
ccgaggtgcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacagtgatcaacgagtggaagagtcaagaaggatacctgacctactccnatcatcggtcacacatcgcaagtnaatggtcagtcatngctcaagcacgggtngagatccgcaggccaacnntancacacggcaattaancattcgnttncaccnanatcttggttctccatactctgttnccaaaagtnncagtagtcaaatcc

SEQ ID NO: 90891 - DNA, 556 bp, Triticum aestivum
  unsure (1)..(556): unsure at all n locations
  Clone ID: PAT_TA_90891
ccgaggtctcctgcgcctccacttccatcgcctccccaagatcgcagatccgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactggcccgcgctcttcgccaagctcctggagaagaggagcgtcgatgacctcatcctttccgtcggatctggtggaggtggtgctccagctgctgctgctgctgccccggctgctggtggtgctgctgccgctgaagagaagaaagaagagaaaaaggaggaggcaaggaagaagcgatgatgacatgggcttagcttgtttgactaacattcattcagtctcctgtggatctgctagcnaagatactatctangtgcttaagtnaatttgcgattgatagnaatctgttgagactaatacttgnatgatacncaaacacctggatggcntttaaatgaaaggtcncataaaaaaaaaaaa

SEQ ID NO: 90892 - DNA, 545 bp, Triticum aestivum
  unsure (1)..(545): unsure at all n locations
  Clone ID: PAT_TA_90892
ccgaggtttttaatcataattaacaatagattactttctcccatagtgtactggcataagaactctgagcgagctagggacatgatacgtacactatactgataagactagttcatctatcaatctgtgtcctcacaagacccaaaacaaccaacgcctcctccagatctgatacacgggcagcttcttcgtctcgtatacagcgagatgaagaagacagatctgctctataggcagctgtttcgtctcaagaccaacactgccccttcaaaagcttcctccgccaagtctgccgatgaagactagaaattcagtcaataaccaagaaattgcaccactaaccttgctgtctgaaagtttaattaatccctggggtcaactttcttaagatttcacagncncnagggaaanntcacagggagcggctgttgaggtgagattncccatacgcgtgtaggcatcaactgacgnccaggtatgggnaatccatccaacggtgctacgagagcaaagtaggatggatcagcatcgcctgccccgngtgg

SEQ ID NO: 90893 - DNA, 449 bp, Triticum aestivum
  unsure (1)..(449): unsure at all n locations
  Clone ID: PAT_TA_90893
ctagtctcgagtttttttttttttttttgaacagcaggcacctgatcgacacatgcatttcatatgatattattagtattaggacaatgaacccacagggctttcaacactagtacaggggcagcagcagctaccatggaaacctcagacctcatcaacgtcctactagtgtttcttctatctgaaaaagaaaaacatactaacctcagctgcaggtctaaaactaaccttcctgaacactgtaacaaacctaggctagaaactgcaggtttaagctaatccttctcaacacaanctcccactaagagcacgtaaacactgcatagtgnaanatgtcggttccttcaaaaaattcttccgttcactcnaatgcgcgantcctgcccgatgggttcccgggttcanggcgtcnggatgtangttncccccccgnaagnanctgctcccca

SEQ ID NO: 90894 - DNA, 529 bp, Triticum aestivum
  unsure (1)..(529): unsure at all n locations
  Clone ID: PAT_TA_90894
ctctcctccagataatacattaccatggcccccgccgtgatggcttcctcggctaccaccgtcgcacccttccaggggctcaagtccacagccggtctccccgtcggccgccgctccagcggcagcctcagcagcgtcagcaatggcggaaggatcaggtgcatgcaggtgtggccaattgagggcatcaagaagttcgagaccctgtcttacctgccacccctatccacggaggccctcctgaaacaggtcgactacctgatccgctcaaagtgggtgccctgcctcgagttcagcaaggttggcttcgtcttccgtgagcacaacagctcccccgggtactacgacggncgatactggacaatgtggaagctgcctatgttcgggtgcactgacgcacacangtgctgaacaagtggaggaggcaagaaggagtacctgacgctagtcgtgcatcggntcacaactgcgcagtgagtgcgtcactcancgccttaggcacgggtgcaagatccggaaggctaatacn

SEQ ID NO: 90895 - DNA, 550 bp, Triticum aestivum
  unsure (1)..(550): unsure at all n locations
  Clone ID: PAT_TA_90895
ccgaggttttttttttttttttttttaaccacaccaatttcacgattaccattacaaagcaaatcccacaattatcagaaagttttcaagacactcaacatctgatagttaccgacacaacattggagagtcgactgacaaccatagagcagagcaaaaatactgatgaccgcatagattttagcatacagtgcgattagcacttgacctctttcagcccatgtgcaaagtacaggaaagttggatcagcagctccctccttgtagtaggcgaacaccacgccgccatcatcatgcatgctctcgccaacaaagaactgaaggtccttgagcttgctaagaagatactttgtggcagactcaacattcttcttgaaaacatctaggtcatccccttcaagcttggcagagaggtcttgatgtagcgcttcatgtgagagataaactgctcttgtcaaaagcangttgctcctgaagacgaagggtcaacaagtcaaccacttcacggcctgtcatcgacacctcatcatcacacacctcagagnggatng

SEQ ID NO: 90896 - DNA, 395 bp, Triticum aestivum
  unsure (1)..(395): unsure at all n locations
  Clone ID: PAT_TA_90896
ccgaggtctcgagttttttttttttttttttttcanctacacacagatanattattgcttctggnccaccaacatattaancatggcanctctcccttcttttaanccagctaataattganaacattatanatctaaganaccatagnanactgcaagaacatcatccttatggcatcatagtcctcctcttactgcaccatgtttanctcttgttctgtacttgtccttgggncttggnggaagaacgattgctcggacccatcaagattctnaagcgttgcatgaagaanaaacatccccnngggactncccaanaagcaatcaatcnncaatcntggcctccgtagtnannacaactttnnancgttaanngcttaaaacnggccgggggg

SEQ ID NO: 90897 - DNA, 482 bp, Triticum aestivum
  unsure (1)..(482): unsure at all n locations
  Clone ID: PAT_TA_90897
atctagccanagtgagtgagaagagagacatcatccaccctcngacaatggctcttgttgccgacgagctcaaggncaatgccgatgtgtactacnacnatnagatttgccancagtgcaccaggctcctgctcaaggaagcaggcctccccaatggcctgcttcccctgaaggacatcatggngtgcggctatgtcgaggagactgggtatgtgtggctcaancanaggaagaggatataccacgtcttccatagcctgnggagggtggtgtcttatggcactgagatcacngccttcaccnacangggcaggatcatnaaggcancgggataaagaccatggagccatggtgtggctcctgtggangattccccttgnngaacancgactggtaagcncatctcncgacattgcggtttcnanattcntgancancttcacaccanagngagatgaaacgntcttgcggacnaaacagtg

SEQ ID NO: 90898 - DNA, 600 bp, Triticum aestivum
  unsure (1)..(600): unsure at all n locations
  Clone ID: PAT_TA_90898
gatcggtcgagccctccgccgccgccccgccttcagctctctccttccttctccgatccaagatgaagttcattgctgcctatctgcttgcttacctctctggcaacgccagcccctctgcagaggacctgacatccattcttgagtctgttggttgtgaaatcgacaatgagaagatggaactcatgctgtcccaagtgaagggcaaggacatcaccgagctcttggctgctggtagggagaatttgctgcggttccatctggtggtggtggtgtggctgtttcagctgctgcccctgctgctggaggtgctgctgcccctgcagctgatcaaagaaagaagagaagncgtggagaaggaagagagtgatgatgacatgggtnagtctgttcgacaatttggggactttgtctaatactatcctggcaggaaacagatcatgatgtttaccttattagctgattgtaaacatggaagacatgtttgaattattaccctgttctggtnttatgggaacatacttgatcanttgccttaaactcgcgcacaccatcantcccgcgatgcgccgacatcactcgccattcccaatatcatta

SEQ ID NO: 90899 - DNA, 208 bp, Triticum aestivum
  unsure (1)..(208): unsure at all n locations
  Clone ID: PAT_TA_90899
ggccgacgtanancacaccaggtgnatnactntctgnaancacaagaagtatgcancatctggtgaggnatcgcctcctcgccgtgctcctcatcggggtagttgcagcctctgccttcaaccantcanctgacgctggccgangccttgcnnccatcganaagtttgcaganctagagccanatccaganaccagcccagagccaat

SEQ ID NO: 90900 - DNA, 500 bp, Triticum aestivum
  unsure (1)..(500): unsure at all n locations
  Clone ID: PAT_TA_90900
ccgaggtctagtctcgagttttttttttttttttttttgcttgcttgcatgatcaaaaagctttgcataacaatttccttttcctattgcctattatctaactctcttacactatccaggtattaactacaacaagcagaagacaacattagggtctctgcacacatgtttttcaggggttacgaacagcaaatttgctggctggctccaacagttggcatcacagaaacanntagtggcaagatatcaccatagaactcagcaatgccttctcaacctcggcagaggcatctctgctgagcaagcacatgacatactccatcactgcggcatcacaaggcagtgtgatctttccattgcttgcgaaacaaatcttcctgggacaccttaggagctctccgaagacatcatgctgaggtacacaacgggactcgaaacgnttcgtcggtcgtgtcatgataagtggccttacacncagaggtgacatctcactctggggg

SEQ ID NO: 90901 - DNA, 199 bp, Triticum aestivum
  Clone ID: PAT_TA_90901
ccgaggtgaactagtctcgagtttttttttttttttttttttttttttttttttatcttgaccaaaatgggaaagcatatcatataaaatccatccattatatggtagtagtacatatgagtaacatacagctatatatgaggtagatataaaaggagtttgggcggttggcttggaggtttataaataccaggacagc

SEQ ID NO: 90902 - DNA, 653 bp, Triticum aestivum
  unsure (1)..(653): unsure at all n locations
  Clone ID: PAT_TA_90902
tttttttttttttgtcaacggaagccattgtcctcaaaatttaggacagtccatcttaggcattgcattttagcaggcagtacagtaagcatagcctgctacctcaagtacatagttcattaccttagcctttgcatcccatcagcaagcgttttttggtggcgcactaaaaccaaacatgtatcagcatcctcctgctacatcaatttcaaggtatgcgggtcctgaaaaactgagatatgtttcctcctggtggttgctgtgatcttctcccctcgtttcaacctctttctcctttgatttgatcgcttaggccctgcttttgccaagactgacaactgctcattaaatttactacttactacttacgaaacttttatccaaacaattgggtaggtagatatgaaaccttcacgaggactccaagaggcaccacctagacacctcgccaaatgggtcataccaaaagacggtagtttactggctgcaagcatcaaacctagtanaaccttnnagactcagngncacancanacatccncaatggntanccangactgcatttagtgnccagcacaaactcnctacgnttgacgaccgcggcacaacattncgggagngcgaangattgcattccaggnntataagggctta

SEQ ID NO: 90903 - DNA, 368 bp, Triticum aestivum
  unsure (1)..(368): unsure at all n locations
  Clone ID: PAT_TA_90903
ccgaggtggncatggncnccatcnccaaggccancccggtggtnanggcggngaagctcgacangatctaggaaggggnctccctacngtcgncagaanataangtcncaaatcaaatctgcnctacctcgtcatcgnncgtctttgntgcattatcctttcatcatgttggnttctgcaatcctanttgttgnncantcgcgatgcatggcacacgcaccacngtggcagccccagntccgaacggtctccttgttggctatnttgngtaacttattatggtngtctctctgcacggcggnacggtancggtattgtggcttcgcattttggctagcactctgtaagtacgctcttcnnccaagaaa

SEQ ID NO: 90904 - DNA, 489 bp, Triticum aestivum
  unsure (1)..(489): unsure at all n locations
  Clone ID: PAT_TA_90904
ccggagggaagagagaaaagagaaagctagccgcctttgggccatggcggagttcaagcacctttgcatggccaagttcaaggaaggcgtcgtggtggacgacatcatccaggagctcaacaanctcgccgcggncctcnacancgtcaaatacttcgggtgangcaatgacgtnctgaacnaggangcgctcacncanggcttcacccacgtcntcgtcatgaccttcgccagcgccgangacctggcggcgtgcatgggccatgagaagcactctgcgttcgccgccaccttcatggncgcgctcgacaagtcgtcgtcatggactccccttggtctcgtcaagcaangccgcctgcctgatcgctcagtatcctacaacatggattgcaactatcatcatctgctgaactctggtgtatgtagatactgacccntcctgctnntgttactgtnactgctccttaaacgtatccnnntcccaaaatt

SEQ ID NO: 90905 - DNA, 233 bp, Triticum aestivum
  unsure (1)..(233): unsure at all n locations
  Clone ID: PAT_TA_90905
ccgaggtcgagttttttttttttttgtcacgcaaatcatagccaaatgacagtgataaagttcagagtagcacataggaattgacatgaatggtgcacactaacaagtgatcaaagatcatgtgcttatttagaatagagattgcaaatctgcattctgaaaaggttcccagatctgtacgacgttggtcggcgaagatgacatctanccctggagcccgatgatcccgcagg

SEQ ID NO: 90906 - DNA, 593 bp, Triticum aestivum
  unsure (1)..(593): unsure at all n locations
  Clone ID: PAT_TA_90906
ccgaggtgagaactagtctcgagttttttttttttttttttgaccaaaacacaaccacaccaatttcacgattaccattacaaagcaaataccacaattatcagaaagttttcgagacacttaacatctgatagttactgacaccaacattggagagtcgactgacaaccatacatagagcagagcaaaaatactgacgaccccaaagattttancatantgtgccattancacttgacctctttcagcccatgtgcaaagtacaggaaagttggatcagcagctccctccttgtagtacgcgaacaccacgccgccatcatcatgcatgctctcgccaacaaagaactgaaggccttgagcttgctaagaagatacttcgtggnagctcaacatctcttgaaaaatcaagtcaccccttaagcttggagtaggtcttgagtacgctcagtgagaataacgctctgtaaaacagttgcccgaaacgagngcacatgtacacttaggctggcacaactangtacacacctagagggatgcncatgcaanaatgtctanacangcacattcaaanggtccacccngnggaggacc

SEQ ID NO: 90907 - DNA, 409 bp, Triticum aestivum
  unsure (1)..(409): unsure at all n locations
  Clone ID: PAT_TA_90907
gaactagtctcgagttttttttttttggaanganatngatttatnanactcggaatcncntagatagtnanattacatgataaatcaacacaaatacnataantatancaagccacacaanancatcaatcaanacanatgcgcggtatgaagatttanccaanacacacccatgactaatactagtagtnngattcatttgccntcntgaaaactccagcttgggcannagcancaccancaaaggtcacgggnacnatgatgcagttctttatctgntgggtggnaaatgggaanttcatgttcacagttgangttgaggtatgcagctgcaccctcacgtgcacggcgccagnacatcagtnctaagtgtttgagantgcancatgnactcgttgtgcacttaatc

SEQ ID NO: 90908 - DNA, 318 bp, Triticum aestivum
  unsure (1)..(318): unsure at all n locations
  Clone ID: PAT_TA_90908
tttttttttttttctaaaaactgtgattaatcatttatttttgaaacaaagtatatgcatacattgaaagagtaatgtatctaactactgtccatcttccttgattgcttctatgctagaaagatcaaaatgctacacataaactgttcttagtcnattttcctatatctctgcagatggtaatcaggagcagcagacaccgaaatgctggccaactcccaaatnttgggccanatgataagtggatggcatcnccanggtnttgaggaacacggcctccattntggggagggcgttcncctgagcaagcacatggga

SEQ ID NO: 90909 - DNA, 522 bp, Triticum aestivum
  unsure (1)..(522): unsure at all n locations
  Clone ID: PAT_TA_90909
ganatatcttctcnancanggctcgtgttggctcanccactcncgcngacgccctcaaagtggcnaccattgcngcngtcctcgccatgcnggtnctgccttccttggggcgctgtcngtcnctgggccaatangaantantaatggntccggcaccngcgaancggtgnagcgaatgtggcncacactgcanggntatgtgcagagtctcngttcctcangaaatgcagccantactgcaacntccccagctgtnangactgcnggccgccgttatgcgctactgcanaccanatcaangcgggtggntgcgattgtaatggnaacgcgacacggcatgtgnanatcttgctccggnatcctncattgcngactgcatgangaaaccggaacagtgcagacgactgnacacaattgcgcncactgcgtttnagattcaaaanaaaggcaaaagncggtaggctctgggatttcatcatcaccaangaatgggctctggattaaaagttnncctctcggtaa

SEQ ID NO: 90910 - DNA, 214 bp, Triticum aestivum
  unsure (1)..(214): unsure at all n locations
  Clone ID: PAT_TA_90910
tagtctcgagttttttttttttttttttttttttttttttttttttttttttttttttttttttttttttatgccatcctcaatcaggcctgcagttttattattcanggttcnccgaaaattgtanatcttccanacganatntatgcactctcgccganactcgnaaggcctctcccgggtaattgngttccaaaaagacgtnaaaanggga

SEQ ID NO: 90911 - DNA, 275 bp, Triticum aestivum
  Clone ID: PAT_TA_90911
ccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgagaatgctatcggtggctatgtatatgaacggacgcataatattatacaatatgtcgactatatacgttttaatggggggg

SEQ ID NO: 90912 - DNA, 168 bp, Triticum aestivum
  unsure (1)..(168): unsure at all n locations
  Clone ID: PAT_TA_90912
ntnttcggcctgaantcacaancagnggggatcacttctctgncttcctcctcctctctctttctgtcatgangccncctcacttcantggggaagaggtattcancgcntcatgggctcacgaggtcnnncaggccctcacgtganatcgctccggttgataaccgc

SEQ ID NO: 90913 - DNA, 227 bp, Triticum aestivum
  unsure (1)..(227): unsure at all n locations
  Clone ID: PAT_TA_90913
ttttttttttagcttacaaaaattccantatatatatatatattcagtacaccatataaaaacacaggactcgggctgactgcaacaagatgggcgacgtaaatataagttgaaacataaaccaatcactaactctaatactcanccgancgatangagttcacagtgccaacccaactatacactgttgctagcttaggccactgacaaaaaanaaaaaaaaaaaa

SEQ ID NO: 90914 - DNA, 508 bp, Triticum aestivum
  unsure (1)..(508): unsure at all n locations
  Clone ID: PAT_TA_90914
ctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcaagttcagcaaggttgggttcatcttccgtgagnacaacgcatcccctgggtacnacgatggccggtactggnnantgtggaanctgcctaggttcggggtgaaccgacgccacacaggtgntcaccgaggtggaagaggtcaanaaggntacctgacnnttantcgcatcatggttcanaaaatcgccangtgcagtgcgtcagtt

SEQ ID NO: 90915 - DNA, 470 bp, Triticum aestivum
  unsure (1)..(470): unsure at all n locations
  Clone ID: PAT_TA_90915
ctcctactgtcagcctcagctcactcgaagttagcaatggcggccgcgaccatggcgctctcctccccggcgatggccggcaccccggtgaaggcctccagggcggcgcccttcggtgagggccgcatcaccatgcgcaagacggcgggcaagcccaaggtggcggcgtccagcagcccgtggtacggctccgaccgcgtgctctacctcggcccgctctccggggnaccccccaagctactcaccgggngagttccccgggggaactacggnntgggganaccgtgggcntctcngccgaacccnnnaaactttcncnaaaaaccggggatctggnggttnntcaatngccgntnggaaatnntggnccccctcngggggntttttcngggngttgcccccccaaaaggggntaatttcgnnaanggctttttnttaaagggggngcncacattttttaagnggggggg

SEQ ID NO: 90916 - DNA, 412 bp, Triticum aestivum
  unsure (1)..(412): unsure at all n locations
  Clone ID: PAT_TA_90916
atacaacttgcggtttgttaccggngaggagctcgtntgtcgtcttgccgagtagcttgngaaganacaagcgatttgntgcatgacacgctgtctgaancgctttcgnccaanagtgctttggtgtcttgtnctcatcangcatcnntctcgccanttcgaggactgtccagttcttcctctcancaactccattttgntgaangtgtgtangtagccganaactcatgtgnnatcccttcntcgtcaagaanggtatccacatntgcgttcttgancttcgntccattgtcgcttcnaaccttcntgatcntcacntcagattgattttgggccttcctagagaanttttgaagatcctttgngnactgcgagttgtcagcangantngatcacccacgtnaggctgacc

SEQ ID NO: 90917 - DNA, 403 bp, Triticum aestivum
  unsure (1)..(403): unsure at all n locations
  Clone ID: PAT_TA_90917
tcgagtttttttttttttttttttttttttggccaacttgatctatttatcttgcaatgggaagaggtgctttgtantgggttcgatcttatggtgctttatcctagtgagagaaagggaaaagacacgtatgtatcggtgagggagtcctggattaaggggtcctcgggcgtccggcctgttatccatgggccggactgatgggctgtgaagatacgaaggccgaagacaatacccttgcccggattgngactctacttgngcggggaaggcaagctaggtgacctgttatgaagatttcctcctatgtaaccgaccnaangtanccttagatctctccggtgtccatanaaacccgnngagcanagnccgganagnacagntcattaccatannccatagg

SEQ ID NO: 90918 - DNA, 516 bp, Triticum aestivum
  unsure (1)..(516): unsure at all n locations
  Clone ID: PAT_TA_90918
tttaaaggatcaaatttttggagagaaaaatcaaggggaggtagtacacaccagtacaccacgcacacacaacatggcatgcacagaccacacacaccacgcctagtgagtacatcatgcatgcgcatacgacacacaccacgccccgctaagtacatcgcgcatgccctgccggagagaaaccgcctccatccacagggctccgatggccgcgcgcggtattgacttgtgtctaccgcctccatgccctangctctcaattgtcgcgcttcgntctatagccaccacggtagagaaaagagagatggaaancggaaagagatagggttgtccttttgtttgaaaggtgancaaattaaaaccgagaaaacgtttcacggcctgcctttgcntcgtgcatgcgctcaggatgccaattctatgagatttcagggacatgtggcccncgttttagggaattttcgagtatcggcancttantcntactcccaacagcatgngcnggtcccatgcaaa

SEQ ID NO: 90919 - DNA, 302 bp, Triticum aestivum
  Clone ID: PAT_TA_90919
agatagatatggccagaagacttaatgcttggagtttttcatctctacaggaaataggatggggcccaccagaaagaaagatggcgtacaaggttaagctaggtagaaaatccaatctaagatgtaaaaggattggactcttatattttatactagtttgttttctttccaaagttgtgtgcgtgcgtgaggggtttaggctaggttcaagttgttaattaaagcaagggtgcgtggatgtaatagttaggttatcttttatgaaatagacacgatgtgttttttagggtaaaaaaaaaaaa

SEQ ID NO: 90920 - DNA, 564 bp, Triticum aestivum
  unsure (1)..(564): unsure at all n locations
  Clone ID: PAT_TA_90920
caaaggctttggcttcgtgatgaacattgccggtcatccactcaaggacccaagtcttcggatctctattgtagccacgaatgtgaagagtggcatagaattggagcagcaacttttcgtttcagtgctcttggtcggtgacgaaaggcaacaatccagactctttgaagcaatccagagcttcttccaagcaaggcagaccagttatggcttcagtgtcaagacgcatatgagggaaaatgcgaccttgattgtacagaatgcatgagtaataacttcgctgcagataactccagaaccgatcagaagatattctttcccttgagtgggggttcttggcgctattgaagaaggtgttgtctactttgaagccattgacattaaaggatctgggtgctgatgcaggacctggaaaccaaggcaaccttggnattggcttctgtacctgangcctgtgctcaacgtgagagtcaaactgaggacaagcancaggcgcaggacaggancagtacatcattggtgactgacttcnacanatggttgtgagntcaattgctnaacatg

SEQ ID NO: 90921 - DNA, 556 bp, Triticum aestivum
  unsure (1)..(556): unsure at all n locations
  Clone ID: PAT_TA_90921
gttgcctttgatcctcagacgcacagttcgggaccccctacccgagatcgaccggttttgacaccgacaccaggtactcaagagcagccaatggttaatccagagacccaaattaaccctactggcgaagacaacccagagcagaggattgagctgactcatggaaatgagcgggttaatgctgacgagctggtgacggtggaagagccggtccatgccgaagagcaggtcaatacagatgatctggctcataatattaactcgccaagtcctgtaggagcctccagtcctttgtaggaggtagccaatatcattccatcacgcacggtggatgatgcagaggtgaccataactagagaagctcataaggctccagaggcttcgaatgctttgggcaaaattgtagccaaggatgagttagcaatgttctctaangggaaactaagctagagctccaaatttgacaaactaagcgccatgatcgcatcaagatattgacccggtatctagatcggaagctaatgatatgataatgtctcagccaatttaggatgag

SEQ ID NO: 90922 - DNA, 401 bp, Triticum aestivum
  unsure (1)..(401): unsure at all n locations
  Clone ID: PAT_TA_90922
ggagcgtccccaacttgaagaccggttcagggggctactgatggtgtcctggactagggggtactcaccacgtcgtctcccgatcagttggnttgggccgaggaccaccatggacgtttgctcatgggccagttcggacagccantgtatacacgaggaagattccacangacttggtgatcaagacaaggactcctctccaccatgcgtattcgactangactcctgttatcctaggcctctggtatattgtataagccgaggccaggctagtcgatangtcatcatgacattactcatcatacctctagggtttacaccacaacatatgatctcgaggtanatcaactctgtaatcatacncatcnattanactcaattgcagcatgtanggnatatct

SEQ ID NO: 90923 - DNA, 519 bp, Triticum aestivum
  unsure (1)..(519): unsure at all n locations
  Clone ID: PAT_TA_90923
ctgccctcctcctcctcctccccgccgccgccgccacctcgccccagcccagcccccatcaccggcgaagatgaagaccatcctggcgtcggagacgatggagatcccggaggaggtgaccgtgaaggtgtcggcgaagatgatctcggtgacggggccgcgggggacgctgacccgcaacttcaagcacctcaacctccgacttccagctgcaggagggcgggcgcaagctcaaggtggacgcctgggttcgggcaccccgcaagaccatgggccgccatccgcaccgccatctcccacgtccaagaacctcatcaccgggggtcaacaaagggttcccgctacaaagatgcgcttccgtgtatgctcacttccccaatcaacgcctccancaacngccgccaaccggggcatccaaatnaaggaattcctccggcgagaagaagtgaggaaagnggacatgctccacgggtcacanctngcggtccgagaaggcaagganaaatctctcnaggggaa

SEQ ID NO: 90924 - DNA, 512 bp, Triticum aestivum
  unsure (1)..(512): unsure at all n locations
  Clone ID: PAT_TA_90924
ccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtggggtgccttgcctcgagtcagcaagttgggttcatcttccgtgagcacaacgcatctcctgggtactacgatggccggtattggacaatgtggaagctgcctatgttcgggtgaactgacgccacacaggtgatcaacnaggtggaggaggtnaaaganggagtaccctgacgcgnntgtccgnatnatnggtncgaaaanangnttcagggaaatggtcaagtnaatcgcnttaanccacggggttgcaagatccgggnanggctaaaagtcatcacgaaaggca

SEQ ID NO: 90925 - DNA, 387 bp, Triticum aestivum
  unsure (1)..(387): unsure at all n locations
  Clone ID: PAT_TA_90925
cgagtcaaacaaaagtcaaagctacagaaatggacgcaggccgggccagcggcgtcggccccgcccggaggccacgacccgccgccgcggcgtcggatccccggcgcgcggctgcggcgcgggaggccatgttgcgcatggaggaggtcatgatggcccacgcgggcgcggcgggcgagttcagcatgatcatcgaagctccgctccccaacctccagcgctaccgccggnaacgcgacgcctcctgcggccccntcgtcngactctccctcgcggaaggngcggcggactcatgaccccggcgcnagggacgacntccccacacnattgnggcgcnaggnaagntnaccgagganntcggnaaagctcnggggggtacgcaggngg

SEQ ID NO: 90926 - DNA, 523 bp, Triticum aestivum
  unsure (1)..(523): unsure at all n locations
  Clone ID: PAT_TA_90926
ctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggncggtanggncantgtggaanctgcctangttcgggngcaccgaagccacacagtgatcaacgaagtggaagagtcaanaaggagtacctgacgcgtantccgnatcatccgnttngaaacatgngcaagngcntgggtcagttaangccttaaaccacgggt

SEQ ID NO: 90927 - DNA, 475 bp, Triticum aestivum
  unsure (1)..(475): unsure at all n locations
  Clone ID: PAT_TA_90927
gtggctacagaggcttgcggcggcgaaactcctgatctaggttattttctggaggtttctgtatttataggaatttttggcgtaggtctcatgtcaggggggtctccgagtcgtccacgagatagggggacgcgcccagggggtagggtgcgcccccaccctcgtggacggcccggaactcttctgggcccaactcttttactccgggggcttattttgggtccataaaaacatcaaaaatggcacgtcaattggactccgtttgggtattccttttcctggtaaaactccaaaaacgaggaaaaaaaaagaaatgtcactggggtcctaagttaatangttatcccaaaaaacaatataaaataggatataaatgcatataaaacatcctaagatgggataatataatagaatgggacaatccaaaattananatangtgggaancntacactantcngggaantcccccnggg

SEQ ID NO: 90928 - DNA, 529 bp, Triticum aestivum
  unsure (1)..(529): unsure at all n locations
  Clone ID: PAT_TA_90928
gccgccgtcgggccggcgctcgcggccgccgcggcgcgggtccgggtgatgtgcttcacggccaccacggtgccgcagccgagcttgacgcggtacacattcccggacccgccgctgccgatgaggttctcgtcccggacgccgcccacgatctcccgctcgtcgaacgccatcatccggaacgacttgacgttccaagaccccttcttcgcgaacagcagcttgccgccggccatggctgcggcctccgcgtgctgccggcgcttcttgatgaatatcgccacgccgaggacggcgagcagcaccgccatgccggcgaggaggcaggtgacgagcgtgcgcgcggtgctcccagagcggccaccgtctcccggcgtgcagcggcggaggaancggcgccgttttggcgcacaagccgggtttccttggaagctctcgccgtaggcgagataccagcccgccggnacggnccgtcaancggttattgncaagtcaagtactaactttactcggcaagatngccggaacg

SEQ ID NO: 90929 - DNA, 348 bp, Triticum aestivum
  unsure (1)..(348): unsure at all n locations
  Clone ID: PAT_TA_90929
tnacntgacccccnatatatttanacatcaatcgcattctgatccaccantcgatcgatccggcanntagntagccatggtcatgntncgggaggaaggtgactacgagcattgccggngtcgcggccgcgctggtggcgctgctggtcgtggnggnggcgtcgggcgcggtcgggtaccatgtctgcaangtggncacggacagcctggtgaacaactgcaggtcctatctgngcngtgggcatcaacnaggncatgcnccagcngcagcgtgctgcggcgcngtgcgcggcgccaacttcaagtggactctgaaagttacannggnctgctgcccanagggcatcg

SEQ ID NO: 90930 - DNA, 564 bp, Triticum aestivum
  unsure (1)..(564): unsure at all n locations
  Clone ID: PAT_TA_90930
aaaactacccacccccgcgtctccaaccttgtagcccacccacccgacccacgcgtttccaccaggaggtcgccgccgccgccccaccccgtgcgccgccgcccctgcctcccccggcgtgccgccaccccctcctcctctggtgcgccgctgcccccgcatcatccagcacgaggccaccccctcctcctccagcgcgccacggcccctgcctccagcgctcagatctgcgggatccggcnatttctcanggaggtgctgctccggtgagcctccgtctccaaagngcgacncagaaaacggactcctccctatngttcatcctccatcccccgagaanagcgcatccgcgatggctcctctntcccggtcgccntctctgcnctggtatgcntttgtgaattcgacatggncancgcngtgantttgatccnctgcgcctgtgccctnagctgnttanccaccanagaggcaaantcgnnccacaantgntaggatgcnncgtgacctcttgnccantcnaacgggggggncacagcaatccnccanaaattanttagcnng

SEQ ID NO: 90931 - DNA, 524 bp, Triticum aestivum
  unsure (1)..(524): unsure at all n locations
  Clone ID: PAT_TA_90931
attagagagggcatccaagaaacagcaaagtagcagtacaaacatacttgcagctaagctaagacggatcatggcgatcacaactgctagtgccagcccggccatgcaggaagcagcaaagacgccaagcgcctcgccgccccgcgccacggccgcctcgccggctcgctaccggccttcaccgctggtcatattcagcgcctgcctcgtcctcatcggctccnagcgggccgctcctgctgcgggtctacttcgtccacggcggggcaacgcctgtggtctccgcgctggtccagtttccggctggccgtctcctccngcccctgtgngtctccacttcnggggccgccgccacgganctcaactcctctccngnctccctcttggccggcntctnctagcacttttaccccnntcctgttngtttagcnatgggtcacangcctgccgcttcaatnntcttgccacngggaccanncncggggggcccgttccaatnccccaaannggtctttnagcccncn

SEQ ID NO: 90932 - DNA, 550 bp, Triticum aestivum
  unsure (1)..(550): unsure at all n locations
  Clone ID: PAT_TA_90932
tggaaacgaagcaatatgttcttccggccgcatatcgcttgtcgaaggcgtaatcgacaagcggtggattcttgtgacatgtaatacaacctctttttatacttcctccgtctgaaattagttgacagtcaaacggatgtatctagcactgttatacgtctagatacatccgtttgagtgtcatctaatccggatattacaagcacgagacgacagaccgtcttaggtgtgactacatgtgggtatatatgaggggcaatacatatgatccctttagaggacaagtaaacaagttgtactccgtacgccttgggtaccaacgcaaagcccacaccgttgtactacgtcctatcctaatacagttaattttggttcacattttacatctccacttngagcaatccctccaattatccnaagaaantataccccacccaaccacataaacttgtgcntcaaagccatagactagtgggaataccaactaaccngacaaaccaaaattatggtaggacgggttgtcacaagtcacaggntacagctactatct

SEQ ID NO: 90933 - DNA, 496 bp, Triticum aestivum
  unsure (1)..(496): unsure at all n locations
  Clone ID: PAT_TA_90933
ggaccagcagcgcctcatcttcgctggcaagcagcttgaggatggccgcaccctggctgactataacatccagaaggagtccaccctccacctggtgctcaggcttcgtggaggcatgcagatttttgtcaagacgctcaccggcaagaccatcaccctggaggtggagtcctcggacaccatcgacaatgtgaaggccaagatccaggacaaggagggtatccccccggaccagcagcgcctcatctttgctgggcaagcagctggaggatggcgcaccctggcagactacaacatcccagaaggatctacccttcacctggtgctccgcctgcgtngtggcaattaanncatccccgtggtgcggttctgtctcaaggttaacaccaagggattttcaacgtgtgctccgggnccttttccaaccctgctantttgtttcncaaattatangtangtgntttgganttgganatgaactganaataatgaacct

SEQ ID NO: 90934 - DNA, 164 bp, Triticum aestivum
  unsure (1)..(164): unsure at all n locations
  Clone ID: PAT_TA_90934
ccagctttgtcatgtcttgctcattcactaaccagggtaggtctccaggccgttcatgtcgatctcgttgtcaaagtgacaatgttcagacaaatggcaattgtccttaancttccncatggtggccaacaangatgatgtncctngtttcaattggtnggcca

SEQ ID NO: 90935 - DNA, 571 bp, Triticum aestivum
  unsure (1)..(571): unsure at all n locations
  Clone ID: PAT_TA_90935
ttcgggggagaaatctcaagaggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattgggagccaatccctctgctgagggtggtggtgatgatgaaggtgttgaatgaccaagnccgttgaaaggtgggttgacattgttgacaccttccgttcttcaaggagcaaacctgcttttgacaaagaaacattttaccnctcaacatgaaccgctacatcaaagaactctnctgccaancttgaaaggggatgacctaagagctttcaaagaaaaagttgaatccgccaacaaagtanctccctaacaagncnaaggccttcaatcctttgttgggcnaaacatcatatgatggcgcgtggtttcgccactacaagaggactcgatcaacttccntacttgcananggctgaaagagcaatgcaaaccacgtatcnaaacnaagcgtctnatatttgccctacan

SEQ ID NO: 90936 - DNA, 571 bp, Triticum aestivum
  unsure (1)..(571): unsure at all n locations
  Clone ID: PAT_TA_90936
ttgggagtaacatatctgtactccctccactctcttgcccatctcctttctatcgtgtgaatgcgcactttgcgctcattcttcgtctccctgccatattttgcctcattaggcgtgatgtaccttgcatagatgtccgcagggatcttaaaggcggtatttacttcaagcttctttcctcctttctgaggacctttaccatcagccattttcttcanctgaaggaatttgcacaattgagttctctgaaagaataagcatcttttctccgaaggaatgctgtaaaggattanntngaatgaaaacttaacgnatcaagtacctgaaatgtgtacctanngancaagagtataagtgcgaaaaatttgggagaggcnaatgcttcccaaaaaggtttggtaaaatttgatgaatttgaggaattaaccgatgtgtcctgaanattcacaatgtcctttggccttggtccaaaattgtgcgatccttaatcacaaattgaggancatgaagaaaannaattanagaanatttangacgaaattgcncaggtttaaanngggggtaaaaaaan

SEQ ID NO: 90937 - DNA, 527 bp, Triticum aestivum
  unsure (1)..(527): unsure at all n locations
  Clone ID: PAT_TA_90937
accagcgcctcctactgtcagcctcagctcactcgaagttagcaatggcggccgcgaccatggcgctctcctccccggcgatggccggcaccccggtgaaggcctccagggcggcgcccttcggtgagggccgcatcaccatgcgcaagacggcgggcaagcccaaggtggcggcgtccagcagcccgtggtacggctccgaccgcgtgctctacctccggcccgctctccggcgacccccccgagctacctcaccggcgantccccnggcgactacggctgggacaccgcgggctctccggccgaccccgaactttcgccaagaaccgggantggagtgatccactgccgctgggcatctgggcgcntccggtgctcttccccggactgtcccccgcaacgctcaattcggcaagcntttgttaangcggtccaantntcantgaggggctcgatactcggaacccacctgtgnngcgcaanactcncactgggctcaagtggtctaatggccctngaggcacgct

SEQ ID NO: 90938 - DNA, 605 bp, Triticum aestivum
  unsure (1)..(605): unsure at all n locations
  Clone ID: PAT_TA_90938
gcccatctgacatgtagtgaagtaaacaaagttgaaaccactcggggtagcaccccgcacgctagtaaattgagggcgcattgaggacacacttctcttccgcgtgaaggacgcactcgcgcacaattcaccactgcgcggtggcatgcacagaaggacacactcgcgcacacccagcaggcaagcacacaacacagaccagcaccacagaccagcatacgtgtacaccggtgtggccgccagttgagactgacggcgaggcagccaacaaggagaggcggctcgagccaaaaccgcatccggtgagcctggacttcatcagtagcctccgcgatgacatgctgctcctcatcatcggcctcctccccaccaaatctgtcgtgcggacaacctgctctcccggcggtggcgccccctctgggcgccgcgtcccctcaacctcacgttcgacagctgctcngcgacggggattcaaccatggcgcatctcaagttcttcatcgnacctggcagcagaccttgatctgatgtcatacaactgaagncaagcaattcacaatggtctaccccgccaaatagtcagggggcccgtcaattccctngnan

SEQ ID NO: 90939 - DNA, 614 bp, Triticum aestivum
  unsure (1)..(614): unsure at all n locations
  Clone ID: PAT_TA_90939
ccgtcgccgtcgattcgaacctcccccaaatcagcagcagtcgaccggaggcgccgccatggcccgtaccaagcagaccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagatnccgcaagtaccagaagagcacggagctgctgatccgcaagctgcctttccaagcgcctggtccgcgagatngcgcaggacttccaagacggacctccgcttccagtcccacgccgtgctggcctccaaggaggcggccgaggcgtactcgtcgggctgttcgangacacaaacctgtgcgccatccacgccaagcgcgtcacatcatcccaaggacatcaactcgcccgccgcatccgtggcnanagggctaaacttcctctccgttaacnacgtatggtccgaataattgatccggtggtatttgtccnaatgcgtccaagnctaactttgtgtnaaaaanaggtgtagttataaacaacaatnaagtgagtccttggttnaanaacaatntcaaaaan

SEQ ID NO: 90940 - DNA, 330 bp, Triticum aestivum
  unsure (1)..(330): unsure at all n locations
  Clone ID: PAT_TA_90940
ctgctgctctgcttcctccactaaactgctgctacctctgctccttctctgaaccgaactgctgctgctccctctcccacgagcctgctgctgctcttctctccttgatgcccttgcttcatctctgaacccatctctgttgctgttcttcaccaaactctcactgctgctgttcctttccttcactctgtttctctacattctcaagtaattttggtgtaccatgattgtgtnatgattaaatangttcaattcaagagacacattattgttcctgcttaattgtanctcnatgttataataatantgnaatngttttggggggggggc

SEQ ID NO: 90941 - DNA, 528 bp, Triticum aestivum
  unsure (1)..(528): unsure at all n locations
  Clone ID: PAT_TA_90941
aagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgataacggcggctgcggctgcacccagtgcaagtgcggcaccagctgcggctgctcctgctgcagctgctagatcattgatatcgatcatgcatgcaccgcgcgtgcagcatcgatcatatcgatctactactacaatacaatgtaaccgctacctgattcaagggcttatctatgcacctgacctgcatcangnatcaaggtgccatgcaatgcttgtntaaaaaggccccctaaataaatctcctgggtttactaaaaaaaanggggggccggttccaattcgccaaaaggnttctnntacccc

SEQ ID NO: 90942 - DNA, 469 bp, Triticum aestivum
  unsure (1)..(469): unsure at all n locations
  Clone ID: PAT_TA_90942
cacaaaagaagccaacaccaatcaaggcctccatccaatcccaagcaacctcgaagatgtcttgctgcggaggaagctgcggctgcggcagcgcctgcaagtgtggcaacggctgcggcggctgcaacatgtaccccgaggtcgaggccgccggcgccaccctcctcgtcgccgccaccgccacccacaaggcgagctccggcgggatggagatggcggcggaggatggnggctgccgctgcacccaatncaatgcggcaccagctgcggtgctccctgctgcactgctaatnattgtcatcgttnatcagcaccgcgcgcatgcacatatcnatatnnattcatccaccacctnnacatttacgctactgatnangccttngagnatgtaanaccngcaanatacanacagtcatcccancatttaacgaccctaaanatcnccngtgtttacctnaaaaaaaaaaaa

SEQ ID NO: 90943 - DNA, 642 bp, Triticum aestivum
  unsure (1)..(642): unsure at all n locations
  Clone ID: PAT_TA_90943
atccaatccgcacagaaatccccatctcaaaaccctagccctcatccccgatcccggcgagcgagatggccaacccgagggtgttcttcgacatgaccgtcggcggcgcgccggcggggcgcatcgtgatggagctgtacaaggacgcggtgccgcggacggtggagaacttccgcgcgctctgcaccggcgagaagggcgtcggcaagagcggcaagccgctgcactacaagggcagcgccttccaccgcgtgatccccgacttcatgtgccaagggcgggcgacttcaaccaaggggcaacngcaccgggaggcgatccatctaccggcgagaattcgccgacgagaanttcgtccacaanacaccaanccgggattctctccnatggcaacgcccggcccaacaccaacgtcccattcttnatctgaccncccctgcattgtcnacggaanaactngcttcnggnaagcctccaaggaatgcgtcntcaanacatcanaagngggtcccnaacggactgnccaancagcgnatcccgatgggaacncaatggccgccgcggtccctngtctatcccctgttccngnctgcgcatnaaaaaaanctttnntccccggccttcaanatccngtgtagggtt

SEQ ID NO: 90944 - DNA, 258 bp, Triticum aestivum
  unsure (1)..(258): unsure at all n locations
  Clone ID: PAT_TA_90944
tttttttttttttttttttttttttttttntttttggctccaaatgatttctgcaaanaccaaaaggaacactgcngncagtatattcatgtagcttttacgtnacacatggcatttacagtatttatctctttgttcangtgtattctgcaaggactataatgcagagggtttcagtanngggacagggatacnaactgaaggtggaccanatctcatgtcntcaacaacaaggttnggaattntttgaggcaattg

SEQ ID NO: 90945 - DNA, 628 bp, Triticum aestivum
  unsure (1)..(628): unsure at all n locations
  Clone ID: PAT_TA_90945
atccgctccaagtgggtgccctgcctcgagttcagcaaggttggcttcgtcttccgtgagcacaacagctctcccggatactacgacggtcgatactggacaatgtggaagctgcctatgttcgggtgcaccgacgccacgcaggtgctcaacgaggtggaggaggtcaagaaggagtaccctgatgcctatgtccgtgtcatcggcttccgacaacctgcgccaggtgcagtgcgtcagttcatcgccttcaagccaccaggttgccgaggatcccggcaagcctaaactacaatttgaaacaatggctatgttatgatggcatttgtgaactcactttgtccacgatccgctttcccgaccaaacatattccccgtccaanagatcgtgtttgtacgaacaaagttgtggacatgcatatgtnattccnaccgaaaaccatactgaatccaaaagggtccgggtcccnctgctgaaaaaaaggggggcccgnaccattcccccaaaatgatcnttaanccgctnatggcgtctttaaantcctaagggaaactgggttaccaantaacncttgaanaaccccttccangggtaaacaaaagcccccntncctccaaattccaccna

SEQ ID NO: 90946 - DNA, 438 bp, Triticum aestivum
  unsure (1)..(438): unsure at all n locations
  Clone ID: PAT_TA_90946
ctccttcgcgccctacggcgacgcctggcgccgcagcaagaagatggccgtcgtccacctcctctccccgcgccgtgctgactcgttcgcccccgtgcgggccgccgaggcggccgccctcgtcgccggggtgcggcgcgccgcggaggcgggtgagattgtggagctgagggagctcctgtccgcctacagcaatgcggtggtcacccgcgcgaccaccggcgccgcangggccacggccgagaagctaaaacagttttgggtaactccgcagcgatcatgtcgggntccaagcggatacntctcccccgggcgcngccgccaagttttaaggtgggcacggtctccnagaagactccgacgcccactccaaaaattggaatttcctaancaanaataancncaaagnacttngggaaaaccnggnagcagggaaag

SEQ ID NO: 90947 - DNA, 615 bp, Triticum aestivum
  unsure (1)..(615): unsure at all n locations
  Clone ID: PAT_TA_90947
atacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaattccgagaccctgtcctacttgccaccgctcaagcacggaggcctccctccaagcnaggtcgactacctgatccgtccaattggngccttgcctccnanttcaacaagttgggtcacttccctnganacaacgcatcccctgggnactatgatggcggtactggncaatgtggaactgcctagttccggngcaccgacccacacagnnaacnaggttgnaggagtccaagaagataccctgaccctattccncatcatcngttccacaaatgcccaagtgatgcctnantncacgctttaaccacgggcgnnaagatccggaaggctaaacnccatcacacagcattaaangcatgcatttgnaaccgaatgttggttctccattacctctatttcaaaatntcgnagtantcaaagtcaaac

SEQ ID NO: 90948 - DNA, 509 bp, Triticum aestivum
  unsure (1)..(509): unsure at all n locations
  Clone ID: PAT_TA_90948
agaaggcgcacggctacggcgagcagaaggcttacgacagcaaggtccagaagcacggctacggcgagcagaacgcgtacgacagcaaggtccagaagcatggctatggcgagaaggcgcacggctatggcgagcagaaggcgtacgagcatgggagcgccgccgccgccctccaccacgacagctacggcgccatgaagaagcacggctatggcggcgagcagaagcgtacggcgctgcaacgggagggtacgacgccgtccaccacgacagtcaatgcaaaactacngctacggcgagcaaaagcgccntacaacacnggagcacnccggaaggtacgccntnccacaacggaacgaancccanacacgttacgcgttggcaanagnttanggcacgggctatcccggaggtacaaccnnttncaacangggtggccaaccaacaacacngttangngggggaaatgccgaggtaaacctctttcacaagnggcccaacnaacaaca

SEQ ID NO: 90949 - DNA, 163 bp, Triticum aestivum
  Clone ID: PAT_TA_90949
ggtgctgtctgggtgtagtccagggagggctttgtagatattcggcttgatgcattgggcgccagagaataatgtaatgtgtacgtgctctgttattctttcctgtatttggggatgatggagaccaaggaaaccatgcaggtctttttacaaaaaaaaaaaa

SEQ ID NO: 90950 - DNA, 580 bp, Triticum aestivum
  unsure (1)..(580): unsure at all n locations
  Clone ID: PAT_TA_90950
tatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctccgattaagcaagttgggtttaccttccgtgagcacaacgcatcccctgggtactacnatggccgggtantggacaatgtggaactgcctattncgggtgcaccnagcaacncaggtgattancaggtggnngaggcaaaaaggantacctgaggcntantccnatcacggttcgaaaaatgccanggtaaatgcntaagttannccttaaannncgggctgcangaancgggaagcnaaanactcatcacagggcacataaagtgcaatngtttnnacccnaaatgctttggt

SEQ ID NO: 90951 - DNA, 635 bp, Triticum aestivum
  unsure (1)..(635): unsure at all n locations
  Clone ID: PAT_TA_90951
ccgatccccaccgaagaatctccgacagatcgaagccaaggctttctcgtcctcctccccaagatgcagatctttgtgaagaccctcaccggcaagaccatcacccttgaggtcgagtcatcggacaccatcgacaacgtcaaggcgaagatccaggacaaggagggcatccccccggaccagcagcgcctcatctttgctggcaagcagctccgaggatggtcgtacccttgctgactacaacatccagaaggatccaccctccacctgggtgctccgccttcgcggtggtatgcaattttcngtgaagaccctggacggggcaagaccatcacgcttgaagtggancctccggacacatcgacaacgtcaagncaagtncaaagacaagganggatccccccggacaacangcctcacttcgcccggcaanacttnaagatggcgatctggcagatacaacatccagaaganccacctccactgggtgtccgcctcccngtggatcaannttcctgaanaccngacggnaaacatcanntggaggggatctcgggcacatcacaactcaaggcaagntcaggacaagngggatccccggcaaaaggctanctncgaaaaatcagnnggcgncc

SEQ ID NO: 90952 - DNA, 376 bp, Triticum aestivum
  unsure (1)..(376): unsure at all n locations
  Clone ID: PAT_TA_90952
cgaccatgggaacccgcgggctcgccctgctgctcctcgcggcggtgntgctgcagacccncctcncggcgtcccanncggngggcctgctgcggatcgcgctgaagaagcgccccatcnaccggaacagccgcgtctcnangagcctctccgnncgctaggacctcntcaggngnggcngcaccaacancctccgctcngaggagganggtgacatcgtgtcnctcaagaantncatgaactcacagtanttcggggagatcagcttcctnaacntgaccngangttcaccgtcatcttcgacatnggcagctccaacctccngngtgccctacgacaantgctacttcacaattgnctngtatctcaaagcaat

SEQ ID NO: 90953 - DNA, 611 bp, Triticum aestivum
  unsure (1)..(611): unsure at all n locations
  Clone ID: PAT_TA_90953
tggccgccacctcccctctctcccctccctccctccctcgggtcgccactcaggtgggagattggaatatctgtctgccttaaccgccaccccctgcatgctctgcggcggcggcggcggcggcgtatcgatggtcatggacgccgcgctgcacgactgagtgcgggccgctgcccggcggatccaagctgccaatctacccccaaatccccgacgggttcaccgcggaggagtcgatcgctgctgtcttcccgccgacggcgccgacgcgggcgcctacctgaagccgccgcgggccgccctgtcncntcccgccgctccgcgacangctctccccgcngccgagaacccttggctcttaacggtgctgcggcngcngcaggcaagtgcaaccggacacccgagtttctcgnacntgctgggtacacaacgcatctcaatggcgagaancnagagattcattataccggcaaaagcctgtcgcgccanaacctctcnanttcccnacacccctntgggcgganagtcaatccacgganaantacanaatcttaaanctncactgantggcggctcgtgctcgncagaggacncgtccattcaagnggtnt

SEQ ID NO: 90954 - DNA, 559 bp, Triticum aestivum
  unsure (1)..(559): unsure at all n locations
  Clone ID: PAT_TA_90954
gttctattaagacatcatacttatcagttctagcttgtgcctggaaaatgcacttgagactctcgatcatatcgtaagccttgacattcttgagttgttgttgcaaatctggtaatataggcaagcaccaaacatttgatcccagtactaatcacatgatatcggatatgcattcttaacagtagcagttgcatcatcaggttcttctggtcccatataggcacacattattcagtagctgcaacatttggtctttccgatctacaattaatactatacatatagaacctatgctttcattctactcataggttccaaaataacctagactagtaagtantgcatttttggtggtacccatttnggacccnaaaaaatgaaaacataaacaccagtantgtagtgtggttccttngnanaaggatatccggtccccanaggcataacttccttttcnaattggcnactccncnaanacctncacaaaaaccgtaatggcnactnaacancaaggcccnggttaatccaaggtggccanggccctgggaaaaaaaaaaaa

SEQ ID NO: 90955 - DNA, 619 bp, Triticum aestivum
  unsure (1)..(619): unsure at all n locations
  Clone ID: PAT_TA_90955
gactttgaacactaagcaacttgtgtatgaacagtactgtctaatactactaccacactggtagctgagctagagtacaatttacaaggtggcgccactttgtactctccagccacgagccggggtctggccgggcgaagtaaaactgagaagaagaaaaagaagacggcccatgcggccgggtgccgctagagacggtgagcggggacgaggccgtcgtcgaagttctggaagtagctcttggagtcgtacccgaagctcacggcgcggcgcttcggccgcagcatggcgcgtctcaacctccagaacagctgcctcaccggcgccggcgcctgccgccacgacccgccgccgctcttcctgtccatcctcttcgggcctccatgctcctcggnactcaaatgatcctcccagaaactccatcagtccttgatgagttatgcggacnaggacgtacgntctactgatcttcgcanctgaacgtactcttctcatggtangtacntttgattgaggcgtttccctccgtcgcggcggngcgccgcaatgttgtgtgggggcgnaacggaatcttggcaagaatacncncgagtgcactataaaaaccgganntcctcta

SEQ ID NO: 90956 - DNA, 581 bp, Triticum aestivum
  unsure (1)..(581): unsure at all n locations
  Clone ID: PAT_TA_90956
ggtaggcctccgcatttcttcaggattttattggaaacttctttcagcatatcagggcagtggtcctcagagccgaaaattcttttgagaaacaatcttttggcgtgaagatcacttagggctgccatttcatacacacggtcatcactaccaggacaacatgatcttgccacgtcaataatgcgtgtagtagttataattctgctagaatatttattgtccggaaaagcacacttgatattgttccatgcttgagtagaccatatatcatccactatgacaagataccttttacttgtagcaattctcttagctttgcaatggatgtantttcgtccaagttcaatatcttttctgaatccatcgggcaaggcactttgtggatanatccttganaatttcttaaaactggcttttgtaaactgnnaaaaagcctgacaaccaaatgccttgaacttgcgaaanccccatttgcgantgtgncttcnaancncaaanccaanattgaaaccttagatctgggggactgttgctctcttnanaccactnaaaatatcctggccncaaaccaaagtttcccc

SEQ ID NO: 90957 - DNA, 605 bp, Triticum aestivum
  unsure (1)..(605): unsure at all n locations
  Clone ID: PAT_TA_90957
atccgagctagctagtcatggagatggagccaccacccaaaatgcttgccactctcatcatcaccatactattgatgatcatgatggacacctctgccgcgcttgcctcggatgcagtggtgcttagaggacaagcaagagcactcctcgtctggaaagatagcctcgacaaccaaagccagcacgccctgcggtcctggggaaacacgtcagcaccctgcaattggcgcggcatcacttgcggtancagtgtgcactggcgtcggcggcggcctgtgatcactggcatctctctgcgcgacatgcaattggganggacgctggagtccctcaacttctcggcttnangaccctgacgcgcctcgacccgtcaancaatcagttggttggncaatcccttgtgaaatagggcacatgaaacacttagttgcattaaaattgtcagtaaaaancttcantaaataccgantacataggggttgccaaactcacttcctaactttaggnaacaacttntggcaattcataaaacggttcctcaaantanggacncaantgnacaanaaatctngtcaatcaaaantnctattnccaaaaaaaaaaaa

SEQ ID NO: 90958 - DNA, 600 bp, Triticum aestivum
  unsure (1)..(600): unsure at all n locations
  Clone ID: PAT_TA_90958
gccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactgggacaatgtggaagctgcctatgttcggatgcaccgacgccaccaggtgattaacgaggtggaggagtcaagaaggagtacctgaccctattccgcatcatcggattcaaaacatgctcangtgcaatgctcacttatcgccttaaaccacgggctgcaagatccggcaaggctaanactcatcacaaaggcattaaaatgcatncanttgtaacccgaatgcttggttcctccaattacttctatgtccaanantttttcatgtntttcaactgtcaaaacncccttt

SEQ ID NO: 90959 - DNA, 511 bp, Triticum aestivum
  unsure (1)..(511): unsure at all n locations
  Clone ID: PAT_TA_90959
cctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaagaggtcaagaagggantaccctgacgcgtacttccgcatcatcggattcgacacatccccaagtttcatncgtcagctcatcgccttnaaccaccgggctgcaaggatccggnaaggctaaaaagtcatcacaacggcaantataaatnncattcgtttntaaanctaaatgctttggtttccttcccatttaccttctggttgtccnaaaaa

SEQ ID NO: 90960 - DNA, 624 bp, Triticum aestivum
  unsure (1)..(624): unsure at all n locations
  Clone ID: PAT_TA_90960
ctaacactgtctttggatgtctccattggagcccaggaaatggatttggtaatcatctgacatcaatacagctgtttggctggacactgaattcgtattggaaatgaaaaaccaattcaggcctgttttggctaccacgtaaatgtccctcgcacgtttcggagggctaccccttcgaattggactgaaatggccaacctcccgcaaaacatacccgttcgagcccgcaaccagaaaatagaagaaaggaggggatggcgacctcgcgacaacctagcagtcagcaggcgggcggcggcggcgacctagcgggtaggtggcggcggcggtaaccaccatggagtccggcggcggtaggtgcctcctccccggtccttccctcntcccaactcctcntctctgccccactgagccacacccgccgtggtggccgtggcggtgcaagactggcgctccccgctcccttgtggatccctgccgtctcccggcaacgtgcctgcctcctcggcaagcccgncgtctcctgccgcgtctcgcctctcgctcatgcaaangagtgcgcnccctcgctcaaggcgaggaatcatgcagatattatatttacgcanaaccattattaagcan

SEQ ID NO: 90961 - DNA, 530 bp, Triticum aestivum
  unsure (1)..(530): unsure at all n locations
  Clone ID: PAT_TA_90961
cttcatgtcgctcctattattggtctactttctagtcctcgagaggaaaatgataagaacaagatatgaatcacaggctcctttgggtgagcatttccctaaagtttcttacaatgatctggttgaagcaacanagaacttttccgagtctaacctgcttgggaaaggnagctatggtacantgtacaagggaaacttggngcancataanttggaantggcagtgaaggtttttaaccttganatgcanagcgcggngagaagcttcatgtcagaatgtnnagcgctgagaagcgttcaanaccngaatcttgtttccatcataactgcatgttctacngtngntagcgacggtagagctttcagggccctaacttacgagttatgccnaaggggaaacttgncacgtgcctcatcanaacggggacggcacagtggtaancatctganttaantnaagatcggcatactgtagcanagcatgtcactggnctattantaatccacganaaccacancattgtgtttga

SEQ ID NO: 90962 - DNA, 624 bp, Triticum aestivum
  unsure (1)..(624): unsure at all n locations
  Clone ID: PAT_TA_90962
acgagatggtacctcgaacaacgcagcaacacaaagcctctggaacaaaggaaagatagctagatagttggaatgaaaagaacggagaagaaaacaacatcttctaccacaagggacttagaagagaaattttacaaggaaggcttgaaaagagtagcttcaaagggacttatggaaaacttctcaaaattttgaggttaaaacctgccatcaaagaaaaaatgatttctagagagcaacaaagagatgcaaaacttctttcaccgagaggataaataaaacttggatcatccataagaaccacaaatagcaacaatccttatgataggctttaggtgaaatctaacctaagatatccaatgaacaaattgatgggttggaaaatctcctgaacgaagagaagatgtcaagaatgagatctttctcaagtctctcatgaatcaagatgattacacaaccncaaagataagggagaataatttcacttggnatgcatatgaagaagcttanccctaaccaaacattgccaacaacagttcttaagagtatacttgnggatccactcagacagatctgcangcacttggaagcanagcctgcaacacttgantcncggaaaaccgg

SEQ ID NO: 90963 - DNA, 622 bp, Triticum aestivum
  unsure (1)..(622): unsure at all n locations
  Clone ID: PAT_TA_90963
tttttttttttcgggcactctactagtataagtcgtttcacacaactgaaattaaattgttttgcacgatgtttgtaatgtctacaacgccttgtaaaaagtgaacagagggagtacattcgacggctacacacgaaccacccaatttgaggtggccagtgataggcgccggcgcaccggcccaatttttggccggtcggctgccgagcatacgatacggacttttccaaccgtacgatacaacttttccttcgtcttcaaaaagtcaaccacgctggaaaaaaggtagtgacctagttcaggcacgctcgccggccgccgcacttgtcctcggcatcacgtgctttccgtcacccgtgccaccgcgtccgcccacccgtgctcgccgctgttcgtgccattgcgctcgtctcggctactccgctcgacatggntgtactcgaacagagacgggttcaacatgtggcacaagggtgcaaatctcggcgtgccgtcccggcttccgccgtaagggggcccgtaccaatcgcctatatgatctataccncgccacngcgtcnttaaactctgacggaaaacctgggtaccactaacnctgngaancccttccangggtanacan

SEQ ID NO: 90964 - DNA, 350 bp, Triticum aestivum
  unsure (1)..(350): unsure at all n locations
  Clone ID: PAT_TA_90964
tggngtcgctcaccangatngcgtccctctccgcggccgtggcggtcgaccggcgcgcggcagccccgcgccgcggcctcgtggtggcccgggccgcaaangtcgagggncagcaggagccggcggccaagatggnagccgtggagcccgccatcgacggccgccgtgccgtggtgtttgctgccgncgctgcggccttgtcggccattggcntnggtggngttcgncgagtcggacgtcannattgggagtcccnaggccaanaagaagtacgcccccgtctgcatcancatgctcancgccaacatctgccaaaantgatcgtgtgaaaggcggtnntgngaatgctg

SEQ ID NO: 90965 - DNA, 476 bp, Triticum aestivum
  unsure (1)..(476): unsure at all n locations
  Clone ID: PAT_TA_90965
gtaaccaagcagcatgagcctcaacgttccaaaaaatagcagcatgcgcctcaaggccgtgtaccagcgcatcgtggacaacttcctcgccgttgtcaccgccgccatctccagttactctctcgtcgccctggtgcggctcggaccagcagagctcatcagctggctccgtgagctccagcttcagccagcgcacctcttcttggcggggttcgtcccggccgcagcggccaccgtgtacctcatgcttcggccgcgtgcggtgtacctcatcgactacgcctgcttcaactcctcctccaaccgcccgctcgcccgcatccccatggcctccttcgtcgagcacacaaagcatacgccaacatcgacgcccgcagcgtccggttcatgttcncggntgntgcancgctccgggctcggggagganaatnctgccggcggccaaantactcccaagcacgantatgcacctcaga

SEQ ID NO: 90966 - DNA, 623 bp, Triticum aestivum
  unsure (1)..(623): unsure at all n locations
  Clone ID: PAT_TA_90966
tgacaccgaagaagtgattactagggcgttgtcgtcgagcatacgaacaagcatgtcatgactgtggtcatcaacaagcctgactcaaacttcgtcattaagctcaaactcagcaagggcacgaggaagcttgtcaccatctgcggcatgtcaccatcagcggccaatagcatctgcggcatgtcaacatcctggaccttggatgaggattacttcgtcaaccaaatatcaaacaaggtcctgggttgctagntcaatactacctccactcctgaacccgcctantttcgggattagntcacccaatggtgtctccttacatccnattgttttgnccgaccacgacttcaatggttacaattnagantgatgggaatgnacantgttccanggaacttaccttcctgattacttacctgacggcaggaataagtnntacganctccnagganacantcacaggnggtgacnatcccagaaggnagttccaangcctgtttatgcnaggaggggaacatctgaccatgctggttctggtgcaacaacncactaggaatnagcaggnttcggnttcttgcgacttcncaaggaagnttccgnccgaataaattnngtaaattttt

SEQ ID NO: 90967 - DNA, 169 bp, Triticum aestivum
  Clone ID: PAT_TA_90967
ctggtgaagatgttgctggatattgaccccctctcgatgagaggatcgatggtgatgatgatggtgacgatttcccccacctggagggatgtttcctcggaagaacagctccgccggagccctagattggttccaccaaggttcctccccgaaggggggggcccggtac

SEQ ID NO: 90968 - DNA, 428 bp, Triticum aestivum
  unsure (1)..(428): unsure at all n locations
  Clone ID: PAT_TA_90968
cccccctccgatctcgccgagaaatctcctccgatcgaagcgaagccaaggctctctcgtcctcctccccaagatgcagatcttcgtgaagacccttaccggcaagaccatcacccttgaggtcgagtcctctgacaccatccgacaacgtcaaggcaaagatccaaggacaaggagggcatcccccccggaccagcagcgtctcatctttgctgggcaagcantcccnaggatggccgcacccttngcggatacaacatccnagaaggancccacctccaacctgggtgctcnaggtcccttnggtggatgcagttcttncgtcaagacctccaacgggcaaacatcacactggagggttgancctccngacaccatccgataacgtnnaggcaagattccaagacaaggaggnacccttcccggac

SEQ ID NO: 90969 - DNA, 619 bp, Triticum aestivum
  unsure (1)..(619): unsure at all n locations
  Clone ID: PAT_TA_90969
gcggcttcgactccagcgcctcctcccttcccctcatcgtctccggtcagccaggtagttaacagctccagcagccatgggcaaggagaagatccacatcagcattgtggtcattggccatgtcgactctggcaagtcaaccacgactggccacctcatctacaagcttgggaggcattgacaagcgtgtgatcgagaggtccgagaaggaagccgctgagatgaacaagaggctttcaaagtacgcctgggtgcttgacaagtcaaaggctgagcgttgagaggggtacaccattgatattgctcctgtggaanttngagaccaccaanatccctgcactgnccattgatgtccctggcaaccgtgacttcatccaaaacatgattactgggactccccagctgattgtgctgtgcctaacaattancccacactggggtttntagntgggactccaaggatggcaaccctttanacctccttgcttcaccctggggtgaacaaatnttgctgctgaacaaaggtccacatccaantntcaaagccttataagaattcaggatcctntactaaaagcgtaanctaaggtcctctncaccngtnagnaaaatattaagg

SEQ ID NO: 90970 - DNA, 453 bp, Triticum aestivum
  unsure (1)..(453): unsure at all n locations
  Clone ID: PAT_TA_90970
caccaacgaccaccagcgcctcctactgtcagcctcagctcactcgaagttagcaatggcggccgcgaccatggcgctctcctccccggcgatggccggcaccccggtgaaggcctccagggcggcgcccttcggtgagggccgcatcaccatgcgcaagacggcgggcaagccaaggtggcggcgtccagcanccgtgggtacggtcccgaccgcgtgctctacctccggccgtctcccggcgaccccccgagtactcaccggcgantcccccggcgactacggctgggacaccgncggcctctcccgcccgacccccgaacttncgccnaaaaccggagctggaggttgatccactgccgctgggcatctggggcgcgttcngtgctcttcccggacttntcncccgcaacgctcaattccggcangctnttgttaaaggncgcccnattt

SEQ ID NO: 90971 - DNA, 287 bp, Triticum aestivum
  unsure (1)..(287): unsure at all n locations
  Clone ID: PAT_TA_90971
anttttttttttttttttttttttttttttttttttggnnagggggaantantttcggaagtanccaaatntgcaattactggatacancccgcanccatcagtttaagcaaacgaaccatagtatacacagccantaatcaganctccattgtcatgggatctcttctacntanagngtccccgactaatacacaccaangnnattcatcannnatacaaancnaggngaccngccatganaatcnagtaagcatgatcaggtcctcttganggggtcgaagttgt

SEQ ID NO: 90972 - DNA, 628 bp, Triticum aestivum
  unsure (1)..(628): unsure at all n locations
  Clone ID: PAT_TA_90972
aatggtgggtgtcggttgaatatccgacgtatctcatagtacgggtcctaagctaggcatcttggagcgatggtaatatgaacatgggggtttacccagcttcgggctctcttgaagagataataccctacatgctgcttttgattgtatttgtatgggtgtagtacagagtacatgtatctaccacgagattgtagtaatgaatatgagattgtccattggactagcctggcctcggtttatataagacactgggaggcctanggttaaggaganccttggtccttggggcgccaatcctgtggatcctccctggtatgcggcaggggtgtctgaactgggccaatgagtatgcngcatgggggcctccggccaatcctaactaattgggaacactggggagtacccctatcctnaggaaacgtcaattacccccctgaaccgnccttcaatttggggaatccccgatcctccgnactactcnactccggtgccggctgaaacggtnaacaatctacaactcatcctgagatncaaataatcnaagattanagtcggtacnnaganccttaattcaccttacaggctgtatatatcaactaggttatttccggggatgccctctcnn

SEQ ID NO: 90973 - DNA, 642 bp, Triticum aestivum
  unsure (1)..(642): unsure at all n locations
  Clone ID: PAT_TA_90973
gcggctttacctaccgagaagaagagagaaaaaaggttcgagtgcgttccagagtgaggagtgagaagagatggctccggtgaagctgtacggcgcgaccctgtcgtggaacgtcaccaggtgcgtggcggcgctggaggaaggccggcgtccgagtacgagattcgtacccatcaattccggcacccggcgagcacaaganccccgaccacctccgccnaggaacccttccggcaagngccanttttgcaggatgggtgntttatactcctcccancaactgctatttgcaaagtacgcctgcccgccaagaacaanccaagtgtttgaaggagggcgacatccaagganccanatggtggatgtgtggtccaggttggagcccatcnatacactccgtcttacccattctccttcnnangcctttaccancccatcttttggggancactgacaanaagcatcnacgacacttgttaannaaagaactnctggcgttacnaggnactgacaatcaatactggctggaaattcccatcnncggcctaacattgtcgtacctgtcttgcgtaaactatctccttcacctacccantaagcctggctactcggnagcntctcaaagncaccntaccattttat

SEQ ID NO: 90974 - DNA, 343 bp, Triticum aestivum
  unsure (1)..(343): unsure at all n locations
  Clone ID: PAT_TA_90974
cgccagagggcctagccgggcaaagctcgcccggtccggcggcggccangccttctggctcccccgcgcgcagaggagcggcgcgggcccttctctccggctggggcgcggcgtgggcgccnggcgctgcngcgcnacgtcncctggcgcgctggcggcnctgggtgntggtcgcntgnctgacggcncggccgttggtggatcgcncggggcccanacgtgacggcggatctggcgcnttggggctcctgcggtnagggctgcnggcggcncngcccnaccgcngtnggcgtcnngtggcagctgctnacatcanangggatctgcgcaacaacngcttggt

SEQ ID NO: 90975 - DNA, 435 bp, Triticum aestivum
  unsure (1)..(435): unsure at all n locations
  Clone ID: PAT_TA_90975
attattgcctctagcgcatatttccttcactaccgcccaccccagcggtactaccgctgcgggcgggcaatggggggttgtgtcggggtagnnttttntgtttttctcccccatacccattcgctccactcgcccgtcctcttcgtcgctccagcgacgtctcaccgtgggagggtttcggccggccgccatcctcgtgtcgtccctctctatttcttccggtggagtcnatccccaccgcgtcctcctnccatggatgccgggtattgccccctttcccgttctctcctttgcctaanatctcacatctgggtncctangancaatagnattgttcctcccaatttttgggctaattcnagcttnagtagatgganaaaggctcctnagccggttngttaagttttggaagttaatttttgaattngcatccca

SEQ ID NO: 90976 - DNA, 594 bp, Triticum aestivum
  unsure (1)..(594): unsure at all n locations
  Clone ID: PAT_TA_90976
gctcagggcggctgacgtattagcttccggcttcggcagatccaggctcctctgtgatgacacctcggtgtcgcccgcttcatgaggtggagaggtgggtggggtcttgctctccaacatcttcggaagaaggtcccccgaagacaaactctgttgagaagagctgctagccggactacaaaaaatgaacctgggtattgatctcnggagaaatgcattacttttgaattaaatggttaactccatactccggtgggagggctggccattnggtggggcatgacatggtgaggacgcctatttggggcaagancccctgggaccttttcttcccctgcttgggactcctncctccaatncttcaaaaggggcctttctncgccccgggaaannaagctttgcccccttccccnatatctccctttgggaagaatatcccttggggtcnggatcccangttgaattttgnttaaaacccgtctcncttcccctgnaggnacaatgctaacaccggcaacnctggnatgtggataggaacctcggaatgnccggnactatcntcgctgctacaatctgcacaggnttaatagccag

SEQ ID NO: 90977 - DNA, 635 bp, Triticum aestivum
  unsure (1)..(635): unsure at all n locations
  Clone ID: PAT_TA_90977
tatacattaacggccgcacaggaggtattataattcttgcaagcacaagtataaaaagattttatattctatcaaaatattccttttacaatagcacatgctattcgaacataacatccttcgagcactgcgcttctattaaacgagcgcccggaagaacttcctcaaagtagtgcttggcaggtactcggctttcgtccgaatcctgggatgcaacaacactagccttcatatccgcccaatacgtcttgacacgagcaagagccatttgtgcaccctctatgcacgttgacctcttcattgcataaacatgcgacaccgaaccaaggaaatgctgcaccaagctaaaataactcttcggctctggctcttccgggcacaaacgactcgcaacatactcatggcgtgtccggataactgttcagctctgccaagcggcaatggtcgatacgaaagtggcttgtggattgtggactagacaaaaaantctccaatnaanggcactcgactcggaagntcgtngctctgcgaatccncaatccaataatgnttcganccatgcggtcaaaaagaaactaggtccganttaccnagaaaangnttcaccngatcagctgatancccctaanncatgg

SEQ ID NO: 90978 - DNA, 214 bp, Triticum aestivum
  Clone ID: PAT_TA_90978
ttttttttttttttttgacacaaaatacgaagaggatcaataaaccaggacggaaaagaaaatgtccattgcgtttagtgagcatcccaatgaatgaatgagtaaacttatatgcctcgggggggcacaacaagcagggccttcaaatatttctatgtgcaagcttttttgttgacggcaaatccgctcttacgaatgatctcataaggggggg

SEQ ID NO: 90979 - DNA, 633 bp, Triticum aestivum
  unsure (1)..(633): unsure at all n locations
  Clone ID: PAT_TA_90979
atcaaactatctcaatgtttgaccgagtttgtgcaaaaatatatcaatgtttatgaaaccaaataagtatatgatgaaaatatattttatcataaatctaatgctactaatttaatgacataaatgttggtgcattattgtataaatacggtcaaacataaaaatgtttgacttttcaacaaagttaaaagtacactcttcaaaggacgtagggagtaggccgcatttgggaatggttgaaattaaatgaggggtatttattttacacatgtaccggccgcccaacaaatttcggctggaaacgaaacaacaaagtgatatctgtatttctttacaggtgtatttaagaggaaatacggcagtccaatcagggtcctacagttattgctaatcatacacacaagcggctacatattgatgtctcatatattaagtgcattattattatgtctgataaaaaccgtgttaaaaaacattaanttccnggtttagtacacaccgtatgagatgttaagccnaaccaatgcataaaccgtcagtcncagttgagatcaagtcgtagtaatcagagagagtaatttccaggantcactanttgtttcctttcgaaaaacggtagtgattagccaaaaa

SEQ ID NO: 90980 - DNA, 408 bp, Triticum aestivum
  unsure (1)..(408): unsure at all n locations
  Clone ID: PAT_TA_90980
tttttttttttttttttttgnccgtcanccttctgctgaaattaagtttgaaatgnaccgggtggttgtgaaacagccagcatcgttcgcctccacaanacccaatcgcaatcacaccagagaccggacatggncgctacggtgncgcctagcatcacgtgcatgcaatgttaggcatggtgttgctgttggagtgccctcaaccacctccgtctcctcccctctggnatanacgcatnagcagancannttattgngagatangcacgccccanaggccggtcacagtggngccagcaccacttgaacctgaagcagnggccacagtgcatgcgccacttgcagggagggnnattgangcgcagacgcagctcctcctcctcctggnctnatcgccngcgnnctggg

SEQ ID NO: 90981 - DNA, 505 bp, Triticum aestivum
  unsure (1)..(505): unsure at all n locations
  Clone ID: PAT_TA_90981
gtactggactgcagctaagcccccgagtgggaggattgctcaccactcggtaggatttttaaaacttaggcgtgtactggactgcagctaagcccccgagtgggaggattgctcaccactccggtaggatttttcaaacttaggcgagtactgggactgcaactaagcccccgagtgggaggattgctcaccactccggtaggttttttaaaactttaggcgagcactgggactacagctaanccccccgagtgggaggatttctcnaccactccgggtagatttttaaaactttaaggcgagtactggactgcagttagccccnanagtnggaggattctccacactcccggtagatttttaaaacttnaagnaagtacngctgcactaancccccgagtgggagattccaacaccccatagtttttttaaaacttnagcatacnggctggaantaccccccagnggaagttccacancngtanttttnaactngggganacgg

SEQ ID NO: 90982 - DNA, 185 bp, Triticum aestivum
  Clone ID: PAT_TA_90982
gcacccccaccgaagttaacacctatgaccccaagtgatctgcctgcacctattgggtcaacaagcatggaagtgaaatcctcctctgtaagaagagttgttgcaattttagctcctgtagggtgcttcatcttgcttaccatcttgttcctcatcacctgctttataagtaaacgaagaacaca

SEQ ID NO: 90983 - DNA, 341 bp, Triticum aestivum
  unsure (1)..(341): unsure at all n locations
  Clone ID: PAT_TA_90983
tgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaaagagctccgccaccagcatcaaatccatcaaacatggggcaaaggctcccggcgtgccccggcaaagtgcggcgtccagcgtgccttccccatcnanattccnaccaactggcaacatgtcaacttagtcaatatatatcctttccctnaagtgcatgcatggacgcgttggcgntggagttatttcca

SEQ ID NO: 90984 - DNA, 433 bp, Triticum aestivum
  unsure (1)..(433): unsure at all n locations
  Clone ID: PAT_TA_90984
gcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatccgagggcatccaagaagttccgagacctgtcctacctggccaccgctcaagacggnaggcctccctccaagcaggtccgactaccttgatccgtcccaaatggggtgcttgcctccgagttcagaagggtttggggtcatcttcccgtngagnacaacnacccctggggtactacgaatggcccggtactgggaatgttgnaactgcctanttccggngnacngacccacaaagtgtcacgagtgg

SEQ ID NO: 90985 - DNA, 329 bp, Triticum aestivum
  unsure (1)..(329): unsure at all n locations
  Clone ID: PAT_TA_90985
gtcccggcgcctaggccggcggcgggcggtggcggtggcggtggcgccgtggacgcggtgaaggcggcgagcaaggagcccatcagcccgggctcgccttccccggccagcaaggtgcgccccggcgccgtctccctgcccgggtggaagctccgactccctctgcaaggagtccagctccgccgccggncatgatggcgcgttcccctattctgaagcacgcgggatccttgtcatcctttgctagtactagattttccnggctggnatatgtataagtttggnagcggagttttgctgnncgttccttcccggngatgtcatgtaga

SEQ ID NO: 90986 - DNA, 331 bp, Triticum aestivum
  unsure (1)..(331): unsure at all n locations
  Clone ID: PAT_TA_90986
ccgccgttgaaacctccagttctcagcggaaacacagcaacctgctcaaacgtctccactagctctcgaccaagatggacgtcgccgacgccgcctcctcatctggccaggagcagcaggggcacaggacggtgtcgtctgagccgccgaagcgccccgcggggcggaccaaggtgcatgagacgcgccacccgctgtaccgcggcgtgcggcagcggggccgggtcgggcagtgggtgtgcgaggtgcgcgtgcccggggtgaaagggtccaaggctctggctcggaccttcgccaaccgncgagatggcgggngcgcgngaacgacgca

SEQ ID NO: 90987 - DNA, 595 bp, Triticum aestivum
  unsure (1)..(595): unsure at all n locations
  Clone ID: PAT_TA_90987
aacacactccaccaaatcttgtaagatctagcgcgatgtgatgtgctattaaccaacctatcgacgaggcagtggcgagtggcaggcaataatccaaagcgaagcggccacacatgaccgacgcgacgtctacggaatgtctggctactggagatttcatgagcagctagtgtaaagcggtccgcatctccgtccgcacgatacaagataagttgcatgcatacacaaaggcttagcagttagtacgtgaccatgacggggacggcctggaggggcacggcgagcgtntcacggtgggtgatttctccggcaactccaanttcgtccggcgccangcccggtcccgggancgncatccnaacgcctgcagcacgacgccaagacgaacggacacccgtccgcatcnngcaggccggggaaagccgcgcccngcccgacgggagatcntaccttgccccngatccacgcctanccgcgcttatcaagactctcccggacgancntcgggtctccaagcgccggtccgcatgtngccaacgtgaagtnacgtggngcctggcagggaacgcgtttcagcctctcgcgctggnggaan

SEQ ID NO: 90988 - DNA, 590 bp, Triticum aestivum
  unsure (1)..(590): unsure at all n locations
  Clone ID: PAT_TA_90988
gtaaagtacacatcaataatatgtatatcaaatatacctttgttcagtttgccatccttctcatccgccaagtatctagaggcacttccacttccagtgaccatttcctttgcagtagaagcactcagtttcaggcttgagtcaagctttgggtttcttcaggggagtgccaacttgtttgtcattattctttaattcccctttctattcttttgccctttttcttgaaactagtggtcttgtaaaccatcaacacttggatgctctttcttggatttctaccttcgccaattcaaacatccgcgaaagagtcggggattactttcggtcaccccttaanatattataggtcaacaacgaatccnaaaaattgggggngaaaagggacaagagactttggtcaattactaccttactcngaagatactccacttgatcaaanaatggtagacccgggcaacctgananagccattgggtgagcatctccccatttccnaggaaagacacaagngctaaactcccganagggaagngatgaatcaatnaanctggganactanngcccangggtaaaaatttgnagccgtn

SEQ ID NO: 90989 - DNA, 621 bp, Triticum aestivum
  unsure (1)..(621): unsure at all n locations
  Clone ID: PAT_TA_90989
gttttttttttttttttttattccaataaaattccataatatgaaggctgaaaccaagtcatgtgatacaaaatggaagaggaagtagagtacttatgaacacaaacagtaataaaaacaggcacaacagataaatgtatatgcacttggagaaaaccatacaatccagcacatgggtttttgtccacaacacttccactccaaaaaaataaaaatcctgggcatggagtgcaacactcctgttcatatccctaaaagagtgttaaggtccatccctccccattaagaacaccgcatgnttaacattccacaagttttggggcaataccaacttcccgcggtgatcaccactggcgactgacccctgaccaaganttcctgaagttnccntcctgaaaacattttttggacancctgaccacaacgtgggggcattcaanaacacctggtgggacatattgccccaactagccaanaaagaactttanncccggnaccnctccgngncaattcaacaacgtaaggttcattgaggccttaatatcgctaataccatacanacggcantaggnttgngaaatgngatncggttgggtaatgcgtctcacaagncacgtgacc

SEQ ID NO: 90990 - DNA, 269 bp, Triticum aestivum
  unsure (1)..(269): unsure at all n locations
  Clone ID: PAT_TA_90990
aattaggaaaatttagtcgtgatttcttgtacgttaggaaagtgctgctttgctaaaaaatgaagagaaaaataaaccaacatggagagtgtggtngggagggnggatatgttttgttcttgggtcnanaatcatgcctctaccaccattcacctccanatcatgntgaaatacagnntctggganagntaantgttcgcgtggnanatatnctgaananttgnaccancctgtcaanatanacaactttcntccanacctctccatca

SEQ ID NO: 90991 - DNA, 656 bp, Triticum aestivum
  unsure (1)..(656): unsure at all n locations
  Clone ID: PAT_TA_90991
gcaaagcaaggacgatgacgaggagccccggccacagaacacagggggacagaagaagtcctccccccaagttaaaacggtgaacatgatatatgctacccatatccccaagagggagcacaagcgcgcgctcagggacgtctacgcgatagagcgagtttgttccaaagtcaacccatggtccgtcctgcctggatcaccttccgattcgttagggaccatcccgaccaagtatccgtcatggccggttcaacccgcactgggcctccgacccaatcatttgatggttccatcttacgttaancctccatggacggtggcaagcagccttgaacctggctatatcaagatgttatgcgttaatggtatttgttcctccaaggtttaagcccacaaaacacttttaaagtgtcctacaagtgttanaggctgctgtaccggtcatcaattggaggtggctccggttaccggcantccgacgaangttttcttcnatanctcccttccgcaaanggtacaactctgtcggacaatcnatcctcgatcattgcgnacanctagcttttaaagtaaatncggncaccgngtatanacatggaaatganncccnctataggaaacgttcccccanaacnaanggnttttagaacttattg

SEQ ID NO: 90992 - DNA, 242 bp, Triticum aestivum
  Clone ID: PAT_TA_90992
aatatacagtacttcaatggatattattacaaggcaataaacaagcaaatccggtgttcttagtggcacattatttgaaatctctggaactgaaaatagaatttcttcacaactagcaaaatacatacaatgcaactcaaatttcaagggcaaagtaaatgtaacaaacatcaaagcagcatggatgcaactcccggggggggccgggtacccattccgccctatagtgagccgtattacgc

SEQ ID NO: 90993 - DNA, 337 bp, Triticum aestivum
  unsure (1)..(337): unsure at all n locations
  Clone ID: PAT_TA_90993
gaaacagataaatagaaagataaagatgctagctagtgtgtgttagagataggagtcgagtggacagaaggctgagttatgtgtgtgggtgtgagagagatagagagacggtgcatgtgagtcacatacaaacagatatcagggagaaatgagatcccgagagacggagttttttgtctgcgagagagaaagatatttcacaacaagagtgatagctagagagacatatgagggaacgcaagatatctctagggagagagagtgtgtgtgaagcgatatacaagagaacaatgggagaaatatgagacctgggggacagagttgtgtgggctccaan

SEQ ID NO: 90994 - DNA, 652 bp, Triticum aestivum
  unsure (1)..(652): unsure at all n locations
  Clone ID: PAT_TA_90994
gctgcgcggtgcgcgcacgttcacgttcgctgaactgaagaagataaccaataacttctcggaggcgaacgacataggaaatggcggcttcgggaaggtttacagggggacacttccaactgggcaactgatcgctgtcaagagatcccaggagggatccctgcaggggagcctgggaattcaagaaccgagatcgagtcctgtccagggttcaccacaagaatgtgggtgagctcctccggttctgccttggaccagggcgagcagatgctgggctacgagtacaccccaaatgggacactccaaagagagctcaacaggcaancccggcgtgcggtggactgggaagcggagtccgttcaccctccggcacggccaaaggnatcnctactccaacgantcgcaacctcccgattgtccacggggaatcaanccgagaacgtctcctcnnacganggtcaatgcaaagctccggctttggctctccaaattctaaggcgaggacgnaaggggaagncacacacaagngaagggacatgggtactggacctgagtacacatgccagnacnacgggaaaanactctnagttcgntgtgcgcngaatgtacgcaaaaccntgacccggggaaatcncggngggtnccccncccg

SEQ ID NO: 90995 - DNA, 422 bp, Triticum aestivum
  unsure (1)..(422): unsure at all n locations
  Clone ID: PAT_TA_90995
canacatncactaggcagttgaggcatctgatntggttgnncatgcccancggcttatttctgggaacccatcgnttgggcancgaatcacgatcatcaaaggcaaagtcgaggaagttgaacttccagaanaagctgatatactgatttctgagcctatgggaacccttttggagaatgaaagantgctggagtcctatgtcatagctagggacagattccttgctccagatggtaaaatgtttccaanaactggaaggattcatatggctccattttccgntgaatacctctatgttganatggcanacangtctctcttctgggagcagcatancttctttggngttgatcttacacncttgcatggctcagcgtttgacggntactttcacanccccgngantggntgagntgatcca

SEQ ID NO: 90996 - DNA, 304 bp, Triticum aestivum
  unsure (1)..(304): unsure at all n locations
  Clone ID: PAT_TA_90996
atacataaataaatcatacatcaatcagagtacacacataggtccgactacggaaccaaaataaaagaagacaacccaactgctagatccctgatcgtcccaactgggcaccactactgatcaacatgaaacgaaacaacacaacgaacaagagttcatccgagtcccacttggagtcaagttgcgtcacctgcactgggtatcatccggcacctggcagtgttttgggaagtactgtganccacgaggactccagatctcacacccgcgagtncaagttattttaagtttaaggaaaggtggg

SEQ ID NO: 90997 - DNA, 255 bp, Triticum aestivum
  unsure (1)..(255): unsure at all n locations
  Clone ID: PAT_TA_90997
tcgagtttttttttttttttttttttttttttttttacatcatanatanatcatacaannatcaaangacancccaggggcctcnagggctcnactataaatgnncnatcatagacnactcaacngtntcaananaatcagagtnnagacatantttantnaagtttgccttaanaaaggctagcacaaatctagcaagnatcgactcaggcantgccncctgcctgggaccccctaactactcctggtcgtcgt

SEQ ID NO: 90998 - DNA, 163 bp, Triticum aestivum
  Clone ID: PAT_TA_90998
ctcgagttttttttttttttttttaaacgagctaatgcatcctgaaccagccgtatagtccacaattcacattttcggcacagagtacaggcacaaagcaagagtgcttcacacaatcaggaggattcgagaattaaactatattccaaataaaaaaaaaaaa

SEQ ID NO: 90999 - DNA, 660 bp, Triticum aestivum
  unsure (1)..(660): unsure at all n locations
  Clone ID: PAT_TA_90999
tatcaacccaacacatccgctcaatgtcagcaaggagaagccaaacaacgcggcagggagatatccaactatatgttctatctgcttctcatccgtcctgagatgctaatgcttggcgccaaatcgtatctccgtcaccttgggccagcgataaaatgtggaaaacagcaagggactactccgaacccgacagaagaaagctgggcgcgtggagtttttaacttgtcaccctcctgcacctggatatgggttcccaaatgcatgccaagttggccaaaagcgcttgatggagtttgggtggcgatngagaggtggcctttgatcccaagcgtgtgggttggagatntcctggtattccccgccaagcaaatggcangggtacctgcatgccnaganttnggggtgacggcggggangctcacctacatttactcctttgggccntcaatgggaatggggcactgggggntaagatcaatgtcaagncctcccttcnatccccaagggnaaacnggcatcgcanaangggcatgcctaagcatnccgccgctggggaaacattgtgcaatgggctatctgcatgaaantttgctgattctacgaatgtgattgtgggnggcncagttccaanattacagtngnnccgagttctcaaaacng

SEQ ID NO: 91000 - DNA, 609 bp, Triticum aestivum
  unsure (1)..(609): unsure at all n locations
  Clone ID: PAT_TA_91000
ctccttcgccgggaaggcggtgaaggacctgccgtcgtcggcgctcttcggggaggcgcgcgtcaccatgcgcaagaccgcggccaaggccaagccggtgtcgtcgggcagcccgtggtacggctccgaccgcgtgctctacctcggcccgctatccggcgaccccccgagctacctcaccggtgagttccccggcgactacggatgggacaccgcggggctctcggccgaccccgagaccttcgccaagaaccgggagtggaggtgatccactgccggtgggcatgctggggcgcgctcggtgcgtcttcccggagtgctcgcccgcaacggntcaantcggcnaagccgtgtggttaaggccggtccaantttnaacgagggcggctcgatacttcgggaacccaacctgtcaatcgcagagacctcgcatctgggctgcaagtcgtgtaaanggcgcgtcaaggtacgctccccgggggccgctcggnaantgtcnaccgcntacccggggaagtcgaccctgggctcctgnnacccgagggttnngactaagggaagngataaaanggcgctccatgtccaagttgntctcnaagcaacnnacga

SEQ ID NO: 91001 - DNA, 277 bp, Triticum aestivum
  unsure (1)..(277): unsure at all n locations
  Clone ID: PAT_TA_91001
tcggggttggcttctcctccccttccggttcgggttctggntcggttcgggtccgagagtagctagcctaatctagggtttccgtagttcggagaggagagaaagggagagatccatggnggagacggacntaccgctgcttcgtggncggnctcgcntgngccaccgatcnaccacaacctccancaggtcntcancaantacggngagatcctcgacgccaagatcatcaacgaccgatacacggacaggtccagtgggcttcggnttcgtcacg

SEQ ID NO: 91002 - DNA, 287 bp, Triticum aestivum
  Clone ID: PAT_TA_91002
ctaagtccatatatggatcctccgggccccacagctggccaagctgggcatactttggatacgtaaacctgcggcgcagaagaaaaggcttgccagccacaatgtctccggcctgatgcagctcctccttcatagcccgcattgcagaatgggcatccttggcttcggcggtggccttccccaggtttctctctccgataggcgctcctttttaagagcctcattgcggtcggtagcatccttcaatttaacagccaattcggccatctcttccctgcttcggcagt

SEQ ID NO: 91003 - DNA, 630 bp, Triticum aestivum
  unsure (1)..(630): unsure at all n locations
  Clone ID: PAT_TA_91003
gtcgagctcgggaggcgattcaaggtgctcgacggcctcatccaaagggcgtcgcaggtcgtgtccccttctggcgaaggtagcagcggcagtggtgtggagatggaggaggtcgtggaggagatggacgctaggcgtaacgacgtcacgtcggtggctgccgcgttcggggagatagagcgcgcaaacaggggtgtcggcttcggcttgaacaccaaggtccgtctccgtctctgcttccgcaatggttctacaggtgattttttcacctttactttcctgattcaactttccattgggtccgtttgcgagcggccggccctacatgaggagattttcctccgcgaccacaccgtattctgctcctatatacaaacgcgcacacacccgcggttatctcggccgtccctctcctcangctctgctctctgtcnggtcccggagatggcggnaaagcggcgacggcggattgtggaggactcacaaggtgtaccggaactaccgccgtggcancggtggacaagtgangcggcggnggtgcaacccgancgaccgagagagaancctngnggactccccgaagagaatgcggngcgnagcgntnatnccggaacncnccatgtccaggna

SEQ ID NO: 91004 - DNA, 440 bp, Triticum aestivum
  unsure (1)..(440): unsure at all n locations
  Clone ID: PAT_TA_91004
gcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcangaagttcgagaccctgtcttacctgccaccgctcagcacggaggccctcctcangcaggtggactacctgatccgctccaagtgggtgccttgccttgagttcagcaaggtccgggttcaatcttccgtgaggacaatgcgtctcccggntnntacgacggncgctactggacaatgttggaangtgcctatgttcgngtgcacggcncacacagtgataaanangtgangaaggcaggaag

SEQ ID NO: 91005 - DNA, 525 bp, Triticum aestivum
  unsure (1)..(525): unsure at all n locations
  Clone ID: PAT_TA_91005
agatcgtgagtatcaattagctcagatacagtctttgacggctgacatagctaagcagaaagaagttgcaagaagatgtggggctgagctagagaatgccatgaggagagttgctgcctccgaaggaaggaggcctattgcaaagggagacaatcaagaacgttgcaagattcaagcttgcttctgcaaatggagaaactaacggggctgcctcttcctccaaaagatggatgccgaagcccgaaggcctggacccggtttggatgtctcccagcatgggtgccgtataacacgaacaccgaataccctggatgatcacatatttgggttgatttttactacaacaagaagagcaagcagcagaccaatantttgtacngtttttaatttatttcccgttccncgggttattccnactaacctaaantcgctccggnaaggatcncaagttncaaatatttggatacatccgggngaactaaggnggacgttaggnctanaattaccntncnttcatggntgtac

SEQ ID NO: 91006 - DNA, 646 bp, Triticum aestivum
  unsure (1)..(646): unsure at all n locations
  Clone ID: PAT_TA_91006
aagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaaagtgggtgccttgcctcgagttcaagcaaggttgggttatcttccgtgagcaaaacgcatcccctggggtactacgatggccggtactggacaagtggaagctgcctatgttccggatgaaccgacgcaaccaggtgatcaacgangtggnggaggcaaagaaggagtacctgacgctatgtccgnaatnancggttcnanaaaatgcgtaagggtcaantgcgtcagttnatcgccttaagcaacgggntgcaggatccggaaggctaanagtcatcacganaggcatnttaagngcatngaatttgcaanccgaaatgcttggttcctccaattacttcnattgnccaaaaaagggagcaagtnagn

SEQ ID NO: 91007 - DNA, 650 bp, Triticum aestivum
  unsure (1)..(650): unsure at all n locations
  Clone ID: PAT_TA_91007
aggaccccaacaagcccaagagggcgccctccgccttcttcgtcttcatgggcgagttccgcgaggagttcaagcagaagaaccccaagaacaagtccgtcgccgccgtcggcaaagcggccggtgagaggtggaagagcttgagcgaatcggagaaggccccctacgtggccaaggccaacaagctcaagggcgagtacaacaaggccattgccgcctacaacaagggcgagagtgctgctgctgctgccccaaagaaggcggcggccaaggaggtagaggaggacgatgaggaggaatccgacaagtccaagtcggagatcaatgatgacgatgacgatganggtagcgacgaggacgaggacgatgacgagtgaagcggacaatgcnggaactgctgtgcgaaaaacgacctgagctgtgtcggtggtgtcataangagctatccatctcactagaatatccaagtttcactnacatcgtgatgttgtttaccttttcctgcaatgcctgctataacgatacgtcctgttgcgccgctccggcgggtgcctntgttggagggtgttctccaaccccgggtgccctgctngaccnaatggtancntcgtcacaatgcaccggtanatgganaaacatcngtaagtann

SEQ ID NO: 91008 - DNA, 633 bp, Triticum aestivum
  unsure (1)..(633): unsure at all n locations
  Clone ID: PAT_TA_91008
ccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtgggactacctgatccgctccaagtgggtgccttgccttgagttcagcaaggtcgggttcatcttccgtgagcacaatgcgtctcccgggtactacgacggccgctactgggacaatgtggaaactgcctatgttcgggtgcaccgacgccacacaagtgatcaacgangtggaggagtcaagaaggagtacctgacgcgtactccgatatcggntcgcaaatcgccaagtgcaatgcgtcagcttcantgcctcaagcaacgggctgcaagatccggaaggctaaacagtcatcacaagggcaattaaangcattcaattttgcaactcnaatgctttgggttcctccaattgcttctactgtccnagatattnagtcatgtcagtaaaatgtcagaaagg

SEQ ID NO: 91009 - DNA, 628 bp, Triticum aestivum
  unsure (1)..(628): unsure at all n locations
  Clone ID: PAT_TA_91009
cggccgccgcccgcgtccctgcccctctcttctccattacccctcgcaccaccggccgccgccgctcgggtcaccagccgcctccgcctctcgggccgctgaccgccgcggctgctcgggtcaccagtcgcctccgcctcttgggccgccggcagccgcggccgcttgggccagtggtcgccgctcgtgccaccgtcgctcaagccatcggccgtcgcccgcgccaccaaccgccacctccgctcgagccatcaaccgcctccgccgctcgagcgctcgggccaccaaccgccgtcgctgctcgggccaccggtcgccgctagcgccacccgctgtcgcagagagcatcgacggatgcaaagggccgctgccgttcgctccaactggttaacacccgagcggctcatggccggcgcggtgccgacgggggtgcccgtgcctctacgctcgcgcaacgatgccgagcaaagcccgagcctctttccgtaataattgtnaatatttggtattgatcctgggggggcccgtacaattgcctataggagcgtataccggntcacggccgtcgtttaactcngacnggaaacctgggtnccaattacccctganaaaccctttgcagtgggta

SEQ ID NO: 91010 - DNA, 635 bp, Triticum aestivum
  unsure (1)..(635): unsure at all n locations
  Clone ID: PAT_TA_91010
acgtcctccgctaccctcgggccgtgcgtggccgtggatcggatggacgatcatctggcggtgctggcgcgcggcgaggggtgnacggaggagcggcacgcggngttcctcnacggcgtcgagcgctccttcgtncangaggtgntcgtgggcgncgcaggcgtcagcgangagcggngggcgtcncgcangctctgccaccgggggccgccgcccgccggnggccgcggncagntcccgntggatcnccccctccccnacancgccgtggagtccaaccgccggggaccctcccgggaccgcagnccgcnacgccaaatgacgcatgttgcgtccatgaatctgaaagttaacaagctagctagagtgataaattccntcnagaaccgtagcctccagagtcnanagttgtatncgtcgcagtggaagtnangttttcagatcgtgcagtatgccgatattggccttgtaatgtgctttatgnacgnggatggntgncgttggtatgactagtaanatttnttcttttttttacggggattaatnnagatagcagganncaatgnagncnaatatacgacnctgngtttanntttgancaanaanacanatgtgcnnatgttcccaangtagcn

SEQ ID NO: 91011 - DNA, 519 bp, Triticum aestivum
  unsure (1)..(519): unsure at all n locations
  Clone ID: PAT_TA_91011
ctaggcacccagagacgaggaagggcgtagcaagcgacgaaatgcttcggggagttgaaaataagcatagatccggagattcccaaataggtcaaccttttaaactgcctgctgaatccatgagcaggcaagagacaacctgngcgaactgaaacatcttagtagccaagaggaaaagaaagcaaaagcgatccccgttagtagcggcgagcgaaatggggagcagctaaaccgttaaacgnttnntgggaanaagcaatacaagcgtttgtgctgctaagcgagccggtttnagtggcgcaccctagatggctaaagccaattaccngaaagacactactttacntcctgacccngagtacatgggacntgggaccccgttgtgnacaagcaagacacttntcaagntaaancctggggtgaccgtacgaagtatacngttagggaaagngaaaagaccccantggtaangaataaacgnnaaccngtgacccanantgganggaaatggttctgagc

SEQ ID NO: 91012 - DNA, 487 bp, Triticum aestivum
  unsure (1)..(487): unsure at all n locations
  Clone ID: PAT_TA_91012
aaaatatcatttttgttcgttgcaaccaagtcagctggcagcttatgtgaattcagctatgctgtggatttacaaatgatgtcctgaggttaactctctccaaggaaagggaaagtggtcatctcatggaagcctggctctcgacgtcgccgtcgtctcgcttccgtactagtccccaactccacctcctgcgtctgctggatggccgtccgctgctccgggacggacggntctgggtgtcctgctccgtgctccgccgctgggacggtgttagctgggctgctcctgggaagctgctgggtgcccgagcgcacttccctgaattcttcaaggcctccgttgtactgggtgggtgtcatactccggagctgggcgtgcgatcccatgaaccggtggtggcaaggccggagcttcggcagatnaccaagganagtcccttccaaggcccaacaactggtcangctggcgtccccngcaaaaggcgtaa

SEQ ID NO: 91013 - DNA, 516 bp, Triticum aestivum
  unsure (1)..(516): unsure at all n locations
  Clone ID: PAT_TA_91013
cacaagttttcttacaaattcttacacgttatcagcactgctctccggcgagagcgattccgacgagaaacacagagcacgancaggacgagagagaaggtaagatggcagggatgaacctgcacaacatcgcctctgcacttgtttgtttcatccgangagaaatccatcgatctgagagacgacaaagagctggagtttatcacccttggggcccaggcaacggccgccgtggtcgtcgtggccaccgtggttgtggtcgtggtcaaggattaccctggcctgccgcggnagatcaggcaggaccaggcaaccgcccgtggccgtccaccgtgcctaccaaggcacctctggatgccggcttcgtcactcccagcaatgnactatgctcccgnccgaggctgcagccccgttcctgggnnanggaggagtcctcgacgccggtcaggcccgccaccgcagggatctcttcggaanngnatggatgaggcgtggcttctgtcngtgcacantagg

SEQ ID NO: 91014 - DNA, 491 bp, Triticum aestivum
  unsure (1)..(491): unsure at all n locations
  Clone ID: PAT_TA_91014
ccaaggccccagccaaggccaaggccgtcgcgaagcccaaggcggcggcgaagccgaacgcagccacccatcagtagcagcggcagccgcacatcagcagcttgctctgttccatccggcagaatggccggccaccaccaccatggcgctctcctcccccgcggatcaagtcgccggagctcctacgcctccggcggcggcggcccgcatcaccatgcgcaaaggccgcgccaaagcctccgcctccaacagccgttggtacggccccgaccgcgtgtctactccggccgtctccggcgagcccccgantactcaagcggcgantccccgggcgatacgggtgggaacgnnggctctccgccgacccggaacttcnccaaaaacgcgagtcccaagtaccactccgctgggcatgtcngggtcngtggtttcccnactgtcctcnaagggtcatctgnnaggactgntaaggggnccaatttaacaggggg

SEQ ID NO: 91015 - DNA, 282 bp, Triticum aestivum
  Clone ID: PAT_TA_91015
gcaagaaaccgcacggcacgccactgccagttccctgcttgaagtggtgtccatagatcggcatgtcgacggcgggaggcccggcggggacgacggtgtcgcagcacgggggcggcggcggggggtgctgcagctccagcgggacgctggagctcgtggcggcgttcacggcggtgtgcctccgcactctacggggtgatactgtacctcaaactacctatacgtacggtggagccgggcgggacggcgtgcatccggacgggatccaacacggaaccggcg

SEQ ID NO: 91016 - DNA, 512 bp, Triticum aestivum
  unsure (1)..(512): unsure at all n locations
  Clone ID: PAT_TA_91016
ctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggccatccgagggcatcaagaantccgagaccctgtcctacttgccaccgctcaacacggaggcctcctttaagcaggtccgactacttgatcccgtccaagtgggngcctttcctccganttcagaagtttgggtcacttcccgttgagacaacgcncccctggggtactacgatggccggtactggaaatgttgnaactgcctatgttccggatnaccgacccaccaagtgttaacgaggtgganggaggcaaagaagganacctgaccctatgtccnatcatcngtccnacaaatctcaagggcangcgtaatnaacgcctnaa

SEQ ID NO: 91017 - DNA, 358 bp, Triticum aestivum
  unsure (1)..(358): unsure at all n locations
  Clone ID: PAT_TA_91017
tgtcgaacggtcgccgtccttctttaagtgggaagcgtggacgggtcgtcgtccacactgccccacgccacccagcggcctcctcgaaccctgacagcgccgaaccctagccttcctttgtcctcgagctcgccggccgcccacctcgccatgggcttctggaacggcaagggcaagcacgaccgcgaggccggtcctcctccgggggcgccgccgcggatccgtgagaaaggagggagcccgcgtctccggccgcgtcctcccgttngagcccccgcgtcaacggcgngttctcccgtccagccccgggcggcccctttaacaattgcccataagccttcccggnganngcaaccgg

SEQ ID NO: 91018 - DNA, 528 bp, Triticum aestivum
  unsure (1)..(528): unsure at all n locations
  Clone ID: PAT_TA_91018
cgaaggagcaggaaaagtgggttgtggacatcatgctctcagtgacgctggtgaaacttgccctggctttatattgccgcacgttcaccaacgaaatcgtcaaggcttatgcgcaggatcacattttcgatgttatcacnaanataattggccttgtggctgcactgctcgcaaattattttgaaggatggntcgacccagttggtgcaattattctagcaatctacaccatcaggacatggtccatgacggtgctggaaaacgtacactcgctcgtcnggcagtcggcttcgccagagtancttcanaanctgacctacctttgctgggaaccaccacanngccntgaggcanatngacacngtgcgtgcctacacgttcagctcgcactacttcgntggnngtggacatctgctgccggccgtatgccgtgcaagcagggcacgacatctggatgcctgcaagaanaactggnngcctgccngagatctacncccttcagcaccttggttannantaaccacngct

SEQ ID NO: 91019 - DNA, 546 bp, Triticum aestivum
  unsure (1)..(546): unsure at all n locations
  Clone ID: PAT_TA_91019
tttttttttttttttttcatgccacaatgaaaatatttccattttatagtaactttgtggttcagaaactacactcggcaagaatttagatcttagtcacattggaaaccatatgaccttagttattctgtttacagagacataaatggggcaggcagcaaggacttttaatagagtcgtcatcagctctcacaacctggggtcaccctggtgttttccaaaagccttcttggatgcttcttaacttattttcttaagctgatcaccctggtgtttgganttttggtgccaccttcctcaaatgctgataaaaggcnatttaataagctggatccaaggggtcaatgcccatctgttcactttttaataagacgttttnaagaaagtcaaagcagtcccaaaaatagtcaaaaacaantgtccnaattccctaaaaaaaaggggacggcgggnanactggtaaacananctcngaanggtgcaagactcnaattccccgggggannntgcacaananagattcccatacatccaatgttnncaagg

SEQ ID NO: 91020 - DNA, 454 bp, Triticum aestivum
  unsure (1)..(454): unsure at all n locations
  Clone ID: PAT_TA_91020
gtcacttcttgtttgctcaatccaatttcaatccggctaagcgttttcgccgcctttctagcaacactcagattgagagcacagtaattgttagagtaagcagtcaggagcttaaacaggttgttcttggcctagaaagcatggttgttgatacgaaggagtttgctatatttctggatgagctaccctccgcatgtaccgccaacctatggcgcatattatttgtggacaagtacatgtttgggccgccaaatgggagagggaacaagcatcagcttccttgctacaagcagagttcccgtatggaaatgtgggtgccttcccattaatgcttcctgcattggttgggaaagagancctggtggacaagttttgcaacgatgagcgtgtgcagacantctccttggatctgcccnacattgggaaaacttcaaagatgaaacgatgaaatttt

SEQ ID NO: 91021 - DNA, 581 bp, Triticum aestivum
  unsure (1)..(581): unsure at all n locations
  Clone ID: PAT_TA_91021
ttttttttttttttgttctaacaacagtcttttgcattcaaccttcgtactttacatcatgcatggttgtagtacaaacgaaacccagctgcatgcatgcatgcgcacacttgatcgcgtacgtacgcacgtgcacggttggtttccangacacaacacctagcagcttacttgccgggcacgaagttggtggcgaaggcccaggcgttgttgttgacggggtcagagaggtggtcagcgangttctcganggggcccttgccggtgacgatggcctgcacgaagaagccnaacatggagaacatngtangcggcgttcttgatnccctcaccttgaactccgcnaacctcaaggtcntcggnaaggccaaggggtcnaactgcncccgggtaaacggtcaacattccccaacgggcgccgngcaccggtacctcgacgnaccaattacacangnnaggcggggggccggtaccattncccnaaagagtcattaccncccanngcctcgttaaantctnacggnaaactgggtnccaattancctngaaaaacccctttcaacnggntaaaacaaagcccc

SEQ ID NO: 91022 - DNA, 635 bp, Triticum aestivum
  unsure (1)..(635): unsure at all n locations
  Clone ID: PAT_TA_91022
ggtggtaacggacgcgtccgtcagctggcagcggcgtgcccggagcgtgccagagcgtgctgccagcccggcccggaagccgccccagttcatgtgcgcggcggacacggtcagagacagagcaacggctatattaggacagtcaatcaccgctattcgatccacccccgacggcatttcctaatactactactcctcctccaatcctcctccgtttactcatggcgaccgttacaccanaccaactgcgccgccccccgttaaacggcaagagcaagggcaacgactaagccccgccgtcnaacggcaagacaacggcatgccnagccgcccccggcaaacgnaacaacaacggcacggcaagcngccgccgcnaacggcatgcngangcaattgtaacggaagacaacggcaaggnagcnctgccncnaacggcaaanaangcataggtncgcgnattnnggcccnaagagcgngatggattccngggcaaggcggntctgnggnacgggcanatactcggcatcgtaaaataccacttagaaangcgngccttntcctcccagggaacntgttccgcttcangctnagcagaccttcccccttcngggattaggtccccgttgcccccnaaa

SEQ ID NO: 91023 - DNA, 609 bp, Triticum aestivum
  unsure (1)..(609): unsure at all n locations
  Clone ID: PAT_TA_91023
ccaatgtcttttctttgagagccaaccagcctcagcgcgcgcgcgcgtgcgtctgcagcttggctgcggggctagagcagcagcgatggcggcgtccgtggccttctcccccgcatccgcatgcaggccgcggctcccctgcaaccccctctccgtcccgccgtctctcgtccgcctggcgggagcgggatcctccaggcgcctccgccccgcctctgccacggcggagccggccgacgtgctgccgggatccggggccggcgactaaacctnggacgggtnggtgccggcggggctgtccaangactgccggagggctcgacttcnangcaccccttggcggcgacaaatctcgacttcgggatcaaccggcatctctcgggcacactttgcctcacaagcctnacgtcacaagactacggatgggggatactccaatctgggtanatcaaaacaaacggtcgctacaggagctcaggcatcgctctgtaaatatatnatggatgcnatcctggcacggtaccaatttcaaggaaccactcatttactgcccantcgtcngcaaagntacttagattttcaaaaaatttcgaacgtttctaagttggg

SEQ ID NO: 91024 - DNA, 653 bp, Triticum aestivum
  unsure (1)..(653): unsure at all n locations
  Clone ID: PAT_TA_91024
gaaacacagagcaagaagagaagagagaagcaaagcttgagatggcgcaaaccatggcgtccatgaccggcctgtcgcagggcgtgcgtctcccaggcccggccggcaggcgcgccagcaggttcatcgtgagggcgtcgtcggcggaggcggaggccgccggccgccgcgcggtccttggctcatggccagcggancctcggcagcgcttcgtcaggtgggtgcaccccggcaccgtccgcngcacaggtttttggccggcccgccgccgtctccggttggatcccccggaacngacaatcccgaacaagcaaggactttcgactgcccctggaagaacngttctacctgcagcgtcaacggncgnaggcggcngtcccggccaaggatccggccaagaatcctnaacttaaaccgtcatcgacaagaacaatggcgtactcatgacactccgctganggctcctaactnnctacactcaaactnactctcaaaacacaagggggaaaaagcnaaggacttacggaantctncaactnaaggctngcatcancaanttagncccacaggcaaatntacganaaancttttgattcccacnggaaatgttnaaagcttttcttagctttatttnanttacgatnnnccgtaat

SEQ ID NO: 91025 - DNA, 570 bp, Triticum aestivum
  unsure (1)..(570): unsure at all n locations
  Clone ID: PAT_TA_91025
cgacatcgtcccttcatgctgtcaaaatatgttttgaacttgcattttctgtacaggatccagaattcggtttaaaacagaaaattgaaccaaaaaattgcttaaccaaattttcgattagctcatttttagtgcctatttcggttttcacttttgctaaccgaantcccccaaaagaagacccgtagaaactaaaccaaacgcccaggcctanggtnatgcattgttaggccactancatcgatctgatccatggcacagancaaagggatgcacattttactccaatatcantcttggntccatgagcacaagtatttccnagccctaacacaccanattcaaccgtnattgtgnggacacaataacttaaccatcgatggnacacatccaatanncgtgagcaantattgcaaccgtttaaaanaataaatggncatgggccnanatggaaaatattcangaaaancaagaaagnggatctcccncaanggacngcaaatggaaccnggtngnggaaaanngaaggncggtcttacccanngggcccttttttnttggaaatgcaat

SEQ ID NO: 91026 - DNA, 275 bp, Triticum aestivum
  unsure (1)..(275): unsure at all n locations
  Clone ID: PAT_TA_91026
gttggccaataaatagtacagtactacttttctgcagtccatgaagtgactatccaatctttctgtgtctattttcaaatggcactgcatgccagtgactatactattctcttgtgcagttcaancaaaantgcggtcactttgtgtgtttgcnaaatancaatgggcagacatctttgtctgnacaaatatcanncatcntgtanacatataccccaccttgtattttcggttgaaacatgtctcttccgcctanttctgtcacgtgttgcact

SEQ ID NO: 91027 - DNA, 679 bp, Triticum aestivum
  unsure (1)..(679): unsure at all n locations
  Clone ID: PAT_TA_91027
cggctctcggcgttcccgcctatcgacttcaccgccgatcgccgcgtgcactgcttccccgaggtgatcgccggcctccgcatccacggcgagctcaccgtggaccccgccaggacccccgaggtccggagcatccgcgacttccggcgcctcctcgacgacgcctaccgcccccgcatcaactacctggagcgcatggagcgcaaggccgcccgcaagcaacgccgcgccagcggcgcccgccgccggcaagtcgcgctcccgagcaanaccggcggtccggcggagaaggccgaactggtgatcttttcaaaggacggggtcccgcgtgatcganaacnaggaggactgaaaggcggtggccgcggacttnggttcnactcccnttgtcccggccggaccgacacggaattncaagtataccgcaactgaacccaacaaccaatgtggcntcaagggccccatannattcntttaatgnccccggaagggtnacaagtgtccctggaacggactggcgggaacatanacgnaaccgggggcnctcgctcgtantnggtaaaaatntnccgagaactcctgccccantaccgcggnacctntangcccncgntaccaancgttggannacaaaagttcnaccgaaattggtcaattgcgttcggagggcccccggctt

SEQ ID NO: 91028 - DNA, 614 bp, Triticum aestivum
  unsure (1)..(614): unsure at all n locations
  Clone ID: PAT_TA_91028
ctcgtagcagccggtccagctgcccaggggccgatccgcccgtagaggtcggcgacagcaaacccgtttctcccccgttgtgctctgtgttggactgttggtcgtcctgtccactgcgcccactgccgtccggcgaagtcgagcggaggcgcggtgcagggatcgccggaccnnaggcngggggcggccgaggagagcctgccgccggactcgccgaggaaaccccccctccatgcggggggactccctgagtgagatgggactgagacgaaggcaactacatcttgcctaaggcaacatcttccttgaaagagagccaacaacgaaaggagacagacaccaagattcagcaagagaaatatccaaagaatccaatggctgatgatcatggaggtgccgattcatncacaacgggtgccaacatcaagaacaaccaccattactgctcaanaaacaagatgctttgtggaacttgctggtccaaaatgccggaccctccaacacntctgggctgcttctgatcaacatctgaggaaccgcaactgttcggacnaagactgggatctcanantcnacatgatgngcccatatgatcgtataccataaggantttt

SEQ ID NO: 91029 - DNA, 456 bp, Triticum aestivum
  unsure (1)..(456): unsure at all n locations
  Clone ID: PAT_TA_91029
agctctctctctctctctctctctctctctctctctctctctctctctctctatctctntcgctncntcngacacctccgtcgctcctttccaggggctcaagtccancgccggcctccccgtcagncgccgctccaacggngntagcctcggnagcgtcagnaacggtggaaggatcaggtgnatgcaggtgtggcccatcgagggcatcaanaagttcnagaccctgtcananttgncacngctcanaanggangccctcnttaagnangtcgactacctgatncgctccaagtgggtgcttgcctcgagttcannaangttgggttatcttcngtgagcanaancatccctgggtaatannatggtcggtacggacatgtggaactgcntatgttcggatgaacgaagncaagcaagtgattaacangtggaggagtcaagaaggatacctga

SEQ ID NO: 91030 - DNA, 397 bp, Triticum aestivum
  unsure (1)..(397): unsure at all n locations
  Clone ID: PAT_TA_91030
acgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcaccacnggccacatataaattgccattgcngttttgtcaactctgacattgctttggtttcctttcccattaacttcctggttggtcccnaanataanatatgtgtagtccaagtccccnacatgacccgaaaancaagcncgtatttaatgcaacgatggc

SEQ ID NO: 91031 - DNA, 310 bp, Triticum aestivum
  unsure (1)..(310): unsure at all n locations
  Clone ID: PAT_TA_91031
ctcagccatctctcctactcatcacccaccagacacaaccccatctcccgcgcgcgcgtgtggcctcggctcctccccccatctcctctctcgcnaagaaccaccgagcttggagcgccancgcnatggtnatggncacgcaagcctctgcggcgacgcgccacctgatcaccgcggcctggtcgccctccgcnaagcccngncccgccaccntcgccatgccatcctccgcnngcggnccggacccgctctgcgtcgcggtctcggacacncccgccacancggagccnccngcggancccagaccccg

SEQ ID NO: 91032 - DNA, 637 bp, Triticum aestivum
  unsure (1)..(637): unsure at all n locations
  Clone ID: PAT_TA_91032
aagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatccgagggcatcaagaatttcgagaccctgtcttacctgccaccgctcagcacggaggcctcctcaagcagtcgactacctgattcgtccaagtgggtgccttgcctcgattcacagggttgggttcatcttcccntgagcacaaccatctcctgggtactacatggccggtattggacaagtngaaactgcctatttcnggtgcactgacccaacaagtgttaacnaggtggangaggtcaanaaggatacctgacncgtatttcgcatcaacngttcnacaaatcctcaaggcatgctnaagtcaacgcctnaaacaacgggctcaagatcggnaagctaaagtatcacacagcatattaattcaatgaatttgaccnaaattctttgtttctccatactcatntcanaaatntgcagtancaaatgccaaacacctnaacacnggtttttn

SEQ ID NO: 91033 - DNA, 259 bp, Triticum aestivum
  Clone ID: PAT_TA_91033
acattagcggtcttgccacctttcccaggatgacgcttgtcatagcgattagggcaactaggagcccaatgatcaggatccccacacacatgacaagcacctttcttcttgtcattcttcttcttgaagttcgtgtgttgcacagccttgttcttcccatcaaactttgctttaccatcaaacttgcccttgttcttgaacttgtggggctggaagttcttcttctgtaccaagattgggcactagatcctccctcaat

SEQ ID NO: 91034 - DNA, 345 bp, Triticum aestivum
  unsure (1)..(345): unsure at all n locations
  Clone ID: PAT_TA_91034
cttgccacccctctccacggaggccctcctgaagcaggtcgactacttgatccgctccaagtgggtgccctgcctcgagttcagcaaggttggcttcgttttccgtgagcacaacagctcccccgggtactacgatggtcgatactgggacaatgtggaagctgcctatgttcgggtgcaccgacgccacacaggtgctcaacgaagtggaaggaggtcaagaaggantaccctgacgcctatgtccgcgtcatcggttcgaacacctgcgccangtgnaatgcgtcanttnaacgccttnaagcaacggttgcaaagatctggnaaggccnaccacaatttaaa

SEQ ID NO: 91035 - DNA, 622 bp, Triticum aestivum
  unsure (1)..(622): unsure at all n locations
  Clone ID: PAT_TA_91035
attggttcatactttttaacgtgcttcagccttttcaaccgttacgcaatacatgggcgcaagccatggatatagcactatgggtggaataaagtataatgatgggggttatgagaagacaaaaatgtagaaagtctcacattgacgcggctaatcaataggctatggtgattcccatcaattgatatcaatgagaggagtagggatttccatgcaacggatgcactanagctataaatgtntgaaactcaacaaaataaattaantggggtgtgcatccaacttgcttcctcaacnaaaacctagggatttttaaggaacccattattgggaatatacaaccaattccaanaatgaaaattccnctanntatataaangnaaaacatcgggaaccccaaccanaaatanagggggcacctttaacnaattttggaaaaggattcattnnccttcggcttcccccnatttttctgggctcccttttctgggctttttaataaccggaccaacccacttggggacaaacccaaaancttccaatggaaatgccaaaagggntacacnttntatnaccagantaaccaaanttnccctgccaggttgttcctaagaaggnacna

SEQ ID NO: 91036 - DNA, 233 bp, Triticum aestivum
  Clone ID: PAT_TA_91036
gccgcatcagccgtctccgccgcgccagcagactccgctgcctccaccccggcagaagagaaccaccgctccggcggctagtaatacaactgcgaagaaatccagagcaggtacaatgaacatcgtcaaggaggctcctaccaagttaccatatgaaatgactgatgaggaaatcaataagtcgtggatgccgatgtgaaacgctagttgcaccgaaatcccaaggggggggg

SEQ ID NO: 91037 - DNA, 547 bp, Triticum aestivum
  unsure (1)..(547): unsure at all n locations
  Clone ID: PAT_TA_91037
ttcaaggccggctcccagatcttcagcgagggcggcctcgactacctcggcaaccccagcctcgtccatgcgcagagcatcctcgccatctgggcctgccaggtcgtgctcatgggcgccgtcgagggctaccgcgtcgccggcggcccgctcggcgagatcgtcgacccgctctaccccggcggcagcttcgaccccctgggcctcgctgacgacccccgaggcgttccgcggagctcaaggtgaaggagattaaagaacggccgctcgccatgttctccatttcggttcttccgtgcangcatcgtcaccggcaagggcctctccgaaactcgccgacaactttccgacccgttnaacaaaaccctgggctttgccacaattcctgcccngcaantactgtagtgttgtgtaagttcnggaaccacgtcacttactacttacccattaatgtgccatcagctncatcaactggttcctttgtacacaacatcatgattaaatacaangtnaatcaaagntgtgtaagcatgataaaaaaaaaaaa

SEQ ID NO: 91038 - DNA, 482 bp, Triticum aestivum
  unsure (1)..(482): unsure at all n locations
  Clone ID: PAT_TA_91038
agtagcagcggcagccgcacatcagcagcttgctctgttccatccggcagcaatggcggccaccaccaccatggcgctctcctcccccgcgatcaagctcgccggagcctcctacgccctcggcggcggcggccgcatcaccatgcgcaaggccgcgcccaaggcctccgcctccaacagccgtggtacggccccgaccgcgtgctctactccggcccgtctccggcgagccccgactactcaagcggcgattcccgggcgactacggttgggaaccgnnggcctctccgccgacccggnaactttcgccaaaaaccgcaagtcnaggtaacnacgccgctgggcaatctcggcgntcggtgttnttcccaattgtcctcnaaaggttantttggnaagaatctgnnaaaggggncccaattttaananggggctnaaantggaactnattgncaacncaaaaacttgcaacggnttccatt

SEQ ID NO: 91039 - DNA, 413 bp, Triticum aestivum
  unsure (1)..(413): unsure at all n locations
  Clone ID: PAT_TA_91039
ctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatccgagggcatcaagaattcgagaccctgtcttacctgccaccgctcagcacggaggcctcctcaaagcagtcgactactgatncgtccaagtgggtgccttgcctccnattcaacaagttggntcacttccgttaacacaacnatctcctgggtactacgatngccggtattggacatgtnggaactgcctatttcgggtgcactgacgcacacaagttaa

SEQ ID NO: 91040 - DNA, 561 bp, Triticum aestivum
  unsure (1)..(561): unsure at all n locations
  Clone ID: PAT_TA_91040
ggccatacctcgaaatacgagacgaggctgtaatacggttcagaataattataaagccaagaacataacatctcgctgaaaaagtggcccatggatgtgacttatttttgaagtattgttactttttacagcttggggttgtacgtgttaagcaaggtcggacacagttcttgtgtgcggaaaactacggttgaagtattcggaaaaggggaacccgccttgcaatgccgaagacagttcgtgtgccggatatatcgtcattgaagcctggttcangggctaatgacggagtcctggactaaggggtccttgggcgtctgggctatgtgatgtgggccgggactgatggaccatgaaagatacaagatagaagaactcaccgtgtctggatgggacnnccttgcatggatggcaaacttggnatttggntaatgtattccctccccgtaaccgatctgtnnaacctanattctccngggtcaaanaaccgggagttatcntnnaaggatacaacatcagntagcatcagggtagcatanatcagggggcggnncaatccca

SEQ ID NO: 91041 - DNA, 555 bp, Triticum aestivum
  unsure (1)..(555): unsure at all n locations
  Clone ID: PAT_TA_91041
cgnccctcnctccctcgtcactctctctctctcgcncanatccgcnangancaccacngtcgncgccaanaactccatcncccctgcggncaccgttgcatcccgcgggctangaggttgccctggagctccgtcgagcttcgctgcttcggctacaanggccggttcgagcttagcgccccggcaacgacaagatcaagctcttcttcctcctgtggtcgctgncgttttcattgaactgcttcactccggcctcccccggcttcaccgactcgcccgcgagaaccactatgacggatcccaggagccangacgacgcaactgatgactactactacccgaaggatgcctactactacgtgaanaccgcacacgactaagagtagtcangaggtcccaagcangagggcntgccttttcgataatgttgcttttgtgctagccttcttaaagnaatcntgttaactcatgtctgtantcagatatgttgcttcgctgaccctgttatcaactgattatcaagcctcaaggcctggctgtatanaaanctgtata

SEQ ID NO: 91042 - DNA, 617 bp, Triticum aestivum
  unsure (1)..(617): unsure at all n locations
  Clone ID: PAT_TA_91042
aacaaccagccctccctccacagggcaaagtctccgtcctcttctacgacgacggggcgggctcgggcctccgcccgctgccggagagcatgtcggacttcctcatggggtccgggttcgagcgcctcctcggccagctggcgcagatcgaggccggcgggctcacccgggcgcgcgagaccccgccggcgtccaaggcggccgtcgagtccatgcccaccgtcgccatcgcggcctcccacgtcgccgccgactgccactgcgccgtctgcaaggagcccttcgagctcggcgccgaggccanggagatgccctgcgcccacatctaacacgaggactgcatcctcccctggctgcaactccgcaactcgtgccccgtctgccgccacgagatgccaacgacacgccgcggcgcggtccaaggcgccaacgccngggaaaagaagagacaacgtgggctgacatctggaagctccgggaagcgggtcgccgtcggaggtcnccgcggangaggccagaagacantnccggtctttacaaaaatgncgcggttnaacangnggcccccaagagnttctgggtcaggaaaccgtcacggaagaagcataaggngttcc

SEQ ID NO: 91043 - DNA, 595 bp, Triticum aestivum
  unsure (1)..(595): unsure at all n locations
  Clone ID: PAT_TA_91043
cccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaactgctaagttcggatganccgacgccaccaggtgattaacaagttgaggagtaaaaaggatacctgaccctatttcgcataatcggatnnanacatcctangtgaatggtnagttatccctnnancaacggctcaagatccnaaggctaanactatcacaaagcattaaaatgcattganttgtaaccgaatgttggntcctccaatacntctatttccaaaaantttgcanttantcaaatggcaaaa

SEQ ID NO: 91044 - DNA, 440 bp, Triticum aestivum
  unsure (1)..(440): unsure at all n locations
  Clone ID: PAT_TA_91044
tttttttttttactagtgacactctgtttgtctatatattcacacatgtattatgttcccgattaatacaattctagcatgaataataaacatttatcatgaaataagaaaataaataataactttattattgcctctaggacatatttccttcacgaaagggggctctccggacaangatgcccgagagcgcgagcgtctccgccggcgactggccggccggagcanaggcgaatgccgccaacgcgggggaccgccaggagtctagcgcagcaccgcggtcggtgcggccggcgacgccccacccgccagcacggtgccgccggggaaggngcccgagancccanggcgtcntctttcgatccagganacgcatcgcgcccnncngtcgccggtggnngncgatcgtcccgccggaggccgaactnccaaccctggga

SEQ ID NO: 91045 - DNA, 576 bp, Triticum aestivum
  unsure (1)..(576): unsure at all n locations
  Clone ID: PAT_TA_91045
gcgaagaccagttcaggcccttcttgggccaggacgtaagctgtaggggagctccggatcagagttcgggagctgtggcccattttgggtcgcgcgactcagtgacatagaaccactgctgttgccaccctttgacggaatcattgaaagtacctgatggccatgtgacgttgggcatctttctcaccatggcacctccgcactcggcgtgctctccactcacccccttgggcttcacattaaaaatcttcagccataagccaaagtgtggcgagatgtggaggaaggctcgcacatgacgatgaatgtcgaggtgttgangaaggaatttggggataaattatgaaaacnatcctgtagtaatacatgacgccacnaacaaatgggtggaggggaaacctancccncggntnaatgaggaggaataaaccccncgnggggtcatataaggacatnttcccccctcggaaatatggngatttttgggcaaanaccggtcncggaacttttgaacctcccganntaaggcacanttcccngccggttcgaattngnggctttgcgnaaaaaaatggg

SEQ ID NO: 91046 - DNA, 615 bp, Triticum aestivum
  unsure (1)..(615): unsure at all n locations
  Clone ID: PAT_TA_91046
ctagtctccgtatgtgtgtggattgcagtcagctgaatgatgtcaccatcaaaaacaaatatctgctgcccaggattgatgacttatttgatcagctcagcggggcaaaagtgttctccaaaattgatttaatgacaggataccaccaactcaagattaaaatggaagatattcctaagaccgcgttcactactcggtacggtctttatgaatataccgttatgtccttcggccttaccaatgcccctgctttcttcatgcatatgatgaataaagtattcatggatttcctcgataaatttgtggtagttttcatcaatgatattctcatatactcaaaaagtanagaagagcacaaaggatacctcaagagctatcctgcaaagactccgtgacatcaactgtacgccaaatttataaatgcnagtacntccaaanaaggttancaataatcaagcaaggtaaagacnactnattgggttgnaccgtgacagtactcaaatcggagttcctggataattggaacaacgtgntcattaaggntcccnanatgcaancaanacangctccaagaagtaaaaattgatggcgaggatnanaaantcatactaaaca

SEQ ID NO: 91047 - DNA, 314 bp, Triticum aestivum
  unsure (1)..(314): unsure at all n locations
  Clone ID: PAT_TA_91047
agagcacgccgctgctgccagcggacgactgcngccaaggcggcnaattgctctgctccgctccgctccggnncgggccgcnagatagacnctctanctanttataaantagataggatcatangaacntgcatnaatccttgcatnggtgctgncatgcancnaacnattggaatattggactatntattactgcnaagcatcacagttacgtatggtttctgtccaaangacatttccngagngctctannttcaagtgatcaatacncgctgttgttgtttcacactactcaatcccaaaccnatnttatc

SEQ ID NO: 91048 - DNA, 630 bp, Triticum aestivum
  unsure (1)..(630): unsure at all n locations
  Clone ID: PAT_TA_91048
caaaaacccacaaaaacaagaaataacaataaaggaaagagaaaaagaaaaagaaaatgcaacccataatagcaaaaacgagcccacgaagcaattcgactgaccaaaaataagggccaatcgattccatacagtccaactcgccaccgaaatgacacagaaaaaacaaaacaacagaaatctcaaagcagactcagacggccacaaaatcgactagctatacccggtcgactgggttttattttanggcatcactttttctgaaccacctagtaccccacacatttatctcaaagcccgatnaacaacntgggattttggcngcnaaaanattcnagntggttacncaagacacttcattttgnacaanccgcannttaacatggnaccnccaaatgcatcacaaatgacanagnccacncnttacttttaattgggttaancggngggcanncantacaaactatgcaacctaaaaaanttttaagggaacaattanttgccaantatggnttgganaccttcaangatagaatggaatanttacantgttaaaantgccaatttaaagatttcnttaantnagatattttnnggaagttaccctttatgcgnnaaaaatttttctag

SEQ ID NO: 91049 - DNA, 583 bp, Triticum aestivum
  unsure (1)..(583): unsure at all n locations
  Clone ID: PAT_TA_91049
caaggagggcatccctccggatcagcagcgtctcatcttcgctggcaagcagctcgaggatggccgcaccctggctgactacaacatccagaaggaatccacactccacctggtgctcagactccgtggtggcatgcagatcttcgtcaagaccctgaccggcaagaccatcaccctggaggttgagtcctctgacaccatcgacaacgtcaaggccaagatncaaggacaaggagggcattcccccngaccagcagcgtctcattttttgcngggcaagcagtccgangatggccgcacgctccgctggactacaacatccaagaaggaatccacatccactggtgctcaagtccttagtggcatcaatcttcgtcangaccctgacgngcangacatcacctgaagtccanctctganacatcgacactccaggcatattaangacaangaggnatccaacggacaaangtccaacttgctggaatactgagatgcnnacttggggctnaaatcaaaaggntcaanttantngggtccnttgcggtggcataactctganaggttngctcgcctggntaaa

SEQ ID NO: 91050 - DNA, 667 bp, Triticum aestivum
  unsure (1)..(667): unsure at all n locations
  Clone ID: PAT_TA_91050
gagttagtcttcaagcgggtctatatatatgggcgtttttttgctaagttacaactctcgttcttttgaagactttgttggatcgagttgtaatcttaactccgatggtggtctgatacttttgctatgttcttctgcatgctatttcctcatatatgttaatgcacgcatgctgaattacatcaatcaccatatttcatcatgcatttcaaattcttcatatcgtatgttaaatgcgtgtatgaatacaagatatanggggaagatctccatgatctactcttcaatgtgcaatgcttcaaaacaaattcctcacatatgcacactcaaggggagtcctcnananctgcaatcaaatcctcaatacccgtatttcactcnaatgttaaccccgttggaaacttaaccatattgtcatcaatcaccaaaaacgggaatggaattgcacnaatgcccttggggatttggngatgaagatatagtaanggacaangcttgtaatgtaanagtcataatcatagggttgtattacagnaaatcaccctaaaaagattctcacgaaacttgnttcaaacttaagnanaatatggcctanaccaatcancagaataacnaaatttctcatnatcctctgcaagaaactttaaggcngatagattcattnnca

SEQ ID NO: 91051 - DNA, 414 bp, Triticum aestivum
  unsure (1)..(414): unsure at all n locations
  Clone ID: PAT_TA_91051
ctggacgggactaattctaggctatcatcacttcatcacatcttccatctacaacaaccaacggcgataatggccgccttgccgcagctgcttctgaccctcttccccgcggcggttgccgtcctgatcctgctgctggcctcggcgccggccgcgcgggcctcntcngcgacgtaccgctgcggntggtgcccgcgcangtccancgngtccatcctccctcccgacgccggcgcgctcaccggggccgcgtgngggtacngtggcccngcggttgaggagaccggcgtncacgaaggctccanattgccgccgtnaacgccngtttcttcnggcngcggccggacatgcngtcctgntaacaaatgaagtgcaagggcccgaacccntngcnaaaggtngntcaaagncctc

SEQ ID NO: 91052 - DNA, 675 bp, Triticum aestivum
  unsure (1)..(675): unsure at all n locations
  Clone ID: PAT_TA_91052
cggacatcctacatatctccaataaattattggtgatcaccaataaaacgacccaactcccaatatatagaggggaagttggccctctcccaataccatggggcccatgtgtcatttttagattttttaattatgtcnagcttaaaattgcaattctctgatttgaagcacanctcaatatcnagactatgatgaagtaatgcaaaagtatctttgtccantctgagccaangtgcaaattcttctcttcgcaggtgcttcacagcangatactcacagttggacatgctcgcantgangggatggatcactatccttgttgacaatgttggctcangccaagggattgtgaccgactttataacgatggcctttttnnaatcacagcctcnaatcacattaggcctggacaaggangcnacaatggtacncatctctncgggcgtcttaaattgtnggaaggaanggttccaagganncnaggaccatccacacaatagnggcanttccnaanctttgaaaanagctttgcagacngttaaatttcccatnggattgnactttcngtangtttcgaattnnaaaatgcctctaannntttcaaaaaatgganattgncccaaggtcannaatttggttnccttaagtaaacctactgnncaaatgncaccngaa

SEQ ID NO: 91053 - DNA, 415 bp, Triticum aestivum
  Clone ID: PAT_TA_91053
ttttctaacaaagctctataacagaacaaattatgcacaacaacaatgtacaaaagaaagagaaaactctaaactgctctttggtaaatcgctgctcgattgtaggttgcctttcacttaaagttaccaaagaaatgtaaaagaatcaacaacaagttgtaacataaatgatagaggaacaaactggaattctgttgtagagctccgtatctaaaaatgggaagcgaggtgattctggaatgcagaattgttaggtgacgcctccatagccaaatcatagcccgcactctcgctacttcccataagtcatagtcaagaaagaaaaatgttcattccgttaaatgcggctcaaaccttacagacaatctgttaacatcaactaattcaagttaacaaaagaaaaccccaggggggg

SEQ ID NO: 91054 - DNA, 582 bp, Triticum aestivum
  unsure (1)..(582): unsure at all n locations
  Clone ID: PAT_TA_91054
gtgaaatgccactcgaacccagagctagctggttctccccgaaatgcgttgaggcgcagcagttgactggacatctaggggtaaagcactgtttcggtgcgggctgcgcgagcggtaccaaatcgaggcaaactctgaatactagatatgacccaaaaataacaggggtcaaggtcggccagtgagacgatgggggataagcttcatcgtcgaagagggaaacagccggatcaccagctaangccctaantgaccgccaattgtaaaagagttgggggtgcaaagacagcaagangttgcctagtaacagcacctttaaagattgcttataccatgattnaaacgccttgcctgatataacgggtaaccatttnccnanctttgaattcaaaatctcntaggaacttcccctatnggaanaacgcaaacnggtcacaacggaacaaaatcgctgattacgaaanatggnagaacaatcccacaacaagttctcnangtttcacgaggtatagcctaaatagccaaaggtncatgaaaaagcatntccngcaaccttntgaagaggacgngggcaggtaccaa

SEQ ID NO: 91055 - DNA, 484 bp, Triticum aestivum
  unsure (1)..(484): unsure at all n locations
  Clone ID: PAT_TA_91055
ttgggttcacagatttggaggatgtcttgcaactgtggatccggttgcagctgcggctcagactgcaagtgcgggaagatgtaccctgatctgacagagcagggcagcgccgccgcccaggtcgccgccgtggtcgtgctcggcgtggctcctgagaacaaggcggggcagttcgaggtggccgccgggcagtccggcgagggctgcagctgcggcgacaactgcaagtgcaacccctgcaactgttaagctgcatgcactcgtacgtacgtacgtgtgatggtgtgagagtatacttngaataacgagcgtctgatctgatggagtccagcaagggtgcgtgtgcgtgtgatttgcttgctcgctctccgcctatgctccgcccatggtgtccttgtgtgtagtgtgtcccattctcccgtatgctcanctactccactatggatggangatgatatgtaagaatgaaagatttactaaaaaa

SEQ ID NO: 91056 - DNA, 501 bp, Triticum aestivum
  unsure (1)..(501): unsure at all n locations
  Clone ID: PAT_TA_91056
gctccgaccgcgtgctctacctcggcccgctctccggcgaccccccgagctacctcaccggtgagttccccggcgactacgggtgggacaccgcggggctgtcggccgaccccgagaccttcgccaagaaccgggagctggaggtgatccactgccggtgggccatgctgggcgctctcggctgcgtcttccccgagctgctcgcccgcaacggcgtcaattcggcgaggcgtgtggttcaaaggccggtcccagatttcaagcgaagggcggctcgactactcgggaacccagctctcaacgcgcaaanatccttgccatctgggctgcaagtcntgtaatggcgccttcnanggtacgcttccccggngccgctcggcaaatnttcaaccgtctacccgggggaacttcaccctgggctcccnatnaccccaaggatcccggnntaaagtaaggnttaaaaaggcgcccncangtctcaanttcggtctctgcaggcat

SEQ ID NO: 91057 - DNA, 367 bp, Triticum aestivum
  unsure (1)..(367): unsure at all n locations
  Clone ID: PAT_TA_91057
cagaagtcaaagccaacgtttctgctgctggcgctcccgagcaatacagggaaggacggtcagcattatagggtggaagaagccaaatactaggaggcattaagagagaccggccaggagtctgccagcagcaagccagaggtcacacagacggatgcttctttgcgccagcactatgacagaggagaaatagcaccctctcatgtataaataggagcaaaccagaggtcagatagcatccagaacgaagatatcttcctgcctccacttcctgttcctctangcagcctgggaaaatgagcgagcaagcaagaaattggtaacaatcgatntaagtgacaaccagattcaaatctccaaggggggg

SEQ ID NO: 91058 - DNA, 548 bp, Triticum aestivum
  unsure (1)..(548): unsure at all n locations
  Clone ID: PAT_TA_91058
gtagaacccatgacaaaaagctttagcaaccaggcactttgaaccggcatgatgaccacaatccccctcatgaatttcctgtaggatctcttggccttcttccggagaaacacaacgctgaaatacacctgaaatgctgcaatggtgtaactcaccattgtgaataaccatagacttgggtcgccggactatctatcgggccaggacttcatcatctggtaactcgccctggttcatatacgccagatatggaaccgtccaatccggcacaacatgtaaagcgggcaacaattgagcctccggatnaggaacaacgaaatcctcctctgtaggcaacttaacagacgggttatgcaagatatctaaaaaggtattgggaagcaccaatttacgctgagatcaaaccgggttaaancgtccggcngctcaattttgcccnattcanatgccaaactganacctttaattacccncanaaancaactcaagtnttaaccccangatngttctaaaacccatgcaaaaattttggcccaatnagtcccaat

SEQ ID NO: 91059 - DNA, 621 bp, Triticum aestivum
  unsure (1)..(621): unsure at all n locations
  Clone ID: PAT_TA_91059
gcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacataccaagagggaanggcatcgttggactccctcttcaaagcgcccacgggcgacggcaccacgagccgtcctaactcctacgagtacgtcagccaagggactcaagaantacgattcnacaacacatgggaggntttaaatcgctcctgcttcaaggacaactgtttcatctcncaagaactcatgacctgccaacatcagatccatcatctgggtactggggaagaaggtcangaaatcttcaatgtaactgtctcccaanangcanaaccatcatatatgcggaaactggaatgaacccggaacacaacnatagaagtacggggggaaatttanaggaattctcc

SEQ ID NO: 91060 - DNA, 240 bp, Triticum aestivum
  unsure (1)..(240): unsure at all n locations
  Clone ID: PAT_TA_91060
cccactcagtcctcggttcccggtccggtcccgttccgttcgttagggtttagtagtagcggggaagaggaaggaatggcggacgtcgagtaccgctgcttcgtcngcggcctcgcctgggccancgacgaccagtccctccagaacgccttctccaaatacngcnacgtcatcgactccaagatcatcactgacagggganacgggccgatccctcnggttcnggttngtcaccttcgc

SEQ ID NO: 91061 - DNA, 607 bp, Triticum aestivum
  unsure (1)..(607): unsure at all n locations
  Clone ID: PAT_TA_91061
gcgaccaactccgcccccatcattcccgccgctccccacctccatcgcttgcgcggccgcctcctcctcccccatgcccgacatcgagccgggcagcgtgtcgtcgtcgtccgcgcggtctcgggggatgggggccgaggcggggggccgtcgtacctggacatgtggaagaaggcggtggatcgtgagaggcgctcagcggagcttgcgtaccggctgcaggcgtctccgccgcctgccaaggcggaggccccccagcaggcggacgtggagcggagaacggcgcggttcgaggagatgctgcgggtgccgcgggaggagcgcgaccgcgtgcagcgcaccaggtcatcgacgcgccgccgccgctctcgccgccgcgcgcgctgtaccaaaggaaccgccgaatcctcgcaacgccgccgcgcaaccgaaaaaccgnggnggcacggagtgatanggtcggcacttttggttcccaaggcncaaagggctaggtaaggtccggnaagactacgtgntccatcgaaatgaaatcgggatcaactcaactggaaccngncggttggcggtacncctgaaacataacagnaaaattnttaacacaaaa

SEQ ID NO: 91062 - DNA, 603 bp, Triticum aestivum
  unsure (1)..(603): unsure at all n locations
  Clone ID: PAT_TA_91062
cttcaacctacaaaggttctcgcaatgttccttgttcctcttgctgaacggagtgttgtaaattttgttcacctccgtcgtgtcatttctttaagctttgcgacctctcaaggttctttggtttcactcatttgtcaaagaagcaattagttttacctcttcccttcctcttccgttttccctccggtgccatcctagatctcgggacgagatcctcttgtagtggtggagtgttgtgacgccccgagaccgacgctccgattgccttccttgtttggcgagtcagctgtgttttatttgtgtgttgcattcatcatcgcatcatttgcattgcatcggcacttcgttgccgccatgctttaaaatttgcattcgttcgtaagtggccgcgttccccccttgtcttcgttcaacgttcaagacaacgtgttccggtcctcttgtaaacaacaactcctcgtcagcccgcgatcctccggcgtcgaaantgtccgtaccgacggtttgtgtacgttgggtcgatacccnacacanaaanacncgttctattggccccacaatttgccatgcgattaacanggacaatccaaaaatnctttaann

SEQ ID NO: 91063 - DNA, 292 bp, Triticum aestivum
  unsure (1)..(292): unsure at all n locations
  Clone ID: PAT_TA_91063
agaagaaagtcctcaatccacactgcgggatctgttgttccatcatatgattcgatattcacgggtttgaactcttctgggaattcatgctccattacttcgtcagtgaggcagaggggacgtgcggcgcctctatatcgggccaagtcgcgacgcagctccggatggatccgtccgcggtttttggcccggacatggttatgcttgtcncgcccggctaaatacctccccctgcgtccggggaantcccccaaacggtaaatnatttggggcnaacnngcccaatttcaaa

SEQ ID NO: 91064 - DNA, 338 bp, Triticum aestivum
  unsure (1)..(338): unsure at all n locations
  Clone ID: PAT_TA_91064
ttttttttttttttttatttcacaagcttcagcttctgaaatcaattaaaacacaaaaagaaaacatcaacaaacactctgaaattcaccagaaaatctaggcaggggagaaaaatctcatctttggtgtgctgctacagattttcatacagaacacaatgcaaaatgaatcaattcatttgggacttatgggtaaaaattatggntattccaattctatgggaannttnaatgaattttaatnaattnaanaagggggngacntnccaagggttaanccacangggggcccacacncanacctttttgggccggcaaaangggttaaaangcccgag

SEQ ID NO: 91065 - DNA, 623 bp, Triticum aestivum
  unsure (1)..(623): unsure at all n locations
  Clone ID: PAT_TA_91065
catggcttcaagccattttgcggaatctgggctcaccatcgcttcttcatggttcgtaggttcatcatgatctagtagcatgacttccagaacaggattaccataccactctggcgcggatcttagtctggttgatctacgagcttcagtagtatcttgttctgaagtttcatgatcattatcattagttcctcactaattgggtgtaggtgtcacaagaaactggttctgtgatgtactacttccaataagggagcangtacantaccccgtcaantctacttcctcccatcactctttccnagggaatcctcccccaaaaanttccaaatttaagcaacaaancttgccttcngttcggtgatagagngtacccatatttcctttgggaatcctatgaagaaattcccccgattcngtccacttacaggtggatttttcacataacatacaagccaaattnaagaacacaattggttctgcaaacacatcataggacgccaacggttgatgggcctattacagaagggcactcagacaaccaaacatacngaatcgtaggaacaanttccaacataagncatncantcggancatanantggtccgggtantnacanccat

SEQ ID NO: 91066 - DNA, 647 bp, Triticum aestivum
  unsure (1)..(647): unsure at all n locations
  Clone ID: PAT_TA_91066
gcgaacttattttcgtttaaagaagcgtttacttccatttattatgtacatcgtctgttcggccctctcacatgtgaaaaagaatcttgcacgtgctaacgagtgtcatcaccaatctcactcgcctcctaaacaacaaaaatattttttttctatacagtatcatgcatcttctctctgggaagaaaaaaaaagaacaaagaaaaacgtatggagtatggacaccgcccatgcatgctacaacggttgatctgctggcgccgccggctgcgccggccaantggcgttaggctcgnccaccgtanccgngaagggcccattcaaccgnacttctgcccttcaaggaaacttcctttgngactggnacccttggcgttgacngnacgggtcngttaanangggactcctggctacgcctggaanagnactctccnccgaagtntgttgggatgngtctaggccaaccccncccggncccgtanatctngggccaatggtgccagggcacactgatatggnnacccggccatgaaagatcgtatggggaacgtgaaccaanacagtcgaccntaagancgaaacggnaancccnttcgggtgcggaaaggnacgaacgggatcggcnccncnacccgtttttttnnatn

SEQ ID NO: 91067 - DNA, 244 bp, Triticum aestivum
  Clone ID: PAT_TA_91067
caaaagatacccgcacctctctccacatcattatctcccagaacctcattgctcagcaactagaaaggaataagtctctggaacaatctagcatgcatggtggccgccgcagcctaccggcgccgtccatccccatgcctccgcccattccgaccactagtcaccaccacgctccactcttcctcgccttatctctcatctttcatttttcgatgacattctcgagataccattttctgataaa

SEQ ID NO: 91068 - DNA, 666 bp, Triticum aestivum
  unsure (1)..(666): unsure at all n locations
  Clone ID: PAT_TA_91068
ttcagtctcgttaccggcaagtcactttactcgtaccgtaatgcatgatcccgtgaccaaacacttggtcactttgagctcattatgatgatgcattaccgagtgggcccaaagatacctctctgtcatacggagtgacaaatcccagtctcgatccgtgccaactcaacagacactttcggagatacctgtagtgtacctttatagtcgcccagttatgttgtgacgtttgggtacacccaaagtacccctacggtatccgggagtacacgatctcatgggtctaaggaagagatacttgacattgggnaaagtcctagcaaaacgaactacacatctgtgctatgcttaaggattggggccttgtccatcacatcatcctcctaatgatgtgattccgttgtcaacgacatctaagtccatagttaggaaacatgacnactgctgacaacgantatcaactanaggttacaaggactattggccaanatcacacagtattacgattccggatatcattttncatgataaagcatttcntgacaaggattataataancttttaatgctcaggganattcacantaagcagaatgatggtaagtcaaaagtnncaacagattaacanattnccggttagncacaaatttcaagantcctaacctc

SEQ ID NO: 91069 - DNA, 641 bp, Triticum aestivum
  unsure (1)..(641): unsure at all n locations
  Clone ID: PAT_TA_91069
cttcccccgaccccccgctccgtaccacccacccaccttaccggcaccaccacccacctctgacctcgccgtcgacgggggcggttggacggaggcgatcgatggggcacgggctcagctgcagccgcgacggcgacnagcacgacttcttccgcgccgcgcaggccggcgacgtcgacgcgctcgacgccctcctcgccgccgacccggcgctcgcccgccgcgccaccatctacgaccgcctcaccgcgctccacgtcgccgccgccaacggctgcctcccggccgtcgacattctgctcgcccgcgccgtncgcccggaagtcgtcgaacngccggaaacgcacccgntcatgtcgcngcaccaanggcacatcgatgcgccttgcctcctccgnnccngggccaatatctatgtccatcggtgaancgcggactgctcaaaagcggngacanggnaaccgatgctgcttcatctnccnnggccgcacagccgtggcnatntngggtccttggctctaagtcggaanacaagggcanncgctnaattgngnaagaggcggcgatnnttnatgtgtcaaagggcattttggccacggncaagttcggaaanggntgacngccccggggaactnangttn

SEQ ID NO: 91070 - DNA, 265 bp, Triticum aestivum
  unsure (1)..(265): unsure at all n locations
  Clone ID: PAT_TA_91070
gcgcctcctactgtcagcctcagctcactcgaagttagcaatggcggccgcgaccatggcgctctcctccccggcgatggccggcaccccggtgaaggcctccanggcggcgcccttcggtgagggccgcatcaccatgcgcaagacggcgggcaagcccaaggtggcggcgtccancanccgtnggtacggtcccgaacgcgtgctctactcnggcccgtctccngggaaccccccagtattcnaacgggagtttccccgggaa

SEQ ID NO: 91071 - DNA, 209 bp, Triticum aestivum
  unsure (1)..(209): unsure at all n locations
  Clone ID: PAT_TA_91071
gctgccttcgcgttgcccggcttcaagtcagtcgtcatctgcctcaacacagacaacgcccgctcatcggcaagctccgccttgggccaccccttgttgagctggggcgccttcgtcggtaacaccaggcgcggatgggcgtgcttgggcatccatcatgacccatttggttcggatattgttggcctcttcccntcccaggggggggg

SEQ ID NO: 91072 - DNA, 406 bp, Triticum aestivum
  unsure (1)..(406): unsure at all n locations
  Clone ID: PAT_TA_91072
ccccaacctccttctccacctccggccgccgccacggccagaccggcgtggcggtgcgcctcccatccatcagccccacaagataccaccatcaccatccatccgtcaccgcgccacggcaccaccacccaccgctccaccatctccaccaagccgccgccgcagccatccatcatccgcgctgccaccagctcaaccaagcaccattccattcactctgtatccctctaantctcntcngttcntcttctcaatgcccctnatttgtggttttnttccncacacncggtgaaactntttcggnggtgttttgtggtgtgcctcttctnaaaaccctcttgngnggnaatccaaaccctncaaaggggggaaaacccnccctttggtatacaaacncctttgcccc

SEQ ID NO: 91073 - DNA, 631 bp, Triticum aestivum
  unsure (1)..(631): unsure at all n locations
  Clone ID: PAT_TA_91073
gctgcgtcttccccgagctgctcgcccgcaacggcgtcaagttcggcgaggccgtctggttcaaggccggctcccagatcttcagcgagggcggcctcgactacctcggcaaccccagcctggtgcacgcncagagcatcctcgccatctgggcctgccaggtggtgctcatgggcgccgtggagggctaccgcgtcgccggnggcccnctgggcgagattcntggacccgctctaccccggcggcagcttcgacccctgggcctcgccgatgacccgagccttcgncggactcaaggtgaaggagatcaanaacggcncctcgccatttctccatgttcggttctncttgcaagcatcgtcaccggcaagggcccctcgaaaactcnccaacaactcgccnaccgttaanacaacgcctgggcttnnccacaatnttcccggcaaatgangcgtatctcaactcangcgaaattnaagntgatggtctctcaatgttctcacgtnnggctttccgttcgaatgataccggacataatttaattnaggttncanaaagattgggnttaaaaaaaaggnttggaanccgtttttaattancaatntaaaaaacaangcatatcacccggggn

SEQ ID NO: 91074 - DNA, 508 bp, Triticum aestivum
  unsure (1)..(508): unsure at all n locations
  Clone ID: PAT_TA_91074
cttagctagctagcagccatggccgccctctcctctgcagccgtgtccgtcccttccttcgccgccggcgccaaggtggccgctccccggagcagcaggatggtggtgcgcgcgtccctgggcaagaaggccgccagcgcggccgtggccatggccgcgagcgcgatgctgctgggcgggtcggcgatggcgcaggacgtgctcctgggcgccaacggcggcgtgctgggtgttccgagcccaacgactcagcgtcaangccggcgagaccatcaccttcaaagaacaacgccgggtacccgcacacgtgggtgttcgacgaagacgcngtgcctcccggcgtcaactctccaagntntcccaagaaggantactcaaanccccccgggganacttctccgtnanctcaacttcccgggactanggttctaatgcaacccaaccccgaaccggatgtcggaangcaccgtnaaacaacttcaacnaccttgcaaatntncggncgtta

SEQ ID NO: 91075 - DNA, 195 bp, Triticum aestivum
  unsure (1)..(195): unsure at all n locations
  Clone ID: PAT_TA_91075
gccccttcctcttcctcgggagcgagcgagcgagcgggcgggcgattccgatcgccgcggccgtggagagcggcgggggtgctcggcctcgcgggancggggngangtgganaacggaaaggcatggacgggnaaacngtngnagacngtctcccgacngtctaatctgaatttnttcgtngaatntancanccc

SEQ ID NO: 91076 - DNA, 658 bp, Triticum aestivum
  unsure (1)..(658): unsure at all n locations
  Clone ID: PAT_TA_91076
aatattgagcgggaagggagccaacaatggcgggcaacttgaaaggggacaactagtccaagctatcctgacaaaagtggtcttcgcctgcaaaaggctctggtggtgacgccgtcttgggctccacggtgacctccgtcttgccgtcctgctggtcttcggtctcattgcactgatagggaaacctttgcttgatgcctccggtactccgcgcctgcgcctgcctcctcagcaccaaagaggaaacaagnacgctgcgcgcgctggcgcccgcctgggtgtcnatngtcatggtcaagtcacatgacctcaagaaggttaacccgcctttgaatctccgtcctcntnaacctgcctggctaagcccttccngaggaatcctgcntccctgcccaanaaggttggccctccccaaggccttgaatnctttttnataaaaagggncaantccggctanaaacanccntggccccaggnagaatntgggaancccattccaagnanccnaaataaccccggccaaagggccccgggntggttcagggaaccaangcaattggancccgggccnaaaccannccccttanttggtatttncngggcncccttcaagtgccaaaannccnttaaaggnngngaaaattttctattttccccc

SEQ ID NO: 91077 - DNA, 381 bp, Triticum aestivum
  unsure (1)..(381): unsure at all n locations
  Clone ID: PAT_TA_91077
ccaaggcaggccgctgtttggaacattctcggtttagttcttcttcggggtggtcaactgcagagtggtatctcagttttttctactctcacgactgttgctccagattacctggactcgcttgccaatcttggtgttgcatatattcaaagtggggatctagaactgtcaacaaaatgctttcaagagcttgttctgaaagatcaaagtcacccaagctgctctggtgaactacggtgctctcctcctatgtnaataagggcctttggcgcaagggcaattggnantgtccatncaagattttncctgcatcaanaanaancttaattgctgcaaaagangctacttncactgtnagnccgancctaaacccatccatat

SEQ ID NO: 91078 - DNA, 152 bp, Triticum aestivum
  Clone ID: PAT_TA_91078
gccaggtacctccaccgcaaccaccagtggctgcagcccaagaggcccggcttcctcaccgctcggcctctccggcagccgcgccgggcgctctccgccgtgccggaaacaaagaatgaggaaggccaagacggccgaggagatcaccgaga

SEQ ID NO: 91079 - DNA, 363 bp, Triticum aestivum
  unsure (1)..(363): unsure at all n locations
  Clone ID: PAT_TA_91079
gtgagacactaccagtggcactggaggtagaacgtcacatgtctttatcgattagtggcattgtctaattgtcgtttgccggctgtacattatctatcaatggcattatgttcttagggccaacaacactagtaagtgttgacacattctgggctacaacataccctgaagcaatgagatatgaagatattatatcatttaagggaaaacatgggaggtgctcaaatttggtcaaggaagggaattttgagaagaacactcaatgtttgacgattatatggctagatncgctatgactccctaaaggaatttttttaggaggtaaagaattttaaggaaaaggctagaatggttttttancga

SEQ ID NO: 91080 - DNA, 279 bp, Triticum aestivum
  unsure (1)..(279): unsure at all n locations
  Clone ID: PAT_TA_91080
ccggcccatgcaggaccagagtttacccgagtcctgactctcctgtcgagcacgcgcccaaataagcgctggttcgttcgtgcgtgcgtgcgtgccatctatcatcccatccatggcgctggcacctctgccgtgagcagcanggacgangacaccacatcaaaagcgtcaccctcctttttanagcgngacccctttgtttaaccnccgantctcantttttaatcanaacanccagcntcactccnttcnggcctcncnctgngcgtgtaatctatc

SEQ ID NO: 91081 - DNA, 621 bp, Triticum aestivum
  unsure (1)..(621): unsure at all n locations
  Clone ID: PAT_TA_91081
gagatatcaagcctggcaacatactcttgaatgagtatttcaacgctaagcttggggacttcgggctatccatgatcgccagcaaaaacagagcgacagtggtcacaaccgccgtggggtcagtgggatacatggatccacatctcatgaaagacggggctgtggagttcaagccgtaagtcggacgtatacagcttcgggatcgtcctactaaagattgcacgtacacaaaatcaagggangaatctggcagatgcgcggtggcagtgagcaacaattcatgttgatgggttgtggatgaaaggtacctcctttgaccgtaccgaatgncntgtgtttcccttggcccaagtttctcaccagcaanaggacaanacttccaaggnggagcatgatcctccaggacggcaaaattcctgccacaannaaggaacggacttngggtccttcattttaacaggaggnctnttatnanatggggatcctctaataccttggcannatnatgaaccncantaggcaaacctngggcatttcaccaattctgcntcaaattcggttacaattnnnggatcgtccatcgaagntttncaagtnctccagtcatcaanacaatnttcn

SEQ ID NO: 91082 - DNA, 318 bp, Triticum aestivum
  unsure (1)..(318): unsure at all n locations
  Clone ID: PAT_TA_91082
cgcacccgccgccaggctcactcaactgagtanactagccaccaacaacggggcacgtcgagatcagcacggggcttctatctcggccaaaagctggccagcaaggtgcaggtgcagccactagttcgtagctagactagtgtaccactggtggatcatcaggttcagtttctcgaggcgtggggctttttttttggtcgatctgtccatatagatcgaccttttcttctctccccgtcttgtactaatgtcgtgtacagcagtgtgcagtgtgggtcgatcacgagaccctcccgaccaatgtnaccacctccacta

SEQ ID NO: 91083 - DNA, 195 bp, Triticum aestivum
  unsure (1)..(195): unsure at all n locations
  Clone ID: PAT_TA_91083
cacgccacaggagagacngattgcacncgcacgctcgaacacggcacggtggtcgccaccaactntcgattctggtcctcggtcgcaactgcancacgttccttgatatcanncaagctntcatgacacangccgnatggtcgcagntgcacncngtacatgcgcncatcgttcgnaattcgtngcggaccaagc

SEQ ID NO: 91084 - DNA, 334 bp, Triticum aestivum
  unsure (1)..(334): unsure at all n locations
  Clone ID: PAT_TA_91084
ggcacccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttaagtagccaagaggaaaagaaagcaaaagcgattcccgtagtagcggcgagcgaaatgggagcagcctaaaccgtnaaaacgggtttttgggagaacatacagcgttgtgctgctaggcgaagcgnttaattccnancctaaatgntaaanccanttncccnaanatcatacttacgc

SEQ ID NO: 91085 - DNA, 677 bp, Triticum aestivum
  unsure (1)..(677): unsure at all n locations
  Clone ID: PAT_TA_91085
cttggatattttttcacccttgcatgctatctaaaccttgtaggtgcttggatgaatctaaatccatgagattgcaactcactcacattttgagcaatctctacatcatcaagtctctacacaatggtggttgaagacaaggaaacacaaaactcttcaaacatatcctttgacaaattctacattaagatttatgattgtcattttggatacacaagtgctcttccttgcaaagctaaccatgtaggaaaatgaactcaaatccaagtggggctcccaactcttggatgagtacatcaacctttgagcaacccacacaantcaactacatgatcaagatcaacaccatcacccaaggtacgttatccatcttaagagaactttatcccaaacnatggggcaaagcaaccaacaagatgtgaatacatccaagagcttaaacgaaaatggnactttgacttaaacgacgagtatgacaaagtnaaatgactcactgatcctaagtcaacatatctaacatagngattgcacgccgattgtaccccnagacgacctanaagattctatttggatacgcgngttcttggctgcccttatttgattgacagcacaagcacagnataacttgacaaccanaanaattgnggtttctcattacaggatcnaggatttcttaa

SEQ ID NO: 91086 - DNA, 603 bp, Triticum aestivum
  unsure (1)..(603): unsure at all n locations
  Clone ID: PAT_TA_91086
atgaaagagtctgaattttataaaataaaataaaatcctggcctagtacgatgtggtgtactccactattatagagtctaagcgatttgctgatggggctcttttgagatttgatcatatggaactcgaatagattacactctgtgagtaccaaacgaacaacaaaggaggcaacaaactccgccacgcccctttgccctcctgacgtgacctggagcataggcggacggttcttccgctcacgttctagcgttctctttctcccataccatctgctccggctgaatatctgccgcaagagcgcatcttggggacntccantttccgacatcctgcaaacttccccgactccggatcgaatataccccgtgtacccggtttcngagaaatgggctccacgggaacacattaccanctgaacgccaatgccatcatttgccncgaatctccattggcactcaatgtggctcncaanaagaccnantgggatcnctgaacttaactctgaagacccggtcggaaccatgctctagccgactagtcgtacaatanacccaatacctnggccgactcccgcaggtgganccatctnttaacgtcgnc

SEQ ID NO: 91087 - DNA, 211 bp, Triticum aestivum
  unsure (1)..(211): unsure at all n locations
  Clone ID: PAT_TA_91087
nttctnttttttttttttttttgaataagntcatgctaggatgcctaggactncctacangcttcantttcganacagatgaaatgtcccnacncaaanacactatgcgaataatcattattnacancataaaaagccacttccacgtccacgttaccctttanaangaccgtgaatgtncaagcttcatncacnacctgcacatgcacca

SEQ ID NO: 91088 - DNA, 375 bp, Triticum aestivum
  unsure (1)..(375): unsure at all n locations
  Clone ID: PAT_TA_91088
ccaatcaaggcctccatccaatcccaagcaacctcgaagatgtcttgctgcggaggaagctgcggctgcggcagcgcctgcaagtgcggcaacggctgcggcggctgcaacatgtacccggaggctgaggccgccggcgccaccctcctccgtctccgccaccgccacccacaaggcgagtccggcgggatggagatggcggcggagaacggcggctgcggctgcacccaatgcaattgcggaccaagtgcggtgtcctgctgcagtgctaaatnatcgatnatcgtnatcgacatgcatcacctgccgcgcgcgtgcatcatatctatgatcgatttggnccatctactacaagtnttacccncttggccaagg

SEQ ID NO: 91089 - DNA, 376 bp, Triticum aestivum
  unsure (1)..(376): unsure at all n locations
  Clone ID: PAT_TA_91089
ggccggggccctggccacgtacactatatatgcggcttagccatgacgctgtgtggccggctggccgctgcgcgctaccccttaatcccgtccccccggagagccagcggcagagtccggccgccgcgccgagagccacgacgcccgggcggnagctggtcgatcatgtcgtccaacgagggtgagggtgaggggaaagcgggcgtcaatggcgagcaccngctggagganggcgagggcgaaggcntgctggnggcggtgatggagcagctggcancggaaggggtgacgggcgctgcacgcncaggtctaaggcggagtgggaccccgtactgcanaacgcgtggcanacggcggcntgccgngcgctgttgtc

SEQ ID NO: 91090 - DNA, 439 bp, Triticum aestivum
  unsure (1)..(439): unsure at all n locations
  Clone ID: PAT_TA_91090
ctcgagtttttttttttttttttttttttttaaattcggtgttgctgcctgtacaaatttaaatagaaattcaattttgtcagtacagtgctactgcctgtacaaattcttagctttgcttgacaaaactgttttactttaccaaagtagacaatgctcttccgactaggcagggcatggcagggaggaatgctcttcaactcaccaaaacgaactggggaatatcccatgtacaccaccaccatgcttcctccctgacagaagaaccctcagcacccaattccgctgcagcccattgccctatacctntttgccggggcnggagttggccgctgagcgtccaccttttggagttggccggtgagcgtccatgggcggggatacngtggccgccgggagacccggagatttccccacgcgganctccgggacaagcccg

SEQ ID NO: 91091 - DNA, 660 bp, Triticum aestivum
  unsure (1)..(660): unsure at all n locations
  Clone ID: PAT_TA_91091
caaaatctgaccgttagacacgtgtgagttcctaagtgacccagggtcattgtggaccaataaggttgggttgcctcctggctataaatagcccaccccctacaccataaattggtggctgctcagagttagtgcacgacttttgtctttgagagcaacccacctccgaaccctttggagagagaaccttgcgaggaaaaatccaaaaacacacagagccaaagagtgttaggcatcactgaanctttatgtccgcgtgattctgaagacttattacacttngaggactgtgaacctccagccggttaagctcacgttctgagcattgatatgtctccaacgtatctatattttttattgttccangctatatattaccctttttggtgtttaatgggtttatccacacatttatacattttgggacaactactaaccggaggccaccatatgctgtttttgggctattcaatattcaaagaaaactttcaaacggatcaaacggatgaacctcnggaacntatttggacaattgttcggaaaccggangaatcaanaattcccagccacaatatagagggcccccanggcttcaccttccnggcccggaacacantnttttccaaantcaggccaaaancaggnaccanaaattccagg

SEQ ID NO: 91092 - DNA, 373 bp, Triticum aestivum
  unsure (1)..(373): unsure at all n locations
  Clone ID: PAT_TA_91092
attgcttccacaactatgccaaggacattggcttcatcgagtaccattaagaatggaacctcaaaggaagcaaggactatgaagttatcatcaaactgtggtgtttcaacgaggacgatctttatcaacaatgagggttgaattagatcttcanagacanatacatctttatntnataaaaatgctgatatgatgatcaggatgagttgcaagnngatagatttcaaaatggctttgantangaanagatgcactcccaatncanaacaacttttgacggatgaaggataaggacatcccacgatccagcatctactccaatnccagcacaatgcttggacncannaagtgtcanacccnattccnattaagg

SEQ ID NO: 91093 - DNA, 504 bp, Triticum aestivum
  unsure (1)..(504): unsure at all n locations
  Clone ID: PAT_TA_91093
gaggactgctctgcccaaggattggatccagggagactggatgccgtcggtgattcggcaggatgatctcgatgatctggtcgaggggggattcattccccacgaatctgcgcgcctcccggggaaagaagtcgaaccccagcctcttgatggtgagtgcgtcctcctcgccacccatatcgatcgtggattctctctgcctcctcatccttttttccggagctcttgaacttcttccntnncgcaactccacactttactcccaatccaatgtgtanctgctgctttcgttcccttggtgtnaaaattccntgggttnccgccccattggngatcttnancaatcttanttgtcnctctnatccgtcaacaangcaattgatttcaaacggccaaggtancaacatcaggggccgggtncagtttgggaaaagtcnttcctctacntttccctttcaccctnggtgnaatcaattggtttatggttaacanntgcccaagaaa

SEQ ID NO: 91094 - DNA, 415 bp, Triticum aestivum
  unsure (1)..(415): unsure at all n locations
  Clone ID: PAT_TA_91094
cgcaagagctgttgccctcctggccctcatctgctgttccttagcatgcacggcggcggcccaagttgttccggacggacgtcgtgagccaaggactccgccgtcgccgctgccagggaaccagaacccggttggaaggctccggccgagattgcgtcgccaccaccgcccttggagacagcggcgcttacgccgcaccgcaagaccctgcagcaggctgtttcaagcgttcctccgtgtatgaagnacctntccctccaatatttcttgtcaatgcatgtacaattnatgatggtncnaattaanctaatgaatatnacaccacggangtgtnatcatacttcttgggtgatgagatatttgctgtgttggnagactgaaactattaatancagacaaaanttcgaacaaccaa

SEQ ID NO: 91095 - DNA, 596 bp, Triticum aestivum
  unsure (1)..(596): unsure at all n locations
  Clone ID: PAT_TA_91095
acaggttctctacccacacttgaagaactaaaggtattcctgaaagagagcagaatggcacaagataattgggttcctatcaagagcacgtcagcaagatctattctcaaagccgccctcattcatgaggaagattaaaagtaatgtttccttaantnatggcgatggantanacanacaagatatcaccacanntnctggtgcacnagngaggaanntntcacgttcaatgtttgcancggaaattcacattngaatntatcggtgacacatnatnantccagcagcttaaggatncttancaggntcactggtntgnaccggaaagttcatttggaagntttgnagttaaaggaccttacccancaaggntngngtgctttcccgnaaattcntaaaacgtacaattggaggcntnttnggaggagtttcnnganaaagttccctttgcagaanncaaggngggttttccccttttggatcaaaccnctaangcacacagngtnggggctcttttttgnggggggggactttncatgaaaccattcccattggggaaattcccaancttngtntaaagccnttttgaaaccacc

SEQ ID NO: 91096 - DNA, 607 bp, Triticum aestivum
  unsure (1)..(607): unsure at all n locations
  Clone ID: PAT_TA_91096
gtttgcctcatctatcgcgccacctccatccccacagcaccatcttgacctgccccaccgaaactccaacaccctcaccaattcctccgatgaagccgaggcctactcggggacaccaaggaggttctgcactcaccgttgcattttatcttctattcgatctcacggggctgccggtgctcgataccgagcagccatggcgggtctccatcgacggcatcgttgccagccacttcattcatggtgtctatcccccatgtcattgcttcctcaacggcgactccacaccggcactaagctgcagctgctccggtctcgctcgcgttgtggtttatcctggctgtcngcaagctgctgnaatggtcttgcttcgntnaangctacgtctatccgcattgtgtatcaagctgctgtccgtcttgctctcgtcancgtgctntcnctctggtctcgctcgtgatgctgctgctganaactccgacagtacaggattgctgcttaanatcgctcacaagcgctaanactgctccnacaanggtcctgccaagggggccgtacaatcgcctaangancataccggctacggcgtntttaantctacggaaaa

SEQ ID NO: 91097 - DNA, 286 bp, Triticum aestivum
  unsure (1)..(286): unsure at all n locations
  Clone ID: PAT_TA_91097
caaccttgttggggttaacccgcaatcaattcctgccagatatggtccactcggacttactgtcggctagggtatatgattgaaagttcaccgtttcttgcgcccaattatcatggcctttggtggcaccacataggggtaatttaacctcttataaaggtatacgtaccgtggtgtatgggaggtcnccgcaagtatgctagattgggttcgaaagaatgacactggtgatacgggtaaaggatangtaaaatatacctacggacgattattgttanaggtacag

SEQ ID NO: 91098 - DNA, 451 bp, Triticum aestivum
  unsure (1)..(451): unsure at all n locations
  Clone ID: PAT_TA_91098
ctcggataaagctgaggcctaatgggtgccaccaaagaggttgtacactaattgtcgcattttcttcttgattcgatctcacggtgctgccggcgctcggtccggagctgacacggcacggctccatccactgcagcatcgccggccacttcatccacggcgtcactccctcggcggcgacgtccacatcagtangagctgctgctgctttagctctcgctcgcgctgctgctctgctccttgctctccctcccctgcttggtttgcccttgcaatgctcntgctcgcgctgctgtctcgctcttgttcttgcttgcgatctgctcnggatttaactacactnaatcnactgaatcacttttgggtcaatccattttaaaggaatgggtaaggnaanccncaataaaagggnccccnggcctccgggntatttanaatggccggacaatgg

SEQ ID NO: 91099 - DNA, 360 bp, Triticum aestivum
  unsure (1)..(360): unsure at all n locations
  Clone ID: PAT_TA_91099
cttatcttcgctggcaagcagctagaggatggccgtaccctcgcagactacaacatccagaaggagtccaccctccacctggtgctgcgcctgcgtggtggcatgcagatcttcgtgaagaccctcactggcaagaccatcactctggaggttgagagctccgacaccatcgacaatgtcaaggccaagatgcagganaaagagggcattcccccaggaccagcancgcctgatctttggntggnaagaagtggnggatggtcggaccntaacaagataacacatccaaaaagattcaacccttcaactgtggnccnttccntggnngccaaanaattccctgggnntttgttcaacttt

SEQ ID NO: 91100 - DNA, 300 bp, Triticum aestivum
  unsure (1)..(300): unsure at all n locations
  Clone ID: PAT_TA_91100
agananctgccttgcccgacgaccagaggagccagncaggaagncnatangcaaagcgcaagcgcggcggtgctctgctcgctccggcgancgtgnttcngcctcccggggcaaggctccgntcagtgagtcaggcggncaccgttgttgntgccccgtcctccgtggactggcgcntggatagaatggacgcagcgacgcggcgggcgctgctgntcctgctgctcntngcanccaccgtgncggcggngctctgccanaccaacccggacaatgcccgccntnctcnggtcggtgatg

SEQ ID NO: 91101 - DNA, 460 bp, Triticum aestivum
  unsure (1)..(460): unsure at all n locations
  Clone ID: PAT_TA_91101
ccccactttctcaggccacagcggcggcaccagctcgatctcgcccgcgaccaccgcgccatggagccggccgcgacgtcctacccggtggcgcgggacccgccgccgcggccggngccgcagacggcgcagctgggcggcggtccggcggcgccgcagcccggcgggtgggcgcgctgggcgctgtgggccgtcgtgtccctcgtcctcgccgcnagcttcgctgtacgnancggccgcggngcctcgcctacntcgtcgtcanctactatctcctcgcngntgctctaaagntccctcnggaagcttagcctgntgtggtgcgacgatccggnggcggggccagatngcgcntggtccggctcgccctgtgtncctctcnttgcgttcgcaacntattcccgcgcgcgtcgctnatctantncgacgctgntncacattcctcntggtggcctngcgc

SEQ ID NO: 91102 - DNA, 664 bp, Triticum aestivum
  unsure (1)..(664): unsure at all n locations
  Clone ID: PAT_TA_91102
cagatttggcgataagcaaggtacgggacttttgacatgtcccccttccaggggtaagtttgcagtgtggtatgtaaaacaggtgtactgctcgtaatagagaccacctggacacttgacgcggttttctgcttccctggctgttgcattgtgtantcngcaggaatgccggacagggcttctggagaacagagtcctgaaagtaaaaagaaaaagaaaaaaaagaaaaaaaaggaatgacacaaacgggagcccctactgcggtctagccgcattctgtgcatgccgtggtcatggcccgtccactatgcccatggtgcttcaaagcgcaatacgttcgcgtaatactgggcttcncnaantcacaaaggctggggntnngggccgcattacnacgcttgntcaaaaacttgcaagccgtcctgccgtaagttacnctgggcgcctnacaatgtccgattggttaattggccgactggaggattccttaaaaagntgttctgaattcncccaanggtgacgnaagcccncnttcaaaggaangtcaatgttcaattacnggattanccccagggggccgtacaatnccccaaagggtcttaaccncccncggctcnttnaatncgacnggaactgggttcaattacnctganaancctccang

SEQ ID NO: 91103 - DNA, 374 bp, Triticum aestivum
  unsure (1)..(374): unsure at all n locations
  Clone ID: PAT_TA_91103
ggccgcggcccaggcgttttggactaccgtaagacaggccggcctagtggtccatctaagttcgaaacgaaaaagcgcgggacgagggatgacggtatctatagagatcagcaggggaacatggtcagagacgaatctggtgagcgaggaaatggtggtggaatcccagtccacattgatgaaaactcggtcaattttttcgagagtgggttgatctcttttgctagaccaagtgtagcatctatccagaaggggaagctcaatcagcgccctctgggttaataaaggaatttgaacatgtttgcttccggactgcctgaaattactcgtgtttttgtccgaggggatcttaagangttgaaatcaccaagatt

SEQ ID NO: 91104 - DNA, 460 bp, Triticum aestivum
  unsure (1)..(460): unsure at all n locations
  Clone ID: PAT_TA_91104
gtccgtcctggtgatccggtcggtccaatggcggctgaggcatgcgcggggtctagccctgccgacttagaacactagacctacccttgcatctcctttccacaagctgtttgcacgttaagggggactcctgagcattgcgactcaggagcctaactgaccacgtagccctcactccttgggtccgcctgggtgatctcgtcggcccaatggcggctgaaggatttcnggggtcccggntctgcccaatttaaacgtnaaagcaaaatggnaaggaattnncaaattcaaagcaaatattacaaaatttgttctcccnatnttaaaacaattttaaatgcctccaaccaaggaacataatnttcaggagtttaaacaagnaaagagaccaacactnatnccctggaaacgccgggcttttaaaaaggccctcctgggtggggttaacttaaacgttatt

SEQ ID NO: 91105 - DNA, 456 bp, Triticum aestivum
  unsure (1)..(456): unsure at all n locations
  Clone ID: PAT_TA_91105
ctcgagtcttggcctgcggttggtgctgagagctgtgcagtcgtgtcgtcgatcgttccggcgcgcgtgcgacgatggccggggtggtggaggagctggtgaagaaggccggcgggtgcgcggtgatcgacngcggcttcgccacgcanctggaggccctcggcgccgacatcaacgaccctctctggagcgccgcctgcctcatcaccaagccgcacctcatcaaggaggtccatatgcagtatcttgaanctggngccgatgtcatcatctcctcgtnctaacaggcaactatcccagggttcttggccaaaggattgcncctcnangaggcaanagattactgtaaccaggttcatctgnnacggaatgcccnnacaantctggaatcgantttccggactcaaacccntcnaaagcacccctgtggcgcncaatctgagtacgggcttacta

SEQ ID NO: 91106 - DNA, 654 bp, Triticum aestivum
  unsure (1)..(654): unsure at all n locations
  Clone ID: PAT_TA_91106
gccaggcacatatctttttgatttggaatttcaagtaaggacatgctaacaaaacaaagatgccggccggactggctaaatcagaggctcttgagtatgatttgcgcgccatgctgaggatgcagcgttatcacggtgcagggcgcatgggcgtaagaaggcgaagagccggaactccgaaacgctgaaggatcatgctcacggccatcttggcctcgagcatggcgaaagttattgccgatgcagatcctccggcccccagccgaacgggaagaacccacctggcattcctgggtcgccttggagattccctccgcgaactctgcggcttgaactccggaaactcctccccccacacgttcgggttgtggtgaaccatgaggaagggtaactccaaggaccgttccggcaaggtaagtgaccccccgattcgcatctcttggttatttccggtcaanggtgacaacggcgtgtaagcctgacactcntacattacatctcatngttgaatcattaaggcgtcaanccggttgcgtcctgcganacccaaaactcctcctcgccggtccnccgggggccgtaccaattnccaaaagatcttanncccaaggctcnttaactctacggaaactgggtacaactaccctcaaancc

SEQ ID NO: 91107 - DNA, 638 bp, Triticum aestivum
  unsure (1)..(638): unsure at all n locations
  Clone ID: PAT_TA_91107
gaagctcatagccaatcaaagcctctccatctccgaagctccaaccgaaccgaggatgtcttgctgcggaggaaactgcggctgcggcaccgcctgcaagtgcggcaacggctgcggcggctgcaacatgtaccggaggccgaaggccgccggcgccaccctcctcgtctccgccaccgccacccacaaggcgagtccggcggcatggagatggcggccgagaacggcggctgcggctgcacccagtgcaagtgcggcaccaagctgcngctgctcctgctgcactgctagatcattgatcatcgatnatgcatgcaccgcgccttgnacatcgatnatatcgatntactactacatacaatgttaccgctactgatnnagggcttatctatgcacctgacctgcatcaacatcaagtgcatgcatcttgttgtnaaaggccccctaaataaactccctggtttaactaaaaaaaaggggggcccgtaccattcgcctatatgatcntatangcgcctcacggcctcntttaaactctgacggaaacctgngttacaacttatccctgagaancccntnccagtgggtatacaaaggcccacattccttcaaattccacnatgaatgacccctnncgn

SEQ ID NO: 91108 - DNA, 624 bp, Triticum aestivum
  unsure (1)..(624): unsure at all n locations
  Clone ID: PAT_TA_91108
aagatgcaaaacacgacgatacttggtgctttgactaatgaacatgatggggcagtttgacattttcttcttgacgagcagaggcagcttgacacttgacttgaagatatgagattcctcaagatatacaaaagtgcggaactcgatcaacatggaccacgtaggtggaaaactgaatagtatgttccgtcgggcatgtccaacatccatccttaaacctctccgcatccgtttgtaccacggaatccatttaatgcggcctgtatccggccacggtgcggccgaacatactttccttctgcaaatcaagagacaaatgtgaggagtttccggganccggttcgctcccatgcccgcttctgaccgtcctgacccaccaaaacccttcgtctcccgtgcaccttccaactggggcgctaacgcatgcatcatgtccatgttaaacgcgcgctccacattgaaacgtaaaacggactgactccactgctcngcattgaagcaccncnacgaagngcgccnctgaccctgctgaaaanctctcgcggtcaaatgcncattaactgatgaaccgnaactatcggcaaagtcatcngaccgcggtaancatncggaaaccccttcncc

SEQ ID NO: 91109 - DNA, 627 bp, Triticum aestivum
  unsure (1)..(627): unsure at all n locations
  Clone ID: PAT_TA_91109
gcgccaaagccctcgcctcctgcagctccctcgtcctgcccggcgacgagcgctcgcctccgtcttctccctcgcgccgcgcgccgccgagctttgggggcggcggatctccggggacgatcgccgccatcgtcaccgccctcggcggggggccccgcggccgtcggcattgtccgcctgtccggcgccgacgccgtcgccgtccgtccggccgcgtgttccggccggcaaggagggagcccggcgcccttggaggcccgaaaccacttccgtgggattacggggtcccgctagaacggagatgggggcgtcatcgatgaagtgctggtngtgcccatgctggtcccaaggtcctacaccccaagangatttcnttggactccaatgccatgggaatgactttgcttgcgtcctgtgctnaaggctgcttngaggctggtgcaagctccccgacctggtgatcatcttcncgattcctaaatggaaattggatnggtcaaacggaaactctcnaggttattaacaaatctgtncncaanaaatcccctggtggaacaaggagntttcaaccaatgaatctaaataagngataaatgtanaattaggcnttaatttaataatcccatt

SEQ ID NO: 91110 - DNA, 629 bp, Triticum aestivum
  unsure (1)..(629): unsure at all n locations
  Clone ID: PAT_TA_91110
gagagggccggcatgctgtgactggatcaaaatcaaaatcaatttacccttcaattaagaaaacgaccccacattaactagtctcccttttattctgggtcataattgaccatgattttcgcacataaaatatatgttatacgttgcaaaaatagtataatttgaaagtacattcagatacgaaccaaatgatacaatttttggtgacatgcattcacattttgcttgtcaaatatagtacgtggtcaaactttggacccaaaatatgcaaaacaacanaaaaatacttccaagaccagcgccgctcttccgtcttctcctcttaaaccaccgcctctcctctccttttcccaatccaaatgcagcaccgctcctctcctcntccatttcaaaaacaacgcccctcctctcctgttccaatccaaaacaagcgtnctcctctcccntccaatccaaaacaanacgccctctcctctccaatcaaaaacacgccggnaatgaangngcgtggagaataatcatggggagncaacgtcatgagatnacagatgggaccgtnancacngattggnanaatctggntgcacaggcaatacanacgganacaggcaattngaaaacaaaggann

SEQ ID NO: 91111 - DNA, 197 bp, Triticum aestivum
  unsure (1)..(197): unsure at all n locations
  Clone ID: PAT_TA_91111
gagacgggagttaactaanaatcaaacgctgntanaanatagatacaacattggccggctatgcagagctggttcgacgtacgtnctcctgtctctcacatgganatcatatcatancatttattcatgtatatgtgtatatatatatatatatatatgtgtgtgtgacctcancgtaatctctatctatcnctgga

SEQ ID NO: 91112 - DNA, 320 bp, Triticum aestivum
  unsure (1)..(320): unsure at all n locations
  Clone ID: PAT_TA_91112
ggtggctcgccggcgagcgagagaggcattgttgcaagggagatcacaacgctgcaagccttcatggcctctttggcggagcttgccggggggaaagacaatggcgagtgtggaggcaggacgaggaaggaaacgaagcagcgaggcacaaattggttgcgtgagaatgacgtgcttcagggttgaccaatccaacggctgtgtgagactgaatcngacggccggtgagccgactgattcccccttgaaattagccgcctgaacgcctaacaatcccccaatttttgaaagggtttanctttggncccaacctantaaaa

SEQ ID NO: 91113 - DNA, 615 bp, Triticum aestivum
  unsure (1)..(615): unsure at all n locations
  Clone ID: PAT_TA_91113
tttttttttttaataaatatatgcttgcaaacttgaaaaataatttaccacccaaacaactttggaagtagaaaacaatattgaaagtactcaaagtaggtgtacatcagctccagaaccagctcttccaaaatatcatcttttgtaattccacatccctgcctgccatgtcaatgtaaactgccaactattctgggaaacttcatccaagtacagcataatgaggcacgaataggtgtatgctctggagtactattcaatggtcatgcggcacatccngacaatgaacacacaggaatagcaactcaagcgagcaagntcagatgttgcggtttgaggtcgcctctccaccctcaagtcagacgaattcccggcaagcggtgaattatgtgcaaacgtttcctggcgaatccacagggtacagcgactcaagaactttccacacgacgatgaccaaatnacggggccncgggaacacgatctacacatcnacctgttgcngggaagnaccaaggtcgttagtactancatnaactatntaaaggtccttacaacagttactcatgnagnactattggtcaagccactgcccacttgngnttacaattcccactn

SEQ ID NO: 91114 - DNA, 602 bp, Triticum aestivum
  unsure (1)..(602): unsure at all n locations
  Clone ID: PAT_TA_91114
ccaaactatgcttttcagtaggactaccatctcctattgcggcaacctagccattaccggcattccttcaggcagattatgttgcctgctggtcttcaaaatcgggctcatccctcttctcagccaaaggagcacaactcagcattactgctttcatttcctcaacatgcgatcaaactcttccgcactctcatcactcattctaacaatatcaatcgcttgtangtcactgtgggagtgcctacaagtggaatgaatgggtcaacgcctcatcttccgggtaatggaccagtgtccggggtaagtatacccccgcgtctttttccaaacacttaacatgtgcttacccggtatttcaaccaattcaatacttccatcacctggcgcatcaaaaacagaacccgtgttagtttatcatcaaantgcnggcatttcacatgttantaangggaacaacaaatatgcacatgaccattnactgacacaggnaacaaaattccatgtgtcaaattgtcgtaccncatctatcatgcgtcacttatccactgtnacaagtacccantcccggtgcccaggtaaagcgcaaactttncctaagcacc

SEQ ID NO: 91115 - DNA, 211 bp, Triticum aestivum
  Clone ID: PAT_TA_91115
gcgaccaggggcagccccgaccagggcggcggccgagtggatgggcccctggcgcgtcgcagcgcaggcgggcgcggcgcacggccaggcgcgacggatgagcgccgggcgagcgagggcgaagcctcggcgcaggcaagcgtggccatggcctggcgcagcgtgcgagggcgaggcctcgacgcgggcgggcgtagcctggctactccgg

SEQ ID NO: 91116 - DNA, 601 bp, Triticum aestivum
  unsure (1)..(601): unsure at all n locations
  Clone ID: PAT_TA_91116
gccatcttgccaaccatggcaccgccgcactccgcctggctgccgcacaccacctttggcttgacgttgaaagtcttaagccataggccgaaatgggggcggatgcggaggaacgcctcgcacacgacgatgaacgccgggatgttgaggacgaagttcggggccatattgtgggaaatccaaggccgttagtaagaacatgaccccccggacaaatggatgcagagggaacccatccgccggaggaatggggaaggaatacaacctctcaaggggctaaggatnggatnactcccttttttnggaagccgngcgcatttcctaancaaatatccggcttcctcaactttttgatgtgtcctcccaatgacanaggaacatcactttcctcccgctcccggacatnacgganaagtttaggtggtaatnccgatttgcgttgnccaagngggcccgtacnacaattccccctanangatctattnccccccaatggcgtcgtttaaantcggacnggaaaactgngttncaacttatcccntgagaaaccccttccactgngtataacaaagcccacgnttccttcaattccactatggan

SEQ ID NO: 91117 - DNA, 487 bp, Triticum aestivum
  unsure (1)..(487): unsure at all n locations
  Clone ID: PAT_TA_91117
gctaccttgctgcctcctgcaccgtgcggccgccgacgataggcagctgctcatccggatcaagcgcgtgtggcgcgacccgcccgtgctcgcggcatggaacggctcgggcgaccactgcacctggccctacgtcacctgcgatgcctccgggcgcgtcacgagcctctccctcggcaacaccggcgtcgccggaccgttcccgaacgccatcggcggctctccggctcactagcctcgatttgtccggtaactactcgacggcgaantcccccgcccgacatccggcgcgcgctccngggaagaactcaactctccggaagctcaaaggnaatactcaaacggacatcctcctcttgtcccngttaaagactgcatcctccaactgggananattctcgccnggacaccggnaantcggnactaacggcttnaaccgnaagctcgcaacatcgtnaagttggcaactccgggtcnttaaaaanct

SEQ ID NO: 91118 - DNA, 581 bp, Triticum aestivum
  unsure (1)..(581): unsure at all n locations
  Clone ID: PAT_TA_91118
gtgactcgtccccgtaggcgaagagatgttcgtcgttcccgcaaggtacgattgccgatttgcacatgcgcacttcgcttacgttggagtggcatgtgctgccctcggcgaaggatgcattgcctgtcctcctgatgacggtgtgctgccccagttttcctgcaccaagattgtgtcggcgtctgtgataggtacgcttggagatggagcagcggcgtctcctgatgagtaaccggcttgggccggtaagaggcaccaacagatcgctccatggaggggacaagcaagagagaagcaaaccnttgggtaacaacctccaataatactttgggacgctttgnatgcaacaanatcccacatcnaagccctaatggcaaaantgaaagactttcctgggacacgttacaatgacaattatgttatgacaaatttaatacccaccatgggatcaagnctnaagcgacantacaatacaaacctgcatccnaantnccatcaaaaaaaaantttcaaattgaagcaanaatacggnaataatcagaaaaacgntggcnatcaaaatgaaccttcccaagtcaaaa

SEQ ID NO: 91119 - DNA, 530 bp, Triticum aestivum
  unsure (1)..(530): unsure at all n locations
  Clone ID: PAT_TA_91119
gacagacagaacttgagagagcgcacgcgagatggcagcctccatgatcacctcgccgattgtggcgccgacgagcgtgccgtccctctcccgccggggctcctccttcgccgtcgtctgcagcggtggcaagaagatcaangtcgataagcccctccggactcggaggcggcttgacagtccgacatcgacgccaacggcaggaaggtccgcaagaaggcgtgtaccattttgtttgacaaantacggtgccaacgtccgacggtacagnccatctacacgcccagagaatggcctgatccgggtgaccgctaccccggcggaacgaccggctcctaaccnggcctcaacttcgnncgctcctccgggggggntctcctngttntaaaaaacnacgttctcncccgggtaaanaanatctaactnntanaaaggccgggctcngctggcatnaattcccngtaactgcntantacnccggtgaatgtttcaatcaacgatcaaatnatgtccaacagaaaaaaaaaaaa

SEQ ID NO: 91120 - DNA, 504 bp, Triticum aestivum
  unsure (1)..(504): unsure at all n locations
  Clone ID: PAT_TA_91120
tcaagatagaatcatacttaagtgcttgttgacatattatcaacagggaagttacattgccggcttccaaatatgaacaaacataaaaggcctgaaagcaacacggacattatgccgatccatctancctancttggcnaggacatcnncganaacagtcntngtctcgccgtacgtacttctctgcctcggtggggctcttnatcttngctgcatgcgtcaagcccgtccgagggtggcganngagcttgccggtgaggccgtnatgccgtcctcccctccttgggtgggtcttnnaggagataacnnctttatgtnnnaccgcacgtangaagcctgacgcngncgccgtcaanaagtaaggcattgnttctntctatcacggctgagtttgagaanncttcgcgatcctngccggacgcactccncccgtngancggtcaagaanacgatctttagggcaggcaaatcnctgcctcgtcnaatttccttcccgggatcaac

SEQ ID NO: 91121 - DNA, 567 bp, Triticum aestivum
  unsure (1)..(567): unsure at all n locations
  Clone ID: PAT_TA_91121
accatcgcaggaccgaggccaacaacaattcttcaccgaaccacttcatcaagctgtacgactacatcatcgtcttcttcagcacaacacggcatcgacatcgtagacacgccgctacatcaccgacacttcatcgccaaggtcttcatcaacgtggtcttcatcaccatcatcatcaacacactaccgccgcctccgtccacaagatggacatctagcgtcctctgacagacttgtctgcaagacgcgacctccgacgacggcaatgaccgcgtcacgacgacgacatcaactgcgtcatccataactacacgactgcatcgacacggcgtcactacagtggacgaccctacacggcacacggtctgggcaaaaccgatgtttggctcgatggnttcctccggccttgggnaaatccgtggancaacgccgacggacctcngacataacaaggngatcgtcaagtcngnacccgtcatacgatttttggcnctccggnttgtgcggttcataacaagangacaaacatnggcagattactcgacaggtaatncatgttggtaccca

SEQ ID NO: 91122 - DNA, 386 bp, Triticum aestivum
  unsure (1)..(386): unsure at all n locations
  Clone ID: PAT_TA_91122
ttgagcatttacccataagaataggattattttcaatgagtagttgtaggtgcaacttcggaaaagagaatctgataaagcttttcttgcctagagtcattgagtcattatataccttaattctattaaggatcttccgcggtcttatttctttcactcttgctcgagccggatgatgataaatctcatgtccggttcctttggggggatggtcctaaagagtcacctatcccaataacaaagaaaccagacttaaatgatcctgtattaaagagctaaataactaaagggatggggacataattattacggggaacccgcaaggccaacgatcttttaataattttccaagtaanaattccaaggtactaatgcatgttatgtag

SEQ ID NO: 91123 - DNA, 571 bp, Triticum aestivum
  unsure (1)..(571): unsure at all n locations
  Clone ID: PAT_TA_91123
gcgacggagaccgagaccttcgccttccaggccgagatcaaccagctcctctcgctcatcatcaacaccttctactccaacaaggagatcttcctccgcgagctcatctccaactcctccgatgccttggacaagatcaggttcgaagagcctcacggacaagagcaagctcgatgcgcagcccgagtcttcatccacatcatccccgacaaggcgaccaacacgctcacgattcgtncgacagcggcattgncatgacaatccngacctcctcaaacaactcgggacatcgncaagcccgggacaaggattcatggaggcctccccnccgggccgactttcangattgggcanttggngcngttctacccgctactctccccnaggtttgttcccaacaagcaaacacacacatattgggancaagcngggtctcacgtatccggaactcggggagantcgcagggtcaaaaggccctactaagggnacaaatggatacntagnggccccaggtnattaagacccggttaaagtnccanccgtgcnaaaccacanaggatttttnntttt

SEQ ID NO: 91124 - DNA, 610 bp, Triticum aestivum
  unsure (1)..(610): unsure at all n locations
  Clone ID: PAT_TA_91124
cggtgcttcagttcggcccatgaaccaatagagttggtcggcaagctcttcaaccaagtgcgagctgttccttccaacatcatggtgaaatatttagcacacaccgcctcatccacatctaacatctccattgccgtatcatagctctccacccacgcctctggctgcaaatcggtggtataattcggtaccttacgaggtcccttggaaatccttgggtagtccgcacattccgcaaagcaggagttaaacacagtacccctaangaactgaacatcgcccctgggtccacggaggcggtggggttaaccggagtatgctgtcgtgcttccgtggcgaagtgtcaactccngctctccaactncgcggcatggccacaacacttgcgnattacactccccaagcgggtgttccctcntggcaatttancggcgtgcactaatgggacacgcggttcggttcaagttctgcaaaatcctgctcnacgggatggatgaacctccacggtgttganatgctgcgtgattaggcatcgaggaatctggcggactgctcacgaacgggatccgtcgtttgaggcgcagcntaacacgcaaanntncaacggttg

SEQ ID NO: 91125 - DNA, 649 bp, Triticum aestivum
  unsure (1)..(649): unsure at all n locations
  Clone ID: PAT_TA_91125
cggagattcccaaataggtcaaccttttaaactgcctgctgaatccatgagcaggcaagagacaacctggcgaactgaaacatcttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccaagtagccgaaagcatcactagcttacgctctgacccgagtancatggggcacgtggaatcccgtgtgaatcagcaaggaccaccttgcaaggctaaatactcctgngtgaccgatagcgaagtagtaccgtnagggaaagtgaaaaagaaccccagtgggtagtgaaatanaacgtgaaacgtgctgactcccaacaatgggagggaaaatgnctctgacgcntgcctgttgaaaatgaccggcgaccatagcantggntggttaaggaacgnaccacggaccctacgaaacnatctaataggcattgcactggctntgacnaactggtgttaccatncagataactggttaatacaagtccacgnganttaaacacgtatttgtagggatcaccaccaactctt

SEQ ID NO: 91126 - DNA, 486 bp, Triticum aestivum
  unsure (1)..(486): unsure at all n locations
  Clone ID: PAT_TA_91126
gtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggncggtattggacaatgtggaagctgcctatgttcgggtgcactgacgcacacaagtgatnaacaagtggaggagtcaagaaggattacctgacccctatgtcgcatcancggattcncaacatcgtaagtgaatgcgtaactnaacgct

SEQ ID NO: 91127 - DNA, 512 bp, Triticum aestivum
  unsure (1)..(512): unsure at all n locations
  Clone ID: PAT_TA_91127
gcgcctcctactgtcagcctcagctcactcgaagttagcaatggcggccgcgaccatggcgctctcctccccggcgatggccggcaccccggtgaaggcctccagggcggcgcccttcggtgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgcgggcctctccgccgaccccgagacttcgccaagaaccgggaactggaggtgatcactgccgctgggcaagctgggcgcgctcggttgctccttccggagtgtcnccgcaaacgggtcaagttcgcaagcctttgttaaggcggtccaattttaattanggnggctcaatacttggaaaccaacctgtgaacncaaananctnccaatcngggctncaantgggncaa

SEQ ID NO: 91128 - DNA, 619 bp, Triticum aestivum
  unsure (1)..(619): unsure at all n locations
  Clone ID: PAT_TA_91128
gtcgataggcgacgcagcgaagctgcagagcattgacgtgtcgtcgaacgagctctacggcgagataccagcgagcatcggcaagctggtccatctcgagagcctggacatcgcggggaacgggatcagcggagccatcccggcgagcctcgggtcgtgctcggcgctcagcacgatgaacctcgccgggaacaagctcaccggcgcgatcccgtcggagctgcggggcacgagtctgaatttgttggacatttcgagcaatgaactctccggcgccgtgccggcgatcctcgccgagctgaagctgagctacctaaacctgtcggacaatcggctcgacgggcccgtgccggcggggctggccatctcggctacggcgagagcttcaaggggaacccgggctgtgcgcaacaacggagccggttctccgccgctgcacgccggganacgtngcgttcngggaacaccgcncgcangctcgtnactgctctcgcggnatggcgtcctgctcgcctctcgggttgngattcaacaagaagcncggaagncccgangccggcatgncgggncggaagctttgtnccaanaaggtctngactaatcttcagtatggtcacac

SEQ ID NO: 91129 - DNA, 237 bp, Triticum aestivum
  unsure (1)..(237): unsure at all n locations
  Clone ID: PAT_TA_91129
ancntccccctctcgctcgcatcanaacaaacgcgctcggngaccatcttccggnactctccccccgtccccgtcgccaccggcatggcntccgccgtctccgtctccctcgccgcntcctcctcgcncctcgcagcnatctcncgcgcggnggcgggggctcgcgnccccatcaancgctcnnggtcgtccgtcgcccgcngtcccaagcccatgccctcnttgcngactctggtt

SEQ ID NO: 91130 - DNA, 335 bp, Triticum aestivum
  unsure (1)..(335): unsure at all n locations
  Clone ID: PAT_TA_91130
agatcacatcgtatcatgggagcattttcgctcccgtatcacctgatatgcactccccaccccggtccgcacctgccagcagccggtgacgttgccacccggaagttaccggcgccgccggttcccaccccaccccgtctctccggtctctgccttgaccctccaactcttcccaccttcttcgggcaggcttcgcttcagctcagctgagtanggagctgcaaanatatttcctttcttcttttccgtctgcccccccaactgctccgcactttccttctctccttcctttctcccgatctgagcaacacccaagtcgctcgctcgattgatcn

SEQ ID NO: 91131 - DNA, 618 bp, Triticum aestivum
  unsure (1)..(618): unsure at all n locations
  Clone ID: PAT_TA_91131
cctcctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcancacggaggccctcctcaagcaggtcgactacctgatccgctccaaatgggtgccttgcctcgagttcagcaagttgggttcatcttccgtgagcacaacgcatccctgggtactacgatggcggtactgggacaatgtggaaactgcctatgttcgggtgcaccgacgccacacaggtgattaacaagtgggaaaagncaagaaggatacctgaccgtacgtccgcatnacggntcanaanatcncaagtgcatgcgtcagttcatcgcttaancaaccggctcaagatccggnaaggctaaanagtcatcacacggcaattaaatgcatngggttntaancnaatgcttggttcctccaatacttctgttgtc

SEQ ID NO: 91132 - DNA, 650 bp, Triticum aestivum
  unsure (1)..(650): unsure at all n locations
  Clone ID: PAT_TA_91132
gtcaatttttctgggtttttttgaaacttttaagaatgtcttttttgaatttggagcacccggagtcctccaagcatgggagcattggatactttcccagctccaaggctcttctgaacccagcccatctgtttagggaagagcacaacccatctaagtgagaacagcccaatttggttcggtagaaaaacagcccgattatttgagagggagcccctagtcagcgctgcaggcgcccgctaaggagctggcgctcgcactgtcgctgccatgtgccggcccacgagcgcgctcgctcgatcgctcggggaaacgaattccatcgctagatccgtcgttggctcggatgctcgctaggagccagttttttatgtctcaaaaanaaaggagcattccccgttttttgctgaaaaacaccagtttcctattcctaagaantaaaaacangttacaaatgttaagaaaaattctgcatttgaaaaactcaaatcttcaaaaaggtaacgattttgggaaacgtcaatgtatgacaagtcaatgattgaacaantcaacagattgaaaantctaatctaaaaatcacaantttaaaaancacaaatnaaaannacaatnaaaaaatcacaattgaaatacaatcaaattagatt

SEQ ID NO: 91133 - DNA, 449 bp, Triticum aestivum
  unsure (1)..(449): unsure at all n locations
  Clone ID: PAT_TA_91133
tgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacngcacctgcggtgggccctgcaagaagtactgatcggctcatgccagcatgatatgttccgcctaaaatgaaataaaagctcagacganatgagcagcgtcatcgtncctatgcgtgtgtgtgtggccaancacatattatancantangccgtgtcttcgtcactgtgttttcctccnaaggggggg

SEQ ID NO: 91134 - DNA, 179 bp, Triticum aestivum
  unsure (1)..(179): unsure at all n locations
  Clone ID: PAT_TA_91134
atctgttcttatcantttaatatctgatatgtgggtcatgtgcccacaacgatattaaatttattttttgtgggggagggctcatcacagtggcttgccactggggccctcangtgtcgcccagtgcgttgcactattgcctgggcangcgcaccccaattaataaaaaaaaanaaaaa

SEQ ID NO: 91135 - DNA, 522 bp, Triticum aestivum
  unsure (1)..(522): unsure at all n locations
  Clone ID: PAT_TA_91135
acaagatcgtccacaggtgcatagcctgtactagatatcttagctagcttcaaatcaccatgtctatgtctctcctgccgcatgccacggtgttcctgttcatcttcctagtggcctcaccgtctcaggttcatgctcgggttgctccggatgatcggcacgcgcatggcggccaaggttccagtagcaccgacatcgccaaaggcgatgctccagtgacgttgacgccagcttatgcaccaagcgaacgacggcgctggtcgtggccggacgctttggtcgacgccgagcgacggtgttggcattagctacatgctcgtcctcactctgctttcgttgccgttgcttcttataaaacttaatatacattcacgtggaagattggaagtgcagtactagcagtantagtaaaatctcaagagaaattgtattcntttccgataaattgatggcgttctggtcgcacttcctgtnnttggtcagatgatatactgaactcatatatcctctaaaaaaaaaaaa

SEQ ID NO: 91136 - DNA, 414 bp, Triticum aestivum
  unsure (1)..(414): unsure at all n locations
  Clone ID: PAT_TA_91136
tcgagtttttttttttttttttttttttttttttttttttttttttttttttgttgaacatcttaaatacatgatcaacattttttgcaaatacttgttcaacacttttgaaatacttgtttaacatttttcaaacatttattcaacatttttatatacatgatcaacatttttcaaatacttgttcaacactttccaaatacttgnnaaaaaaattcgnangcttgantaacgttttccagaatccttgntcaanatttttcaaanacangttcaacatttttcnaacacttgantaatanttttcanatactgtccaacatttcttcanatnattgccaacaatttcaaaangattgnagtaacattttncananaccgtcaatattttaaaatgcggnannaacatttttc

SEQ ID NO: 91137 - DNA, 641 bp, Triticum aestivum
  unsure (1)..(641): unsure at all n locations
  Clone ID: PAT_TA_91137
agccatgggcgacatccatccctctctcgcgacccagcccatgcggcacggccatgggcgccgtggcagggaagactagggtgcatggtggctgctcggcgctgctgcacgggaggtgccgggcgctgctgtagagtaacngtatggaaangaggagaggtgaatcggggaaggtacaaccatggcggcggggggaactgcnancaacggngcctgncgctgcanccncaatgaccgaagctacatccggtggcgcgcggagctgcaaccgcancganctgnagctgcaaccgtggcggngaccggganctatgacgtcnatgatgctggaaccgaccagtttttttgctggaacgggcgacangangtgctacaaccgtngcagcanaatgttggaacaacagcacggcttnacanatngggaaacggcttttaaaaacttaaacatgtnctgggaaactgaaacgcatcacaaaactcaagcctttaaaccgnnctncaaccgaaagtncaacacaacacttgatttttccaatgnactttctgnattgnatataatnctaacacggaattaactntncagncgcaacgatatgagggnttctgctaacttcgatattttnactccaagnntcccggat

SEQ ID NO: 91138 - DNA, 637 bp, Triticum aestivum
  unsure (1)..(637): unsure at all n locations
  Clone ID: PAT_TA_91138
ctctattgaatctccccctcctccgaatcgacccccaaatctatccatcccctcttcttcaactggcggcaggagggggaaccctagttctggcttgattcacttgagcttatatatgtctcctccccaggctctctctcctgggcttccacaattatttgggctgggctttaagcctgcccagttttccaagtcatcggcccacagctctatgatatcgttttcaggaatgattattttctgtctattatagtcaatctccaccacgcaatcaggaacatatatgacgaagtcatcgtgcccaatttctgaccaatagcaggtattattgatgctttttccatgagatctttggactatccatccatctaaataattccccctttttcaacatcccctcccctaatcactccttgcacttaancttgcangggttcttccttttcccgatcgggngggacacnactctcgccggccaacgcaacgcgcgcaaggaccggaggggtcggaggacctcangggggccggtacaaattccccnaagtgatcgatacgccgccacggcgtcnttaaactcggacggaaaccgggtacaattancctganaaacccttccanngggtaacaangcnacgtn

SEQ ID NO: 91139 - DNA, 537 bp, Triticum aestivum
  unsure (1)..(537): unsure at all n locations
  Clone ID: PAT_TA_91139
gcgaaactcattgcaaaagagggtaaatcggccactttaagattaccatctggggaggtccgtttagtatcccaaaactgcttagcaacagtcggacaagtgggtaatgttggggtgaaccaaaaaagtttgggtaagagccggatctaagtgttggctaggtaaacgccccgtagtaagaggggtagttatgaaccctgtggaccacccccatgggggcggtgaagggaaactcccattgggtaagaaaaaaaccacaacccttgngggttatcctgcgccttggaagaagaactangaaaaggaaaaaatatacgatantttatcttcctccccgtaagtaaatactaactnggaatatggaaattgcatttttggattttgcaataatgccatgggcgaacgacnggaatttnacccnncatggnggntcacaaccactgccttgttcacttgggtaatccgccccttaccaactaaagatttttccttttccattgacatanncanttatccgacnccgactcgntnaaaatg

SEQ ID NO: 91140 - DNA, 525 bp, Triticum aestivum
  unsure (1)..(525): unsure at all n locations
  Clone ID: PAT_TA_91140
cttgcaggaacaatggcagcccagggtcttctctctgggaggcagctgctggggaggcctctgcagtcctccatctccaggtcgtcttcctcccggaagtcccccttcgtcgtcagggcatcgtccagcccccctgccaagcaaaatgacaacaggcagctgtggttcgcgtccaagcatccctcacctacctccgacggcacgctgcccgggtgacttgggttccgacccttgggggctgtccgacccggaagggaccggcggntcatcgacccaagggntgggctacggcgaaattttcaacggccggacggagatgggttgnnnggcataatnnccccggnagccctggcaaggtgggcttggtgcccccgggaaangnattcctggttcaagnaaggcattccnccggnggcactacaattatgggccaccataacccttcgtttcaaanggccatngttcnngacacgggtcanatggaaaccggccatggaaaatatcgggcttanaatctcgggtcgg

SEQ ID NO: 91141 - DNA, 626 bp, Triticum aestivum
  unsure (1)..(626): unsure at all n locations
  Clone ID: PAT_TA_91141
ctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggccatccnagggcatcaagaattccgagaccctgtcttacctgccaccgctcagcacggaggcctcctcaagcaagtgggactacctggattcgtccaaagtgggtgcctttcctttgatttcancaagtccggttcatcttccngtttananatgcgtctcccgggtactaacnacggccgctaactggacatgttggaactgctaatttccggtgcaaccgacncaccangtgttaacaagttggaggagtcaanaaggataccctgacccttactccgcanaatcgatncaaaaatcncaanggcannctcaactaatgcctaaaccaccggctcaaggatccggaaggctaacagtatacacgggcanattaaggcattagtttgcatcgaatgcttgtttctccattcttctanttccananagtgagtcagtanaaaatgncaaactgccttt

SEQ ID NO: 91142 - DNA, 486 bp, Triticum aestivum
  unsure (1)..(486): unsure at all n locations
  Clone ID: PAT_TA_91142
agaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaaggccgccggcgccaccctcctccgtctccgccaccgccacccaaaaggcgagtcccggcgggattggagatggccggcccgaaaacggcggctgcggctgcacccaatgcaagtgcggcaccagctgcggctgctccctgctgcagtgctagattcacatcgatnatgcatcacctnccgtgcgtcacatcgattngtaccgattntactactacatacaattttaccgcaactgatnnaaggcttatgttccacctgactgcatcaacatcaagtgcatccatgattttaacagccccctnaataaactcccttgattaactaanaaaaaaaaaaaa

SEQ ID NO: 91143 - DNA, 523 bp, Triticum aestivum
  unsure (1)..(523): unsure at all n locations
  Clone ID: PAT_TA_91143
ttttttttcaaattattcggattttaatcatttgtgaacccatgcataataacagtactaggccagtgaaactatacattgttagccatagttagtagtattacctggtggtcctccacgccctgtaggtatgcatgtgcactcactgngcaagaatttcactgctgaagagttgacttgngcatctcatctgcacttttgtggatggtgggaagaccttgctatgcttcatgtcgacacgaatcaaacactgngctttnaacccgtgtcaccgtcctccgtcacgttcaagtcagttganngaacaagtagacaactctcctcctccatgctcaacaacgggaacgacggcaagactccggcaagcccaacaaatgtngtccactttccaaaagtccccggcatggganacttgtctttcttccaacggaaaggtcgcaaaactncaaatgcagtgtaatnaatgnngggccggccccanaccatcaagggggaatntttacccacnatcaggaagtacgaa

SEQ ID NO: 91144 - DNA, 556 bp, Triticum aestivum
  unsure (1)..(556): unsure at all n locations
  Clone ID: PAT_TA_91144
gcaaaaacatttacatttgacagaaagtgagaagataacaagcaacaccacttatatttgacacaaagtaagaagatcacaagcaacaacagcccatggaatattggaatcaacaagcagcaaacagcggaccaccatcacttangtacttgataacatagtacttgacatcaaacaaatcaattcaagcaccaccatggaccttgtgggttcccttcacctgngtccccaaatcttcaaaccatctcttcanctgcgatgtgggagaaatgaaggagggcagtangaagcgagccgacgaacagagttntaagaagacaagggtgatgagtngtgaatgggctgcaactgctgacaatcatcngggcgccggacaccggcggngacggcccatcncnggcaatgggacacgaacggggtcnggattgnggncaagnacatcccactggtcaagggccgggtccggggccttttaaccttaagggngcccccccctcnatcggngtctcacggnaaatccatgggaatgggcttagcaaacggnggggcaaggttt

SEQ ID NO: 91145 - DNA, 267 bp, Triticum aestivum
  unsure (1)..(267): unsure at all n locations
  Clone ID: PAT_TA_91145
gttccttttcctcgtgttgacgagtctggccggccaaggcgtgtggttaaaacctacatttggcacaatgttgggacgcatgttgagaacgctgactgcattgagtggcaccttggctctgttaacgacagcaatcccagaggtgatttctctgtgngattactattacgatggtgggacttacgatatgggagcatttttcccatagccaaggggggggggccccgggtacccaattcnccctatagtgatccgtattacgcncgc

SEQ ID NO: 91146 - DNA, 638 bp, Triticum aestivum
  unsure (1)..(638): unsure at all n locations
  Clone ID: PAT_TA_91146
agggaagttacattgccggcttccaaatatgaacaaacataaaaggcctgaaagcaacacggccattatgcggatccatctagcctagcttggcgaggacatcgccaagaacggtcttggtctctccgtagtacttctcggcctcggtggggctcttgatcttggctgcatggtcaagcccgtccagggtggcgaaagagcttgccggtgaggccttggaggccttcttttcctccttgggtggtcctgggaggagatgacggtcctggangcctaacgcaagtaaggaggcctcaaagcggagnccttcaatgacgtacggcattgcttcttgtcnatnagcgctttaggttnaggattcctgggccgatcccttggcccngaccgccgctccgccggtggcaacggtgcaagtaaaaccgtctncnagggaagncaattccttgcnctcnggtttcccntccggggatncaccggaaacggnggnggggcaactnaatgcccaaggtccgggtcacactgacnacgcctccacaacgcngcataggcaaggacnccgcgccgngctcgctcgcagagcccaataactgtggcctccgccgcctgaaanccctgaagcgcagccatgttncacantt

SEQ ID NO: 91147 - DNA, 425 bp, Triticum aestivum
  unsure (1)..(425): unsure at all n locations
  Clone ID: PAT_TA_91147
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcagtgtgggccatcnaagggcattaaaaattcgaaanctgntccaactggcaacgttaacaanggnggcccctcnaacaaggnnaaaaccgattccccccaaatgggngcctttccccaatttanaaggggnggttaaatcccctttngaaaaaanacncccgggnntaaaaaaggggggnttngggaaatttnaaannccaatttnggggtacnannccccccgggttnnaaggggggggggngaaaaaaggtacc

SEQ ID NO: 91148 - DNA, 298 bp, Triticum aestivum
  unsure (1)..(298): unsure at all n locations
  Clone ID: PAT_TA_91148
gctggagctggcatgtaacttaagctttagagcctctctttctatcaggaacaagccttatagtggggtagctgaggggaagcacaatatcctcaatctttgagcccttattcacacccaaattgatccattgtgagccaaggttcataacagaaagaaaagccagaatatttcccaatctatgttaagtagaagctgtcagatagtctaactttcggtctaacttctgggagnactcctagatggtttgcatgtttttcngcctaacatcacatgttaattcaatccaaaccttttc

SEQ ID NO: 91149 - DNA, 614 bp, Triticum aestivum
  unsure (1)..(614): unsure at all n locations
  Clone ID: PAT_TA_91149
tgcttgtgtgtataaggcctatgttatagagtatataacttcgatcatagggatcgatttctagtcgcgtagcttcataataattttgcaaagcttccgcataatttccttcggattgagccaacatccgttacggtccgttcattctattcaaaaaactccgttccaaaaccgtacatgaggtttcatctcatacggtcctcccttctgtacataaatagtactaagcgaaataatccaatagaatcaaaataaaattatccccgtcncaattatgaaccnaaaagggggggatttttccaanaancccctancaaccttccaaaanaggttttcttaacaaccangatccattnatgcanganggaaacnatancccanattcnttggtctcaacgccccnattaaagggattaactactcnacatctttatgggtaaaagggnaccaaannacaaaccgangtggttgtntccaacatcttccancctgatacgtangaaaggnagntcaanaaatttcctgngagtccattcagngaggnttctcccagcgcacgaacaanaaatagatggctnatcaacaaacanaccgtgggnacttctcaacaacna

SEQ ID NO: 91150 - DNA, 404 bp, Triticum aestivum
  unsure (1)..(404): unsure at all n locations
  Clone ID: PAT_TA_91150
acatgtatgtgatccaatcgtccatctacatctggcatgagcatcatggacgcctccacctgaatctcacacatacgcccgcggctagcgttgtgttggtagctaaaccgttcacttgtagatccattcngtcggagcgcttgccgccgccggcggagtcgacgtcgatgaaagatgctgacggccttgccgatgcggnggcggccttggtgggctcaaggaagttgcggacgttgggcgacggcgccccaagaagcggagcgtgtttggcacgtccgtccnaggcggagcagnaccccccccctntnagcgagaagagaccgntccccggnattacaatcatttacatccncanntgttgccccanaanaacctttgcggangancacacgtaanactccccc

SEQ ID NO: 91151 - DNA, 648 bp, Triticum aestivum
  unsure (1)..(648): unsure at all n locations
  Clone ID: PAT_TA_91151
gctgtagctgctgcttcgctgttcagtgccactgcaccttcgttctgtcacctgatgaaggagacgagcagcagccaagccacatcgagctcatacacaagctgcccgagtccttggccagaactgcccaagtcgtcgcctctttgcaccctgcagtgttaccgtggacgcaggcacccccggattcggaaccgcaagcaccaagtacaccaccccgcaaagacctgggacctccgggacacgccaantacccctttccgagtatcaaataccgcaaagcgccaantccaacgacgaccaantaccgcgagacgttataccgctatcatccgcaagaatccgagaccgacaattctggaagaagcaagtacactcccgaacaatgtacgacaccntcgccgnagacccgttttacacaaactcaanttnactaccntcgcgttgacgtacttccaaggagacccgttgacantnttcccccttgacactgtncctacgntcaancgnttgtcccgctacagctccaaagnatacncaaggggggccgtaccaatccctatatgagnctataggcgctnatggcgtcnttanactctgacggaaacctgcgtancaattatcncttcagaatccctttcanngtanaca

SEQ ID NO: 91152 - DNA, 378 bp, Triticum aestivum
  unsure (1)..(378): unsure at all n locations
  Clone ID: PAT_TA_91152
natcanaccctttggncatggngtcgcccatgctctccacngacatggagccactccancggggcatgctggagttctcngggctgaggagctcgtcgtcgctgccgctccggcggaatgccacctccnacgacttcatgtccncggtttccttcatgacgtactcggtgancaccancagcgggtcngcgcaacgcgccgacgganggccaaactcaacgtggngatcancnggttctggcgcatcaaggcgcaattccttcccggtgcttgaanggacggccggcnanaaatcccccccgnaggngnttgccatcaatcaanancacaggcgnnaagaaggagnccnactcctcattaagaancaaaccangggaa

SEQ ID NO: 91153 - DNA, 588 bp, Triticum aestivum
  unsure (1)..(588): unsure at all n locations
  Clone ID: PAT_TA_91153
atctccaaccccggcgcatcccagccccggcgccccaccccggcgcatcccagccccagcgccccccttcncggcgaccccagccccggcgcgcctcagncccggcgcccccagccccggcgaccctagccccggcgcgcctcagccccggtgactcccatctccggcctcctccctccgtcgccgccgcgcctctcgccacctccctccgccaccaacccagatnnctccgagcaccgtgngccatctcctgcgattcccgccaccgcctgtttctagcgcggttctccgcctcccagcgacgacgangaagatgacgggggagctgnccgtcttaacncatggtgcccctggtccttggatntcgctcccctcnggntacctactcgctcgccggnnctcttctggtgaccatcgcgcgtanacntaaatcccaagctcttanattaangncgncgcangcaaactatntcgtttttcttatacacctgtncctgtagagttctcnctgggtnacaaaaaccangtanttttaacctttatnctttncaaagtcttntannaaatgtttatngatttccntggagg

SEQ ID NO: 91154 - DNA, 640 bp, Triticum aestivum
  unsure (1)..(640): unsure at all n locations
  Clone ID: PAT_TA_91154
cgagtttttttttttttttttttttgttttttcggtggggtgggggtttgagattattttacgaccacatcgttcattaaggtgtggacagattttatataaataagaaatttagcagaattgacaaataaattctatttgaacttcttgcattttagtagttgaagtagtcaaattttatataaataagaaatttagcataattgacaaacattatatatttgaaattttcgcattttagtagttgaacttgtcataatagacaaacattatatgcttgaactttttgcgttttaagtagttgaacttgtcagattttatataaataagaagttnagcataattgacaagcattatatgtttgaactttttgtgttttagtagttgaacttgaaagtaatatttaattcggttttaaaattangtacatttancagataggcattaattctctccttttagaggtcatggtttggatcanattcccctttttcttgganaggtaattgacaaacatttctgtattaaattcttggccncccnggtttgttaacgggctannntgggtgtttgtgacancaagcatgtnccgttgcngcctgaaacctcccggcgtcaccggntgncatccncggttanc

SEQ ID NO: 91155 - DNA, 622 bp, Triticum aestivum
  unsure (1)..(622): unsure at all n locations
  Clone ID: PAT_TA_91155
aaaaggtgctgcattgttttattcaagaagtactgctatgaatgcagaatgatacaaatagtgcaataagcaagggacgggcctattaaacatgtcccccctctaggggtaggctgcggagtggtgtataaaacagatttaatgctcgtaagggagaccacctggatattcgtcgccgcctttctccttccctgggctgttgcatccgtgatttggccagtctactgccggacagggctctggtaaacggatcctgtgggtaagaaaagaaaaaaggaaaaagaaaaaaagaaatgacacacttnggagccctgatgtgtttaaccgcattctgggctgtcctggtccgtccccttccccctaatcccatgggtactccaaaagcttaatgatttacccaaagacatctncnattttncnaaaggtgggttngggncccattgctacncatgctcngaaccncaagtgggctgttgtagnnactcgggccctttggcnttcngtcctaangcggntcanaatncctaanagcgcaatgtctctccccaaacccttatttcntttcgaggacccccgtnttccttacttatanccccccanggggcggacattcccaaagntt

SEQ ID NO: 91156 - DNA, 462 bp, Triticum aestivum
  unsure (1)..(462): unsure at all n locations
  Clone ID: PAT_TA_91156
gtaaaaccctgcgtttgcaccaaaatcgcagctcatagccttttctgagagtaactagggaattttattcaaagttcaagacatccgagatacaagcaatatctgggcaaatccctagccacacatggcgacccatcgaaagagacgcagctccttttgctatcgagtggggcctcaaaattattatccctacgctcaaaacggaatgaaacagtaagaaaactattcctactaacaagaattcctttatgatccggagcataaactgggtgatgcattgttgttgatgttccgagatcacctcaaagcancccgaggttatcaccagatttggaagattccaatcccgactaatgcaaganttcgctgcatgcatgcactccaaacccccggttnaatccagncatcataaaccacagctgaacccctaagatactngcctgtgctaccccacataccgca

SEQ ID NO: 91157 - DNA, 429 bp, Triticum aestivum
  unsure (1)..(429): unsure at all n locations
  Clone ID: PAT_TA_91157
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatccgagggcatcaagaattccgagaccctgtcttacctgccaccgctcaacacggaggcctcctcaagcaagtcgactacctngattccgctccaagtggggtgcctttcctccaattcaacaagttggntcatcttcccgtntacacaaccatctccctggggtactacgatggcggtattgggacatgttgnaactgcctatttcngggtgcactggacgcacacaagncngggttgnnaggaagg

SEQ ID NO: 91158 - DNA, 503 bp, Triticum aestivum
  unsure (1)..(503): unsure at all n locations
  Clone ID: PAT_TA_91158
gcgcgccctattgtggtggccctctctagtagatttatccaccaacatttttattaacctcagaaaaattctccataaattttcagtcaattccaagaacttctatttctgcacaaaaataacaccatggtagttctgctgaaaacagcgtcaatccagattagtttcattcaaatcatgcaaattagagtctaaaacaagagcaactgganggagaagggggacagccacgggtcggccagctccggcgatcgatgagcagatccggctcgatccctactgcgtcttctatcggtacttctgcgagaaggatggcaagggcnccgagaagtgcaagggcaaccatggatgatcttctccatcatagccaaacatgtcaaaatttgatagcccgatggnatgttagtgatantanccggacgatgtgtgtaatgcatcgtttangtagttgcacgattttgttgcatttgaggnatacaattgtgngttcngtttgcaaggaa

SEQ ID NO: 91159 - DNA, 648 bp, Triticum aestivum
  unsure (1)..(648): unsure at all n locations
  Clone ID: PAT_TA_91159
gctgagcttcccttttcaagttcctttctaaagcaggcagcacattgcctaaccctgtccgtcccttcccagtggggcctactagctgcctattatcacaatctggcgggcctgcatcctggcccattaaatgattgggttgctagtcgtatgctggccattgaattgtgtagtatgcagctagtaggctggctttttttgtcatatttcactttttgcatttgtcaccattatttgttgttcttcaaatcacctcataaaagaatataacacaacaatttttcgcacattcatgaattttctaactgtcagaacaaataatacaagaaaaatatatatgtgattcaaaattatttcaaagataaaactaanaagaaatatttaattaacaagtgaaatgaaagagaatgtattatcctgcataattgaattgtaaaacgtcggnactaatgaaagaggaaaaatagattgattcaaatattgaaatattataagaaatgaaatacntaacatcatggnatgcacacattcaatgcaacagtaattaggcnacnggatgttcaaacaaaatgtgagatagataacctnaggtaacaagtattgaccanacaattaccacctaagttaaaatgnngncaagtataaaan

SEQ ID NO: 91160 - DNA, 603 bp, Triticum aestivum
  unsure (1)..(603): unsure at all n locations
  Clone ID: PAT_TA_91160
gtcgttcctgcccttggtcttagtgagatgaacggcggctctatataaggcagggcaatcaagtcacttcaacatgtctctcaagcagcaactgcttccctccaatttccttccgaacccgacaggcgacaggcgacacgaaggtaaccgcccccgagctcctcatcgtctcgctctctgctaccctgttccgcagtccgggtctccagtggagaatggangggggggaactccggtacctgtcgcctgcggnttctcctgcgtctccaancgagcgcttcngtgggcnccgcgggaagaactgctcgatccatccctcgtccgcgtatcccgacggccgcggaagggaagcctgtccgttcnccaaaatgggggcataacgacggagagcactcaatcgcctcatgtgctctccnannacggtaattcgccgttccaattntgggggcaaacaacaagtcacaagcggaaagtctccggcnnttccnacgtananaatgctctggcctgncnaacanggcnagtccnaactcgctcaagcctcgctaaacgnanaatnactgttcccccccagactcaggccttaggaaangnattcccgtc

SEQ ID NO: 91161 - DNA, 486 bp, Triticum aestivum
  unsure (1)..(486): unsure at all n locations
  Clone ID: PAT_TA_91161
aagaagcacacaagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcatgcatgcaccgcgcgtgcacatcgatcatatcgatctactactaccatacaatgtaaccgctacctgatcaaggccttatctatcacctgacctgataanaatcaggtgcatgcatctntttaaanagcccctaaataaatccccnggttaactaaaaaaaaa

SEQ ID NO: 91162 - DNA, 535 bp, Triticum aestivum
  unsure (1)..(535): unsure at all n locations
  Clone ID: PAT_TA_91162
agaccatcacccttgaggtcgagtcctctgacaccattgacaatgtcaaggcaaagatccaggacaaggagggcatccccccggaccagcagcgtctcatctttgctggcaagcagctcgaggatggccgcacccttgcggactacaacatccagaaggagtccactctccacttggtgctcaggctccgtggtggtatgcagatctttgtcaagaccctcaccggcaagaccatcaccctggaggttgagtcctcagacaccattgacaatgtgaaggccaagatccaggacaaggagggcatccccccggaccagcagcgcctgatctttgccggcaagcagctcgaggatggccgcaccttgcggattacaacatccagaaggagtccacctccacttggtgctcaagctccgtnggtggatgcagatatttgtgaagacctcaccggnaagacatcacctgaagtggatcatctgacacatcacaactnaagggaagttcangcaaggggggatccccgncaaaaagccca

SEQ ID NO: 91163 - DNA, 160 bp, Triticum aestivum
  Clone ID: PAT_TA_91163
tgaatagcaggtgacaactaatcaaaatgacatatgaacgacagggaagccggatatttagggcctgttcggagggcctccgctccacgaggccgctcccggagtcgacgggagttgtagttaaaaagtacggagcgagagaaacggtactctgcagatt

SEQ ID NO: 91164 - DNA, 635 bp, Triticum aestivum
  unsure (1)..(635): unsure at all n locations
  Clone ID: PAT_TA_91164
ctgcttgaccttcataataccaacgggaatatggtacttgcngaaatggtcattgaatttagtccaagtaatttcttcgtccgnaggccacatagccttagnatttccgcaggccacatagccttancattatcccaccatatancagcanctccctcaacatagtgcntanagaacggaaccttgtcancttctttagtgcgagcaatctcaagcttcttctcaatantccttaaccaatcatcngcttccataggatcgataacttgactgaaactgggaggcttggntctttgaaaatctgacaacttggagtgatgaccattcngatttccattctgcccaaccatagcttgtacacttttcaatagctcaatcagatcgttcctccttctttcntcaaacatacgcatgatttgctcactggagggtggtgtgtggtggacgcatggtggctgatatncctatgggaaagtcctgctgtctgctgaacgacaacaaggacatctnanaagcgtggctgcanaactcccgctcaanaatgntgttttcaatataacaaccggatgagatntcaaaatggannaaacatgcatccaaagaacacacaaaatcagggataaaggtcactatnn

SEQ ID NO: 91165 - DNA, 254 bp, Triticum aestivum
  unsure (1)..(254): unsure at all n locations
  Clone ID: PAT_TA_91165
ngttcanctnactganctcncangcagncccagncaccaacganatggtcgngtcngcgatgcaccanacnacaagcttcctcggcaccgccccgcggcgcgatganctcgtccgcancgtcggtgactttggcggccgcatcancatgcgccggaccgtcaagagcgcgccccagancatctgggtacggcctgaccgtcacaattacctgngccttctccgagnaanccccgtcgtacctgaangggatccg

SEQ ID NO: 91166 - DNA, 359 bp, Triticum aestivum
  unsure (1)..(359): unsure at all n locations
  Clone ID: PAT_TA_91166
aacagaatctgtcaaaaacagaacagtctgtagcaatgtgtaactaacgcacacttctggaactctaaaaancctaccaaantaggaannccggtaaaatttgtcnattgatcagaatcaaaaagaatcaacgcaaaatcacgtttatgtgacttaactaaactaaactcgtgcgtgcaaagtttcggtttttcaagcaagagtcacatcaactatcatcataggttatcctatagttctacttgggcacaaacactaattaanagataaaaacacatctaaacagaaggtagatgcaangtttattactaaccanggaccaaanacaaaaacccaangaaattgggntccccccaaaa

SEQ ID NO: 91167 - DNA, 643 bp, Triticum aestivum
  unsure (1)..(643): unsure at all n locations
  Clone ID: PAT_TA_91167
gctagaagtttggaattcctgcatcatagctcaattgtcagtattccagttagaaacaacacgggtaccaagaaagaatggtgatggtgagaagtatcactataccaagaattcttaataggtgaggcaatacccacaacatccttgacataaaggacaataatacttcaaggtagaacataatacaagctggatagcaagttgcacccataacatgaataagtttgtgatgaaaggaaggtaagaatgttatcgatggtaactcaaaatacgaagggacgaggatggcactaatcatcatgaattcatttgatatactggaaggagtcaaaatgttgatgatgatcacgtcaaattttgtcgagaggctccacgaagaagcatcgaacaacgactgcatcaaacaaaaggactgatgcagtgaaacttattgggttcacggatacgacacaactcgaagtcaagctgctgttcaagtgaacgataagacgaggaagattgatgtagctaactcancgtctaaatntacncgggaataagacaagtacacaattaaacanncatatgttaccatgtggaataatgctnaagntattaancatancacaattnctaagtgtnannaatgaaattatccaaccng

SEQ ID NO: 91168 - DNA, 663 bp, Triticum aestivum
  unsure (1)..(663): unsure at all n locations
  Clone ID: PAT_TA_91168
atgacaccagccctcaccccctgtccttgaccacggcatcgcgacctggcataccagcggnggctgagctcgctcaagggccgagacctgaggacttagagcactaaggagagtgtggggaagaaagggaaagctcgcgagggcctaacctagctacgccacagctgccgacgtacaagtccggcacaacgcaaggaagcgaccccatattaccaagataagtctcgcgcctggaatagctaatcgttgcggcgcgaaatcttcacttgatgtggctctatgatggcaacgttaccttcctttctcaactctcggtgggttgcttgcatgctaaaggggacctcctgagcatcgcgcctcangggctcttactgggacctcgggccgctcanctcctggccttgacaacnacatcgcgacctggcatacaagcgacggctgcanccggcatggggaccggaactgtancgtanaacgctaagccttcgcgaggtnagaaganggaacaagcgggacaggcaacattccacggtnataataaggatacatcatcaanagnatcaggacctttnatccccacgggtgtttnncatcatccaggaacaaagccngaactaagngcctatactagctcatgcgaacatataaatggcatgaggcgnn

SEQ ID NO: 91169 - DNA, 599 bp, Triticum aestivum
  unsure (1)..(599): unsure at all n locations
  Clone ID: PAT_TA_91169
gagcactaccattgccagccatacctgcaacaagtcctccaagccctcaccttgaactttgatttgaatctgtccccaatctgtctccacccagggccaccacctacaccactccaggtcgctgctgggcaccctgctccaccacagccaccgccagccctgatttggctctccaccgcagcaaaaccggcccaacacctccaccacagccttccagcagccccgcctatcaatccgcgcaatcctgcataatcctccgtcatgctccgatacatgttgttgatttggganattggggggcaaaggcaaggttaaggaacgataaagagagagntttttccnggacaatcgttccttcaacncttcantctaaggatataaagcctaacctanattcaacctttctanaattaactattaaatcttatacngcaacatttcaaattaagtctaaaagaacaagnatcttcgaatttcaaacctttttttcgncaagaaaatctgtatntctgaagggacctnngaaatacaaaggtgaaaccaagncgtaatacaanagggtctcaagtaaanttnctnatcaagatcatggncaaaca

SEQ ID NO: 91170 - DNA, 552 bp, Triticum aestivum
  unsure (1)..(552): unsure at all n locations
  Clone ID: PAT_TA_91170
cccgtattgtcatcaatctaccaaaaagggggagattgtaagggcatatttatcccttagtagttttggtgattgatgacaatgcttttgcggactaatcgtgtgcgctgagcatttcagatatatcatgcctaagcacaagacgatttggtgcccctcgaagctcattgaagacggcgtttctccacgtttcttttcggtggatttgagtccgtaggaaagccgtactattaagagggggtccgcgttggaaaggttgggtggaatcatcacgtacacgtctgttcctttctgcaccacctttcctttgggnctttgggagcacctccgtttctccgtatctttgcaaaatgaaggacccctaagtgttgctgaactaagggcatccgtaatactgctgcacaaagcggtatacgcangccctacgtataccggcatgggcgcgtaactatacgcaagtgctcccgtatacgctctgggcccgtanacgtggctcaggctganataccnaggggggccggtaccaatcnccanatgatcgtatancgccca

SEQ ID NO: 91171 - DNA, 632 bp, Triticum aestivum
  unsure (1)..(632): unsure at all n locations
  Clone ID: PAT_TA_91171
caaagatgtactgaggaaattcggcatggaagattgcaaaggcgtcaaaattcctatgcccacaaatggccatctatgcactgatgaaaatggtattgactttgatcacaaggtataccgctccatgattggttctttattgtacttatgtgcatctaggccagatataatgcttagtgtttgcatgtgtgcccgatttcaagctgcaccgaaggaatcacaccataaggctgtgaagcatattcttcgatatctagctcacacaccaacactaggattatggaaccccaagggtctgcttttgatctcattgggatattctgacctggactatgctggtgatcgtgtggaccgcaatcaacttccggcacttgtcattcctccggacgatctttggccgttggcctcnaaagaaacagaacgcgtttcacgtccactacggaactaaatacattgttgctggccctgcgtgccaaatgcttggntnaccatcaccaaggcaaggngcaacttaaaatgtgctccctcgtgacaanaaatgcacaagatgccaaaccattaacatcaagacaagaatcaatcgcacanttctcagtantttaggnaatccacnccctaaacgaaaaacacnn

SEQ ID NO: 91172 - DNA, 323 bp, Triticum aestivum
  unsure (1)..(323): unsure at all n locations
  Clone ID: PAT_TA_91172
gttaanccctcaagaatcaanatcatgttaataattaaccattttttcatttgtacaacaggtatcgagcagcactcctccggngaagaaaaanatanacaatagccatggngcgcgcacgacgacgcggtccactacgggnccgctcacccgtctancacaccggacaggacgccccctggcggtnacgtacaccccgtacgacnncgacatctcgcacgnanccccgacgacactggtcannagcctcaantttcgggggcttctcncatnacnacagcgcngganccgcccatntcctccctngcganntcatnggagcc

SEQ ID NO: 91173 - DNA, 306 bp, Triticum aestivum
  unsure (1)..(306): unsure at all n locations
  Clone ID: PAT_TA_91173
cgagaacgtcctcgtcaaggccaagtaccagtggtgatgcgctcgctgatgctgacgcctctcctgcaatgcatgcacgtacttacgggaccgccggaatcggggccgacgatcacgatcactggcgccccggagtanccaagggtcacgcgatgccaccggcggcagccggacgacgtggagtanaggtaattgaaccgtgcccgttgngccacccaattttgggttcacnggttgtatacaccattcatcnggtcnttgggtccgtggattaccgatccttngngattaaataggaantttaaa

SEQ ID NO: 91174 - DNA, 267 bp, Triticum aestivum
  unsure (1)..(267): unsure at all n locations
  Clone ID: PAT_TA_91174
attcaantccttgtactcatcgctgcagaggatgcagtcattagggcatgcacgtatcttcagcacctctaatcctagagggcagatatccttctttgcttcgtacatactgtcggacaattcgttgtcctttggaagcatcttttttaacattatcaagaaattttcaaatcccttgtnaggtacacnattttcngccttncattncagaatttcaangtgggggtnccaaattttttcgtgtcancttcgnngtttgggnaaaat

SEQ ID NO: 91175 - DNA, 595 bp, Triticum aestivum
  unsure (1)..(595): unsure at all n locations
  Clone ID: PAT_TA_91175
cccagccaacctcccatccccgtctcgcgtcgcagcggcagttccactccctcgccatgggcaagattaagatcggaatcaacggtttcggaaggatcgggaggctcgtcgccagggtcgccctccagagcgacgatgtcgagctcgtcgccgtcaacgacccctttatcaccaccgagtacatgacctacatgttcaaagtacgacaccgttcacggccactgggaagcacagtgacatcaaactcaaaggacgacaagacgctgctctttgggcgagaaccatttaccgtccttcngcgtcaagaacctgaggaattcccgttgggttnagnttggtgcccatacnttgtgganccaaccggtgtcttcnatgacaaggacaagnccgctgtcacttntagggtggtgccaagaaagggggcactctgccccaaanaaaatgccctaanttgtggttgggtcaattaggaaattcactcaaacttanatgtccnaagctactgacanaaanggcttgnccctancaangttttaggaaactcgtatatnanggttgttacaagttaatcatcatgcaaaaaaaacntttggcc

SEQ ID NO: 91176 - DNA, 510 bp, Triticum aestivum
  unsure (1)..(510): unsure at all n locations
  Clone ID: PAT_TA_91176
gctatgtattgtttattaaaaggctgctgtgaaagcagaacaatacaaatagtgcaatgagcaagagatgggattatttgacatgtccccctccaggggcaagctgcgagactttatgtaagacaggtatttagctcgttatagagaccacctgggacattcggcgtangttgctgcctccctgggctgttacattgtgtatttggcgattgtactgccgcacatgccttcccggagattgggancctgaaagtaagaaaaaagaaatgacaaaatttggaccccctaatgcggtttaaccgcangttgggcgtgtcnttggttgtgccctccccnttgtgcccatggnattccaaaggngtaattatgttcatgtaatacggggttcanaatttccccnaggttgggttttgggccncactgcnacctggccccaaatgtgcaagngggctttttaangtaacccgggggcnctttangggtccggactttaanaacccgacggggaat

SEQ ID NO: 91177 - DNA, 206 bp, Triticum aestivum
  unsure (1)..(206): unsure at all n locations
  Clone ID: PAT_TA_91177
gttggnttctcctcnccttccggttcgggttctggttcggttcgggtccgagagtagctancctagtctagggtttccgtanatcgganaggaaagaaacggacagatccatgnngganacagattaacgcngcttcnngggcngcctcnccngggncaccgacgannacaacctccagcangccttcagccatgtatngcnagat

SEQ ID NO: 91178 - DNA, 589 bp, Triticum aestivum
  unsure (1)..(589): unsure at all n locations
  Clone ID: PAT_TA_91178
aagtagtacagtacatgttctcaaagtattacactgataagccatcttgtttctgaaagtatttttcccgaatcgccttgcagcttcatatgttccacggcaactaagcgatcggcacaaaaggatggcagaatccctttgcatacatgcatacacacgtattgggtttacaacatacatcacacaaactacgaactatatatattcagttcgaatatctcatccaagatcgggaacgatgaggtatcctccgtcgtcgtcctcgggcagctccaccttcgccttcttgctctgggcgcgcaccggntgtcttgtagaagcagcgttgctgggccggctgcggcgangcgaaagagtcgggactctgccgcggtctgcccactttggtgccggcgctgggcctctngaacagtccattcgggaacatccaactccttgaaccgaaangaacggagaacctctgtcncnggcccgtatcaaaaacgcagagccnnaacgccaaccggacggataacggacanggaccctgcccgggccaaacggcctctgggaggggggtcggggcccttggntgagggnggggcgtgtt

SEQ ID NO: 91179 - DNA, 263 bp, Triticum aestivum
  unsure (1)..(263): unsure at all n locations
  Clone ID: PAT_TA_91179
ctcgaaaggtgagtgttgaaagacgtccactgcagtgaactccatgatcggcgcccaatcggattcgatcagggcgggcgcgggggtttcggagttcggcgaggagtccggtacattggagtcacgagctttatgagggacaaagtcagtgttcggctctatcaccgtagaggttgcagcacccgaggcgatgtctanccatccgtcctcnatctgcgcggccggctccgatttggaggatcggacgntccgaaagggggggg

SEQ ID NO: 91180 - DNA, 446 bp, Triticum aestivum
  unsure (1)..(446): unsure at all n locations
  Clone ID: PAT_TA_91180
gcgcctcattgaggatagatgtgtccatgaagaacaagtacttctcccaatccaacaacctagattgctcctccatgcccaccttcctctccttcaatgtcaccttcctctcctcggccgccaccctcctctccttggccgccaacctcctctcctcggccgtgggcatcttgggttccttgccatcttcctcacctcgttcgcttcttttattgccttcacaatagttccatagcatttttggagctcatcatctcctttcctcttcttcttttttttnctctttcttgnacccatccggtcgttttggnttcnagtaagaaaccnatttgggtgngggggttctcttgccgtcatcanttngatggctcctcntcangacatcnaaaanaaatggtccctgnagtctggttgcccaanancaaggcttcccnntgaacangctc

SEQ ID NO: 91181 - DNA, 383 bp, Triticum aestivum
  unsure (1)..(383): unsure at all n locations
  Clone ID: PAT_TA_91181
ccacgatctccttgccgccgccaccaccctccagttcccagcaactagtttcacttccaacccctcaaccaaccatcctctcgatcgtagctctccgcggcggcgatggcggtggatctgaccccgaggcagccggccaaggcgtacggcggcgagggcggtgcctactacgagtggagcccggccgagctgcccatgctcggcgtcgcctccatcggcgccgccaagctcgcgctcgccgccggcggcatgtcgctccccaagctacttcgaatcggccaangtcgcatacgtcctccaaggttaactatctgcatcacatgccacttatttgggatcaatgtcaaacaatagttgttcaancgctatatatnacccnnctc

SEQ ID NO: 91182 - DNA, 595 bp, Triticum aestivum
  unsure (1)..(595): unsure at all n locations
  Clone ID: PAT_TA_91182
gcattgtccaaaaccatcggatcctgaggctgatcccaccctggcaaggaccggaacaaccaaccccccaagcggaggggctgcacaccctgacccaattgacatggtagtggctgctctcgcaggcgctatgcccacccaaaggaagcccctttatccatcttctgggttctcttgttcaaagcttagtgttagtagcaagagcacaggtaacactgatttgggggctctgttttagggactgattcccccagcaatcattgatttcaagttacaactaactaaagataaatccagactgaaaaaatcatatccctaatgataagattactaggaaaatccancaactgtcgggtttcngctaactggctcctanaaagtggccttgatggccataaccggcccactcctattacaatgcngcaagcaanttncatgacatatggtnagaaatncactggatacactagtcatcctttccaaancaagcacacaatggtggtatcaatactangtagtgctgccttaagantgaangactgctgcacatcaacaacataatccncttgggaattaattaaatnaaaaaccnccn

SEQ ID NO: 91183 - DNA, 167 bp, Triticum aestivum
  Clone ID: PAT_TA_91183
tttttttttttttttgacggaacaacataatattgcatatagaattttcagaattaacgacaggcacagctcatagttttcaaacaaaggcacccaatcccaaagtgcataacagattccagaataactcaacaagcagcggcagctagtcagacaaaaaaaaaaaa

SEQ ID NO: 91184 - DNA, 357 bp, Triticum aestivum
  Clone ID: PAT_TA_91184
tgccaccgcccacgaccgaagatcgcgggcttagcttaaaatgccaggctaattcagtatgtctttcaatgttttcaaggtatatccttcaccgacatattttggggatggattctaagctctcccatccacttcgccaggcctggatcgaggtggcggggcggattaactgtccagctccgcttcctgaggagcaagtattcccgcttctgacaaaggtgttgtttccggcgccttatgacggaccggagaagaaggccaagaaagcggccaaggggaccaggagtggcttccgccaaaaaggactttgggacgcgatgtccgaagacgagactcatcttcatccgccgaaaagaa

SEQ ID NO: 91185 - DNA, 624 bp, Triticum aestivum
  unsure (1)..(624): unsure at all n locations
  Clone ID: PAT_TA_91185
cgcgtgctctacctcggcccgctctccggcgaccccccgagctacctcaccggcgagttccccggcgactacgggtgggacaccgcggggctgtcggccgaccccgagaccttcgccaagaaccgggagctggaggtgatccactgccggtgggccatgctgggcgcgctcggctgcgtcttccccgagctgctcgcccgcaacggcgtcaagttcggcgaggccgtgtggttcaaaggccggctcccagatcttcagcgagggcggctcgactacctcggcaaccccagcctgggtccacgcgcaaagcatcctccgccatctggggcctgccaagtcgtgctcaatggncgccgttcnangggtacgcgtcgccgggcgggccggtcggcgaaatttgtcgaccgctctaccccggcggcanttcgacccctgggccttgccgacacccggagcttcgcngactcaagtgaaggagatnaaagaacggcgctcgcatttctcaagttcggctctcctgaagcatcgtcacggaagggccctnagaactgccgacacttcgaccgtaaaanangctggctcgcacaantnggccgnagtaactcaagtgttttcgaaccacnt

SEQ ID NO: 91186 - DNA, 611 bp, Triticum aestivum
  unsure (1)..(611): unsure at all n locations
  Clone ID: PAT_TA_91186
aaaatggccaatctccatagtttaattgcaagcagtggcttatttaattgcaaacagtggctgttttaaatgtcagaaaagggaaatgagaaaactagctactgtgctaatgggctctacctactacagtaaacggcccagcccactaccaaggcttttccttcaacctctgtacagagggaacagatgccccatcgtggactccgcatgcccgtccacgccgtgggatgtcaccgtgtccgaccatcctgcggtccgtgcagttggataagagcatcgttgcgancccctgggcaaacctgaaactccccctcccctttcctccctcggctcgctctctctcgatctggatncngagccgatgncgtgatcncgttgctcctgggatccccatagcacctcctcccaaactgcgccaagngtctangangacttcacctctctcgtctctcnaagggggggccgtaccaattcncctatatgatctataagccgctcacgggcgtcntttanaagtctgaacgggaaacctgggtancaantaaacgcctgaanaaatccccttccactgggtaanacaaaggccnancattgccttcanattggagctg

SEQ ID NO: 91187 - DNA, 502 bp, Triticum aestivum
  unsure (1)..(502): unsure at all n locations
  Clone ID: PAT_TA_91187
atctgggcctgccaggtggtgctcatgggcgccgtggagggctaccgcgtcgccggcggcccgctcggcgagatcgtggacccgctctaccccggcggcagcttcgaccccctgggcctcgccgaggaccccgaggcgttcgcggagctcaaggtgaaggagatcaagaacggccgcctcgccatgttctccatgttcggttcttccgtgcaggcatcgtcaccggcaagggccgtccgagaactcgccgacactcgccgaccccgtcaacaaaaccctgggccttcgccacaattctccccggaatttacccgtcagtcaactcctaagcgacacttcatggtgatgatctgctnatggtntctcncattccgctctcccgttgtaatgattatcccgacgataattttnatttnacncatcaaataaattgngtgttnacacaaatggngtgggtanacnggattctagttancaggaccgtctcgctaaaaaaaaaaaa

SEQ ID NO: 91188 - DNA, 411 bp, Triticum aestivum
  unsure (1)..(411): unsure at all n locations
  Clone ID: PAT_TA_91188
ccaaagctcatcttcttctccttgaaatctttttgggttcacagatttggaggatgtcttgcaactgtggatccggttgcagctgcggctcagactgcaagtgcgggaagatgtaccctgatctgacggagcagggcagcgccgccgcccaggtcgccgccgtggtcgtcctcggcgtggcgcctggagaacaaggcggggcattcgangtggcccgccgggcaatccggcgaagggctgcagctgccggcgacaactgcaattgcaacccctgcaactggttnagctgcatgcanccgtactacgtgtgttggtgttgagaatatacgtgaataacaactcctgatctgatgaatccacaaggntcntttcntttcctgttgttgcttgcccctctcccatgtccggcca

SEQ ID NO: 91189 - DNA, 498 bp, Triticum aestivum
  unsure (1)..(498): unsure at all n locations
  Clone ID: PAT_TA_91189
tgaattttctctataagcgcatctattctcattttttagtaagttaatcacatacttgtgattcaaacaattttcaaagaattcaaattttaattattcaaatttgaaaactaatggcactaacagaaagtttatattttttctaaaactaatggcactaacagaaagtttataattttgctaacctaaaagcaaacataattaaaattaaagcaaaaaacaaaagaaaataaataatgcaaaaaacaaatcaaaaaaacaggaaaaactatttttatagtaaagttaaccacaaaataaaataaataaagcaacaaagaaaacaaaaaaactaaaaaagtgntttccaaattttgaaaactaagggcactaacagaanttgnnattttcctaaaactaaaagcanaaagaataagaaaataaancaaannacaaaagacataaataagcataaactaaacaaaaacgggaaaaaatacacaatnanatttggtgtaa

SEQ ID NO: 91190 - DNA, 422 bp, Triticum aestivum
  unsure (1)..(422): unsure at all n locations
  Clone ID: PAT_TA_91190
ctganagagggcancgggtcggcccgacgctgtgcttcggtgaaacgggaggcggaatccagctaagctccggaggcagtacgagccttcgccgagagttggcaccaggcaagtcgtgcccccttttgctttcctttctctcctgcgcaaaaaagaatgtaatctggtgccccacggggcgtgtttnaactgtccntntttaaattggtgcactgttccaactggnttctgcgctatgttttcccctttgtggtgtctttcngtggnaatcacttatctttngggggggnaaaaanccccggttctccccctnccccaagggtaagggcnnatcctttgccctngnttcccngcaagggnttaaccctnaggggnaatccccaaacccttgganccaaggggaaccaaacccaanaacctnt

SEQ ID NO: 91191 - DNA, 611 bp, Triticum aestivum
  unsure (1)..(611): unsure at all n locations
  Clone ID: PAT_TA_91191
gcccaagaataaatgggccctgagaaggccgaaaggtaacacgggctggaaacggcccaatggaataatgagcagttaatgggtataaagcgatacactgttcattaagggccggtttcacaatgggccattaatgggccaagagtaacaaagggactcatatgggccgaaagacgtcatgggccatacatgggccggaagttacaacgggctgggaattatattgggacggccagatgtccgctacttnggccaaatcccggttagaccgtaacggccgtgantaatggtttgtnaatggggctatatgcaaacaatccttaacaggtttccgttggccggccgcactttttgacaagtcaacggtcaaccttttaccggatggccgtnttngccttcanattcaacgtacatagngcttcgccaanaatggntgnaccntccaataatgaccaccntggtcctccggcaaatgaaattaaanggaaccnaaggccggcgtaanattncgtcaaacggncnatactaacgtaccatangngtgcaattcgtcaccttacaaacantcatacccattactcatgatngcctcntagaaatttgaancngan

SEQ ID NO: 91192 - DNA, 432 bp, Triticum aestivum
  unsure (1)..(432): unsure at all n locations
  Clone ID: PAT_TA_91192
ccacccaccagcactccagcagcagctcgccatggttcgtcatgcctcgggcctcctcctcctcctcctcctcgtggccctctcgttcgccggctcggcctttgccgccgaacgttggcttgttgctccggccgggaaggccggtattggggcctttgcngaaggaggagcccaacttaaaaaaggcggccggaaattacccggtgttctncnacccgggnacaacgggnaangncggttcaactncttcgggttcnacaagaaaaatggngctnaaccnanattggggaacggnnaagaaattcaaggtnttcccaaggnggaaccgggggtnaaaccctnancccggccggccnnagaagggggcnaantcaanccggccccnnctgggaaaggnaaannaaactttccccccccncaataaaaaaaacc

SEQ ID NO: 91193 - DNA, 170 bp, Triticum aestivum
  Clone ID: PAT_TA_91193
caaaatacctaagatggtatgcttttatgttattagcactaagatggatatatttttcattttgtgaaaacaggtagactgattttaggacgtttctattgtaaacttttgatgtactgcacaaaccacttctcatgaaaagtatgttttgtgtggtgcaactgtggtgt

SEQ ID NO: 91194 - DNA, 432 bp, Triticum aestivum
  unsure (1)..(432): unsure at all n locations
  Clone ID: PAT_TA_91194
gagagagagaactagtctcgagcaatttttttgtttttttttctggtgccaacggcgtgggagctagtatatgacgctagcggcgtcaaatagcacttggaacacacaaaagttcgggtttgggctagcacactagcaggcacctaaccgacttgtatttgtaagacgtgagtaaaactccaagaagaacaacaggttgaaggatcaactcaatgacctcaaagatnnaacctgggtgctgccagccaccnaataaacacgccctncctnaaacaaanggcaactccaatgtttaanaacaaacccaaatttgnaacttttttggttccctttttgaatttttttttgaaatttcaaaaaataataantggtatgantnaccaatntccttgggaaaannnaaaattctttaatcccaanaattttttaaaa

SEQ ID NO: 91195 - DNA, 614 bp, Triticum aestivum
  unsure (1)..(614): unsure at all n locations
  Clone ID: PAT_TA_91195
gcgcgcacccgccggtacggcccgacgaggcaccacgacttccgcgggtcgaccttccgaagccgaatccctcaccgcttcgcttggagctccggtgccacgtattgcggccttcttctccgactccgaccgccttcatcttcaacgccgtcaaatcctttactacacacgttcgcctacgctccctctactttcccctcaactaatttgatgcctcccccctctctctctctgtgttgtgttgtgtgtgtgtgttgtgtgtgtgtgtgtggntttccaaaactaatcctacagcaacaggtgagatcaacttcctgaagttacaagtgtttggaactaataactnatcctaagtaaacaagtcttgctgcaagcataagaatgacattnnattaaggtacaanaatttacaacattnnaacaattnatttttgnagaacaangctaaagccngaataaatgtganacggaaattacaaggcccntttcctnatcaaagttaaggaatccaatattaaaaggcaaacatctaaattgcgacttgnangagtaanttgnttaaccaaatagtgtcaaatcacaccatnccaataaaagnggagtacacttaanan

SEQ ID NO: 91196 - DNA, 520 bp, Triticum aestivum
  unsure (1)..(520): unsure at all n locations
  Clone ID: PAT_TA_91196
ccacccgcacgcccgcccggccacggctccaccatcgcctgagctgaatggccgtccacgtcgtgctccccctcctcctcctccttctcgtcgccacggtcctcccttacaccgccctcgccgccttctccccggacttcaagatcttcctcgcgtgcggcgcgggagccgacgtgcccttcccgtccgacaaccccgcgcgcaccttcgtgcgggacgacggctacctcccctctgttacgccgccaggggcctgcactacctgcacagcggctactcccgagaacatcatcaaccgcgacgtcaatccacaaacatcatcctcggnaccnacgggcggcggnagaacggcggcggcgcgattatngccaaggtggccgactncgtctctcgcgcatcggccgtccttggggaagaccacgttagcacggcgtcaagggaagttcggtactcaacccgaatactnaatangcaagaacnaaggacggtcgagtcaancntcgggtggggctccaagggc

SEQ ID NO: 91197 - DNA, 552 bp, Triticum aestivum
  unsure (1)..(552): unsure at all n locations
  Clone ID: PAT_TA_91197
atcaccagcacagncgcgcatccaccgttgctagcaaggtcgaccaagcagcaccgagatggctgctgccttctcctccancgtcggtgccccggcttctacgccnaccaacttcctcgggaagaagctcaagaagcaagtgacctcngncgtnaactaccatggcaagagctccaaggncaacaggttcacantcatggcaacggaaaacatcnacnagaagaggaacacaagaccagttgaaaggtcttgcctaacatatctccnacgaacaacaagacatcaccaaaagggaaanggnaacntggactccctctttcaaagggccannggggaaagggacccaanagggcctcctnaaatcccaanaatatntncccccggggcccaaaaattacnntntaaaacacangggggggnttaaaacccnccggtttanggaantnttnttacaatccccaaatnttagcccctccaaaaaattncccccactgggttctnggagncaaggnaaggaaatcccctngggnttnccccaagggnaaccccata

SEQ ID NO: 91198 - DNA, 620 bp, Triticum aestivum
  unsure (1)..(620): unsure at all n locations
  Clone ID: PAT_TA_91198
gggctatgcatcatggtggnccagacgacgcttgcgtggatatcctggcgtggccttggcggcaagctgcccttcgacctcggcgacgatacaccggtgtcgtgcccttcggtctcggtggagcgccgtcttgcggcttcgacggtggcacaccggtgtcaccgcacgaactcggntangcaacgcccttccgntcgtgccaatgatgttcctctgtgagctgccgtttttgggtgcctttttctccntagggctcctgaggtctttgttgatggtggaacnagtgctcggcggacntgntcctgaagtgttngtacaangtttccgttggtcactgtgcaacttccctcngttactcntcttccncaaattttggtctnctcccgggcgctcctccggatttcctttgcactttgtntnccctcaagtatttgtacgacggcaancatcctccaattgggatatacaagcgtgggnttgacccccgtcanctcgaaannnaaaaaaanaggggggccgtnccaatcgcctaaatatcgatacnccaccaangcgtnntttaaatcnganggaaacctnggtnccactaatcctngaaaaacccttcnaaggnnaaaana

SEQ ID NO: 91199 - DNA, 635 bp, Triticum aestivum
  unsure (1)..(635): unsure at all n locations
  Clone ID: PAT_TA_91199
tttttttttttttttggttactattcggcgcctttagcgctcgttacttggctggttactattcggcgcctttagcgcccgttacaggcgttttcgctaacgggcgcatacccacccttcgcgctgggccggcccatctactcttttctctattctgtttttcgcacaaaaaagcggctaaggtgagactcgaacacaggacctgccgccttaaattagctcctacttaccatcccgccaccaattctcacgtgactactaacatctttcccttctactccctctgttccgaaatagttgtccttggggaacttttcccgaacaagtgaaaaacaggataaagtaccaaaactaccctcaaatttgaaaatcctggtcgccggggatnttcgtcctantcaacggtcctcccctccggcaagctcatcccaatgctgcanctccngcgtccgtcgcgccggtcggaactccctnttcggcggcttctcggtcaatcaagagccaaatcntangcactcctcgccgtcgcaaanctcaaccgccggatcctggcgtnggcccccggaataaggctngtgcgcaagtccccgacgacaanaaangcnccgngtcncnccctgccnacntaatctnat

SEQ ID NO: 91200 - DNA, 620 bp, Triticum aestivum
  unsure (1)..(620): unsure at all n locations
  Clone ID: PAT_TA_91200
atcaccgatcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgttgaactaccatggcaagagtccaaggccaacaggtcacatccatggcagcggaaaacctcgacgagaagangaacacggacaatggaagggccttgcntacgatatctcccgaacgaccaagcaagcacacncaagagggaaaagnatcgntggatcctctttccaagcgcccaacgggcgaacggacccacgaagcctccttaantccctacgattacttnaaccaagganccaagaantcacttncgacaaaccatgggagttctaatcctcctntttcatgggcacttgtnccactctccaagattcatacctgcccaacacaannccatcactggnactgggaagaaggtcaaggaaatcatcatgcaactntctcgcaaatgganaaccatcatatattccgaaactgaaatgaacccgnancaccanccanagangtcctagggaaattaaagn

SEQ ID NO: 91201 - DNA, 486 bp, Triticum aestivum
  unsure (1)..(486): unsure at all n locations
  Clone ID: PAT_TA_91201
gatcgatcctcccgcgtaccaagccaccgaccaacatggcagcgtctctccaagccgcggccacgctgatgccggccaagatcggcggccgggcctcctccgcgcggccgtcgtcgcacgtcgcccgggcgttcggcgttgacgctggcgccaggatcacctgctccctgcagtccgacatcagggaggtcgcaagcaagtgcgccgacgccgccaagatggccggcttcgccctcgccaactctgcctcctcgtctcccgggcgancgcngaaggggcgcccaagaagctgacctcnacgagattcagagcaagactaaatggangtgaaggtnaccggaacgcgaacaattgccgaacaaccaacggggggtcantccttcccctnaaaggccggnaatncaaatgaaaaantntgcctggagccaactccttaacgtnaaggccnaggatcaaaaaaacaanccccggcttcaaaaaacaaac

SEQ ID NO: 91202 - DNA, 594 bp, Triticum aestivum
  unsure (1)..(594): unsure at all n locations
  Clone ID: PAT_TA_91202
ctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcangtcgactacctgatcgctccaaatgggtgccttgctccnagttcannaaaggttgggttaaccttcgntngcaanaagcaatcccttggtnnnaacaatggccggtactggacaatttgnaactgcctaagttcgggtgcaccgacgccacacaagtgatnaacaagtggaagagtcaagaaggagtacctgaccntactcgcatcatcggatcacaacatcgcaagtgaatgctcagctcatcgcctnaagcacggctgcaagatccggaagcctaaanntnatcacacggcaattaatgcatgcggtttaatcgaatgcttggttcctccatn

SEQ ID NO: 91203 - DNA, 578 bp, Triticum aestivum
  unsure (1)..(578): unsure at all n locations
  Clone ID: PAT_TA_91203
cttgaccccaccacggaggccatagattccccggcgttggagccgcacatggacttaaactcacacaatatatgtgtcaccggaattctggactcatctctagttataagttccgaaccatgtgagcccgcggacaccgaacttgatcgctcatcgatcttcgaattcagcgccgcgggacatcttccagcactcgcctttgggtgatgtgctaaactcattaaagagcctgtccttggcgggggactcatagccgaactctgtccggttcggactaaggactaatgatcgagaatttgcttccaaccaacaaccaattcatagcactgtccaaggactaatcgacaccttgattacnacnccgaagatattgacggtatggacgacaatgccgatnaagggcaagaccaaatccacaattaccggcgctggacggcaattcttcgtaaangtgttcnatgggggtaaaccaaaacaaacaatgacgacgacncagnaaatcaatcaagataaactcctaatnatacaaaaaacaagtctcgggcgcccaattaatcgttaaaaaaaaagtgggaccg

SEQ ID NO: 91204 - DNA, 521 bp, Triticum aestivum
  unsure (1)..(521): unsure at all n locations
  Clone ID: PAT_TA_91204
ggaacgagaaggtgcaggaccttctcctcctcgatgtgaccccactgtctcttggtcttgagactgctggaggagtcatgactgtgctcatcaccaggaacaccaccatccccaccaagaaggagcaggtcttctccacctactccgacaaccaagcctggtgtgctcatccaggtgtttgagggtgagaggacaaggaccagggacaacaacctgctcggcaagtttgagctctccggnatcccgcctgcaaccaagggtgttccccanattactgtctgctcnacatttattccaaacgtatcccgaaagtctccgctgangacnaanacactnggcaanaagaacaagnttaccaatcaacaaccacaaggnaagnttancaaaggggacattttnaaaatgtccaaaganccacagaaatnnaatcttanggccaagngccaaanaaaaaggttcgccaaaaaanccttgngaaannaccncaaatntggaaacatcaggncagaaaatttcnccaa

SEQ ID NO: 91205 - DNA, 222 bp, Triticum aestivum
  Clone ID: PAT_TA_91205
cttctcaccatcaccattctttcttggtccccgtgttgattccaacaagtgaacggtgttgtttggattctttccttctatcaaccctattgctttcaagttaatggtcggccgttcattcttagactattgattattgaatcaccattctgacattgggtcatgcaacccaacccatatttcgggcgcacctttcaaccaatgtttaattgtgtatgtttt

SEQ ID NO: 91206 - DNA, 595 bp, Triticum aestivum
  unsure (1)..(595): unsure at all n locations
  Clone ID: PAT_TA_91206
ccacagccccactcctagagagcacgcacatcggacacgcacgaagtctcctcgaccagcgagcaatggcgaccaccgcgatggcgctctccccctcctccttcgccgggaaggcggtgaaggacctgccgtcgtcggcgctcttcggggaggcgcgcgtcaccatgcgcaagaccgcggccaaggccaagccggtgtcgtcgggcaacccgtggtacggctccgaccgcgtgctctacctcggcccgctatccggcgaccccccgagctacctcaccggtgagttcccggggactacngntgggacaccgcggggctctccggccgaacccgagaacttcgccaagaaccgggagctggagtgattcaatgcccggtgggcaanctgggcgcctcggntgcgtcttccccggactgntcnccgnaangggtcanttcgcaaggccttttgttaaaggcnggtccaattttacaaggggggtcaatactcggaacccancccttattggaaagaactcccattgggctgcaatctntcaaggnncttaggtaangttncnggggccncgngaantttacccctnccnggggattt

SEQ ID NO: 91207 - DNA, 314 bp, Triticum aestivum
  unsure (1)..(314): unsure at all n locations
  Clone ID: PAT_TA_91207
acttggactcctccgagcggcgggaggggacncgtggcggcngcggcgggtctccctccgcccacgcaacctatagcctatagcaacagaagtggcgggcggtgcggtgcggccggccgaaaaggagacgaccaccaccaacaactgggcgtggaggcaggcctgctttcggtggagtngagcggancgggganccggagagcagccctccactttccggtgccgctgtcgccgtcncggtccgaggntctcgcncgngcgcgccnggggtctatctaantctgccctgctctgccggcggttaaanttcccag

SEQ ID NO: 91208 - DNA, 610 bp, Triticum aestivum
  unsure (1)..(610): unsure at all n locations
  Clone ID: PAT_TA_91208
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaantcgagaccctgtcttacctgccaccgctcagcacggaggcctcctcaagcaggtccgactacctgatnccgtccaagtgggtgccttgcctccgattcaacaagttggntcacttcccgtgagcaacaacnatctcctggggtacnacatgggccggttattgggacaatgttggaactgcctaagttcggggtgcactggacccacacagtgatcacgaaggtggaggaagtcnaagaaggatacctgacccgtatttcccatcaatcggtnnacaaatcgtcaagtgcatgcgtcaactcatcgcttnaagcaacnggtgcaagatccggnaaggctaaacannantcacaaaggcattaaaatgcatncaattttaacncgaatgctttggnttcttccattacttctn

SEQ ID NO: 91209 - DNA, 617 bp, Triticum aestivum
  unsure (1)..(617): unsure at all n locations
  Clone ID: PAT_TA_91209
agaacgctccgggcctctctctgtttgctctcgcgtccgccgcgcccgtcccgtcccgcctgcgcccgcgcgtgtgctcgctcgccgcctccgatccaccggcccaccaccgcgccggcggcatggcggatcagctcaccgacgaccagatcgccgagttcaaggaggccttcagcctcttccgacaaggacggagatggttgcatcaccaccaaggagctggggaacancatgcgttccgctgggggcaaaacccaacgggaggcttgactcccaaggacatgattcaatgaagtccgacgctggatggcaacggaccattgattccccagattcctcaaacctggatggcccgcnaagatgaaagacactgactcaanaggaagantcnaaggagcttcaaaggtgttttttacaaaggaccaaaacgttcatctctgctgctgactccgcaactcatgacaactccggngaaantcacgacaagaagtggacaaatatcgtnaaccactcacgngatgcaatnnatanaggagtctcaagncatgatggcaaatacacgtgtcgtctccaacaagagagaatgtcatgntatagttantcaccctantgtnatt

SEQ ID NO: 91210 - DNA, 355 bp, Triticum aestivum
  unsure (1)..(355): unsure at all n locations
  Clone ID: PAT_TA_91210
cggcattccgaggcaaatttaaggtgggacataagagtttgttcactccgcgggaggagggctggcaggctcgacgaactcatctaggtcgacgccgtcggctatccgagtggctacagcgatgaaagtctccataaaggttcggaagtcatgcttctgggtgttgggtgaccttgattgctgccagcttgtcttgtcgcacctccttgcagtgggacacgaaccaaagacagagccacatcaagcgtcncaccgagcagaaactcctccactcctgcactccgtcaaggattccgtttaagacacaaaannccnaagggggggggggcccgtaccnaattcccctaantgancc

SEQ ID NO: 91211 - DNA, 589 bp, Triticum aestivum
  unsure (1)..(589): unsure at all n locations
  Clone ID: PAT_TA_91211
gctacacatgggccgaaagtgtcaacgggctagaattatattggatgacccatatgaacctaatgggcaaaattcggaaaggtcataacaggtcgtgtgtacccgggccataaatgggctatatgcaaataggctgctaatagtgtttaaatgggctggccagctaacttttaaccaagtcaagcgggtccggacacctgacttttgaccgagtcaagtgggtccggctttttttacctaaatggggcaaccgttgggtccatgccacgtgtcaatgtttcataagcgctcctgtccatttggatggatgacacctggttgcaactaanagctggacacatggtccctttggcgaaatgaaaaatttgacacatgaaaaaccncattgggccgggatgtttaacgaaaaccggttcnaaaaccgacacccaataccttaatggggaccatacnnttggagcaagttccgttaccttaacgaaacatcnntatgtgttattacgcagggantgaaactcntgaganattgaaatgcatggnactcnatgggaacttcatgaaaaaaaatctcccatgcagntttcatggt

SEQ ID NO: 91212 - DNA, 524 bp, Triticum aestivum
  unsure (1)..(524): unsure at all n locations
  Clone ID: PAT_TA_91212
gaccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatncaagagcaagacctacatggaggtgaaagggtaccggaccgcgaacaantgcccgacatcgacggggggtcaatccttccccttcaaaggccggaaantacaaaatgaanaattctgcctggagncaactctttaacgtnaaaggccnaggatcaanaagaacanccgccngcttccnnaaacaaaccatgaccttctaactaaaccctntacaaatggaaggccctcnagtcngggccnacggacccaattcnaggagaangacggatcaatancggcnnaacgntaatcccggaggnaacgctgcctcctctnacgtaa

SEQ ID NO: 91213 - DNA, 469 bp, Triticum aestivum
  unsure (1)..(469): unsure at all n locations
  Clone ID: PAT_TA_91213
gccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaaggcgagctccggcgggatggagatggcggccgaaaacggcggctgcggctgcacccagtgcaagtgcggcaccagctgcggctgctcctgctgcagctgctagatccatcatccgattatgcatgcaccgtgccttgccgtgcatcatcgattgtatcgatttactaactaccataccatgttaccgcaactgatcgaaggctttatttaccacctgactgcatcancatcaagtgccatgccatgattgttaacaagccccctaataaaactcccttgattanaan

SEQ ID NO: 91214 - DNA, 349 bp, Triticum aestivum
  unsure (1)..(349): unsure at all n locations
  Clone ID: PAT_TA_91214
caagaagataagagagaagcaaagcttgagatggcgcaaaccatggcgtccatgaccggcctgtcgcagggcgtgcgtctcccaggcccggccggcaggcgcgccagcaggttcaccgtgagggcgtcgtcggcgggaggccgaggccgccggccgccgcgcggtccttggcctcatggccagcgggagtcgtcgggagcgcgttcgctcaggtggtgcacgccggcaccgtcgcggccatcaaggtttgggcccccgccgccgtctccggtgggactccccggaacggacaatcngaccaagcaagggactccgacctgcccctgaaaaaccggtctaactgcagcgt

SEQ ID NO: 91215 - DNA, 417 bp, Triticum aestivum
  unsure (1)..(417): unsure at all n locations
  Clone ID: PAT_TA_91215
tgaacttanaaaacttggctcttaatgagaacacactctcaggttccatcccaaagagtttaggaaatttgacaaaattgactaccttgtaccttagccaaaatcaactttctgggaaaattccgcaggaacttggtcatttggttaacttaaaggacttgaaccttaactacaacaagcatataggttccattccaaatagcctaggaaatttaacaaaactcgctattttgcagcttgggcgagaaccaactttccggggaaaatccacaaactaannggtaggttgttgaacttaagagctcatgggagcttgggcagtaacacactaacaanttcanccccaaataccctaaggaatttggacaaaaccactacttacacctttccctacaaccaacttttggcactcccaga

SEQ ID NO: 91216 - DNA, 372 bp, Triticum aestivum
  unsure (1)..(372): unsure at all n locations
  Clone ID: PAT_TA_91216
tttttttatcataagttcatcgtgtatatatcggccgacaacctgacaaactgcaacccgcaacaagacagataaaaaatatccacgggagcaacggaagaagttacagtggccgacaaactgaagcagcagcacactgaacctgggccaaggananagtcttccaaaggagggaaagcaaccacacaaaacccgtgtatatttacatgcccaggaggantttggggtttaattacacagccagcacgcataaaccccatacnttctgcggaatcgnaatttccccaattgnaacacnatttcaaggataaataatcngtcaaggcggatggttntcaacaataaccnatcaaattttcngttaaggacccg

SEQ ID NO: 91217 - DNA, 616 bp, Triticum aestivum
  unsure (1)..(616): unsure at all n locations
  Clone ID: PAT_TA_91217
tttttttttttttttttgacananncatgcacgtaantttgctccaaaaggacggaacaanaatttcttaaccttacaagacgatcgaaacacaaaagcaaagaacaaagaaattaaggaaacaaatcaaatcatggcgtacgccaagaacttgcggcgaacgatgatgataanaatcgatgcaagtctaagagctaaagctatgatcacccacctcctcgatcacctccaacatacgtacgtggagccatccattaatgtctgtcgcctcctacgcttgcttgcnccgcntcaaaaccctacatgcgcgtacgacgtaccgttgatctgangacccaatgcatggcatgggaaggangcatccatccttgcacgtgcattgctgacctcgctccatctccaacgattaatggctccaacggcttcccanaccaaaggtgcnccttcacncgaagaaanccnggtccggcgccgatcaccgtccggctcccncatcnacanccncccggtaccgggcanaaggacgcactcctccgnactcnccncgaattgcacggtgaaaaccggcgacgnaagcgcggccatccgngcgtcccgcgtcatgaancgagcngga

SEQ ID NO: 91218 - DNA, 612 bp, Triticum aestivum
  unsure (1)..(612): unsure at all n locations
  Clone ID: PAT_TA_91218
tggactcgctcttccaggcgcccacgggcgacggcacccacgaggccgtcctcagctcctacgagtacgtcagccagggactcaagaagtacgacttcgacaacaccatgggaggcttctacatcgctcctgctttcatggacaagcttgttgtccatctctccaagaacttcatgaccctgcccaacatcaagatcccactcatcttgggtatctggggaggcaagggtcaaggaaaatcattccaagtgcgagcttgtcttcgccaagatgggcatcaacccaatcatgatgagtgccggagagctggagagtggcaacgccggagagccaagcaagctcatcaagcagcggtaccgtgaggctgcagacatgatcaagaagggtaagatgtgctgcctcctcatcaacgatnttgacgctggtgccggtcggattggcngggacacacaatacacgtcaacaacaaatggggaacgcanctcaagaaatcgccgatgccccacaaagtncaantccaagcatttnaaaaaggggggaaccnccggngcaactnncnctgggaanantnccacttgannccncgatctnangccnatgaaaatcacgggn

SEQ ID NO: 91219 - DNA, 599 bp, Triticum aestivum
  unsure (1)..(599): unsure at all n locations
  Clone ID: PAT_TA_91219
acaagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccagctgcggctgctcctgctgcagctgctagatcattgatcatcgatcatgcatgcaacgcgcgtgcagcatcgatcatatcgatctactactaccataccatgtaaccgctactgatcgagggcttatctatgcacctgacctgcatcagcagtcaagtgccatgccatgcttgttgtaaacaggccccctaaataaaatctcancggcggctgcccttcccgtcgtggaancgcgcnccggttccggnggctcctctgtnaacncggccgganaagacaagagnggaaccaattaacgcggaggtcgatggtctangggcntcncgggatan

SEQ ID NO: 91220 - DNA, 595 bp, Triticum aestivum
  unsure (1)..(595): unsure at all n locations
  Clone ID: PAT_TA_91220
gcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgaagcacaacgcatcccctgggtactatgatggccggtactgggacaatgtggaagctgcctatgttcgggtgcaccgacgccacacaagtgatcaacgangtggaggangtcaagaaggagtaccctgacncgtattccgcatcatcggattcaacaacatccgcaagtgcaatgcgtcagctcatcgcctnaagcaacgggctcaagatccggaaggctaacagtnntcacacagcatttaaatgcatgcatttgtaatctaattgcttggttcctccattacttctattgtccaaaaaangaagtcaagttnn

SEQ ID NO: 91221 - DNA, 414 bp, Triticum aestivum
  unsure (1)..(414): unsure at all n locations
  Clone ID: PAT_TA_91221
gaaagttgtcccggacccgaccggggctgtcgcccctgntgtgcccggatcatccccaaacatctacaaaacgtcnccgtttttctttttgggctacctaacctatttttcccgtccgtccgattacgatcggagggacctaaccgccctatactgatttcatctgctatatatatagcantctaaccctaacctacctggtccaatacacccattcccatcccgtcgccgccagccaaccaccgctttcatgtcttacttgggatcccctcccaccaaccagatctccgaccacctccctcgttctgcgcgctgcccaaattgctgcagcctcgatcccgagctctcctctgcttcttgcccaagcncctgaagcctactcntcttcctcaatccgantggatcgngtagctg

SEQ ID NO: 91222 - DNA, 602 bp, Triticum aestivum
  unsure (1)..(602): unsure at all n locations
  Clone ID: PAT_TA_91222
gctcttgatcgtgaaaagatatggtcaagactgacaacaagtgaaactattgaggttttggaaaaggacctagcgatatttggttttttcattgctttaggcagaagtacacaagtatacctgtcttccaaaagtcatacagattcaaatgattctatcaatagtattgtaaggtaccttattggtgggagcgtcctatattatccacagttgtcctcgattagttcttatcaagttgtatgtggaggttgtttgtgaagagcttgagtggcttccattttactatgaagatgtgccaacgccaatagttaatactgaaggcaagaaaagaaatgcctaaaagagaactgatatcaaagggtgctaaatgtctgcacttaatgggtgactagttttataaagtataactcaaggcttgagaaacccttaaatggtaangnaanacgatcctatctaaaggggcatgcaatgttganggactgcatgacnaacttgcatagcaaaaaatatatnctaaagacgnagtttcagaaatggntatgggtgatcnacgagcaactcatgcaagcactgaatttaggaacttggtaantagaaatnct

SEQ ID NO: 91223 - DNA, 243 bp, Triticum aestivum
  unsure (1)..(243): unsure at all n locations
  Clone ID: PAT_TA_91223
cgaagcccgagtggcgcgcgctgctggacgacatggccacggtggccaccgaggagtaccgggccatcgtgttccaggagccgcgcttcgtggagtacttccggtgtgcgacgccggagacggagtacgggcggatgaacatcggcaagccggccctccaaacggaagccgggccgcggnatncaatncctgcgcgccancccgttgattttnccgttgacncaaacccnantncaatccccc

SEQ ID NO: 91224 - DNA, 501 bp, Triticum aestivum
  unsure (1)..(501): unsure at all n locations
  Clone ID: PAT_TA_91224
agaatctccgacagatcgaagccaaggctttctcgtcctcctccccaagatgcagatctttgtgaagaccctcaccggcaagaccatcacccttgaggtcgagtcatcggacaccatcgacaacgtcaaggcgaagatccaggacaaggagggcatccccccggaccagcagcgcctcatctttgctggcaagcagctcgaggatggtcgtacccttgctgactacaacatccagaaggagtccaccctccactggtgctccgccttcgcnggnggtatgcaaatcttcttnaaaaccctgacgggnaagacatcacgctttaaggtggggtcctcgggaacatcgaaaacntcaaggcaaagttcaagnacaagggggggatcccccgggcaanaangctnattttngccgggaagnantttanggtggccgcacntgggaanntaaaaatccaaagggggtcaaccncaactggggtccccttccgggggaagaatttt

SEQ ID NO: 91225 - DNA, 600 bp, Triticum aestivum
  unsure (1)..(600): unsure at all n locations
  Clone ID: PAT_TA_91225
ctcgcccggagacgggcctcgacaagctccgccgggccgccgccacccaacccctcgccatcaacacagctgcaggggaggcgattaagcagtcgccgtcgatgccgacgaccccgaccacgccggtgacgccgtcgtcgtccacgccgccgcgcggcggcagcgtgtggcggagcgttttccaccccgggagcaacctggccaccaagagcctcggcgccaacctcttcgaccgcccgcagcccaactcccccaccgtctacgactggctttacagcgacgagacgaggacaaggagcaaaccaacgctaaataagagccgtccggcaaagaactgaangcaaggtgctcaacaacttgtgcgacgccgccatgtttgctgctcctttgggtatctaancctgcgtaacgtacgttgctgtccgaagntgcagtggttgtcctcancttctacaacgtcnacaatgctgnaacttaatttcttggtccgtangctnnctgatgcaacnaatgatggttagtgtttcccgtgtaacncaagctgttaatcnccccgtgttgggnggctccaagtttacactaggnaanaaaaaaaaaaaa

SEQ ID NO: 91226 - DNA, 526 bp, Triticum aestivum
  unsure (1)..(526): unsure at all n locations
  Clone ID: PAT_TA_91226
gttttttttttttttttttttaactaaataacagaaagtatagagagggtatagaaggctgtgcttctagtttcatccatctcatgctcatcaaaaggaatccactaacaatgttgatcaagtcttgttaagaagctcattccgattaacatgaaactggagaaatttcgaataacactaggttgcctcaacggggatatgcacgtccccaataataagtatataatatttcctcttgaagaggaaattcaaaacctccaaatataatcgatggaatttttctgataaaattgatactatgancttgaggtcgttccccggaaaagtgtnccgtatgctcattaccattaacaagaaagtgacattgcctttggtgcaatcaataatacccccngaagtattaagaaaangtcttccaagaataatagcatactatcgtcccagggattccagaatacaaatccattaaatataantttgcaacaaaaaaagganatctcanaatgtcncnggtatacaattgatt

SEQ ID NO: 91227 - DNA, 588 bp, Triticum aestivum
  unsure (1)..(588): unsure at all n locations
  Clone ID: PAT_TA_91227
gtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcaagcaaggtcgggttcatcttccgtgagcacaatgcgtctcccgggtactacgacggccgctactgggacaatgtggaagctgcctaagttcgggtgcaacgacgccacacaagtgatnaaagaaggtggaggaagtcaaagaaggagtancctgacccttactccgcatcancggattcgacaacatgcgccaaggtgcaatgcgtcaagctcaatggcctnaaagcaacnggctgcaaagatcccggaaaggctaaacagtaatcaacaangggcacattaaatgcatgcaatttgtcaancnanatgcttgggtttcttccattgccttctantgtccaaaaaaatgtagtcanttattaananatgcccaaaactgnctagtaatcaan

SEQ ID NO: 91228 - DNA, 504 bp, Triticum aestivum
  unsure (1)..(504): unsure at all n locations
  Clone ID: PAT_TA_91228
agagcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatcgacgccaacggcaggaaggtgggcaagaagggcgtgtaccagttcgttgacaagtacggcgccaacgtcgacggntacagccaatctacacgccaagaggaatggtctgaatctggtgaccgctacgccggnggnangaccgggcttcntanctgggncgtcatctcgccggnctcctcgncggcggcgtcctcctcgtctaacaacacancgctctcgccgntnanagagatcnacgtntaacacagggccgggtctctgcttgatgcacgtctctgtaatcaaatgctacctcctgtaatgttgaacaacntgnangtattg

SEQ ID NO: 91229 - DNA, 534 bp, Triticum aestivum
  unsure (1)..(534): unsure at all n locations
  Clone ID: PAT_TA_91229
gccacttcaacagcaaagagccccggaaggacacgatcacctacatcccgggcgtgccgacgatcgagccgcacgagctcatgtcctacctccaggagacggacaccaccagcgttgtgcaccgcatcatcttcaaggcctttgaagaggcgcgcggtgccgactacgtcctctgcaacaccgtggaggagctggagccgtccaccatcgccgccctccgcgccgagaagcccttctacgctgtggggcccatcttccccgccggcttcgcccgcagcgccgtcgccacctccatgtgggccgagtccgactgctcccactggctcgacgcgcanccgccgggctccgtgctcnaatctccttcnggagctagcgcaagtcacnaancaagaactgcataanatnccggaagatcctggcaacggcgcaagttctgtggtgatccaacggaatctcaactcgacgaaccggaccgctgccnagggtccgggccnctcgccggccggctggtggtgcgtgtgtcagtggagnccc

SEQ ID NO: 91230 - DNA, 603 bp, Triticum aestivum
  unsure (1)..(603): unsure at all n locations
  Clone ID: PAT_TA_91230
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcaacaaggtcgggttcatctccgttagcanaatgcgtctccccgggtactaacaacggcgctactggacaatgttgnaanttgcctatgttcgggtgnacgacgcacacaggtgatcaacaggtggaggagtcaagaaggatacctgaccctaantccgctcatcgatcacaacatcgcaagtgantcgtcagtcattcctcaacacgggctcaagatccgnaggctaacagtatcacanggcaattaatgcatnantttcaacnaattcttggnttctccaattgctttatntccaanaaanggtn

SEQ ID NO: 91231 - DNA, 401 bp, Triticum aestivum
  unsure (1)..(401): unsure at all n locations
  Clone ID: PAT_TA_91231
cccctccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagtcgaaggatggccgcaccctggctgactacaacatccaagaagggatccaaaantcaantgggnctcaaatccgtggggggaatgnanttttcggnnaanaccttaacgggaaaaacancaccctgggggttangcccncnganacatcnnaaancttcangggcaagntcaaggacaagggaggnatccccccnggcaaaaattt

SEQ ID NO: 91232 - DNA, 618 bp, Triticum aestivum
  unsure (1)..(618): unsure at all n locations
  Clone ID: PAT_TA_91232
gttctaacttaagaggcaaatgacaagcttttccataaaccattttataaggagacatacccataggatttttatatgctattctataagcccaaagtgcatcatctaatttcttagaccaattcttccaggacctattgacagccttctgtaaaattaaatttatttctctattgctaagttcaacttgaccactagactgaggatgatagggtgatgcaattctatggttaacatcatacttgggcaagcattttacgggaagcaccatgaataaagtgtgaaccaccatcagtcattaaatatctagggacccaaaccttgggaaaataactccttaagcattttaatagaagtgttgtgatcaacactactaattgggataacttctanccacttantaacataatcaacaacaaccaanatatgagtataccattagaggaaggaaatgtccatgtatcaatccccaaacatcaaatggtcaatacaagtgaataatcaaggcattctgacctacgatataccacccttgcatcacacaagtaaatgactnngacatcctgaaagntagcataaaccanatgnatacttggacantcgtccccangatgctca

SEQ ID NO: 91233 - DNA, 596 bp, Triticum aestivum
  unsure (1)..(596): unsure at all n locations
  Clone ID: PAT_TA_91233
gcgagttccccggcgactacgggtgggacaccgcggggctgtcggccgaccccgagaccttcgccaagaaccgggagctggaggtgatccactgccggtgggccatgctgggcgcgctcggctgcgtcttccccgagctgctcgcccgcaacggcgtcaagttcggcgaggccgtgtggttcaaggccggctcccagatcttcagcgagggcggcctcgactacctcggcaaccccagcctggtccacgcgcagagcatcctcgccatctgggcctgccaggtcgtgctcaaggggcgccgtcgaggggtaccgcgtcgccggcggcccgctcggcgagatcgtcgacccgctctaacccggcggcagcttcgacccctgggccttgccgacgacctgangcttcgcggagctcaagtgaaggagatnaagaacgggcgctcgcatgttctcatgttcggttcttntgcangcatcgtaacggcaagggcccctcangaactcgcgacaacttccgacccgtaanaaaaccctggcttccacaattntgccgnaataactcaagtntttcggaacacctcactctcttncataatt

SEQ ID NO: 91234 - DNA, 597 bp, Triticum aestivum
  unsure (1)..(597): unsure at all n locations
  Clone ID: PAT_TA_91234
cctaagctaagctaaacagcagcgagcaatggcgtccacctcctgcttcctccaccagtccaccgcgcgcctggccgcctcggcgcgccctgcgcccgccgtcgggcgcacccagcttttcgtctgcaaggcgcagaagaatgacgaaggctgcatctgacgctgccgtcgtcacaagccggcgcgccgcgctgtcctcctcgccggtgccgccgcatcgccgttcaagtctccccccgccgccggccgcctacggagaagcaaccaacgttgttccngcaagggcnaanaaagacacgnctttcntggcgttaancgggaaagggttcaaactgatattccngcaagttggaccccaacaagggctnagttccttggaagtgtcccctnccnaggaaantcnaagncacaagaactcnccgttttatcaacccactncaaggaancataacgataagnncccctaggattcccnccaagcggttcnctcgggaaaatctacggngnaaacganccanggnggttcngcaaaactttgnaangnaaattttgaaacnnncccgtgtgnngtacatntaanaaangtttaaagaagcc

SEQ ID NO: 91235 - DNA, 579 bp, Triticum aestivum
  unsure (1)..(579): unsure at all n locations
  Clone ID: PAT_TA_91235
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcgagttcagcaaggttgggtttatcttccgtgagcacaacgcatcccctgggtactacgatngccggtactgggacaatgtggaagctgcctatgttcgggtgcaacgacgccacgcaagttatcaanaggtggaggangtcaagaaggagtacctgacgcgtattccgcatcatccggatcgacaacatgcccaagtgcatgcgtcagctcatcgcctcaagcaacgggctgcaagatccggcaaggctaaacactaatcacacgggcaatataaatgcattcgtttg

SEQ ID NO: 91236 - DNA, 571 bp, Triticum aestivum
  unsure (1)..(571): unsure at all n locations
  Clone ID: PAT_TA_91236
aggcagtactaccgcgagtgcggtactaccgcacccacctgcggtactaccgcgaggcaggtaagtcctagtctggaaacggcacggatgaataaaaatacatccgtgcctacttccccggtcaaagagatgatgcaaacatccgtcacggtactaccgtgcacaatgcgcggtactaccgtgcgggtgcggatgtaaaaaattacatccgcccctactaccgtgaagcaatggcactaggccagggaaccacggtactacagctcggggggagcgatactaccgtggggcacccgcgatactaccgtcctcgacgtgcggtactaccgtgttgggcgctgatgttaaaaattacatccgcgcctactaccgcaacacagcggtactnggatgggaagcacgtactacgactccaaaggagcggtactaccgtgggtcccgcgatatatccccaagggaatgaggaatcccggacaagggttccggatagcnaacttcacaccgttcncaagacatnanatcanattaanattctccgntccgatgganttcctnggtgaaggaacttgga

SEQ ID NO: 91237 - DNA, 633 bp, Triticum aestivum
  unsure (1)..(633): unsure at all n locations
  Clone ID: PAT_TA_91237
gttggatgaaatatattcattatactaatcatgcagggaatacttaaacctcctgagtcgaccgtagatcgagtcttgtgccagtaacccccatacttgtttcgtactactactcgtctctacagcaagtagagtacggttcaagtaagttgtcaacctctttctagcgcacaccgtacagagaggccatggtggaggataccggttgtagctgggtaggcaggccacctgggtccgggggcatgggtgtttccggttgacgtntaggggaagggcaccccttagagcacacnatataaattgattccatgctacgcgaggttgtagcctccccacttagagtttgcttaacaagtgtcgtgggtgatccagacacgtgtgagataagctggtgtgtgcaagttaagtgtgttttcaacaaaaagacgtngacagaattatcccgatggactaaagaaaccgttctcntgggtaaagatacacctctgcanagataaactataaatnacgtgtcatgtaaggatanatccggaanggcaattccgctaaggccgctccgagggaacgttacanaatggatncnatnggactgganacanataatttgtgtgnaaccgngatttgtatacagnn

SEQ ID NO: 91238 - DNA, 263 bp, Triticum aestivum
  Clone ID: PAT_TA_91238
gcgacatcgaagttgcatttggtatttaaaaatcaaaccacccttttcatatatataaatttggtccacatgcaagtgtgttcgtgttctgaccctctcccgcgtcatttttcgccaaatttatgaacattagacaagtcggatgacacaatagacatggttcactcaaactaactgtgtgccacaccggtgcccctatcacgcacacatccgcatagtacattgggctccacgaggctccccctcccaaaaatatctgcccg

SEQ ID NO: 91239 - DNA, 573 bp, Triticum aestivum
  unsure (1)..(573): unsure at all n locations
  Clone ID: PAT_TA_91239
tttacaagttgtcttggtgtgcttagtgcctcagtatgactatagagatgtgtgaattggtaggccaaaaatattcctacgtcccaaaccatgcacactaccttaggcggcccatcatggccatgagtgggtagtgctagctttgctccctcctattcaattgcatctcccttgatctcatagtttccctaccttctccgcatcaaaactgttgcctctataggtagtcctctcttgtattatcttattcacaaatcgcaacccccctacttgtgccatgtatgcttcatgttgagtcatttaattccagttctcactgcccatcgattatcaatctccgcataatcttcctaatccttatctgcaaactatccatcggagatctaagtccagtgtttggtgaacagctaagggtacacaagagtcacataaagaaggttgatataaatttgtgaccaacatccgaattcaaaaatagctcatactgtaagttaatcctgtccttgcatctaaaaggatgcaagcttttnaataatngaanaggacntangcncaaaaatgacccatacaagt

SEQ ID NO: 91240 - DNA, 546 bp, Triticum aestivum
  unsure (1)..(546): unsure at all n locations
  Clone ID: PAT_TA_91240
gtggaaagctacctagcataaacttgatcatttatctaatcatggcatgaatattaagacataagtgattcaaagcaatagtctataatttgacataaagacatcaatactcaggcatcccaacaaacaatcatgtctttcaaaatatcaacgctaaagaaagttatccctacaaaatcatacaatgttgtcatgctctgtcttctttacacaaagcatttatcatgcacaaccccgatgacaagccgagaaattggttcataccttttaacgcgcttcagcttttttaaccctcatgctatacatgagcgcaagccatggatatagcactagggtggaatagantatgatgataggggtaaatatagagangacanaaccttaagaaagtctcacgtcgacgcagctaacaatgggctatggagatgcccatcaattgatatcatgcgaggagtagggattgccatgcaacgaagcactaagactatantgtatgaaagccatatgaaaccatgggtgtcatcaacctatatgaaatccactatt

SEQ ID NO: 91241 - DNA, 596 bp, Triticum aestivum
  unsure (1)..(596): unsure at all n locations
  Clone ID: PAT_TA_91241
atggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatttcgggtgcaccgacgccacacangttatcaacgangtggaggangtcaagaaggagtacctgaccgtacgtcgcatcatcggattcacaacatcgccaagtgcagncgtcagctcatnccttaagcaacgggctgcaagatccgcaaggctaaacagtacnacacggcaatataatgcatncaatttgtaacctaaatncttggttcctccattgcctctactttcnanaaatgag

SEQ ID NO: 91242 - DNA, 619 bp, Triticum aestivum
  unsure (1)..(619): unsure at all n locations
  Clone ID: PAT_TA_91242
ctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaagtgatcaacgaggtggaggagtcaagaaggagtacctgaccgtatttcgcatcatcggattcacaacatcgtaagtgnatgcgtcactnatcgccttaaagcaacgggctcaagatccgnaaggctaaacantantcacgaaggcatattaaggcatncattttaancnaatgcttggttcctccattacttcnatgtcaaaaa

SEQ ID NO: 91243 - DNA, 222 bp, Triticum aestivum
  unsure (1)..(222): unsure at all n locations
  Clone ID: PAT_TA_91243
gttgttatgtctcattccgtgggttaattctgagttgttcgaccttcgagaagaacaattcttttagggtctttcctttcctctcgttgtcatgatagttggagttctcagagcaagacttcaagacaataatggtgaatgaatcaacattcaactgaagtgcaccctggatcgtgaagattatactantctgcgttacccttcaccttaccctacgcttga

SEQ ID NO: 91244 - DNA, 592 bp, Triticum aestivum
  unsure (1)..(592): unsure at all n locations
  Clone ID: PAT_TA_91244
acatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgactgccgctactgggacaatgtggaagctgcctatgttcgggtgcaccgacgccacacangtgatnaacgaagtggaggagtcaagaaggagtacctgacgcgtacttcgcatatcggattcacaacatcgcaagtgcaatgctcaactcaatgcctcaagcacgggctcgaagatcgnaaggctaacantatcacacggcacattaatgcatcattttaaccnaatcttggttctccaatgcctctacttcaa

SEQ ID NO: 91245 - DNA, 578 bp, Triticum aestivum
  unsure (1)..(578): unsure at all n locations
  Clone ID: PAT_TA_91245
ctcatagccattcaaagcctcttcatctccgaagctccaacccaaccgaggatgtcttgctgcggaggaaactgcggctgcggcaccgcctgcaagtgcggcaacggctgcggcggctgcaacatgtacccagaggccgaggccgccggcgccaccctcctcgtctccgccaccgccacccacaaggcgagctccggcggcatggagatggcngcgganaacggcggctgcggctgcacccaagtgcaagtgcggcaccaagctgcggctgctcctgctgcagctgctagatcgatnatcgancatatgcatgcaccgtgccgtgcgtgatcatcatcatatcgatnnactacnacatacaagttacccaactgatcgagggccttacnatganctgactgataacatcagtgcatgcatgatgtaaaaagcccctaataaattccccgataacttaaaaaagggggccgtacaattnccaaangatctataacccccacggcgtcnttaactcgacngaaactgggtacaataaccttaaaatccntncatggtanacaagcacntcctcaaattga

SEQ ID NO: 91246 - DNA, 591 bp, Triticum aestivum
  unsure (1)..(591): unsure at all n locations
  Clone ID: PAT_TA_91246
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatccctgggtactatgatggccggtactggacaatgtggaaactgcctatgttcggggtgcaccgacccacacaagtgatnaacaagtggaggagncaagaaggattacctgaccntaagtcgcatcatcggattcacaacatcgcaagtgaatgctcactcatgcctnaagcacggctcaagatcggaaggctaacagtatacacngcatttaatgcatcantttaaccnacatcttggttctccatacctcatgtca

SEQ ID NO: 91247 - DNA, 607 bp, Triticum aestivum
  unsure (1)..(607): unsure at all n locations
  Clone ID: PAT_TA_91247
acatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatttcgggtgcactgacgccacacangtgatnaacgaggtggaggagtcaagaaggagtacctgacgcgtattccgcatcatcggattgacaacatgctcangtgaatgctcaactcatgccttaagcaacggctgcaagaatccggaaggctaaacantcatcacgaaggcatattaatgcattcatttgtaatcnacattcttggttcctccattacttcnatgtccaaaaaatn

SEQ ID NO: 91248 - DNA, 593 bp, Triticum aestivum
  unsure (1)..(593): unsure at all n locations
  Clone ID: PAT_TA_91248
gcgtcaccattcttgaggaacttgggcagcgcctccagctccttaccagatcgcctgtcgatcttggtcaccagctcagcaaacttgacagcaatgtgggaggtgtggcagtccagcactggggcatagccgttaccgatctgaccagggtgggttcatgatgatgacctgggaggtgaagttgggccgcctccttgggcagggtcatccttggagtttggatgcaacaaacccacgcttcaatccttaacagcacgttcttgacattgaagccacgnttgtcaccaagaacncttccaagcaaaactcctnggngcatctcaacagacttgactcaacaaatattaccggaacaatggtgaanattcctacgaaaggttttatgaaangttccgaacatcaagacnacaaattctngttcacttttgcaatcaaaggaannttgaaagattttgacaactttttaacgtcaaccaccggtacnntntccaacncaagatcnaaattggtgnaggaatgcatcttcacttccncggggccggancaatccctaaggatctatacnnccaaggctctttaactcnacggaaacc

SEQ ID NO: 91249 - DNA, 416 bp, Triticum aestivum
  unsure (1)..(416): unsure at all n locations
  Clone ID: PAT_TA_91249
agggtcgcttccgccttcactctgtcagggatgaggatgctaagttcaagctctgcaaggtcaggtctgtccagttcggccagaagggcatcccctacctgaacacctatgatggccgcaccatccgctacccagacccactcatcaaggccaatgacaccatcaagctcgacctgggagaccaacaaattgtttgacttcatcaantttgaacgtcnggaatgttggccantggtacngggntgggcgcaacaatgcgtttttgngtgattcaaaaaacaaggagaagcattaaggaaactttcnaaacatccacgntttaggananccaangggaccatttttcaccnctttntggaacattnttaccaatannggaagggacaacctttgggtgagctcccccaaggggangg

SEQ ID NO: 91250 - DNA, 431 bp, Triticum aestivum
  unsure (1)..(431): unsure at all n locations
  Clone ID: PAT_TA_91250
ctaaggtctaatctatcccacatgcatatcaccaggtttgaggtagtggatcgtcctcttcatcggagcttgtctcctccttcccctttgggtcatagtcttcttcttcctccgtggtccagccagaatgttccagactccgaaaaggcataggtacgtggtacggtaagtaaaccgactccaaaataactccaatggcattttttatcagttttggaatatttaagaattttaggaagaaagaagtagtctgaaagggacacnangctcccacganaganganggtgccccctgtctcntgggcacctcntgtgcctcncggactccgttttcttgtanatacntattttggtcngtaaaattcattanatatactcccnaaggttttgaccactgtntnatgnaaatacctcnttttcnttcnanttgt

SEQ ID NO: 91251 - DNA, 452 bp, Triticum aestivum
  unsure (1)..(452): unsure at all n locations
  Clone ID: PAT_TA_91251
ctggggtgttacgaccctagaagcactaccaaacagaggaaccagtttgcggcagcacagaaggttttcttctttttttaatcttcatttgcatcttacttttgtcttatcatctaagtccattttaatctcactacaatttcactcttcgctacgatacatgatttttacaatctagctaccaagcacactcaccaaatcacatttccctttttgggcccttaattttgcgacaagtggctactttaaagcatataggatggataatacttatgaataaccgagagttgaattcctccaaatagttcacaagtagttaagaactcccgtcgcaagttaaaaagaataacagtggnataatttnctcaagttccnaaatttccgatccttcaacgnccattgtaggcttgagtttaccgacnnacgttactatcnatacgaaagccagaact

SEQ ID NO: 91252 - DNA, 618 bp, Triticum aestivum
  unsure (1)..(618): unsure at all n locations
  Clone ID: PAT_TA_91252
cgacaattgtacgcggtgtctgaaatcatcattcttatacggtgggttaggccagcaatcaaagttgaaaatattcaatttgagtttttgcaatttcttgaattttcaaattcttcaactttgcaatttcctcagtccttccaactatgttcttcattgctatatatatatatatatctgtgtgtgtgtgtacatgggtagtgatactacacatgatacatgttgtgaccaaagtgggtcctgctccgtaagagtacccacggggtgattcaaccgaactgcgatttttcatgtcctcctacaacattcacttataccaatccttcaagntgctttttcatccnaagtgaatgtgattgggctgttccccctccnangctaactcaactcatccgttcacaattctcaatgtcatncaatttgaacccgttcaaatctcacggntccttgacaacggagatttgccnaatgaaattaattccanacnattgtttnggtttgccntcaaacctccgnnccaagacaggtgnacancaccagattcaactccantanaggggaacanccccagaaacaaggcagggcactcncaattccgcaangtttcntgnaaaacnc

SEQ ID NO: 91253 - DNA, 413 bp, Triticum aestivum
  unsure (1)..(413): unsure at all n locations
  Clone ID: PAT_TA_91253
gcgccggaggacaccgccgctgccgttccggtggtgctgcccaaggtgggcgggagcggcgctgcgctgttcgactactcgcggggcgggccgcagttcggcgccgacgggctgctcatcggcccgccgctcaccgccgtgatgggggtgttcacggggcccgacgccagcgtcggcgtcggcgacctccggcgcgcgcggtcacggctcgggctgtcctacgcgaagagggaggacggcaangagagcctgttcggcgacgagtccaatgtcgaactcgacgaaagtgctggtcttctgtancccacagattgccagcatgtactaactcaattcttanagctatgggtgggatanttagcggaaaactttaaattangccggctgatttcacgccgctcaaaaaaaaaaaa

SEQ ID NO: 91254 - DNA, 435 bp, Triticum aestivum
  unsure (1)..(435): unsure at all n locations
  Clone ID: PAT_TA_91254
ccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacgcggtgccgcggacggtgggagaactccgcgcgctctgcaccggcgagaagggcgtcngcaagagcggcaagcactgcactacaagggcactcctttcacgggttattnccgacttcaagttccaaggngggantttaccaaaggnaacgaacggggggattcatctacgngaaatttncccacaaaatttntcanaanaaacanccggtttttccaagggcaaagcggccaaaaaaggnccatttttanatgacgntccccgcattgtccacggannntgctttggaa

SEQ ID NO: 91255 - DNA, 543 bp, Triticum aestivum
  unsure (1)..(543): unsure at all n locations
  Clone ID: PAT_TA_91255
tatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggttnaaggtcatgcaaggttttggccanccgaaggcattaagaatttcgaaacctttctancttgcaacgttanaagggaggctcctcnagcaagtgcactaccttattcgctccaaanggggcttgcccagttaacaggtnggttaactcccctntaganaancacncccngggataaaaagcngtacggaaanttggactccnnnttcgggggacgacccaanagggtttacagggggaaagngcaaaaggnncctaacttnttcgacaacggtnttnaaattgcacatnaatggtaantaacncttaancacnggntcaagantcggnaggctaaagtantacacggcaatataantcantcgtttttaaccnaatcttggttcccc

SEQ ID NO: 91256 - DNA, 559 bp, Triticum aestivum
  unsure (1)..(559): unsure at all n locations
  Clone ID: PAT_TA_91256
tggcccctgctttggccgaagagccagattcgtttgggggcgggggacaccaccccaaagacaacaccgccagtcgtgccggcgccaagtcggccccatggcaagaccgccgcaacggtgccggacatccctatgccactggatccaaacatgcatatggcacaggatcaagaacgacgacgacgacgatacatttgccaacgtcgattaagtactttgccgattcatggggacggtggcgacttcatggggctcctttctcaaagaacccaacccaacaaaagacgtgtgcattctaactggtaccgcngagaagcaantttcaaanagngtcttctgaattcactcttaagaaaccttccanctgccanttnaaccanctcaaaanggcaagggccaatatattaaccccacanatcnagaggatctgttaacaaatcgnccattcagantttaagaagaagaccaaaagaaatnaaaggtcggcaaccngacgcatagtcnttnaagangnacttaaagcgtttnccaggggccgtancaatccctaatgatctat

SEQ ID NO: 91257 - DNA, 617 bp, Triticum aestivum
  unsure (1)..(617): unsure at all n locations
  Clone ID: PAT_TA_91257
tttttttggatggaattattatgttttcttattactgtgtttttcgagtcatgccaatcaaagaggccctttcctccggataaaatctctagagaacggctagaaaatggtttcagaatgagaccatgattttaacttaagtggtttcacgtgcataatcaacgccacacgttatcacatcacaaattagaccattctagtccctcttgatttctctccaagccatgctcactccagcgatagtttgggccattgttaangctagcatctggaccccatttgccatgtcctcgggcgatgcatacccttccgggcttgtggctgtatcctttgtaacaaggaatgaagatcatacccattgggtgatattctggccatgaagagtgaatcntgataactccngcttatcaacaattgtatccnagntcaacgttttgcaacaaatccatggctttatgacgattgtcagacagacagnggtnccgggtgatgatctgattccgatattcacccacgtcttgatagnaatggagattgtgaactccaagaanatcctcttccacaacacctanacaattcagnggattactggatcatgnactcggagtctnanaaca

SEQ ID NO: 91258 - DNA, 620 bp, Triticum aestivum
  unsure (1)..(620): unsure at all n locations
  Clone ID: PAT_TA_91258
tctacctgactacacctccctcccagggacaagatgtacgagtgtgatgataaataagcaaataagggcgttgagatgtttctggtttggagatagatgctagaatagtaaccaatgttcagttttcaagcacgcatgtgtaactacaatccgaacaatttctctaaggctaagcacttaagatatgatctcttcaaaacctattgcttcacttggaaaaatgttaagaacattaagtttcctggattggtcctgggtatttgacagacatcccaagcctaaaagncctatcctccactggagagaatcaaantacacccttttggtaccttccngtctaattgtaccctgttgccntggaccctattaaataagatgtttaatggggcaaaaaaaaagggggggccccgtaccnattcgccctatangantcctatacgccgtcacggcgtccntttanactcctggacgggnaacctgggcntaccaattnnnccctggcaanaacccccttnccaactgggntatacgaaaggcgcacgatgccttcaaaattgccacctnatgcaatggaccncctgtcgngaatagcccgcggtttnggtanccantacgtnact

SEQ ID NO: 91259 - DNA, 588 bp, Triticum aestivum
  unsure (1)..(588): unsure at all n locations
  Clone ID: PAT_TA_91259
gtgatcttgatatggttgttgtctttggcaagtatcgttgtgttgtggttatggaagctaacaattccaaagtcttcgaaggctttaggagaggagacttgtatattgttgatttctctacaggaccgcaaccagccgtgtgcctacttgcaaaagcttcagaaggctggctatggcatcgacgacttggtcatgcaggcatgaggaatttgcacacgcttgggaagaagaagcatgtcattggcattggagaatgtcaaattcctcaaggatcacttgtgtggagctttgtgaagctgggaaagatgaccaaggctaagcatccagcaaagactatcatgaccactactcaaccattngaattgcttcaanaggttccctccgtctaacattaccaacatcacaaatgannatcccaaaagcttggtatggccatnatacccnatacacatggtcacatggtactncaactgaantcagganctcaatattcccaaggggggccgnaccaatccccnaatgatctatacccccacggcctcnttaaactctgacgggaaaccggntnccactatccctnacaaccct

SEQ ID NO: 91260 - DNA, 373 bp, Triticum aestivum
  unsure (1)..(373): unsure at all n locations
  Clone ID: PAT_TA_91260
ttttttttgatctttacaatttctaaaaatatttaaacctttctaaatgtccccacactttttgtgcagccaaaggataatacctagtaattatgtgtcatgtatcatctacaactaaaagtatttcctactaaacaaaaaaaaagcaagcagtaaataaaaatagaaaacagaaaatatgaaaaacagaaaacaaaactacggaaagaaaagaaacaaaaaaaagcgaagaaagaaggaaggccatgtgactgggacaagccaaccgcaccactcatcncctcctcgctacaaggnccgagggaaggccttggcggcaatccggcaacaatgnccccccntntcgccttccggcatccgcgcannccatacc

SEQ ID NO: 91261 - DNA, 594 bp, Triticum aestivum
  unsure (1)..(594): unsure at all n locations
  Clone ID: PAT_TA_91261
catagttctttgtgcctcctgacatttaggggttgtggcagtgtctcagggagttgagctccgangtgttgtcgtcacaattttatcgttgcagttctggaatacctgagatcgccgacatcaaaaatctcttttatgcagttgttggtgagataacctcnacgccacccagtactanggcgggagttcgggagtatttccataactccgtataacggatgcttttcgaangttgatgtacatggtttcccaaaggtttcttggtaagtgttgaaggatggatacaactggatgtaggattgtnagtttgggtgagaatagcnnccccttggtnccccaaaacaaantgcataaccgaatnttccggaantcaaaaggggaattcaagtnncccntaggancctttcaacaancncatgatncatagggttcaacaaagtttgttcccgctaatttggaancanccttggttgtttgantgnggaatcnattgcncatnnaatgttatcatacttataaaacgngtccanatanaggaggcaacctctattacagatacaagcaatattaacggagntcctaataaccaacctt

SEQ ID NO: 91262 - DNA, 461 bp, Triticum aestivum
  unsure (1)..(461): unsure at all n locations
  Clone ID: PAT_TA_91262
gtatgccatgttgtgtaccagacctattgtataccctgccctgagtttggcaagggagtacaatagtgatctagaagtagatcactggacattggtcaaaattatccttaagtggaataaggatatgtttctccgattatggaggtgacaaaaggtccgtccgtaaagggtacatccgatgcaanttggacactggatacagatgacccaaanctcaatcctgggatacatattgaaagtggggagcattaactagaagtactccatgtttaanattattggacatagaattttgcaaatacatacggnttctggaatatggcagcccgtttgactaacatcctccacaaagcaaacatgatcacaccttnanaccctttggggtattanccacatacgatgtggactaattattnccccaagtaacctttgggtgtttggcacatgagagttnacnaggg

SEQ ID NO: 91263 - DNA, 247 bp, Triticum aestivum
  unsure (1)..(247): unsure at all n locations
  Clone ID: PAT_TA_91263
ggaaattcaagatgacgcccgccacctgcaacgttctgctcgagacactcttcaagcatgacaagcacaaggaggccaatgacctgtgggagaccatgattgacaaccacagcccgccaagcttcatcggcatgaacagcgatcctacaatgtcatggtcaacaantgcttcaaagggaggcaagttccaagatgcattgaggngttccaccgccancccaggaggaactccaaatggacttcggtg

SEQ ID NO: 91264 - DNA, 562 bp, Triticum aestivum
  unsure (1)..(562): unsure at all n locations
  Clone ID: PAT_TA_91264
cgacgggccatcaagtcacaagtactggctgactttgtcgccgagtggacagaagccaaactccctaaagagtacggcgcgtactctaactagatcatgcacttcgatggttctaaaatgctggccggattggaagcaggtgtagtcctgacgtctcccaccgggagacacggtccaatacatactccaaatattatacacagactccaacaatgcggcccgaatacgaggtctattgcacgtcttccggatggcatctctaatggggattcaatgcctggaaggtgcgcaagattcaactccgtatatcacaaattaacggactttntatgncaaagacccaaatggcgctaacgttatgcgtcctcaaaagtcacccaattccaagggtcaattcacaagtngtccaagaacatcaagcgggganctcaacccaatcngggtaaccaccttncactaacaacctggnaagtgntaaaccancgtggatggaagggatcgcacatacaggtcgataacctaatccgactncaatatcgagntccacatanactngcaaata

SEQ ID NO: 91265 - DNA, 567 bp, Triticum aestivum
  unsure (1)..(567): unsure at all n locations
  Clone ID: PAT_TA_91265
aagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcctacttgccaccgctcagcacggaggccctccttaagcaagtcgactacctgaatccgctcaaagtggngccttgcccccaattnaanaggttggttcaacttcccttgagcaaaannaacccctngggaanacaatggccggtactgnnaagtggaacctgctantttcgatgnaccaaccaacnaggttancaaggtgangnngtcaaaaagggtncntnacccaattcgataatcgtttcanaaatctcagngcanggtaattaatcctttaancacgggtcaagatcggaagctaaagnatcacacngcatttaatcatgcattttaccgaatcttggttccncatactt

SEQ ID NO: 91266 - DNA, 608 bp, Triticum aestivum
  unsure (1)..(608): unsure at all n locations
  Clone ID: PAT_TA_91266
aaagcaggaccaaatcaagaaactagaacctaggggagaatggagctctcacagcgattagcgactagtggccgttggatagttttgcttgatgcgatccgggccgtcggatcaagccaccggatgacctcggctgtcggatcgaagaggaggcactattgcaatgaatagtttcactcttcactgaaaatatctcgtgccaccgtcattattttcatgccacgccgagggtgttttcgtcttttcacatgtaggtatatatagcaacatctcccgtagagacctagccgcctcctcctccctctcctcgcgcggtcgcgcctccctccgaaccctcgatncgcgcccgcctccctgccccacgccgccatcatctccgccggcgcccgcntcctctgccgcctcnatggtattaattgggagaagangatagagagaaattgaaaaaattatgaactnataggaacctatagccacccatgtanaattantaanggcatttttgganantgcaagtcaaanacaacattggtatcataacatgcctacaatattcccctcnccncaactctctanattatgatactaaaatngaatnacaggccttg

SEQ ID NO: 91267 - DNA, 505 bp, Triticum aestivum
  unsure (1)..(505): unsure at all n locations
  Clone ID: PAT_TA_91267
tgaagtctttctttaggacgtggcaactcacaaggtttaccgcattagatattaaaatttgtgcagtattttaacagcttggttgggattttgaggacatgttgagcattccttaataaatcaccccatacaatcgaatatgcttgtagagtaatgtaaatggcggtcagtcggcaaagaacatcaagagcatgtgctcatacggtccagctcgccgtatactgttgcagcacatcctgccattgggcgaccgaatatatatgttgctccgggatncggttaacaccaaaggtcaagccanttctgacacactgtggggaactgcagtattcaacggccgaatcacacagcaatgccaacggtaagatccaagggaagnngggggtnccaaccngcacncggaacacaatnaaccacttggccnatgctnccggttcnaccttcccctcngtcggtccgttagctaagccgacaaggtccatcattcgcgccctccaacgtccaa

SEQ ID NO: 91268 - DNA, 597 bp, Triticum aestivum
  unsure (1)..(597): unsure at all n locations
  Clone ID: PAT_TA_91268
gtcaaatgcggcgtcgtgggtgagatcgtgggtggcgtgcatggggctaagcctcccgagcatgcgtcaggccatgatgatggggacggttcacgccctcctccctaaatggaggtaggtgtgggggctnggtgcatttactgggacggggccggtgcgcggttttccgggacgtccactccccgcgttcacggggcggagtngaggccgcctcatctgtccgccttggttctgcatccccgccacgcggtcccatgcgctttggggtcaacgacggtggagttgggaaactggccgtcnccagcggtttggccccgatccctgccttcccctgcctttgatccnctnagccgggcngccgaccccaactcctcctttaataaagagtgagatgggganacaagaacccnatctctnactccctttcttnaacttcngcccccttctctcaactgccatgganaaanggaacccaagccttcaagttgngggnaaggtcccgcaancacgctcaacgcncancgcgtcaacctcggacggccggatgtcnctggggtctcgggaacctnactcntaggaacctttgcctttccncct

SEQ ID NO: 91269 - DNA, 615 bp, Triticum aestivum
  unsure (1)..(615): unsure at all n locations
  Clone ID: PAT_TA_91269
ctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtgggcccatcgagggcatcaagaattcgagaccctgtcctacttgccaccgctcagcacggaggcctccttaangaaggccatacttattcgcttccangtgggttgcttgcttcnanttcaacaagggtggttnaacttccgtttaacaacannnatcccctgggtactacnatggccggtactggncaatgtggaaactgctaagttccggatgcaccgacgcangcagtgattaanaggtggaggangtnaagaaggttacctgacccaantcgatcancggttcnacacatctcaagtgnatgcgtaagttaatgcttaaacaacgggctgcaagatccggnaggctaaacagnatcacgaangcataataaatgcattnaatttgcactcnanatgcttgggttcctccattacttctatntccaagaaantagtcaagtcaata

SEQ ID NO: 91270 - DNA, 623 bp, Triticum aestivum
  unsure (1)..(623): unsure at all n locations
  Clone ID: PAT_TA_91270
ttttttttcaaacatatttgaagttactctgtttgtttgtccagtaacaaacaagcaaggcagttcgtacaatacattcattcatactgttacaaccataagctaagtgcatcactcactgatacatacatacatacatacatacatataggtgcacatatgcacagataaattagatcacacactgtatatctcaccgttgtcttcctcccataccacagtcaattcctcctccgagaccgctgtcagctccgaagtgaaatgggtaagagcttctacgtggatgtgcccttcgtcgcagaaaaatggcctccaaaggcatctgtaggccatcaactccagctccaagatttcaatgacctcgctcatcgccggccgtnnacgagactcatccgaatacacataatgccacaacgcacagcttcttctccaactcgtgcatgtttgnaacaactggngatatccccccgctcttctnnngtaacgggtcanaaccaaganggtataccctggctnaggacccagttgggtanggtcctntcccgcgggcatccaagagnacancaantgtnctcggctnctggaaaacccggggggccggnccaatccccaaatngggcntg

SEQ ID NO: 91271 - DNA, 369 bp, Triticum aestivum
  unsure (1)..(369): unsure at all n locations
  Clone ID: PAT_TA_91271
cttgtttatttactgttgtatctgagtagcaagggaggggtttgtcaatcctagtaacacaaggtcttttgtgttttctcgaaaaaaaaatcctagtaacaccatgtctaccagatcatcattttgtgatattgcctaaattttacaaataaaaagcctaggcctagttcatttccattgaaaatggaagatctaattaactgcatcctaagtttgagctttttataccaccactacgctgaagatggacacaactccatgactactagattaattatagccactagagcctggcaccgctagctctacagagacaaaaacacagtacacaaacattccattgttgcctgcaaatnacatcacacatgt

SEQ ID NO: 91272 - DNA, 517 bp, Triticum aestivum
  unsure (1)..(517): unsure at all n locations
  Clone ID: PAT_TA_91272
gcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatcgacgccaacggcaggaaggtgggcaagaagggcgtgtaccattcgtttgacaagtacggcgccaacgtcgacggtacagccaatcctacacccaagaggaatggcctgaatcctggtgaccgctaccccggcggaacgaccgggtttcttanctngggctttanctctgcccggctcctnccgcggggggtctccncnctcttaaaacaccaacntcttncccgggtaaaanagacntacgttttacanaaaggccggtcctngttncangcaanccnggnaccaaanaacaccccngggaaantttnacggggggggcccgtcccatttcccnaaanga

SEQ ID NO: 91273 - DNA, 422 bp, Triticum aestivum
  unsure (1)..(422): unsure at all n locations
  Clone ID: PAT_TA_91273
tggctcgcccggcaccttggccaggaaaagccgaaatccatggcagtcctcacgacactcatgacccacttttgcgtgggacaagacagctggctggctcgcagcaataacatatcaaagaaccatggtacttcggataccaaggatggcaatggcaggtcacatcgcaacaaacacaagtgtcgtattaatagcgacaataccgaggatacggcagtcaatgccggattcaaaggctctaaacccggtcaagcggaaaaagcattcaaaaagaagcactcnggtgcccgtccagtttgggaccgtatatncnaccgcttttgtcaaaatacacgggacccccgacaatccaagcaaacaaaacaaacaggattgttggtgttcaaancaggctggnaatttaatggtaaacaaagataagg

SEQ ID NO: 91274 - DNA, 625 bp, Triticum aestivum
  unsure (1)..(625): unsure at all n locations
  Clone ID: PAT_TA_91274
ctcgagttttttttttttttttttagttcaattaaaacgtgagtgcaaggattaattacactcgttcaatttattcccatttagcagcaaccggtcttaatttcaccgcaaatttactcgtccttaattcgtggcacgaggcgagggcgcaacggcttctgcatgacgcaggtgaactcccgcttctcggcaaagtccacctcgtcgcccgcgacctctttccactccgaactccctcaccatgttggccacgaagtactcgaggtggagcatggcgacgccaagccccgcgcagatnctccggctgccccgaagggatcatcctgatctccctgttgccccgtcaacntcaaccattccctatcccccgccaagcacgaatctctcccggcgcgaatncancgggtctccaatcctccgggtccctgccatctcggcaacaaggaattnacctngggccttggggatnaagnaancccgcanagtcgatgtccccngcgctgtgtggaacacaatgcccnggggtgttccggangctcaggaaacgcctnaagtnggatctgtgaggcccccgggactctctggtgtgtcccgnattcggactnagatcccgaanctgccgang

SEQ ID NO: 91275 - DNA, 447 bp, Triticum aestivum
  unsure (1)..(447): unsure at all n locations
  Clone ID: PAT_TA_91275
cgcatatattcttcctgacgtgggacgccctaccgcgcgttttctgggtcctccttggtcgtagcgccgaagcaagtaaatgagtcatcaaatcacgaaagaccacctttcctgccgagtacatcagtgaagcacggtggctacctagttggtctagttcgaccgattagctaggctgcctccacatttgttttttcaccccttttttatctacttgccggtaggtaaatttaaatatccaccacgacgttactctggtgtttgagtgcggcaggattattaattttttgattgacgggagcaagcgcggcaagatttttaanttttttaatggatgggagcaagcgcggcagcaattagtcncgatgactccgcctgtaccactgctgcctgatgtgagaagtcgtccactggtgtttaccgtggggaaaacaaaagatccccacc

SEQ ID NO: 91276 - DNA, 483 bp, Triticum aestivum
  unsure (1)..(483): unsure at all n locations
  Clone ID: PAT_TA_91276
tatacagtacacccaagtatcccacgaaataatcacaaattacatcacgacgcaattgatgatacaatacaaacnaagatnacaccaaaagattaaatacacaaagtgatgccatggggcaaggagacattgcaaacgggtcaaaacaagagaagaaagctgaaagaatgaaagcgatatctatcctcctgccgaaagagcagcttcttcgggcgcctcacccttgggcgcggtactttggcggcggtctcctccgccgcgaacgatctcctcgccgttgccgccgcttccgccgcnggaacgcttctcctccgcctctttgtgcaccgtcgccggcgctgttccttgagcttctcnacgcaagcgcgccttcttcttctccaagctgctccttggcatcttccttgaactcngnttccaatttccgcnggcttgggagttctcccaacaaggtgatttcggccaagaacttcaacggcttgg

SEQ ID NO: 91277 - DNA, 299 bp, Triticum aestivum
  Clone ID: PAT_TA_91277
ccctcccttgcgctcgtgacccatctcacatctcccctgcgcgactgaccttcctccggcgccgactccggctccggccacctcacctaacccgtcggcgctgccctaacctgctagggcctagcccttcttcctgctgtaatcaacatcgtcgttgtctccttccttgtcggcggcaggggcgggtgcgggcgcggtggcggagtgcagggacgagacggcgccggcgagtggccgggaggagggggccacggcgggggaaaggagcggggacgcctcggtgggcacgggaaggggac

SEQ ID NO: 91278 - DNA, 479 bp, Triticum aestivum
  unsure (1)..(479): unsure at all n locations
  Clone ID: PAT_TA_91278
ccgccagctccacgagaaaaaggtagaccacgccaccgccgccgccgccgccgctgtcatcgccggctccgcctccttcccgccgccgactgtcccgacaactcccgcangaatggggagcaccgacgagactgggactcccctaatggcgaattacactatgcttgagctngganaaggaagttgtacttggcnatccgaaaacttgaggatctcggtnactgggagcttggnggtttnattggttccaatatcgctcgccgcctgaaagatttanggggaataacatcaattgcctcctgactgggaagaaagaacgaagcaatatgaccggaaggacatgttctgccatgaatttcaaccttngctgacctcaagggtcatgggacaactgccttaaaggttacaacaacgtcgacattctcaatctcgctgctgatatgggangatgggcttcatcaagtccaaacantccgttn

SEQ ID NO: 91279 - DNA, 207 bp, Triticum aestivum
  unsure (1)..(207): unsure at all n locations
  Clone ID: PAT_TA_91279
cttctcctccccttccggttcgggttctggttcggttcgggtccgagagtagctancctagtctagggtttccgtanttcggaagaggatagaaaggganagatccatnncggagacagagtacngctgcttcgngggcggctcacctgggncacnganttaacacaacctccaanangcnttcagacagtacagnnagatacncta

SEQ ID NO: 91280 - DNA, 456 bp, Triticum aestivum
  unsure (1)..(456): unsure at all n locations
  Clone ID: PAT_TA_91280
ggtcgttcatgtttaacaccattattgaaagcttggatctgagagagatagagctttcgggtagaaaattcacttgggctaattctttgcccactcctacgtttgaaaagcttgaccgtgtccttgcgagcgttgactgggaacagaagttttctctaagtcaccgtccaggcattatcgcgtggaatctcggaccacacccctttactaagttgactctggtgaggcaacgcatgtggggaataagaataccttctctttcgaattagcgtggttttgagagagaaggttctttgatcttatagccagggaatgggctaaagatcaagaggaangacttcaatttaganatggcaagaataagatacgacactttagaantcttgcctgggtggggctaacatctcaatggggtttataaggtttaaaaggaaagtccttcccttatcaaggctn

SEQ ID NO: 91281 - DNA, 429 bp, Triticum aestivum
  unsure (1)..(429): unsure at all n locations
  Clone ID: PAT_TA_91281
tctgaccggtgcagcgctcctcctcgccagcctccttgctcttgcagccatagccagcggcaacaccgaaggtgacatcctctactcgcaaaggctggcgtggaaggaccccaanaacgtgctgcagagctgggatcccacccttgtcaacccctgcacttggttcnatgtaacctgaacaaacgtcaanaacgtnaactccgtaatccgattggacttggggaangaaggctctaaggcgcctgggttcttgacnggaacaatggtaaccttaagtacttgagctgtttgggaanatataantggacgattcaagaaccttcggaaactganacgcctggtcaancttgattctanganaacatctnacgggggnatacaacctccttcggaaatcggannctgntttctnaagcngaagggaaaatt

SEQ ID NO: 91282 - DNA, 481 bp, Triticum aestivum
  unsure (1)..(481): unsure at all n locations
  Clone ID: PAT_TA_91282
gcagcacggaaccatgtacgacgacgtacaaacactgcaccagcaaactaagccacggcaaccacctgcatgcaggcacgaccgccacggatctttcctctgctacgcctccgcggcacaatcatggacatggcctctcctccgagcggagcgtgcagtgagcaggacggcatccccgtcgtccgaccttggccgtcctcctcaacggcgacgccggcgaacggtcgcaggcgatccgacacctccggccgggcgttncaaagaccgggagcaagaacaanggagaacatgggacacccggcccgattggaccccgttcggcgttcgggaacgaagcttcaactcccgccgttcgaacgggggccaagttactggcggggactacgtcaaagatgttcgcgcaacccggagtccaatggcccgccaaacccgacagcctgcggggcgttaccccaaaattaccggggcgcacaangggctn

SEQ ID NO: 91283 - DNA, 440 bp, Triticum aestivum
  unsure (1)..(440): unsure at all n locations
  Clone ID: PAT_TA_91283
cctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcaacaaggttgggttcatcttccgtgagcacaacgcatccctgggtactacgatggccgtaatgggacaatggtggaactgctaagttccgatgcaccgacgccaccaagtgatnaacaagtggaggagtcaagaa

SEQ ID NO: 91284 - DNA, 451 bp, Triticum aestivum
  unsure (1)..(451): unsure at all n locations
  Clone ID: PAT_TA_91284
gaacaaaggaaagcaagacagggccgcctttatatcttgggtcaccctgtagaagggagcaagagtgggcacatccgagtttagcacatgagagtttagatattcaatcagtgttttgcaatccatctcaagcaccatggcttcaccttcctccacactgtcggaaacaggtaactcacagtatgtcgacaaatacacttagcctctgtaatccctgggctactgctcccgcccatcccgggcactggatctgctaaaaactgtgtcattgttcanactatgtcntgccatgttctggtgggagtcnactgtatgggtggcaagtgaaacatgtatttgcgtggtaaacgacngggtcagttgttccctttccctctctgaaatcancttttccatcncattgcctanctcttggncncatttttgcangaaacttncanaatcangggan

SEQ ID NO: 91285 - DNA, 463 bp, Triticum aestivum
  unsure (1)..(463): unsure at all n locations
  Clone ID: PAT_TA_91285
ttaaactaacgcgagtttatcgacagtaaccgaggtgacatggcatcattagcagaggttcattgtagcttaattacccgggcgtcacacaattgaagcagattgcaagcctaatttcaatcttctgcaggtttgggggagaggtaaggtaggggaatccacctgctccggctccggtggcgtgctggtgagcatgagtccagtcaagcattcccatctcgcagcacggcatggatctcctgaattcacttctcctttcgcccatcgaacaaacgtaatcggcggctccctggggtggggcatcctctgcttctccgagaaatatccttcgaagtagattcgcaaggctaagattcaacaactcccaatccacatgatncttgaacatccgagcatacatgcncaagtgagagaatggatccgtcctcctcggcttctcctcgcaacttctcctcngctcctc

SEQ ID NO: 91286 - DNA, 452 bp, Triticum aestivum
  unsure (1)..(452): unsure at all n locations
  Clone ID: PAT_TA_91286
ggcaaagataacccgccgacctatgagttttctaatacgtgtcggctggcaaggtactgtggtgggtacagataggtgccctccatagttcgcttccacaggtgtggcggacggctttttgaacccgccacaacaatatttgcgcacccacgtgcgaaatgttttcaaatattttcagatagcgggtggcgggttctagctcgtcaccactatatttggtcatgttgccacctcccacgcttatactggggtggcgggctactccatgcgcctgtcacttctatacaagaccttacctaccccccggtagtcggagctcattgtaaacacaaactctttctccatcctctctcgccaccgccagcgtcgtggcgtcctccaatgccaacggcgangtcacaatccaccgnctcaaaaggcgtccaaggagcatcttccccgtcgcccangcc

SEQ ID NO: 91287 - DNA, 420 bp, Triticum aestivum
  unsure (1)..(420): unsure at all n locations
  Clone ID: PAT_TA_91287
agctgcatgcacacaggggcccacttgcagtgacttggtgagaagaccgcgggcggagctcgcgcccgtggccgcccctgcgcttggagctcgcgcccatggctgtcccgaggccggagctcgtgcgcccatggccgccccgaggctggagctcgcgcccacggccattccgaggccagaggtcgcgccagccggtccgaggccagaggtcccgcccatggccacccctgcgcctgggagctcgcgcccatggccacccctgcgcctggagctcgcgcccatgggcaacccgatgccggagctccgcccatggcttcccgangctggagctccgcgccacggcactctaaggccggactcttgcacgcgcccgaactccgctcacggcaatcnaggccggngtcaaggccanaccggngt

SEQ ID NO: 91288 - DNA, 458 bp, Triticum aestivum
  unsure (1)..(458): unsure at all n locations
  Clone ID: PAT_TA_91288
agtacagccatggcccccaccgtgatggcctcgtcggccacctccgtcgctcctttccaggggctcaagtccaccgccggcctccccgtcagccgccgctccaacggcgctagcctcggcagcgtcagcaacggtggaagggatnaggtgcatgcaggtgttggccaatcaagggaattaagaaatttcgaagacctgtcctaactgccaacgctcaacaacggagggcctcctcaaagcaagtcgactaactgattcgctccaaatgggtgcctttgcctcgaattcaaacaaaggttgggtttaacctcccgtngagcaacaagcatccccctggggtactaacnatggccggttactgggacaatgttggaagctgcctaagttccgggtgcaccgacgccaccaagttatnaacaaggttggaggangtcaaaaaaggntnnccctaacccttt

SEQ ID NO: 91289 - DNA, 453 bp, Triticum aestivum
  unsure (1)..(453): unsure at all n locations
  Clone ID: PAT_TA_91289
ggatattagagtctttcactcgactggatcttttcactcggatgactatattttcactcggaagacaatctttcactcggatgatgaccacattttcaatcggaagacaatcttttactcgaccgatcttttactcgatcggtaggttttcactcgaccttttactcgatcgataggttttcacttgaccttttactcgatcggtgggttttcactcgaccttttactcgatcgataggttttcacttgaccttttactcgatcggtgggttttcactcgaccttttactcgatcgataggttttcacttgaccttttactcgatcggtgggttttcactcgaccttttactcgatcggtangttttcacttgaccttttactcgatcggtangttttcactcgaccttttactcgatcggtangtttcactcgaccttttactcgatcgata

SEQ ID NO: 91290 - DNA, 378 bp, Triticum aestivum
  unsure (1)..(378): unsure at all n locations
  Clone ID: PAT_TA_91290
ctacagtcctactgtcagcctcagctcgcccgaagcaaagctagcgagtacgcagcgcgcgatggcggccgcgaccatggcgctctcctccccggcgatggcgggcacacctgtgaaggcctccagggcggcgcccttcggggagggccgcatcaccatgcgcaagacggcgggcaagcccaaggtggcggcgtccagcagcccgtggtacggctccgaccgcgtgctctacctcggcccgctctccggcgacccgccgagctacctcaccggcgaattccccggcgactacggctgggacacgnngggcctgtcggccgaccccgaaaacttcgccaagaaccgggactggaggnatccactgcctttggcaatctc

SEQ ID NO: 91291 - DNA, 291 bp, Triticum aestivum
  unsure (1)..(291): unsure at all n locations
  Clone ID: PAT_TA_91291
ctcgancngaattcggcacgagctgangcccgccacgcaacaacacggcacgatgcngcggtggtgttgctcctcngccggcggcctcgcccgccgcttcctctcctcccccatcntcttccatgccngcccgcccgtgtcctccctccccttcctccgngancactcccagacccacgcgcctctctccatcacgggctcgctgttcnactcggcggcagctgctgcgatngtcnggcctccngtgatggngatncatctgctccactacgccatcnagggcaagtcccg

SEQ ID NO: 91292 - DNA, 424 bp, Triticum aestivum
  unsure (1)..(424): unsure at all n locations
  Clone ID: PAT_TA_91292
natttgcagtgtaatcacnggntaaacttggcggtgttggagttggtacggtancagcangcaccaaagatggnncacgcataccatgaaaatctgacatgcnttggtttgggtttgactgatcattatcattattgagattaatgaactgatccatcatactcacggatgtgcttgctaaaccatggccacttgaaggcttccctgatcctacatctattccattgacatcancaacataatggagctcaganncaccatccangctancangtttacatcaaaatcgagnngaggaaaacnagcaanancacggancttcgganaacctcctcaatttcaantcangggnaattcatccaacangggntgntaaaacnccttncncgganacngaattaaaagancnaaggctcacaaggaa

SEQ ID NO: 91293 - DNA, 553 bp, Triticum aestivum
  unsure (1)..(553): unsure at all n locations
  Clone ID: PAT_TA_91293
ctcgtgccgaattcggcacgagatccaatccagcccccctacgatctcaccgggaaacctccgatccgagcgaagcgaaggctctctcgtcctcctcctcaagatgcagatctttgtgaagaccctcaccggcaagaccatcacccttgaggtcgagtcctctgacaccattgacaatgtcaaggcaaanatccangacaaggagggcatccccccggaccagcagcgtctcatctttgctggcaagcaactcgaggatggccgcaccctttgcggactacaacattccagaatgagtccactctccacnttgtgctcangctccgttggtggtatgcagtttttggtcaagacctcaaccggcaagacatcaacctggangttgatcnctcaagacaccattgacaatgtgaaggcannttcaaggacnangagggatccccccggaccaacanccctgtttttgccnggaagaatccaagatngcgcaaccttgcggttaaaaanccagaaggncaactccanttgggctaagtccttggggatcanaatt

SEQ ID NO: 91294 - DNA, 320 bp, Triticum aestivum
  unsure (1)..(320): unsure at all n locations
  Clone ID: PAT_TA_91294
ttttttttaacagatatatantctancttttaacatctatanacatcaaaacaaagtgccantatcacaacagataggantacattccaataccaatacanccacnactcagtanacacaaaataatagtgcagctctcttatcatcaaanccaactacattatatangagataacataaccaacggtttanagcttgtcctcganatcagncacaagggtcatctgttccttcanacccttgcncntgcngatctccgtgacaacggtngnantactgcggagccnngcctccaanngatccgaagacatgatgtccca

SEQ ID NO: 91295 - DNA, 367 bp, Triticum aestivum
  unsure (1)..(367): unsure at all n locations
  Clone ID: PAT_TA_91295
taaccttcccaaccacgattttttattccactccgttcagttatttctatacgaaataacaaattcattctaataatactaaaaaaaatagtgggttccatcgtttctatggttcccttttaaacggtgaggccctctctatacaccggagccctttctttcatcaaaaggtattgcgaacttgtatagtccacattctttggctctacctatccattatatagtanatagctcttttcacaanaatgagttatccatngaantgacggtatttaattatnaaagttggctaaatagctgacnctgtnagtccgttcttttaanntaaaggacataanccttttccttnaanacattcccgccggcg

SEQ ID NO: 91296 - DNA, 326 bp, Triticum aestivum
  unsure (1)..(326): unsure at all n locations
  Clone ID: PAT_TA_91296
aagggatcgatttcggtttgtgtatgagcaaaaggagctacttttatatatgtctgcctcttgtgaaataacagtgaatcagtcggtttccgaattctacactagcttcaataagattagaaaacctcctccgtctctgtctcctcttctaggaggaggatcggaggaggctataatantttnatntcgggcgtcgtcgatcgtcggacacgaaangagcataatttcaagaatataagatttcttgcgttttgtttgtttatcgacgcaattcgccgacgtntcctgttttttggttcnggtaccatgaattcaataggggcgcc

SEQ ID NO: 91297 - DNA, 524 bp, Triticum aestivum
  unsure (1)..(524): unsure at all n locations
  Clone ID: PAT_TA_91297
tgcccatgtctccacagttccttgattactccaacaatctcttctcatccatcccacgggatctgatgccgcggctaactagttctttctatctcagcatggccaacaacacactgcgcggaggcatcccgcatatcatctgtgatgcaaacaacctcaagctgcttgacctgtcttacaattatttcagtggccacgttccatcttgccttgtagatgggcgcctgaccatcctgaagctggggcataaccagtttgaggggacattccctgatggcatccaaggggtggggtgtgcttcccagacgatagatttgaacgggaataacatggangggcaactgcctaaatcattntcaagntcatntctgganggccttgaagttggcggaacaatttgtcaatcttccgaactggcnggggatntgacaaaactanattcttggttgaatncnacagattattggccctgccgggcggtcccgccaacaagaccantcnaaactngcaaatacctttccgct

SEQ ID NO: 91298 - DNA, 284 bp, Triticum aestivum
  unsure (1)..(284): unsure at all n locations
  Clone ID: PAT_TA_91298
ctcgtgccgaattcngcacnatgatgcctatgcacaatatanatcaccatgtgtttccanctgaccaaggncatgatgangtgctanggcatttacaacatcaggatttgataaaggagcaacaccangcaaagagccagaccgctcannggagtgcataccttgacctcccctatgcaatcnttcatgcatanatangcttcgatcganatggncatgatgctccananatgacgacctcngaanggactgcanaanatnaaattgaccaagtctggatgcat

SEQ ID NO: 91299 - DNA, 479 bp, Triticum aestivum
  unsure (1)..(479): unsure at all n locations
  Clone ID: PAT_TA_91299
aacacagagcaagaagagaagagagaagcaaagcttgagatggcgcaaaccatggcgtccatgaccggcctgtcgcagggcgtgcgtctcccaggcccggccggcaggcgcgccagcaggttcatcgtgagggcgtcgtcggcggaggcggaggccgccggccgccgcgcggtccttggcctcatggccagcggagtcgtcggcagcgcgttcgctcaggtggtgcacgccggcaccgtcgcggccatcaaggttggcccgccgccgccgctctccggtggactccccggaacggacaactccgacnaggcaagggacttcgacctgcccctgaagaancggttctacctgcagccgctgccaccggcggaagcggcagtccgggccaaggattcgcccaaggaatcctcaactcaagccgctcatcacaagaancaatgggcgtangtcannacgaccccgccnganggctctaactg

SEQ ID NO: 91300 - DNA, 359 bp, Triticum aestivum
  unsure (1)..(359): unsure at all n locations
  Clone ID: PAT_TA_91300
gagaaggaaaaccaaccagaanaaaagctcgggaggagagcgtggggggcctagggagcatggcggagcacaaggaggagccggtggcggagtccatgatggacaanatctccgacaagttccacggtggggactcntcgtcgtcgtctgtcggactcggacgacgagaagaangggtcggcggcgggcgtcaaggccaagatctaccgcctcttcggccgcgacaancccntccacgcngtcntcngcngcggcaancctgctgatcttgttctatgnangaacantaaggtctccggangggtgcttgcaggcnccactgccatctggncncttttcgatgtccatggtngtacatc

SEQ ID NO: 91301 - DNA, 191 bp, Triticum aestivum
  unsure (1)..(191): unsure at all n locations
  Clone ID: PAT_TA_91301
ctcgtgccgaattcggnacgagcaggagcnatatttactcccncangcatgantcgccacccgagcactaagtgggcgcacaggctgganaangtttacttgacnattgnactgccngacgcaaaggatgtnangctcaacctgaggnctganggncatttcaacttcanagcaanggccccntntgatga

SEQ ID NO: 91302 - DNA, 361 bp, Triticum aestivum
  unsure (1)..(361): unsure at all n locations
  Clone ID: PAT_TA_91302
agcancancaacttcagcggctaccgcggcaaaaanggcgccgcggacagnatnaanaagcacnccaataangancgaggggacatcaancacngtgccgcgtcngataagcggttcatnactctgccggcntccgacgcgctgccccggaactagcccatcagcggctanatcttcgtctgcaacancgacaccanngnaggagaacctcaatnaggcangtcttcnggttgccatccanatacagagattcanttaagggngatnanggcaanggntgcccctcntccttcnacaaatactccagccnancagctccancgcatcntcgacggctgctatctttggntggactaacatc

SEQ ID NO: 91303 - DNA, 478 bp, Triticum aestivum
  unsure (1)..(478): unsure at all n locations
  Clone ID: PAT_TA_91303
ncannctatatacctacatagcacagccatggcccccaccgtgatggnctcgtcggccacctccgtcgctcctttccagnggctcaagtccaccgccggcctccccgtcagccgccgctcnaacggcgctancctcggnagcntcagcaacngtggnnggatcangtgcatgcangtgtggcccatcnaagggcatcaaagaattcnaaaccctgtcctacctgccaccgctcaagcacngaggcctcctcaangcangtccnactacctgatcccgcnccaaaatgggtgncttnccnccnattcaancaaggntgggtcatccttcccattaacacacgcatnccccttgngtactacnatggccggtactggcaatgttgnactgcctatgttccnggtnaccgatccacacagtgattnaagagtggaagagtcaataagatacctganncttctccgcatnaccgattcaaaa

SEQ ID NO: 91304 - DNA, 563 bp, Triticum aestivum
  unsure (1)..(563): unsure at all n locations
  Clone ID: PAT_TA_91304
gcggctttacctaccgagaagaagagagaaaaaaggttcgagtgcgttgcagagtgagaagagatggctccggtgaagctgtacggcgcgaccctgtcgtggaacgtcaccaggtgcgtggcggcgctggaggaggccggcgtcgagtacgagctcgtccccatcaacttcggcaccggcgagcacaagagccccgaccacctcgccaggaacccctttggccaangtgccagctttgcaaggatggtgacttngtacgtctcnaatcaccgtgctatttgcaatatgccgtgccggcangaacaaaccaagagctgttgaanggagggcnacatcaaaggagtcagnattggtggatttttggtcnaaggtggangccatcantacacgccgctctgaccccatcccctcnaatgccttaccacccaagttggggagcanggacanaaggcattgcgaaacctntnaaataagacttgcnganttacnaggccactgacatncaattcctgncgggaancccatnttgngnctaacagntctttaccntctngggnaaacct

SEQ ID NO: 91305 - DNA, 406 bp, Triticum aestivum
  unsure (1)..(406): unsure at all n locations
  Clone ID: PAT_TA_91305
ggnttcanggcantcnattctcnctctctcttccccttccttgctttcctctgcttcctgtccgntcgtgttcgtccntatcctttttgcntgcggaganatatatantggcaaagtttctcggaaaggagcnccttcccttcnccgcttcaattcccacctccganaaancgattcttatccaagtttctgattctgccgaatcgattcactcaattcagcccttccttgcccgattgggatatggantcnatccgcntgtngctggntcgagcntcaagcgggggactgnaatcaggtggatntgattngggtcacgctccgnntnaaccggccggcaanaaatcgattggctnncccgngggtaagctctcttangtttcntcnggttgcnaacanttcgata

SEQ ID NO: 91306 - DNA, 200 bp, Triticum aestivum
  unsure (1)..(200): unsure at all n locations
  Clone ID: PAT_TA_91306
ctcacacanccncctntgttctgtttantctccattnctcaaganaaggcccgggcggcaaaacatgnggactnaagcagcgganaacttngaaccacnggccatagangtcaagacagatgatcanaanatanattgacgacatggntccngatcacatcntcgacggaacgcnatctgcatggtnactcgaacttcca

SEQ ID NO: 91307 - DNA, 299 bp, Triticum aestivum
  unsure (1)..(299): unsure at all n locations
  Clone ID: PAT_TA_91307
ctcgtgccgaattcggcacgaggccttgccttggagctcaactcgaccatgccgtcgccgatcctaccggccaaggaggtggnngaggtggtcaccgccaacgaacaggtgacagatatcatantccagagggtgccntactgggancctccgacggtccgggcgctgganncgatgcgagctgatcanctgagtctctctaccgcgccctcatcggcgangttcanggnctccctcatcctcctctacgtnagcatcgccaccgtcatnggggtaccggagacantcntccnccggcg

SEQ ID NO: 91308 - DNA, 329 bp, Triticum aestivum
  unsure (1)..(329): unsure at all n locations
  Clone ID: PAT_TA_91308
ggcttcanggcantcgattctcnctctctcnnccccgtccttgctttcntctgcttcctgtccgntcgtgttcgtccgtatcctttttgcnatgcgnanagatatatactggccaagtttctcggaaaggagccccttcacttcnccgcttcaattcccacctcagaccaancgcantcttatccagtttctgcntctgccnattcgattcaattcaattcgggcttccttgcgcgaatggatttggantcaatccgctgttgctnagttcgagcntccagngggggancnntaatcagnnttggatctgatntggtntcncagcatcc

SEQ ID NO: 91309 - DNA, 560 bp, Triticum aestivum
  unsure (1)..(560): unsure at all n locations
  Clone ID: PAT_TA_91309
ngaganataggacttgtgcgccgcacgccaaanancangcacgtnagtcgagtcnttcccgttgttgcggccggcggnggaagagatggcgannaacatcnaggacntnccttcngtggagctcatgaccgagctgctccgccgcgccaagtgcagctccaagcccgacaagcgcatcatcctcgtcggtccacctggctctggaaagggaacacagtctccccttattaaggatgaatattgtttgtgccatttagccactggcgatatgctgagggctgctgtcnccgctaagactcctctgggtatcaaggntaaagaantatggacaagggacagcttgtttcagatgacttggttgttgggattattgatgaagcatgaaaaaccttcatgtcaaaaaggtttatccttgatggcttccctagaactgttgttcaagcanaaaagctcnatgaatgctggcaaacaagtctaanggtganaggtcaaatttgaattgatgatgcannttgganaacaattatggccttgatacaccatcagtggtaatntncata

SEQ ID NO: 91310 - DNA, 212 bp, Triticum aestivum
  unsure (1)..(212): unsure at all n locations
  Clone ID: PAT_TA_91310
ctcttnnntttttcggcacgangtctcccatcgantttnntccttttggattncacaaaccctnatatngcagtntgtggttgttcnacngatnatatncacacgttanacggcacatgtgtatgnattatcccatagtaaaagcaaaacttaatcccagacgaccaaaataacancatatcanggcgggcttaagaaaccctgctcgacca

SEQ ID NO: 91311 - DNA, 663 bp, Triticum aestivum
  unsure (1)..(663): unsure at all n locations
  Clone ID: PAT_TA_91311
ctcgtgccgaattcggcacgaggctaaatattattcatagccggtcccaagcccggaaaaaggaggagggtccaaccccaaaaattatccgtgaccccaaaaattcatgatttggtttttgagaattgtcctttttctcctttctactatttttctgttatatggggtttacattatccgtcactagtaaaagagcccgtgcgttgcaacggtaacatgcatgttagctctatatcgaaatgcattgtctactttttttttatagttataaaacttttcttcatcttatatacgctcttgctataaggaaaaaactcatccatcatgtatgatgttgcganacccaactaatagtagttattaattattataattaataagaaaaatacatctcctttaagtanaaagggcagttctagatnatctcttctctttttttgcaaaagantcnaataanccatacgatatcccaagtttacatagatanattcaataatagtcacatatatggataacctcggtgcgtgaaaaaccatggntacaaaattcaaatgcatcagatanatgcaccagttaaagaanngncagtcaaatggaatcannactcatttttatgggaaaccgnatttttcnnntacataaatcatnttatcaggtnaactg

SEQ ID NO: 91312 - DNA, 360 bp, Triticum aestivum
  unsure (1)..(360): unsure at all n locations
  Clone ID: PAT_TA_91312
cttagctagctaccttactcnacactgngtcnacacccaccgcacttnaccaactatggcnatggncatcaacaacaacggtgccggcacngtggntctggccttcntnaacgtctccntgctggtctccacggtcctgtccgcccctctgagacngcagcnggtttccactccagcgacgtgcccgcatttggagagcatcgtgctgtcctcngtgcaggcgncgctccagngcaaggtggcactcgccaccggtctcctccgnatcttcntcnaanactgcttcccacaaggctgcgacacgtccagtgtacctnanaggnaccngnacgganaatgccatgtngnccaacacnatct

SEQ ID NO: 91313 - DNA, 615 bp, Triticum aestivum
  unsure (1)..(615): unsure at all n locations
  Clone ID: PAT_TA_91313
ctgcaccgcaccccgtcgccggccggccggccgcccatcatccccgccgcacctctccgccgacgccttatcccgtcgcccaccccgacgccagcaacgccctgcagttccgccgccatggaggaggaggaggagatatctgggaaggagttgttgaggctggacaactctcttgcggaggcggaggatgcggcggtggccagtcgactcaccgacgacctcatcgtggagatcctgtcccggctccccttccggtccgtctgccgtttcaagtgcgtctctaagccctggcgcgacctcatcgcccaccccgcccaccgcaagaagctgccccacaccctcgccggcgtctctacacaacatcaccggtgccggcggctatcgctaccacctggccggctctcngccgangcgggcgtcttatctcgacccttantcacgtcctgcacatacngagtaaaggacttaagctggtcncgctgnatgcttctcctctgtctacaaccggngaggaacgtcgttcctntctgaatcccgcaccanagtggacgncnccctcccgcggnaacaatcgnntacanatcatcggnttcacagaatcgtcattcaatttat

SEQ ID NO: 91314 - DNA, 219 bp, Triticum aestivum
  unsure (1)..(219): unsure at all n locations
  Clone ID: PAT_TA_91314
gcacggtagaggagccggttccaccccaacccgcttcttcccccgccgccccacccccatcctgcttcttccccgccggcgccgccccactcccaactttcttcttctgccgccggcaccggccnacnccccanctcgcttcttncncgccntcgcngccncnctcccnacttgcttcttctgccttcggtaantgttcaccccgatnncgcttcttcc

SEQ ID NO: 91315 - DNA, 699 bp, Triticum aestivum
  unsure (1)..(699): unsure at all n locations
  Clone ID: PAT_TA_91315
aaaacacatctaaccagaggctagaacaaatatttattcctaaacagaagaaaaaataaaaaaaataaaaaataaaattgggttgcctcccaacaagcgctatggtttaacgcccttagctaggcataatagcaaggatatatctaggtattgccatctttggttttagggaagaaaagagcaaacttgttatctatggaattaatatttctattttgataaagcacgtggccattgatggtagaagaaagattaagcacgttgcggaaatttgcatctaggctagcttttatctctttaatatattcgttttgggtaggagagcaacacagatgtggattcaactttctcattcaagggatgcccaaatatagttttcatcttttcataggtatctatggggtccccttgaagaaaacctcntcaaaaatagatctaaaacttgtttgaacgaaacgggcaaccatcataaaagcttttagataaacccaattgatatggggtacatactagccggntcttaaagcctatcccaagcatcttcaagatcataagtaataacggatatccggatcactcacaaatntcagctcatgaggccggngtctcanagacatgttagactannngcaaggtncaagncaaaccggagnaccaactttgtnaatggaaaagnattgaanaggnataangaggnag

SEQ ID NO: 91316 - DNA, 587 bp, Triticum aestivum
  unsure (1)..(587): unsure at all n locations
  Clone ID: PAT_TA_91316
gaccagccgctcctccccctcgcccgcggcgactaccgcctcttcgtcttcctctaacgacaccacccaaccacgtgaggcgagaagaatcagcatcggggccttgatctagactagagccgtcctcgaccaggatccaagaagagggaggtttcccaccgtgctggcatgtcggcggtggttgcgcaggacgtggcgccgcccatcgaggctgcctcggcggccgaggtggagtgggcggcgtgcgcgtgctgcgggctcagggaggagtgcactgcggcgtacgcggccggcgtgcgcgcgcagtacgccgggcggtggctgtgcggcctatgcggcgacgccgtgggcgaggagctcgccgcggctggcgccggcggaggaggatnggcacggcggantaaangcggcgatcgcgagcatgcggcttctgcggtcgtcgccgcancggccgagcggtcatcgccgcggtcggcgctgctcgaaccagacgggaggaaccgaggcctggtggngtcagtcaagangctgaactgaagagntgagatcgtcgtcanagtactaaatcctacnagtaaatatagctc

SEQ ID NO: 91317 - DNA, 354 bp, Triticum aestivum
  unsure (1)..(354): unsure at all n locations
  Clone ID: PAT_TA_91317
ctcgtgccgaattcggcacgagccacgctcccccgcctccccctccctcccccctcgatcccgccgccgctccggccccactcctcctgccgcctcctctcccgccgccgcgccctcctcntcctcnccctctcntccctgcgcccatccggctcggccgtctcctcctccgcngcgatggcngcgccgccggtggncannaaggtgccgcagaaactggcngagcacggggacntncgcgtngacnactactactggttccncgacgantcccncaangacacngncgtcctcgcccancttcncnccganaacnactanaacgtcgncctcatgtncnntaccaaacaactt

SEQ ID NO: 91318 - DNA, 423 bp, Triticum aestivum
  unsure (1)..(423): unsure at all n locations
  Clone ID: PAT_TA_91318
ctcgtgccgaattcggcacgaggcttctcctccccttccggttcgggttctggttcggttcgggttcggttcgagagagaggccgagtagctagcctagtctagggtttcggtagagaggaagtgagatccatggcggagacggagtaccgctgcttcgtgggcggnctcgcctgggccaccgacgacaacaacctccagcaggccttcagccagtacggcgagatcctcgacgccaagatcatcaacgaccgcnanacngggaggtcccgtgggttcggcttcntcacgttcggcagcgaggagtcnatgcgccaggncatcnatgagatgacggcatggagctcgancggcgnaacatcaccgtcatcgangnccaatcccgccgctccggcggttnngncggcagcagcggctacngcgg

SEQ ID NO: 91319 - DNA, 579 bp, Triticum aestivum
  unsure (1)..(579): unsure at all n locations
  Clone ID: PAT_TA_91319
tttccatccgccatttcccgaccaatatgattaagcttgcgttcctcatccgaggaactgcactgctcctttgcctattgatcttccaagcagcatccacttcccatggcctgagtgtgtcaggagcctgcatcagcagcgagcgagatgcacttctgtccttgaaggcaagcctcctggaccctgctggccgtctctcgtcatggcagggtgaggactgttgccagtggaagggagtccggtgcagcaacagaacgggccatctcatcaagctcaacctccgcaacatcaacatgaacgacatgggctattacatgtacgactacgtgtacgactacatcgactacagcgactacaagagcaagatcattgagcttgtcggcgggcgagatgagctcttctttggctacttacaacacctgangtatcttgacctgaactgggattactcaatggcacaagcatccctgtcntcctgtcntctctcaagaactaaggataatgggagaatacttccaactnggaatcctcaaaattggatatctgagtagtggaatatataatatatggaataaaaaa

SEQ ID NO: 91320 - DNA, 385 bp, Triticum aestivum
  unsure (1)..(385): unsure at all n locations
  Clone ID: PAT_TA_91320
ggaaagcttcgatcgagnganaggagagganagganaggaantcaccatagaaccctacatctgnnccacatgtacanggcgctgcttaacntggtcacgaggatgaagtccccggccgcnagccatccttacttccccntgtctcncactccggtttcgacgacggtgccctccgctccaanctcttcagcacctttnncggaatcataggaaatatgtnaaaactggctntaccaatagaatctacctngacttgatccattnaacaaanaccatgnatttattacgnccagcattgnntttcttnatacgaccancatatatctnacttggtccttcatcctgcntacgtttattcccaccntctctgttatnctgantcaa

SEQ ID NO: 91321 - DNA, 608 bp, Triticum aestivum
  unsure (1)..(608): unsure at all n locations
  Clone ID: PAT_TA_91321
gaaaacagagaaacccgcccgatcccataccctccagcgcgccgcaccatgacccgccgtcgcaccatgcccccccgccgcgcgccgccaccccatgacccgccgtctcaccatgccccgccgccgcgcagcgccaccccatgacccgccatcgcaccacgccccgccgccgcgcactgccaccccatgacccgccgccgcaccataccccgccgccgcgtgcatccaccccctgccccgccgccacgcgcatccacctcctgccccgccgccgtgcgccaccaccccctgtcccgccgccgcgcgcgcaggattctaccggccggagaagccgtgagccggatcagcctcgcccctgagctcgtcttcttccctgcctccttccgcgaaccggacgcctcttctgggtggtctgcacgctgcgtcagcggtcaacctcgtnaccgaggcgttcacgtanaaggctccctcgtccgcgcatgggtccctgacggcctnccgaantgggcgacgtnctgccactttctctccgtatgaacaangatctgttatnngtagnttgccaatgntatcntgtanacagttgatggtncgttattgacncttgt

SEQ ID NO: 91322 - DNA, 656 bp, Triticum aestivum
  unsure (1)..(656): unsure at all n locations
  Clone ID: PAT_TA_91322
gtggattccacttcctgcctccccggctcgtgcaagctccacagctttgcttgcacacattggtgcgcagtgtgcaatcgtgtctagggcacaaatcatatcgacggattcctgctgtctcctcgtttctgtaagtaggtgagtcgtcgggtgaagaagcaagctcaggtgccgctctgttgccggtcgatcgtcgccggccgtagctcatgacgacggagaagggatcgtcggcgtcgctgggacggccgtgtatcctgatcatagtgggtggccggcgtggagcggttcgcgttcaagggggtggcgtccaacatggtgaattacctcactggcgtcgtggggatgagcacggcggcggcggcgcanagcgtcagcgcatgggtanggatcactccatgctgccgctcgtcaacgccgtcctcgccgactcctactgggatcgtactcaacgtcacgcatatccttgctctatgtcccgggctggaagacagctcatgggaatgctcaaaatgatcatggcgacctctctgcantcactattcatnggcaagggctaaacctcgtgaacctcgggccacantcanatcgnacaggacaaaagggggggggaaacgngaaatgaagnaaaacctctcangggactcgaaacngga

SEQ ID NO: 91323 - DNA, 467 bp, Triticum aestivum
  unsure (1)..(467): unsure at all n locations
  Clone ID: PAT_TA_91323
gttgggtttatcttccgtgagcacaacgcatcccctgggtactacgatggccggtactggacaatgtggaagctgcctatgttcgggtgcaccgacgccacgcaagttatnaacgaggtggaggaggtcaagaaggagtaccctgacgcgtatgtccgcatcatcggattcnacaacatgcgccangtgcantgcgtcagcttcatcgccttcaagccancgggctgcgaggagtccggcaaggcctaaacagctcactcaccacgggccacatataaagtgccattgcggtttgtcaactctgacattgctttggggtttccntttccattaaccttcctggttggtcctaagataagaatattgtantccatgttccgacatgactcaagaaacaagctcntaagtnaatgctaccgatggctattttaatcacatcacattatatnttantcaaaaaaaaaaaa

SEQ ID NO: 91324 - DNA, 607 bp, Triticum aestivum
  unsure (1)..(607): unsure at all n locations
  Clone ID: PAT_TA_91324
acgagggcgagggcggccgggtccgttgaccgtcgacctagctcctcctgtcctgagaaccctgcgaactgatggggtgcttcgcgttcaagggcggcaagggccgtcggcgcccggccggcggcggcaagccgccgcccgcggagcctaagccggacgggccgaagcggagcaaggcgtcgtcgtcgtcggcgtcgacgccgacgaggagcatccaggagctgtcggaggagcggggcgcggcgcggctgcgcgtgttcgggctggaggagctcggcagcgccaccaacggcttcagccgcgcgctcaagatcggcganggcggcttcggctccgtctaccgcgccttcttccgctccgccgccggcggccgcgtcgtcctcgccgtcaagcgcctcaaccaacgcaacctgcaagggcacaagcaatggcttgccaagtgaattcctgggcgtctggacaccgaactggtgaaactcntgggctactgcccgtggacccgaggccgnaacanaggtgctgtgtacaatcatccaacagacctgacacactctnaaccagcaacgccgtgcctgaagacagtgaatatgcgggcccccgctcatan

SEQ ID NO: 91325 - DNA, 638 bp, Triticum aestivum
  unsure (1)..(638): unsure at all n locations
  Clone ID: PAT_TA_91325
gtcaagctaagctgtaagctcccgccagtcttccatagccaattgatccatggccgccacggcaggaagcaccgcaggttcgtcgtcgccgcgcaccagcttcgtcgcggactccctgatcctccccacgcgcaacggcagcctcttcgcgtccgccttcgcgctcgtctacgcccacaccttcgtctccctctccgtcgccctcctctacgcccaccccctcgccgccgccgtcctcgtccacgtcggcgtgctggccagggaggacgacggctacgacttctacgcggcggaacgcgacgaggagattcggggacacgcanagaagctgctcctcctctacctcgcgtacctcgccagccaagctcgtcacgcgggtcgccgtcgcgctcgccgcctccgcgacgtgcgccggngaccggcgcccgcgctcgctggcgaactcgttccgcaggcaggatcgcggaacttggcaacggcgcctcgtcgcgtctcaagtcgctcgtcgggggtctctcncgnttctccctctggtgttgtggaccccgggctgtgccggtcgaaaggcgcgcgttctcttnngtaggtactgcgttccctnnctgttcttgaattcngcgggatcaagggtgcgtnng

SEQ ID NO: 91326 - DNA, 426 bp, Triticum aestivum
  unsure (1)..(426): unsure at all n locations
  Clone ID: PAT_TA_91326
ctcgtgccgaattcggcacgaggccgccgccgccgccgcagagccgcagggagagaaggcaaggangaangaaggggaagatgccggcggggnacggnctgcngtcgcggacgcgcgacctgttcncncggccgttccgcaagaaggggtacatcccgctcaccacctacctgcncacctacaaggtcngtgagcacgtcnacntcaaggtgaacngngccgtccacaanggnatgcctnacaagttctancacngacgcacnggncgctctgcaangtnacaaagcgctccatcggtgtcntataacaancaggtcggnaacaggatatcaagaanaggatcattccgtgtngancactcagccatncaagttcatnangattctcatangaantaanaacnacaanctaaaggtngaggtatgg

SEQ ID NO: 91327 - DNA, 623 bp, Triticum aestivum
  unsure (1)..(623): unsure at all n locations
  Clone ID: PAT_TA_91327
agaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaagtccgcactgacaagacctancctgctggggttcatggacatcatttccattcccaagacggtganaatanaggttcnttatgacacaanggtcccttcgcttnancttcaaggatgaggatgctaattcaactctgcaagtcaagtctgtcaattcggcaaaaggnatcccctactgaacactatatggcgcacatccgctaccagaccatcatcaaggcaatgnacataactcgactgagacaaaaatgtgactcacaagttgactcggaagtggcanggtacggnggcgnaaacggctttgngtataanaaagaaacanagg

SEQ ID NO: 91328 - DNA, 402 bp, Triticum aestivum
  unsure (1)..(402): unsure at all n locations
  Clone ID: PAT_TA_91328
ctcgtgccgaattcggcacgagattagtccacaatcaaaccgctgcttctccgtcgtgcttcgtcgctaagcctccggccgcgttctccacacccacacccgaacaaatccgtggggactgcgatccccaaaccagtcgcaactctcggaccagaagacaccgccggccggcggacggacggaggaacccatggaggaggcctgcgagatcncgcgcctgccggaggagctcctgtcggcggcgctggcccgcacgaccccgcgcgacgcctgccgcgcagccgccgtctccccggccttccgcgccgcggtcgactccgacgacgtctgggccggcttcctgccccccggngactcccgccctcgcctatgggganctttcgtncngcacgntctcgtcca

SEQ ID NO: 91329 - DNA, 276 bp, Triticum aestivum
  unsure (1)..(276): unsure at all n locations
  Clone ID: PAT_TA_91329
ttctggttcggttcgggtccgagagtanctagcctagtctagggtttccgtagttcgganaggagagaaagggagagatccatggnggagacggnataccgctgcttcgtgggcggcctcgcctgngccaccgacgaccacaagctccagcaggccttcagccagtacggcnanatcctcnatnccaagatcancaacgaccgctagacgggcangtcncgtggnttcggnttcgtcatnttcancatcnatgagtcgatancnccagnccatcta

SEQ ID NO: 91330 - DNA, 263 bp, Triticum aestivum
  Clone ID: PAT_TA_91330
gttgtactgacgttttccgagcggttgaaccgatgcgtactcttgtaggtgcggaggtctgcaccagattccgcatgtcccgcaatccagcaatcgagcagcgatggaggtctgccttgttgagcaatcgagcaaatccaccactacatcggcatcccaccccctccccccaactcctcgccgcgaggacacgaagggagagcgacgatgcaccggcgacaaggcgagctgtgccgtcctaggggcgtcgcggctggattggg

SEQ ID NO: 91331 - DNA, 594 bp, Triticum aestivum
  unsure (1)..(594): unsure at all n locations
  Clone ID: PAT_TA_91331
cggtatccagacgtttcttatccacacattgccttatctcttctccaacctgccgagctcatccccatcctcggtttcttctcttcagccatggccacccgctcactcaatcctgccacaagccatggcatgaccaccatgatgcgagacggaggtgcaccacgtgctgcaaccgtgagactggggtgctaccacggcggtgaccacgcactgcaattcgtggaggccgggtgtgcgtgaagacgcaccgcgggcgacggcgacccggggatgctctgtgtgctgcaaccgcggtgacggggtgcaccccggggagacggcgatgctggaactagctgccgtttttgctgcaaccagccggtgaaagcgctggaaacagcgcggcggtggctgtgcaacgatgctgaaccacggcgacaagtgcgggaaattcngggacatttttttgntggaacatgattnantttgcnggacaactcgaanttttgcacaaanctcggtttgttgaacaacaaatttttgcacacttttgantnccggacatgtacaattgcacacctctnaattcngaccaattttcgcaaaaaaaaaaaa

SEQ ID NO: 91332 - DNA, 621 bp, Triticum aestivum
  unsure (1)..(621): unsure at all n locations
  Clone ID: PAT_TA_91332
ggaccggagaaggggatcgctcaggcgaatggcccaatcccttcctcggtaaatccgctagcaagatcatcgtcctgcctaaattccccgtgcttccgatcgaatcgctccggttgccgcaggaaacccaatctggtttccctcttttcctgaaccaaagaaatcccccgatcgctgctccgcggctgcttttccggactgcttcctgaactgttggcatggttcatcctaggttccttgttgcttgttcaggctctaaactgtgcttcatctccaattgttgcagtaacttcaagagcatgattggcggttcgacgatggcatcttcactgctgatggattcgaatcaagaaacctcaatgcagttgaagccttcgtgcagagtcagagttagttgttactagaacaattgcaacagttttggagattggaagtaatantgaagggtcattggaaatcaaattacacatttaggagcaactcaattggtccctttgttgaagnaaattgtgagggttgcccaagtcctgaattaagaggaggacccctaagcgataatgtgtagtanccncctgtttggggaaganaaangattggaggtccacgnggcaatanaggatt

SEQ ID NO: 91333 - DNA, 510 bp, Triticum aestivum
  unsure (1)..(510): unsure at all n locations
  Clone ID: PAT_TA_91333
gtcctccgtgtcgatttgctccccccacacacgcggaaggaacagaaaaccatacccaccaccacccctaccgtgcctcgccgcgccgcgccagtcaatcaaccatccagccagccacccaagccaaccaatcacccccatcccccctccatctcgcgtggattaatggatctccgccccgccccgccctgctctctcgcttgctaggaaccgtagctgccgccagcccagcccaccccgcccgattcggagccgcgccgagggagagggagcgacatggggctccgcaggagaggccctctgctgctgctcctcctcctcggnctcgtggtggccacggncgcggcggctgttngacgacgcctccgcctncgagggcgacgcnatcgctctacagagcttgttcnaagaatgtcnatgnttgggaacctnaaagaggttcttttaaaactgtnttntccgnccgangacancctgntacnaggattngancgcatntcntntcctgaa

SEQ ID NO: 91334 - DNA, 312 bp, Triticum aestivum
  unsure (1)..(312): unsure at all n locations
  Clone ID: PAT_TA_91334
ctcgtgccgaattcggcacgagatcctctccacctcctcagccacacctagagcatcttagctccggctaggtagctagcaatggccgccgcactgagcctccgcgcgcccttctccctgcgcgccgtggcgccaccggcgccccgcgtggccctcgcgcccgcggccctcagcctcgccgccgccaagcaggtgcggggagccaggctccgcgcccaggcgacgtacaaggtgaagctggtgacgcccgagggcgaggtggagctggaggtccccgatgacgtctacatcctcgaccagccgaaggangaa

SEQ ID NO: 91335 - DNA, 303 bp, Triticum aestivum
  unsure (1)..(303): unsure at all n locations
  Clone ID: PAT_TA_91335
tcactaaaaggggaaacaaaaagctgggaagctccaccgncggggtgggcgggccggctcctaagaaactaagngggggtnccccccnggggctgncaaaggaaanttccgggaacnaaggggnggtggtccccaangaaaaaagnanctggggggaaaccccggngngggggagaaaaaaancnaaggggggcaacctgggagnccattcaagggggaaaaaanncgggnaaacnnccccntggnnaaaaaaatttttgggcccccnccngggttttttcaaaaaaccaaatngggggcccc

SEQ ID NO: 91336 - DNA, 617 bp, Triticum aestivum
  unsure (1)..(617): unsure at all n locations
  Clone ID: PAT_TA_91336
agaggttcgagaaggaagccgctgagatgaacaagaggtccttcaagtacgcctgggtgcttgacaagctgaaggccgagcgcgagaggggtatcaccattgatattgccctgtggaagtttgagaccaccaagtactactgcaccgtcattgatgcccctggtcaccgtgacttcatcaagaacatgatcaccggtacctcccaggctgactgtgctgtgctcatcatcgactccaccactggtggttttgaggctggtatctcgaaggacggccagacccgtgagcacgccctccttgctttcactcttgggagtgaagcagatgatctgctgctgcaacaagatggatgccaccactcccaagtactcgaaggccgttatgaggaaatcgtcaaggaatcncttcgtacctgaanaangtcgggtanaccctgaaaagtcccttcgtccaannccgggttnanggtgacaacatgatnagaggccacaacctnactgtacanggcctaccttcttaggtctgacaaattatganccaagagcctcanaaagcccgntctccctnaagatgttnaaatggnggatggaatgtccgttgcccttaaacgggtatac

SEQ ID NO: 91337 - DNA, 346 bp, Triticum aestivum
  unsure (1)..(346): unsure at all n locations
  Clone ID: PAT_TA_91337
ttttttttttttttttttttaaaaaaataaacttttccaatttgtttttgcacttggcaacatagtgaaccattgggagagagaagatcactgcggcaatgaaacaagtgagctgcacctaaaaaaagtttttttgttgtttgcttcaatgcaggttttccgaagagagctgcgatctatacatctcttggactactacgaggcggggccgaacgaactacagttgaaatgcaagcggcgccggcgcactgcattctccaagaaacaacaccgcaactgacaaaagaccaagagatnnaagaacaaaggaacgattggcntcaatgacttgttccttttaaancca

SEQ ID NO: 91338 - DNA, 606 bp, Triticum aestivum
  unsure (1)..(606): unsure at all n locations
  Clone ID: PAT_TA_91338
atccagcccccctccgatctcgccgagaagtctccgattgaagcgaagcgaagccaaggctctctcctcctcctcctaagatgcagatcttcgtgaagacccttaccggcaagaccatcacccttgaggtcgagtcctctgacaccatcgacaacgtcaaggcaaagatccaaggacaaggagggcatccccccggaccaagcagcgtctcatctttgctggcaagcagtccgaggatggccgcaccttngcggatacaacatccaagaagganccacctccaacttggttctnaagtccgttgnggtagcaatttttcaaaacctcaatnggaaaacatcactcaggtttancctcaaacacatttataagttnaagcaaattcaagacaagangnatccaacngacaacaactctcancttnctgggaacaactcaggatggcgacctttcagatanaacatcaanaaggtcatctcnattgggctaagtcntgggggatcaantntctaanacnacgggagacatancngaggtagtcncgnatatanatttaggaagttcagcagggggattcccgcanaagtntactncgacactgagagn

SEQ ID NO: 91339 - DNA, 662 bp, Triticum aestivum
  unsure (1)..(662): unsure at all n locations
  Clone ID: PAT_TA_91339
ctgaacttttgggagtgaaactaacagcgattatggttggttattgctgtacaaaaattggtgaagatgattggtgctttgtgttccgtattctacaaaagtggattgaatcgtctgttttacttgttgaagaaatgacagatggcgtgaatgatgctgtaatacaccggacatccgctgtgggatattttgggagaagcttaaactgatagcttgcactccaagaggagctaacattactttttgctgaatcctgcccnggtacattgtgttgcctccaaccaantttgacatcccccaatgaaccccaaactcctgcancttattaatttaaggggantatgcaaagagttaatgacaagattaatggananggcccccgtttggtccttnggtcccggggtttcaaaaagcaattccggtttttggatnnaaaaaggtcanncaacaaaacttcggcctgtggggttaaccgcatttttgggnancaagggnaccatcancnaccancttacacaanttaaggtntcacgggntcaagaaacgtggggacaacaaggatnatcagtggctaaatcaattctttctctaagcatanccaacanagttgactnncccacttngtcgaccccccggatttaaacatgggaccccaggccgaa

SEQ ID NO: 91340 - DNA, 160 bp, Triticum aestivum
  Clone ID: PAT_TA_91340
tcaccacccagggccaggggtcaggcactgttccactggtgagcgatggcgatggtcacggctgacgcctccgccgccgccgacgccgccacgaagcagccagaagccgacaaggattacagctcctacaacggcgcctccaccgcggtgttgggcggag

SEQ ID NO: 91341 - DNA, 629 bp, Triticum aestivum
  unsure (1)..(629): unsure at all n locations
  Clone ID: PAT_TA_91341
ctcgtgcctctccgacctcaccgggaaacctcccatcgaagcgaagccaaggctctctcctcctcctcctcaagatgcagatcttcgtgaagacccttaccggcaagaccatcacacttgaggtcgagtcctctgacaccatcgacaatgtgaaggcaaagatccaggacaaggagggcattcccccggaccaagcagcgtctcatctttgctgggcaagcagtcgaggatggccgcacccttncaagactacaacatccagaagganccacctccactttggtgcttaagtccgttggtggtatgcaattttccgtcnaagaccttnaccgggaagacataaccttgaggttgagtcctccggaaacaatcgacaacttcaaggcaagtttcaaggacaaggaggattccccccggacaaacactctaacttcgccggnaanacttgaggatngccgacctttcggntacaaatcaagaaggacactcactgtanaaggtcngggggatgaattttaanacctatggaagacattacctgagtgancccgnacantaaatttaagcaagtcagcaggnggatccccgcanangccgatttncgagaatcagtgcgaccttgtnaaata

SEQ ID NO: 91342 - DNA, 624 bp, Triticum aestivum
  unsure (1)..(624): unsure at all n locations
  Clone ID: PAT_TA_91342
ctcgtgccgaattcggcacgagcagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcaagcggaaaacctccgacgagaagaggaacacggacaatngaaggncttgccttacgatatctccgacgaccagcaggntaccaanagggaaaagnacntnggatccctcttccaagcgccaacggcgaanggaccacgangcgtcctcaactccctaacnatactcaaccaaggatccaagaattcacttncnacacacatgggagnttctaatcgtcctgctttaatggacaactngttgtcaactctccaagatcattgacctgccaacacaagtncactcatctgggtactgggaagnaaggnaaggaaatatcantcaactntctcncaagtggnataaccatcatatatnccgaactgaattgaacccggancaacagnttaagaangtccttngngaaa

SEQ ID NO: 91343 - DNA, 457 bp, Triticum aestivum
  unsure (1)..(457): unsure at all n locations
  Clone ID: PAT_TA_91343
cgctcccggcctctctctgtttgctctcgcgtccgccgcgcccatcctcgtccgcgcctgcgcccggcccgtgctcgctcgctcgccgcctccctcgcctcgatccaccgcgccggcggcatggcggatcagctcaccgacgaccagatcgccgagttcaaggaaggccttcagcctcttccgacaaggacggagatggttgcatcaccaccaaggagtgggaacantntgcgttccgctgggggcaaaaccaacggaggctgantccnaagacatgatncaatgaagtccgatgcttaatggaacggacattgacttcccagattcctcnaacctgaatngccgcaagatnaaagacactgactcaagagggangantcaaaggagcttcaaggtgttncnacaaaggaccaaaacgttcatctccttccggcttactcccncattcaatgacgaa

SEQ ID NO: 91344 - DNA, 476 bp, Triticum aestivum
  unsure (1)..(476): unsure at all n locations
  Clone ID: PAT_TA_91344
aaagaagccaacaccaatcaaggcctccatccaatcccaagcaacctcgaagatgtcttgctgcggaggaagctgcggctgcggcagcgcctgcaagtgcggcaacggctgcggcggctgcaacatgtaccccgaggtcgaaggccgccggcgccaccctcctcgttcgccgccaccgccacccacaaggcgagtccggcgggatggagatggcggcggaggattggcggctgcggctgcacccaatgcaagtgcggaccagtgccgctgtcctgctgcagtgctaattattgatcatcgatnatgcatgcaccgcgcgcatgatcatatctatatccattcatccatccatcttgtacaagttacctactgattcaagnctttgnatgttgtnaacactgccaacatnagcaaagcaangtgatcccatcatgttaaaccgaccctaaataanctcccgtgggttaactattaaa

SEQ ID NO: 91345 - DNA, 636 bp, Triticum aestivum
  unsure (1)..(636): unsure at all n locations
  Clone ID: PAT_TA_91345
ggagaccccaacttaagggcaggtgttcatcacagtatggacatgtatggatcaggaggcatggggaatccagagtatgggttgcagaggaaccggtcgtattcattcaatgaaggtgtagacttctttcagccaagaagggctgaccctaactttagggtagatgttcatcacagtatgaacatctatggatcaggcgccatggggaattcggagcatggatttcagatgaaccagtcgtatccattcgatgaaggtgcaaacttctttcagccaggaaggncaagaccctaacttcagggcaggtgttcatcacaatatgaacatctatggatcaaggcgccatggggagtacagaacatggtttcagaggaaccatcgtaccatttgatgaaggtgcaaacttctttcanctaggaaggcanacctaacttaagggaagtgtcatcacaatatgaacatctatggttaagcgcatggggaatcaagacatggnttcaaaggaacagcgtatcatcgataaagngnaactcttagctngaagganacctaatnaggnagttcacaaatatatactatgatagccctgggaatanaatgttagggacaacgancatctaggggaactnttacgga

SEQ ID NO: 91346 - DNA, 275 bp, Triticum aestivum
  Clone ID: PAT_TA_91346
gtagaaaccctcgacgaaggagcgggttgcagcagaggcggaggaatgtggtgggaatgcgagtcaacagcggcggtaatggcttgatttgactgaacaggagggatggtggtctctctggccggtgggtccaaatgtggcgattggcggttcacacggccactagccaaaagtggctgctgcagcagaagaggaggttgaatgcgaggcgtcggctcggagatcgcgccaccgaatctgcagtcatccttgctctgggttcttctcgtgccgac

SEQ ID NO: 91347 - DNA, 456 bp, Triticum aestivum
  unsure (1)..(456): unsure at all n locations
  Clone ID: PAT_TA_91347
ctctcgccggctcccctccccctccccctcctctctcggcggccaccgccgggccgcacagaatggtggcgccggctgccgtctccaccttctcctccttctcctcgtcttcctcttccgtcgcacccaggacccaccgccgcggcctcctcagcacccgtgcgccgctgccgccggcccggaccgtcgcctcctcccgcgcgccgctggtcgtgtccagcccgccgcccacgcccgcccccgctccggggcacgccaaggtcgaccgctccggccggttctgcagcccccgcgccgcgcgcgagctcgcgctgatggtctcctacgcggcatgcctggagggcgncgacgtggtgcggaattcgaccgncgtngtggcgcnagaagaganctggctatgtttaacaangtntngtcanagctaaatttatagctttgtggggggctctggaggtc

SEQ ID NO: 91348 - DNA, 648 bp, Triticum aestivum
  unsure (1)..(648): unsure at all n locations
  Clone ID: PAT_TA_91348
cgctactcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgagggtggtggtgatgatgagggtgtcgaatgaccaaggccgtgaaggtggttgacattgttgacaccttccgtcttcanggagcaacctgcttttgacaagaagcaatttatctctcacatgaaagcgctacatcaaagaacctctctgccaagcttgaaggggatgactagatgtttcaaagaaagaatgttgaatctgccacaaagtatcttcntaacaagctcaangacttcaattcttggtggcgaaaacatcatgatgatggcgcgtggtgttcgcctacacaaggaggaactgctgatcaacttcctgnacttgacatggctaaagagncaagtgcaatccacgtagcnaaatcancgncgcatatttgccgcccaaggtgaatcancccaangtngtcgnacaaaaatntn

SEQ ID NO: 91349 - DNA, 583 bp, Triticum aestivum
  unsure (1)..(583): unsure at all n locations
  Clone ID: PAT_TA_91349
cactccaaaccctagcctcctcctcctctcgccgccgccgccgacgccgacgccgccgcagccgccatgtcagggaggaagaagacccgcgagcccaaggaggagaacgtgacgctcggccccgccgtccgcgagggggagcacgtcttcggcgtcgcgcacatcttcgcctccttcaacgacaccttcatccatgtcacggatctgtccgggagggagacgctcgtccgcatcaccggtggcatgaangtcaaagctgatcgtgatgaatcatccccttatgcagctatgcttgcatctcaagatgttgctgtaagatgcaaggagcttggaattactgctctgcacattaagctccgtgctactgggtgggaaacaagacaaaaactccaagtcctgggtgctcaaagctgcgcttaaagctcntgcacttctggcatgaagattggacgtattgaggatgttacccggtccaactgacacaccgccggaggtgganaantgggaaggagntgtaattcatgctcntcaaggatgacatacaagtatcatancgttctngaactgttcgtcacncgttata

SEQ ID NO: 91350 - DNA, 642 bp, Triticum aestivum
  unsure (1)..(642): unsure at all n locations
  Clone ID: PAT_TA_91350
agcctccccctctccactcccccctccgccgacgccccaccactccccccttccccctccgccgccgccgccgacgcaatggactccgtcgcgtcgtgggggctgaccccgctggcggacgccgacccggacgtcttcgacctcatcgagcgggagaagcggcgccagcggagcgggatcgagctcatcgcctccgagaacttcacctccttcgccgtcatcgaggcgctcggctcggcctcaccaacaagtatccgagggatnccgggggcccgctactacggnggcaacgactcatcgacgaaatncgagaactctgccgcgaccgcgccctcgccgcttncgcctcgacgccgcctcctggggcgtcaaagtgcagcctactccggtcgcccgcaaattngccgcataaacgcctcctcaaccgcaagacggtnatnggctcgactccctcaagngncactcaccacggtacacacgccgggggaaaagtntccgcactcatcactcnagatctgctanaggtancgcccaacggtacatcactananaagtcaggggggccgtacaattccctaangatctatancggctacggctctttaagtctatggaaactggtncaataacctnagaaccctg

SEQ ID NO: 91351 - DNA, 296 bp, Triticum aestivum
  unsure (1)..(296): unsure at all n locations
  Clone ID: PAT_TA_91351
gctggcgctacaagttccttaagtacatcgtagcaataggagcctaattgttttgatgacaaaagttggcatgtcaaatattagcaacggtcagatgttggctaaacattggttgtatatcaattttcgttgccaatctcacaaaagattaagattgttaaatgttggcaacttttaattttaccaaatgttagcttgccaaatattgggcaatgccaaatgttaagtagataactaagtattgggtatattctgttgtcctaactagctaccacgggaccctnaaaaaaaaaaaa

SEQ ID NO: 91352 - DNA, 488 bp, Triticum aestivum
  unsure (1)..(488): unsure at all n locations
  Clone ID: PAT_TA_91352
gtcgtcgcctcctcctaaaccactctccctatccccgtgtccagaatctaccccccggctccaatggcggcgaaggaaccgatgcgcgtgctcgtcaccggcgccgcaggacaaatcggatatgctcttgttcccatgattgccaggggagttatgcttggtgcaagaccagcctgttatctgcatatgctggatattgatttgctgctgaactccttaaagggtcaaatggtttgatcaatgcgaatttcaatttccnaaggaattttttcaanaacganttntttagntttancgggntaaagtttccgtaaggttggggnntccccaanaaaggaagaatggaaaggaggtnttttgaccaaaagtttcaaacttaaaanttaacaangnccttgacccaaganccccaatncaagtttggtgtttcaacangaaanacaaaatgccaaacntaaggattngccaatcnaccntgaaaaaaaaat

SEQ ID NO: 91353 - DNA, 634 bp, Triticum aestivum
  unsure (1)..(634): unsure at all n locations
  Clone ID: PAT_TA_91353
ccgcgtgccaagccaccgaccaacatggcagcgtctctccaagccgcggctacgctgatgccggccaagatcggcggccgggcctcctccgcgcggccgtcgtcgcacgtcgcccgggcgttcggcgtcgacgctggcgccaggatcacctgctccctgcagtccgacatcagggaggtcgcaagcaagtgcgccgacgccgccaagatggccggttcgccctcgccaactctgccctcctcgtctccggngccagcgccgaaggggcgccaaaaagntgactttnacgaaatttcaaaacaagactacattgangtgaanggtaacggcaccgcgaacaatgcccgacatcgacgngngtcatccttcccttcaanggcggaagtacagatgaagaattctgcctggagcactccttaacgtcaaggcnanggatcaaaagaacaaccgccggcttcaanaagacaagtcataccgctaactanacctnacaatggaaggccctcaagtcgngccanggaactcanttcagganaaggangatcatatcgcgtactncactcccgaggaaccgtgccttcnctancttanaatctccacgaacccaannttaaggcctcttgcacanaaggtt

SEQ ID NO: 91354 - DNA, 538 bp, Triticum aestivum
  unsure (1)..(538): unsure at all n locations
  Clone ID: PAT_TA_91354
ccagtgagaagtgcaggcagctagctagtaataaggcgtagctttgctcttgtagctagctaagctaacaatggccgcctctgcctctcgcatttctctggtggtgctgcttgtggctctggccacggccgcgtcaggccaactatcgccgacgttctacgacacgtcgtgccccanggcactggccaccatcaaaancgtttggnggccccnttaagcaagcaacccccgcatngcgcgtcgctgctcccggctgaatttcaacactgctttctccaaagctgcgagctccgttctgctgtctggcatggacaaaaccgggtccgaactttattccctgcnagctttcngcgtcatccgatacatcaaagntcaactccnagggtatatgcagcaagacgtctcctgcgccgaatctcantgtcncggccgcgatccgtcntcgcctcggggggcctnaatggnaatcctcngggaaaaggatcatagatctcaaacaagnggnggnaaaatggnctccaagcttaaatctaccggt

SEQ ID NO: 91355 - DNA, 626 bp, Triticum aestivum
  unsure (1)..(626): unsure at all n locations
  Clone ID: PAT_TA_91355
cttgcttctaggcccagccaggagaggcggcggccgcacgcagcgggggcgagcattccgtcgagcctggcagtagctcccggaggccctggcgccccggcagcatccatcctgtgagccgctcccgcttcgctggcttcgtcctaagtccgcagctgcgtcaaggcatacgagttgggagcttacatggctatgctgccaagtgattccgtcacatcatgggaatttgtagaaaatacccctacagaattacaaagagcgggaataaggaagctggcaaacttaatgcttcaaggtattcaagttnaaaaggaatagaagagattctccgttccaanaaggatggaattgatttaaagaaagaacttacttccgaacctattgcacttaccacaaattttgggatcgaccaaatgcacaattacattgcacaccatgngttcgtcactttacttcgcaaccaagcaaaaatntnacattcaaacantgtatcantatctatttcagggaanggcaaataatcgaacnanacgtcaaaatccnaggttgaattctggtgaaatcagaaaccngcntagngtcaccggtctanatntcaaaggtccgncggcaaatnanaggatttt

SEQ ID NO: 91356 - DNA, 632 bp, Triticum aestivum
  unsure (1)..(632): unsure at all n locations
  Clone ID: PAT_TA_91356
ctcgtgccgaattcggcacgagctcaccctctctctgtcagctctctctcccccttgggacttgttccgccatcaatcagtctatccatctccccttgccgttccatcgcttcgcagccatctttgcctgcatcgactgccgggaagaggcaggatgaggctttgtcttgcttgctgtgtccccacctgagccctatcttgtccggactccgacggcctagcctagccccctgctctttgggaataaggtacgctgtgcgcatgcacgccatgaatcttgcgccggcagcaccaatcctattccttttctcctctttggggggtctctctctctctcctagccgtctttgcttcttccaaggattagtatcgccttgggggaanggagaccgtgttgatccattaaccaagtggtgtattttgctcgactccccaagagtgcttaaacggnaacatgtttgaccggncttgcatgccntctcctctcccanctcttctcctcctgtatcaaccctctcttgtgcgcttaacttttgggtacaaatccancgtttctccctttgctctaactangtctgcntaagcggaagagncaagagggttgtgggngggaatnaatnttacgaatgaag

SEQ ID NO: 91357 - DNA, 644 bp, Triticum aestivum
  unsure (1)..(644): unsure at all n locations
  Clone ID: PAT_TA_91357
gcagcttctcgagataattgaatttaacattggcattgggccagacttccaaagcttgtgtcagcaaatcaagagcttgcttgtacattgaactagattctttttccttgggttcaattaccagtgacacccttataaggaaagtaataatcatctcttccattgcagcattgggtttatattcctcatccggttgcccagaagatcctgggtgtttcaatattaggtatggatgccccaccaggtgacatcacaggaagaggttgtaagcctgggtcaactttacctcttactcaaatnatcaagcaaacatgggaacatctgaaancgttttgggtnaaccaccaataacagtaaggctaagcatatcaacaatctgatcctggtccactttcctgcacactttnattnaatccgcctcgtctctcccaagccactacaaccagcaattcgatgcaagactcggttcaacanttgtgttgtaggtaaccaagacgntaagagagtaacatctggggaacaatgtgctcgcacatgaanattcgcatgcaaaatactgganagtgaacagttggaaaaaaggctccncaaggatttctcngacgtcaaattgatnagntccagagngctcagaacaagaagga

SEQ ID NO: 91358 - DNA, 629 bp, Triticum aestivum
  unsure (1)..(629): unsure at all n locations
  Clone ID: PAT_TA_91358
cttccgcttcccttaccttctccctctccctctccctcgtctgccgccgccaccaccaccggcgacctcctccatggctgacacaccacccccttctcttcccccttaccttctcctcatcagcgacctccttccctccccctcgccccagatcgaagaataggcccggatgcgacgcgggctcagatccaagcacgcccacaacactctttttgctggaggacgccatggaaaagtgctctggccctgggtactgcagcatgagaaggtgcctnccaaccttaagtcntgttggttgattgggaaaaaagattanngtttaagaacannttcatggcaactncnaaatcgnaattaaaccaagggngggtnaaaggnccaaggagaaggacaaccggcaagaagncctnacctccctatgccccaaggcaagtgggcgttganatcaagaatcncaaggaaccgganaatatttttgnaaatgctcagggnaaacctcaaagatangncataagccaaggattgtttggaatgaaataaattgtccnggggtatggtgataaattattcaaaantcntcgttgnaaaggccaatntggaattcttttanaatatggaatttgcacgcn

SEQ ID NO: 91359 - DNA, 641 bp, Triticum aestivum
  unsure (1)..(641): unsure at all n locations
  Clone ID: PAT_TA_91359
cctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcctacttgccaccgctcaagcacggaggccctccttaagcaggtcgactacctgatccgctccaagtgggtgccttgcctcgantcaacaagttgggttcatcttcccgttgagcacaacgcatcccctgggtactacgatngccggtactggacaatgtnggaactgctatgtttcggatgcaccgacgccaccaagtgatnaacgaggtggaggaagtcaagaaggatacctgaccctattccgcatcatccgatccacaaatcgtaagtgcatgctcactnatcgctnaaancacgggtcaagatccgcaaggctaaacagtactcacacagcatttaaagtgcatgcagtttgtaatcnanatgcttgggttcctccattacttctatntccaaanagtgagtcagtcagtcaatgtcagaacatcctantatcn

SEQ ID NO: 91360 - DNA, 642 bp, Triticum aestivum
  unsure (1)..(642): unsure at all n locations
  Clone ID: PAT_TA_91360
ctcgtgccgaattcggcacgagccggagcaccctatccttgcgagcacgggcgctcccgaccagagtcctccccgagcgcgacagctagggttcctagccaccgccggcccgccgccactacttccgggccgaggcctccgccgcccagctgccggcacaggacccccaccagcaccgcctccctccttcctgggccagccgccgcctccgccgccgcccggagctactccggcgaccagtccatangcagtgcaaggcggccgttcaacaactgattgtgctctgcatctgaagccggcaagnggttaccaccaatggcgggaacgatgattgccgttaacggcaagacaagaatggacgctggctccgagaaagaaaattggtnggtatcccgccgtttccggactaangtccccctgggatttncaagaaataaaggcataaggcttccaattaactncatatctgctccctcaatggggggcgttngcaactccgtctcaaatgtcnaaactgtcaanatgtcacaatcgggggcaagantcaantnctttgcgatacgataaatagtcctcgatcgggtccattttggctnactaatcntgngagagnggtagggnggnaatnttnaaagaaactng

SEQ ID NO: 91361 - DNA, 455 bp, Triticum aestivum
  unsure (1)..(455): unsure at all n locations
  Clone ID: PAT_TA_91361
gagaactagtctcgagtttttttttttttttttttttttttgcccccaacaatattctcaccaagccgatcatcaacccgtttnaanatccgcncnaaacattngnnaacccccnggtccaaaacacgggcgctttagaccncagggnaaancaaagcgacntctcacctaacccggtttggcgcacgcacgnacatttgctaatggtggacgtgatgggancntcaacggcgcgctttgncgnttctccaangggtcanctcctccnaggatccgatgcgggcttgttgggaatngccccgtggggcccaactgaatttattggccggnnaggggtttncncccantaaatttcccggaaaaatggcgcccaaaaagccttnnccncccgggaantgnaacccacaanttgnaatcccccnaatnccgtaacggttcgcacttggggcgtcttg

SEQ ID NO: 91362 - DNA, 576 bp, Triticum aestivum
  unsure (1)..(576): unsure at all n locations
  Clone ID: PAT_TA_91362
gtgagaggggtatcaccattgatattgccctgtggaagttcgagaccaccaagtactactgcaccgtcattgatgcccctggtcaccgtgacttcatcaagaacatgattactggtacctcccaggctgactgtgctgtgctcatcattgactccaccactggtggttttgaggctgggtatctccaaggatggccaagacccgtgagcacgccctccttgctttcaccttgggagtgaagcagatgatctgctgctgcaacaagatggatgccacaacccccaagtactccaaagccgttatgaggaatttcaaggatccctcctactgaagaagtcngtacacctgacagtcccttttcccatcccgggtttaagggtgacaacatgattgaaagccacaactttactggnacaaaggcctaccttctttagtcttgacaaattaacaacccaagagcctcaaaaaaccctccntctcccttaagacttananatggtggatggaacgtccgttgcctnttaaacgngtataacctgaaggtgtacttgncaaggcnaaantnggaaatnttaa

SEQ ID NO: 91363 - DNA, 174 bp, Triticum aestivum
  unsure (1)..(174): unsure at all n locations
  Clone ID: PAT_TA_91363
ctggcctaaaaacttgtcaatgccangctataataagatcaatcttttcntgcgagtaatggantnaattaaatanttcagcnacgtantccctgttcatgagcctcgtgaagaatcaatcgctagtccacggagctcatacntcagcgctgnanagcttgntactcggaccnc

SEQ ID NO: 91364 - DNA, 635 bp, Triticum aestivum
  unsure (1)..(635): unsure at all n locations
  Clone ID: PAT_TA_91364
ctcgtgccgaattcggcacgagaccgctgctagcaaggtcgagcaagcagcacagagatggctgctgccttctcctccaccgtcggtgccccggcttctacgccgaccaacttcctcgggaaagaagctcaaagaagcangttgacctcggccgtgaactaccatggcaagagtccaaggccaacaggtcacggtcatggcagcggaaaacatcgacgagaagaggaacaccgacaagtggaagggtcttgcgttacgatatctccgacgaccagcaagaataccaagagggaaaaggatcgntnggatccctcttccaagcgccacttggcgaacggaaccacgaggcttctcaatcatacgatacttnagccaagatcaagaatacacttcnacaaacatggagttctaatcntccgnttcatgganacttgtgncanctctccaagatnatgacctgccaacacagntcaacanctgggtactgggaggaaggtaaggaaatcctcattaactgtctcgcaagatggataaccatcatatatgccgaactgaaatgaacccgaagcacagtcanagaacgtcctagtganatntaaaagnaaattctccctaaaantttaccnggggtngag

SEQ ID NO: 91365 - DNA, 638 bp, Triticum aestivum
  unsure (1)..(638): unsure at all n locations
  Clone ID: PAT_TA_91365
ccctccgatctcgccgagaagtctccgattgaagcgaagcgaagccaaggctctctcctcctcctcctaagatgcagatcttccgtgaaagaccttaccggcgaagaccatcacctttgagtccnatcctctggaaacatcgacaagtcaaggnaaagttccaagacaaggaggnatccccccgnncaaangtctcancttttgctggnaacactcnaagattgcgcaccttngcggnctacaacatccagaaggatccacctccactggtctcaagtccgttngtggtatgcaaatattttgtcaaaacctcactgggaaaacatcacctcnaaggttgatcctcaaacacatttataatgttgaangcaaattcaaagacaaggagggtatcccaccggaccaacanctccatctttggctggnaacactcgaagatggcgnacctttcaagactacaacatcaaaaggatcatctcaactggtgcnaagntcctngtggatnaaatttctaaganctcacggaagacatcacctgaggtgagtctcgaacattgcaagttaggcaagntcagcagnggaattcccgcanactctacttcganaattagagcnaccttngttaaacaaganccccn

SEQ ID NO: 91366 - DNA, 508 bp, Triticum aestivum
  unsure (1)..(508): unsure at all n locations
  Clone ID: PAT_TA_91366
ccagtcaccgggacgctcgtcggcgcgagctcctcccgtttgctctcactccatggcgccgtcgccgccggcgcacccagccacctggatccagctgccccgcaaggcccgagcgcctcgttccctcctcccgtgcctcgatccagtatggatcggaagcagcaccgccctacgccagctccggagcctcgtcgtgcgccaagtcaatctttgagcaaagccgctgccctggaacttctcggtgtcccgcnattcctctgctgggaaaggntccnaaattcntngttaanaatanaccngaaattcttccggaattcncggggcctttcctttcccctggnantttaaaccaaanacattntcnccgaaanaatttaaattngaggcaanccggcctttcccnaatttcttccccnaagtacncttntaaagaacaangacgaataccccaaaaagggaaaactctgcgccttaanctgcgcntcggttaaggccttgcgtaaccggc

SEQ ID NO: 91367 - DNA, 639 bp, Triticum aestivum
  unsure (1)..(639): unsure at all n locations
  Clone ID: PAT_TA_91367
ctcgtgccgaattcggcacgaggcggcgatggcgatgctgccctcctagaccgctcccaaattctccaaccaaaagcccagcttgcttaggcgcccttnccgccggcgccgctttacccgnttaataggtgccctggnctccattccgccgccgccgaccgccgataaatccctcctcctcttccactcccacctactctgcgttgtggttggcgtgtcttttccgaaggaccgaccgtngccgttngggaacaatgctgttacacgagatgaagctctgganggatnaattagatatngggggnaaaaagaattgtctgaaaactccttgcanattagttnnataaagaggaaaccgtatttnccccaaaaagatgccccaacgatctcaaaaatccggttcaaaaaaaggacctgaaatattccggaaaaaagcantgtgnaccgtttcanaagagaatcttgggnaatatactggcgaatcatataaaacaattatcnaggatattttgcaaanatgaataancanagcactcatcttggagttcatatcaaaaagnccagnattgnaggtttcnatacaatatagaacaaatntgtatcagaacttanggacccgattagatcagaactnnngat

SEQ ID NO: 91368 - DNA, 260 bp, Triticum aestivum
  Clone ID: PAT_TA_91368
ctccaccaccagccgctggcacccccgccgatccaggcagcagccaccgccgccgccgccgccatgtccggctgcccctgctccacctctgcctccgcctcctctccactctccctcctgcccgctcccagttccgtccccgccgcctccaggcgcagcaccgtcgccttcccctcctcgcgcgacccacggagcggctgggacgcgacggagaaggcgtgcgcgcgatagtccgcggcgagcagcggcagcaaggacag

SEQ ID NO: 91369 - DNA, 241 bp, Triticum aestivum
  Clone ID: PAT_TA_91369
ctcgtgccgaattcggcacgaggccgtccgaagagcgtgctatggtgtactccgatttgtcatggagagtggtgcgaggtatcccatagtgccaaccacatgtgttgtttgagcatcagtgccatgatcgtacaaccttgctaggccaaaatcgccgagccttccattcatctgcttatctaaaagcacattgcttgcttttatatctcggtggatgacgacttgtcccaaaggggggggg

SEQ ID NO: 91370 - DNA, 522 bp, Triticum aestivum
  unsure (1)..(522): unsure at all n locations
  Clone ID: PAT_TA_91370
tggcgatgcctgctgctctcagggccttaactgtcttgtatgcgcttgcagttcttgctggaaatcaggtggaagggcggcaccatcagcctgattgtccttctttctcgtgcggtcttcttggaaacatatcgtctccatttcgtcgggcaagtgatccacctgggtgcggctatcgatcttacgagctgggtttgcaagtgataccaaaggctacgatacacatcggcggtgcaactttactatgtgtcctggcatcaactacagtaatcctcctttctgggtttcngatgccgacttggtttncacancaactgcctctactccggtgggatcctccataccnacacgactacatggnatccaattgnccccttgtacaactccgggttgctttgttaaatctccaaggaantaaaggactggaacttcatcccgttgcttcctaacacaaanatctttgttaacntttaacggcnaaatttacataatggagtacttaacctcttgtggtattggcgt

SEQ ID NO: 91371 - DNA, 316 bp, Triticum aestivum
  unsure (1)..(316): unsure at all n locations
  Clone ID: PAT_TA_91371
ctcgtgccgaattcggcacgagagataagcagctgtcctactgtcacatacacacacacacaagtgctagctagctaatcgatcagccagccatgtcggaggagaagcaccaccacctgttccaccacaaggagggcgaggacttccagcccgccgctgacggcggcgtcgacacgtacgggtactccgaccgagacggtggtgaccgcaccggcaacgacggcgantacgacggttaccaagganggagaanaacacaagcacaaagngaacttcgggaaaatggggcaagccgcggccgnnccttcnccctcta

SEQ ID NO: 91372 - DNA, 169 bp, Triticum aestivum
  unsure (1)..(169): unsure at all n locations
  Clone ID: PAT_TA_91372
cctcttttggcatcagtgatcgtcggaatctcatcactcctagattgatttcgacttgttanaattatcngacttttttgccgtaattttcttcntcgcngtncntcgatcgatgtanagcacttttcgcctcatacanttctttncttcntcgatttttcnatcacca

SEQ ID NO: 91373 - DNA, 621 bp, Triticum aestivum
  unsure (1)..(621): unsure at all n locations
  Clone ID: PAT_TA_91373
catgctcctgctcaccattcctaggattcttgagcttgctgaagagctgtgcatgccgcttgctgccgtcaagtactctcgtgggatgttcatcttccccggcgcacagcctgctccccacaggagcttctctgaggagtttgatgtcctgaaccgctactccggccacctgaanctggtggcaatgctatgttgattcgggagacccagcgaagctggcagaaagtggaatctactatccaccganaacctgagcagccatggcacctggaatttcatgactgggctggcaagaagagctctgtcttcttnaaactnaactgatgcagttccctgtccaaggaatacaattctccggatcccnaataccccnaatggaggctgtgattcgattcnaccctggggtacccatgaaccataaggnttngctttcacacatttacccgaggangttaactacccactanaagtcatggcatggacctcccctggctacgnaaatctaanagtctcggtgttgncctaaattccggnggggcaaacttggggcgtgcacccncactgggaaaantcaactaggatcatgnaaanttgganagancctggggntccatanaantt

SEQ ID NO: 91374 - DNA, 238 bp, Triticum aestivum
  Clone ID: PAT_TA_91374
acttagtattagtataaatgtctaccaagacttctgtgtttatcatccttttggatcttatgtaatccccttagaccaacaacaattaacttagtgcatcattttgtatcttatgtaaaacaaaccatgacaatcctgtgcgtatgactatcgcttgcttgctgcatacactatcatgagctatgcttttccgagcaagcaatatttaatgcacaccctttaatacaaaaaaaaaaaa

SEQ ID NO: 91375 - DNA, 665 bp, Triticum aestivum
  unsure (1)..(665): unsure at all n locations
  Clone ID: PAT_TA_91375
aacaacagcaggcagttctagctaggcatggcgatcatcctgctgctcttgctcanctgcctcacgccgttccaggaggggggaagccgatgcgttctgcnacaacnttaaggtcctcgccgccaccctccccaacaaaacctcctcctccccggtacacttccgccaccaccaccngtcggccaanccctgacacggtctacncctcgcgtctgnccgtngtgacatctcaacgacactgcctggtcccgggagcgtccgccaacacgttcggataagtgcggaacgccacgccaccggacgttggagtgctacgggggaacaactattatccgantatatacctcctctacaantcaacgacatccttgtccctcaatatacacaaatagtacgggagatgaaaacgtggcgacctcctttgaaagtggaactcaagaagtcacggngacgtgccctcgtcgccggctatccgcaactgctggtggagacgtggaaaagnaacaacgcgacccaagngttcccaaagctcatgacagggnagacttcaaagngtcncttgccatcacccgntncaacgggacgctgnagcnaacancccgntgtaancacattccncaaggaagaaangctannggcnttagnnaggnccttaaagcaccaaa

SEQ ID NO: 91376 - DNA, 565 bp, Triticum aestivum
  unsure (1)..(565): unsure at all n locations
  Clone ID: PAT_TA_91376
ccgcccccgccctcatatatacgcagctgagctgaactgagcgccnctgagctccccgcccgcgcncgcgcanttcacnggttgatctancctccggcgnccccgggngcccggacaaaacgacntntggaaaaacaatccaacaagccggggatcgattctccgtgtatctttggggctgggacggaaggcggccggccaagaagtcgangagcaccgtncccggagcgagtgcaacggcgcgttagcgtctcnatttgaacaagatttcgaatccttggatttaactggcntgcatganaattctgtcctgcgccattattnatancctncgataactatccgacttgctgtgcgttctangtcttccctccccaactgtccagtcttatttcttccaaaaaaaaatatttctanaantcgtttggcaaacaaaaangatcnaaatgngcggngaactcaagnggtgctggatcctgctnggaactcggtctgcgtttccactgccttaanccgtcgcgacccggtcctgtgcgcatgccaaggccttcggnattcccagact

SEQ ID NO: 91377 - DNA, 652 bp, Triticum aestivum
  unsure (1)..(652): unsure at all n locations
  Clone ID: PAT_TA_91377
ctcgtgccgaattcggcacgagatccagcccccctccgatctcgccgagaagtctccgattgaagcgaagcgaagccaaggctctctcctcctcctcctaagatgcagatcttcgtgaagacccttaccggcaagaccatcacccttgaggtcgagtcctctgacaccatcgacaacgtcaaggcaaagatccaaggacaaggagggcatccccccgggaccaagcagcgtctcatctttgctgggcaagcagtccgangatgggcgcaccctttcgggactacaacatccagaagggatccacctccaactggttctcaaggtccgttngnggnatgcaaaatttttcaaaaacctcaactggaaaaacaataaccctcangtttaatcctcaaaacacaatttaaaagttnaaggcaantttcaagncnagggnggttcccaaccgggcaaaanntcnaactttgcnggaacaancnaggaatggcgaacctncagataaaatcanaaggtcattcantggggtaagtccttgtggtatcantntctaaacctacggaagacatacctgaggtnatccccgcacattaaagtaagcaantcagnaggggantnccggnaaagtntatnttngggaaatttgngggnccct

SEQ ID NO: 91378 - DNA, 628 bp, Triticum aestivum
  unsure (1)..(628): unsure at all n locations
  Clone ID: PAT_TA_91378
ctcgtgccgaattcggcacgaggcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcangtgtggccatccgagggcatcaagaattcgagacctgtcttacctgccaccgctcaacacggaggcctcctcaagcaagtggatactgattccgtccaatggggtgccttccttganttaacaaggtcgggttatcttccgtnagcacaatgctctccccgggtataacnacggcgctactgganatgtnggaactgcctatttccgggtggaaccgacncacaaagtgatcaacgagttgganggaggccaagaagganacctgacncttattcgnatcacngtncacaaatcgcaatgcatgctcaacttatgcctnaaccacgggtncaagatcggaaggctaaagtatacaggcacattaatgcatganttttacntaatgcttggtttctccattctttattccaanagnngcag

SEQ ID NO: 91379 - DNA, 631 bp, Triticum aestivum
  unsure (1)..(631): unsure at all n locations
  Clone ID: PAT_TA_91379
ctcgtgccgaattcggcacgaggcggttcattatttaaggttcctgaagcccttatccctccagcaggggcccgtgtgatgtccttaactgatggcctctccaagatgtcgaagtctgctccttcagatttgtctcgcattaaccttcttgacccaaatgatgtgattgtgaacaaaatcaaacgctgcaaaactgactcgctccctgggcttggaattccgacaacccagagaggccggaatgcaaaatcttctctcagtctaccagttcacactgggaaaaacgaaagaagaagtgttaagtgaatgccaagatatgaactggggggacttcaaggtacctttacggatgccttaattgatcatcctgcaacctattcaaggttcnatacgagaatnatgtccnattcaagtaatttggacaatgtcctgctaaatngggaaggnaanttctgaaatacaaagcacctcnaaaantttacaaaccagggnttctngccaaatncatagttgacattttataacgcacaagcaatttgactgtggccttcgcaaggacgaaacntttgttnaagctgntacctttgtccgtntaggccggtaaagttaangnttttcgaaaaaaaaaaaa

SEQ ID NO: 91380 - DNA, 373 bp, Triticum aestivum
  unsure (1)..(373): unsure at all n locations
  Clone ID: PAT_TA_91380
ctcgtgccgaaaaaatactgcagcctttttattacgtctgactgactgaggggcgctgcttgttggatgggggacggcgcgctgcggcggctgttcgagaagccgttgccggagaaccccactctgctggaggtgctgtcggcttgcaacaaccacacccaccacaagaagctgctgccggccgtggacccgtcgtccttcacggagatcttcggtgagtccactccacgaagaanccgacggcgccgccgccgaactcctgccacgggtgccatccctggatcacgcgctacggcggcgtcctggtcnacatcgctancaagccgagaagacaaggacatcntcnctggacgcctcctcaagncgaacccgt

SEQ ID NO: 91381 - DNA, 454 bp, Triticum aestivum
  unsure (1)..(454): unsure at all n locations
  Clone ID: PAT_TA_91381
gtgcatcgcctcctcaactcatcgatcggaaaaaagatctcttcttgaccttgctgggttgacgcccacacagatctcaagctcagggggcgactcccgtctcatctcatctcatcggagggggatggactccaatccgccgtcgcagccgccgcaagcagcagcagacgccggcgaagaagcgcagcagccggcttccgaggcgccagcgccgcagcggtgagggaggagtactncagaacgctcaantcctctcccaacccaagtcaagggtccgccgtcgtctacgccgtccttcctcccaaaacaagggctcaacgccgacgaaatttacgaggcttccccgaatncccgtncggcngccaacaacgcttccctcccgaccaagcccagggcaagcaagtccccgccgccgncgngctccgcaagttaagccaacaacgnggggccatat

SEQ ID NO: 91382 - DNA, 332 bp, Triticum aestivum
  unsure (1)..(332): unsure at all n locations
  Clone ID: PAT_TA_91382
ctcgtgccgaattcggcaccgccacagactgggacggcgggaccgtcggaattgctgcctccgttgtcgaagacgttgccacgcgtcgggcgtcgctgcaaacattggatggaagtctgtgcatcaaatgctgtcgttgctccatgtccttggccgtcccctccgtaacagccatgtcgggatggcctagtcactctctgcggagaaactaaagtgctgataacgtgtttagaaagggaaacgaagagacaatcgagagagccttgggaacantttaaagttaatccttatccncaatgatgatnggttacacatattaaaanaaaaaaaaa

SEQ ID NO: 91383 - DNA, 620 bp, Triticum aestivum
  unsure (1)..(620): unsure at all n locations
  Clone ID: PAT_TA_91383
ttttgattaaatccattttacgtaaatcaacattttcacaaatcatggctgccgagttgtgctattttgcctgcagtcagaccaggatcaagaaaattttaacgatgccagccgtacccgtcgcctggaagtacgtcagatctggactctgttgcggatactagaagcacaatgaactcacgaagactcgctagcccgtgcacagtccctgaagaaacacacgcatgcagcggaggcccagagttgcaggttcgctacgcgggtctggccgacagcgatctagccatggagaccgtgttgagccagatacatgggccgatcgaaatccagctcaacggagcacacatcanggagattcgttacttccttttttgatcaacctggtcctctacnacttgtttttgaaaagngcgtagactagagtactacngacccgattaattacnatctgcactaagctccatggngataaccgccgcgcggttacagccgaatcctaaggaaaaccgtggcgattctacatgatcactaaaatgatcccncactgaagagaaagcaagtttacccgataatctaccaaggcaaacttncatanacannctgcgcaaatttttagaatt

SEQ ID NO: 91384 - DNA, 604 bp, Triticum aestivum
  unsure (1)..(604): unsure at all n locations
  Clone ID: PAT_TA_91384
ccgcgatggcgctctccccctcgtccttcgccgggaaggcggtgaaggacctgccgtcgtcggcgctcttcggggaggcgcgcgtcaccatgcgcaagaccgcggccaaggccaagccggtgtcgtccggcagcccgtggtacggctccgaccgcgtgctctacctcggcccgctctccggcgaccccccgagctacctcaccggtgagttccccggcgactacgggtgggacaccgcggggctgtcggccgaccccgagaccttcgccaagaaccgggagctggaggtgatcactgccggtgggccatgctgggcgctctcggctgcgtcttccccgagctgctcgcccgcaacggcgtcaagttcggcgaagcctntggttcaagggcggtcccagtnttaaacaaggcggctcaataactcggaanccaacctctcaagcgcanagatcttgcatctgggctgcaagtctctatggcccgtcaaggtacgctccccgnggccctcgcaaattgtaacctctcnacccggggagcttnaccctggcccccatnaccnagnatccgngtaagnaagaattaaaggcctccaantccaattggt

SEQ ID NO: 91385 - DNA, 263 bp, Triticum aestivum
  unsure (1)..(263): unsure at all n locations
  Clone ID: PAT_TA_91385
cggattgggggaanaataagcggcagngccaaaancctantgcccccgcgcgctgccgcctcagatctcngatcctagccgccggtccanatctgtcntcgcanatggngggcacggggnggtccatgctgctgtcgctcntgctgttcgcggtgacgctgtcnctgctgnagatgtaccngngctggatcaccgnctncnaagctcangancatctccggaggattcntcagctccctcctcttcgtcntcctcntcaactt

SEQ ID NO: 91386 - DNA, 614 bp, Triticum aestivum
  unsure (1)..(614): unsure at all n locations
  Clone ID: PAT_TA_91386
tccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccanaactgtgacgtcccccatgttgaccgccaagattatcagctgattgacataactgatgatggtatgtagccttctaactganaatggcaacacnaaggatgactgaaacttccaacgatatttcgcttggcaaattaaaacggattnccgatggaangactgatcgtcgtattccncaaggttaaaaaanttgccnttaagaacgtggggaattaacacntctggtncaactgaaactggacaanctcggggttgnaacataatggncaaancgttggtaanattntcaattgnnttt

SEQ ID NO: 91387 - DNA, 605 bp, Triticum aestivum
  unsure (1)..(605): unsure at all n locations
  Clone ID: PAT_TA_91387
ccgcgatggcgctctccccctcgtccttcgccgggaaggcggtgaaggacctgccgtcgtcggcgctcttcggggaggcgcgcgtcaccatgcgcaagaccgcggccaaggccaagccggtgtcgtccggcagcccgtggtacggctccgaccgcgtgctctacctcggcccgctctccggcgaccccccgagctacctcaccggtgagttccccggcgactacgggtgggacaccgcggggctgtcggccgaccccgagaccttcgccaagaaccgggagctggaggtgatccactgccggtgggccatgctgggcgctctcggctgcgtcttccccgagctgctcgcccgcaacggcgtcaagttcggcgaagccgtgtggttnaaggcggtccagattttcaccanggcggctcactaactcggaacccagctcgtcaagcgcaaacatcttgcatctgggctgcaagtctgctcatggcgcntcaaggtacgcntcccgnggccctcgnaaatttcnactctcaaccggggganntcaaccctggctcccgatacccaggatccgngtaaagngaagaataaaangcgcnccattccaatt

SEQ ID NO: 91388 - DNA, 634 bp, Triticum aestivum
  unsure (1)..(634): unsure at all n locations
  Clone ID: PAT_TA_91388
cgaagcggttgagtgccgcaccctagatggctaaagtccagtagccgaaagcatcactagcttacgctctgacccgagtagcatggggcacgtggaatcccgtgtgaatcagcaaggaccaccttgcaaggctaaatactcctgggtgaccgatagcgaagtagtaccgtgagggaaaggtgaaaagaacccccagtgggtagtgaaatagaacgtgaaaccgtgctgagctcccaagcagtgggaagggaaattgatctctgaccgcgtgcctgttnaaagaatgagccggcgactcatangcantggcttggttaagggaacggnacccaccggagccgtnncgaaacgatcctaataaggcgatgtcactgcttatngacccnaactggtgtntatccatgaccaagataaacttggttaaactaagcaaagtccgaaccgacgatntttaaaatcancgtnaattttggtanggngaaatncacccaaccaaactactggttnccccaaatcntttaggccacaatttacggcatctagggaaacatgttcggtcggctgccaacgtacaatcagnaatctatacaatntnccaaatanaggncaggtcgcattaacatgggnactcccc

SEQ ID NO: 91389 - DNA, 261 bp, Triticum aestivum
  Clone ID: PAT_TA_91389
gcgacgaagggcagaaaaatggtcttgaaggcatctgcaggctgtcggtcccagcctccagaatctcaatgacctcgcccattgttggccgatcgcaagacctcatctgaatacaccataatccgagctgacagtggtgtcagaggaggaatccgactgcggtgtcaagaggaaagacaatgtgtgaggtatatatatacgatgttgtggatatattttggtgcaatgtaatctgcacttatatgtatgttgttcacagag

SEQ ID NO: 91390 - DNA, 574 bp, Triticum aestivum
  unsure (1)..(574): unsure at all n locations
  Clone ID: PAT_TA_91390
ctcgtgccgaattcggcacnagaccacactcatctgatcacccatagctagctagctagcagcttaaggaactagcttgcagctaccgatcgatggctcgtctcaacagcaaggctgtggttggccgccgtggtcctgncggcggtggtgctgatgatggccggcagggangcctcggcggcgctgtccgtgcgggcaggtgggactccaagctcgcgccgtgcgtggcgtacgtgacggggaagggcgtcctcgattaagcaaggagtgctgctccggcgtgcaagggctgaacggcatggccgcancagttcggaccgcaaaatactncaagtgctcaaaacctcncaacaacatcaattcatcaacatggcaaagtcnccgggntcccngaaatncgggtcaatgtgccttcccaacaagaattccacaaatgnaaacttcaactagttaatattaaccttccnantgatcatgacccctntnttgggctaagncaaattnaggatggcaaacatacganggctataaaaaataaanaagtnctcaaggttatnaataggggcaatcgtac

SEQ ID NO: 91391 - DNA, 494 bp, Triticum aestivum
  unsure (1)..(494): unsure at all n locations
  Clone ID: PAT_TA_91391
ctcgtgccgaattcggcacgagggagcctcatgaccgcgttggcgcacgatggtggttggcttggtggcaggatccggggcgcccgaggtgcgggttgggatcgggggaaacccctatcggcatggccaacaccggcgcggtggcgcctgtgggtgccacctgaccttccgggagggtgtcggggctacccttcctctccgcctccgtccgtgtaacgggggaaacccttggcaacagcatccgtcatcgtcgtgatccgtcttggaggtgttgataaggtgccggcgcttccggatcttgganccnagtggaagattctggtggggcgctgcgatcgcgagttcttcctttttgnttatncgccgtttgtccgatttgttcctttctttcccctgtccttcctttgggcctgactgtgctgcttccgccccaacacctaccatgtatggtccggttggttgcttgtntacaaagcgggggaaaccttttccgt

SEQ ID NO: 91392 - DNA, 439 bp, Triticum aestivum
  unsure (1)..(439): unsure at all n locations
  Clone ID: PAT_TA_91392
ggacagccgagattcaccgaaattctactcgttgtaggagtacatccgagtgcatgcgtagcttgggggaacaggagcatgcttcggttggggattctggtttttacatggacgggacccaagagcagcagtacgtactacacacatcaacaacgtatccacaatttagcactacctgcacgccgactttacaancttgtccatatcttactccatttgcattgggtttggcagtcaagcttaagcagcaagacacagcctggataantgattagaattaaaaaataaaaactggtccgagcgtcctgggctcctctccctgcccggcacttcgttgacgtcatgtttcccgatgggacggcggcgaanagaacatgcccacttccaantccaancngggagcatttgtgaccttcccctttgcatnaggaggtgtcca

SEQ ID NO: 91393 - DNA, 465 bp, Triticum aestivum
  unsure (1)..(465): unsure at all n locations
  Clone ID: PAT_TA_91393
tttagcctccagcgccgccgccgccgccccccagcgaattcgacaagcccccgagctcgccggatccgatggccgtcacgttctccgacctccacaccgccgacgggctcaaggccctcgaggcgcacctcgccggcaagacctacatctccggcgatgggattcaccaaagacgacgtcaaggtgttcgcgncggtgcccgttgaagccagcgccgattcccgaacgctgcccgtgggtatgacaccgtcgccgcggctgttgcttcaangttcccttggcatcctctgggtgaantgatcatccggtcctgctgcaactgtcctgccgctttccaaggatgnaagacacnatnatgaatggttctgttttgggaataaaaccaagganggacaanaaattgcaccnaaccttaggtgcaaacctgcaannaaaaaaaaatggaaaccccttccccagggntaa

SEQ ID NO: 91394 - DNA, 632 bp, Triticum aestivum
  unsure (1)..(632): unsure at all n locations
  Clone ID: PAT_TA_91394
ccgatccgtcctgccgccatccatggccgcctccctcttccgcctctcccggccccgccgcgtgctcctccccttgtccgccctccgcctccctttctccacccagcccctcccgcagccccgggacccgtcctcccccaattccaaccgcggccttcctgccttcctctccttcctcgccgccgcagccgcaggcggaatcaccggttccgtcgctctctgcgatgccggcccgaccaccgggtcngcgggaaaagacaacacccgactgttggtgcgtntggggaacgcaancgccttccaaggcattcatagaaaantcgcatccttcctccggggaagaactgacgtggttacgaaggagaagactttccaacgggacccgcaagaatacttcaacaaggaatcaaagtgccgactcntcctcttnccaaancccaatatgaagnaacggatatgtgatgnttgttanaatacaaagngcccatgtacaaatggnggggtacncaatganggannacttggaactaaggnggngttgaatgacaagtctaatganaaaataaatcctcatgttagaaaggtgttgattaacaganttgtgatnactataaaactaacccangcccntt

SEQ ID NO: 91395 - DNA, 606 bp, Triticum aestivum
  unsure (1)..(606): unsure at all n locations
  Clone ID: PAT_TA_91395
accttcttccctctcctccccacacccccacgacccatgtccctccatcctcccgccccagatgcaaccggcgacccagccaccaaccccgagtcagccatccccactcctaccaccttcctccgcgcgccgaagccctgccggatcaaccccgtctccggccatcaacgccccagcgcactcgacnnggcccccatccctcccgcgctaccccactcccccctctgccgaatccatggngggccacggcccctcccgcgccgcccatgctctcccacaccggatncgaaggctaccccgcgcactgccggcgacggatttgggcacaccgtcatgcccgcgccgcccaaccgcccaaccgctggttcacgccgcgccggacctctcgcggcgcgctgccgctggttcaagccgcgtcgatctccaangtcgcctacgcgtcttaaggcccggggccttcttcctccaancgggattgcaganaacaagaattcggtcgttancgcccgtctgaacagangcactctgtcgttaactctggcaataggcacgganttaggccacgtcggcggtcggcncagtcctcctcgtcttncangccactnt

SEQ ID NO: 91396 - DNA, 371 bp, Triticum aestivum
  unsure (1)..(371): unsure at all n locations
  Clone ID: PAT_TA_91396
gcagatggccggcgagtgctgcagtatacgagtattctgttagcccaatgagccaattttatctacctgtgtcgacttataggcaaactgataatgaggacgttgagatcagatacatacctaaagggaattctaagatgggcgttatttctatcgaaaaaacatctcatttacaaagttcccttcaattcaaacttttccgtcgatggtgaagaatttgggtcaaacattatctttaagcccacccacaaaagaagacgacctaaaccaatgttatttaacaagatagagnttccgcaaattggacaagaactcaaaaactccnggcttaatggggataaatataaatatattaattcaaaaaaaaaaaa

SEQ ID NO: 91397 - DNA, 421 bp, Triticum aestivum
  unsure (1)..(421): unsure at all n locations
  Clone ID: PAT_TA_91397
ctcgtgccgaattcggcacgagccaccacctctccggcgcggggccgggcggagcggagcgggcgaggcggccagggtttcccacgccccaccgccgctgccgcattccgtcgaccgcatggcgctcgtgcccagcggcgaccaggccgcggcctgcaaggccaccatcccctggtccgagatgttccgctccgcctccgtccgccgccccaagcaggcggaggacccgcccaagcccgcgcccacgtcgccggggaagaaggcggcgccgccggcggaggccgaggggctgtccctgggagccggacgcgcgcctggcgctctacatcgccatggcgcacgcggggctcgccacgggctgctcgtgtctaanggcttctananctgttcgccacttctncggnccgtgcantgggcgctg

SEQ ID NO: 91398 - DNA, 579 bp, Triticum aestivum
  unsure (1)..(579): unsure at all n locations
  Clone ID: PAT_TA_91398
ctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcagtgttggcccatccgagggcatcaagaattccgagaccctgtcctacttccaccgctcaacacggangcctccttaagcagtcgactacctgattccgctccaagtgggtccttgcctccaatttaacaagttggttcatcttcccgtttagcacaaccacccctgggtactacgatggcngtactgggcaanttggaactgcctattttcngatgcaccgacccacgcaggtgattaacgaggtgganggagttcaagaaggatacctgaccctatgtcgcatcaaccggtnncacaacagcgncaangcatgcgtcaactnaacgccttaaaccacnggtcaagatccggaaggtaaaantccccccanggggatanaaanggcccnttttttttcc

SEQ ID NO: 91399 - DNA, 205 bp, Triticum aestivum
  Clone ID: PAT_TA_91399
ctcgtgccgaattcggcacgagaaaaggtttactgagaaggtttccaatgaagctctgacaattagagatggaggtaatatataatgaggttacctaggggttcaatactgactctgctactcgtatgtaaatggagtatggtctataaatactgcgcttatagatagttgattatagatactaagtaaagataaaaaaaaaaaa

SEQ ID NO: 91400 - DNA, 590 bp, Triticum aestivum
  unsure (1)..(590): unsure at all n locations
  Clone ID: PAT_TA_91400
ctggagcggtgtcgggtgcagctaaatgctgctaccaccgaactggagaacttcaagaaggcgtcttctgggtcgcctgatcaagttgaagagaagttgaaaatcaccaaggagggagaaaaagaggcgaaaaggcaacacgccgcaggcatatcgacgggccgtcctgaagaggaggtatccggatcatcaagtgatctgctgcaaaggctgtcgcaattcacgagcatctcngctggcatgccgatttttccaagnttttatggcatccgctccgtccaagaatttggagaacttnttaantttcaaaggacnccgcgcgtatcctgactatggaaatatccgcctcccaaaagtgtccnaaaagccttggcattgtggaaatcatgtttcaagcngnttctancaaattgcctggtttgaccctaaggtcnattgnnaaaatccccttacttaantatatgccaatttaactggccncaaatatccaacaagatgtaattggccgctgttgacggttnaagaagaatctttattccaatgacaagtcttcccaatntgacnctactaattnacaatttnangaattt

SEQ ID NO: 91401 - DNA, 602 bp, Triticum aestivum
  unsure (1)..(602): unsure at all n locations
  Clone ID: PAT_TA_91401
gttcataattgatgtcattgacctgacgcatgtcgttaaccatgagccagaaggaaatgttgattcatgtaggtactgtaagcttccatacagcaggagtgtatataggaacgatctcaccaagaatatcgccaccacataggtagactgagcatattatactcccaaaatataaattgccagccaaggaaaaaaacaagatcacttgtcaggtccgtaaaactagcaatctgaaactcaancctatgttcatccgatacttgtttaaatgttatatggctaaatatagtatgtttgacaatgcatacaatgtttgcagatccaagaanggactgctgaatggnaaaaattgcaaatgaagcaacaagactatccctggnaagaaaaaatgggggaantnttgacattaaaactaancaaagtccaaanttanctaccattatttgtttacngnccanccgnatacgggcgatatcatttcccaagggatggaattcntttccggcataaangatgggtcctgancaaatgtagatataaaggggataaggancttacccggtggncaaagactttgnaaccaacttaaaggcnangcccct

SEQ ID NO: 91402 - DNA, 603 bp, Triticum aestivum
  unsure (1)..(603): unsure at all n locations
  Clone ID: PAT_TA_91402
ctcgtgccgaattcggcacgagaaaaggttcgagtgcgttgcagagtgagaagagatggctccggtgaagctgtacggcgcgaccctgtcgtggaacgtcaccaggtgcgtggcggcgctggaggaggccggcgtcgagtacgagctcgtccccatcaacttcggcaccggcgagcacaagagccccgaccacctcgccaaggaacccctttggccaggtgccagctttgcaggatggtgacttgtactcttccaacacgtgctatttgcaattatgccttccgcaagaacaaccagactgtttgaaggagggcgacatcaaggagtcaanaatgggtggatgtgttgtccagntggaaggccatcaattacaccgccgtctgacccattctcttcaatgccttatcancccnagcttnggggancaactgacaagaagncattgacnacacttgttaagatttaaaactgctggnatgtncnaagccactgacatccaatactgctgganacctaatctgcggctaacatttcgtaccttcttgnggtaactagatccgtcacctaccattaagctgggnnactttgaagctctcaaagcct

SEQ ID NO: 91403 - DNA, 513 bp, Triticum aestivum
  unsure (1)..(513): unsure at all n locations
  Clone ID: PAT_TA_91403
atcgatcctcccgcgtaccaagccaccgaccaacatggcagcgtctctccaagccgcggccacgctgatgccggccaagatcggcggccgggcctcctccgcgcgaccgtcgtcgcacgtcgcccgggcgttcggcgtcgacgctggcgccaggatcacctgctccctgcagtccgacatcagggaggtcgcaagcaattcgccgacgccgccaagatggccggttcgccctccgccactctgccctcctcgtctccngngcanccggaggggggcgcccaagagntgacttcacaaattcaaaacaagactaatgagttaanggtaccggacngcaacaattcccgacatcaagggggtnnaaccttncctttaaggccggaantcaattaaaattntgctngagcactcctttaacgttaaggccanggatcaanaaaaaaaccnccgcttaaaaanacaaataagaccttnaactaaaccttacaaatgaaaggcccncaagncgggcca

SEQ ID NO: 91404 - DNA, 329 bp, Triticum aestivum
  unsure (1)..(329): unsure at all n locations
  Clone ID: PAT_TA_91404
ctcgtgccgaattcggcacgagtcctccccttccggttcgggttctggttcggttcgggttcggttcgagagagaggccgagtagctancctagtctagggtttcggtagagaggaagtgagatccatggcgganacggantaccgctgcttcgtgggcggcctcgcctgggccaccgacgacaacaacctccagcaggccttcagccagtacggcnagatcctcgacgccaagatcatcaatcgaccgcgagacggggaggtccccgtnnggttcnggcttcgtcacgttctgcagcgancgagtcgatgcgccangccatccacgga

SEQ ID NO: 91405 - DNA, 627 bp, Triticum aestivum
  unsure (1)..(627): unsure at all n locations
  Clone ID: PAT_TA_91405
aaagaaatgaaaaggcttagtttgctctcaccaagaaatatcacagtttaaaccatgttcacacacaccatctaaaccatgacttggttcagttttgatgaggtgtgtacagagaagatggggatttgaggcgctcatccaaattgcctccaaactgatcgatcttcccgacaaaagatggcctccgaaattggtggcacgctgatcatcagttttggggctgaccttttcaggtaacagcagcagcgcgtggaagaaaaccgacagcacgcgccgttagggacatggttcgtcggctgaaacctgccgtgttacggcggttaactaccagcgttataaaaatatatactccatctcatcatttcctcaaaactgcgacttanaaggaaggcgtacattctaacacatacgtttcccttaatgggccaaccaaggtgaaggagcaaacactgagcataaccttggacccgctccttaacggattctccngtgacaatactacccaaacagacttcactatanaaaacacctaacctcantaggtcangtntggcnccggctgccganatgccttcgaagtgatgccaacatggnggtaagttaaacnctggaacccataacatactt

SEQ ID NO: 91406 - DNA, 211 bp, Triticum aestivum
  unsure (1)..(211): unsure at all n locations
  Clone ID: PAT_TA_91406
ntttttttttttttttntttttgatcaatgtgaccgtatatttctcnattccttcaattcantaataatcangnaagcatagactatccatggnctgcagngcanangagctaaaaatcctacagctcantggngatcctgtgaaccctttccttgggcaatggcatggactccagctcgaaggntcancatgcccggtngcttcnaatcg

SEQ ID NO: 91407 - DNA, 672 bp, Triticum aestivum
  unsure (1)..(672): unsure at all n locations
  Clone ID: PAT_TA_91407
ccgccgccgacttcccaaccccggcctccactccaccgccggcggcctctccccctctccctggacgcatatccactcgagcagcacagcccacggtcagatccgcccctccgtcctcgcgccagaaaccctagccgtccggcgatggcgaccgaccgcaggcacaggcctcgacgacggtggcgccacggagcggagcttcctctgcccgggacgccgctcatgtgctcgtcaaggtccgctgctccttcctccagtcccagacccaaggataagcagcagcagcatgaaggtacgaccctctctcttgatttcctcttaatccctccctttcctttccctaaggcatgggatttgctttccttggtangtgcacgcatctcctcctccctgcaatttgttgtgttgctccatgagcatactttctatagtagagatctaataagcttcgttgattttcaaaaggaaaaaattactttgcttgacatatcnacctttaatgaacttaaaacagntatcaagcaggattttttagaatattgtgtaacgataataaacgattggttcncaatgttaatattaagnggggtaatatccaagcaatcggtgtcaactntcaagnaannactgantaaatccccgattaatcgaattccgctagtccgaaaataa

SEQ ID NO: 91408 - DNA, 534 bp, Triticum aestivum
  unsure (1)..(534): unsure at all n locations
  Clone ID: PAT_TA_91408
ctccagtgagcctccactcccaccaccgctcccctctcgcctcacgcacgcaacacagtctcgctccaccccaccacctcgcgccgctcctccgccgcgacgatgctcctctccgggccgcagccgcctaccccgccgctgctgctcccgganagcagcggcgaggacggcggcgcccacgaccacgactcctcctcgcgggcctcggtcccgaagaagcgcgccgagacctgggtccaggacgagacgctcagcctcatcgcgctgcggcgcgagatggacaaccacttcaacacctccaagtcnaacaagcacctctgggaggcatctccgccaagatgcgggagcagggcttcgaccgctccccgacatgtgcaccgacaagtggcgcaactcctcaaggagttcaagaaggcgcgcagcaagcccgcanancgccggcgccggcgggaacggtctgccaagatggctactacaggagattgacnacctgctaagcncgcgggaagnngcgcctctccgcgggatgggggg

SEQ ID NO: 91409 - DNA, 521 bp, Triticum aestivum
  unsure (1)..(521): unsure at all n locations
  Clone ID: PAT_TA_91409
ccaatctccaaactctctctagtccccaccacaacccgctccccatggcgacggccgccgccaccgccgccaagccggcggcgaggacgacggtgaacgtggccggggccgtgtaccgcgtgcagctggccctcctcgacggcgcagcggcctccaacgagcccctcctccacgcggccgccgctatcctctcccgcgccgactacgacgacgtcgtcaccgagcgctccatcgccgangcgtgcggccacccagcgtgcacnagctccctccccgaccccgccaaccccaaggcggcgccgcggttcacatctccctccgcgagcaacgcgtctacnactcnaggaggccgcaattctgctccgaacgctgcctcgtcgcctccgcgggcttcgccgcctcgctccgccgacgcccttcgggatccgcccaacagntggaccctggtcgcgtcttcaaggcaacggggacgtccggggtaaggttcggtcgggntggaaaaaaggagcaggggaggaagg

SEQ ID NO: 91410 - DNA, 202 bp, Triticum aestivum
  Clone ID: PAT_TA_91410
gagaactagtctcgagtttttttttttttttttttttttttttttttatcatatcaagttgctagtagacgggtcttatttgtctgcggcaccatatgattttgtcgcaaaatagcaaaataaaacatctcatgatttgctcccctgtacagagatagaagagtcacttgagttgggggcaacatccaatcattcggggggg

SEQ ID NO: 91411 - DNA, 626 bp, Triticum aestivum
  unsure (1)..(626): unsure at all n locations
  Clone ID: PAT_TA_91411
ttctctacctacccacctgtgtcggtttcgggtacaggtacccttttgttgaaggtcgttcgagcttttcctgggagtatggcatcagttacatacttcagcgccgtagcgcctggtatgagcctcgtggagaagcaatcgctagtccacggggctcatacttcagcgctgcagcgcttgggtactcggacctcggctcgaggcattttctctaccccttcttaccctgaaaaagcagggtcaccttgtgtccttaaacctataaccatctttcggctaacctagcctcctccgtccctccgtaccaacaaggggtaatacangaatattgacctgttgtccatcgactacgcctttcggctgatcttaaggcctgactcaacctccgtggacgaacctngcggagggaaacctgggntttcngggcattggatccacaaagttttcgttactcaaancganatctcgcttcgctngttcancccgcttngccggtggtccctcnaaggggaacnccccaacggngattttgnatccaaaatcgganttctaaccgtaactnangcangggccatatgncntaccancttaaggggtgcttaggaacccggttctgnccactctta

SEQ ID NO: 91412 - DNA, 605 bp, Triticum aestivum
  unsure (1)..(605): unsure at all n locations
  Clone ID: PAT_TA_91412
ctcgtgccgaattcggcacgagccgcaagcaaaggccaaggtggcaggagctcctcgcggctctctcggagcggcggcgccggcgcgaggggagcgggatccggatcccgcgcggcggagcgatccccggccgcctcgccggatcgccggagacagtttgctggtctccatatagttggggatttttcggagtctgaggcgggattcagagatggaggagctgctgggcacggagatcgggaagcacgactacgactggcttcttactcccccgggaacaccccgtgctcctgcactggaggttgctgagaaagccccaccatcaaatgtgcctaaacggaccgtcactagatcttcctcaaccaccaagagcatcaaggctttctgttgatgaaacagagaatgggcattcaacaactcccaatagacaagtgcgaagcatgtcccgacttcaaacangtcatcagtgctcantccaagcattcttcngtcaattcgagactactacccgacaagaggataacatcttcctctcaatgcatcactcaactcactcaatggaacacataactacccggtcaaaaccgcaactaccggtcaantcg

SEQ ID NO: 91413 - DNA, 595 bp, Triticum aestivum
  unsure (1)..(595): unsure at all n locations
  Clone ID: PAT_TA_91413
ggttgtagaaattttcatgttattaaatttcctctcgttgtgttgagatagtcaatgttttatccttctcctttgcatatgctagtttttgcttgccttgataatttgtttgctcataaaattcctatgcataggaagtatgttagacttaaatatgttttccacatgatttatgatgttctctttgtgcttcaattcttatctttcatgtgagcatcgataacatcttatgcctagctaagggcgtaaaactatagcgcttgtcgggaggcaacccaatgaataaaatttattttgcttttttctttatgttcttgagtgttagcacaattatgctactgttatgattgtgttttttgtgttttaattaagtgtttgtgccgagcaaaaccaataggatcttcctgggtgataattgtttgatcttgctgaaaaagacagaaacttgcgctcacnaaaataattgttaaaacccacaagaacgtgataaaatgcaattcttttgcagaagataatatacaattatcaagtttccnagtttcanaattttggngtccataatattcaacaatcanatgccaaacgtcngtttttt

SEQ ID NO: 91414 - DNA, 584 bp, Triticum aestivum
  unsure (1)..(584): unsure at all n locations
  Clone ID: PAT_TA_91414
gtgagcagccaggcaatgttgtggaagactctttcgtcggagcactccacggggttccttggcgtgcaccccgccgtcaaccgcgtcctctggtgggcctccgtcgccctcaccgtcattgtgtccatcacgtacctactcaaggttgtgttctacttcgaggccgtccgccgcgagtttcaccatccggtccgcgtcaacttcttttttgcaccctggatcgcttgcctcttcctcgtcaagggcttgccccgccccgagagggagatnaaccacattgtccnggnactcctcatgacaccaacctccggccttgactncaaaatcnacggcnagtggatgtcaagcggcgagcgcaaactctcgaaggtggcaaccgtcnaacaactcgccgttgttggaacttgtgggaacatacccgtgccaaatggctccgtagttgccatctttcttgctcnggtcgctcacaactcgncncttgtacctctacaaagatcccacaacgtgnactgcaaggagtcancgatctctctcttgcactaccaagtcccncaangnttggcanattccggaatcggcaaggc

SEQ ID NO: 91415 - DNA, 600 bp, Triticum aestivum
  unsure (1)..(600): unsure at all n locations
  Clone ID: PAT_TA_91415
ctcgagttttttttttttttttttttttttttttatctgtcaggaaacggacgaagctcgccctctgcttccatggccgccagcgaccggagccaacatgggtgtccttcccgtccctgccgccagatcangccgctcctctgagcccgaactgcaccaagccgccgcattctctgcacagctactcgtcggagtgatcctcgccgccgtccgttccacaccccggcgtcngtcccgttcctggatctgnctccccgcgcccagttcagcgtccccgcgcccgtcgtcnccggntccggtgggcacaggccggagttagtccctgctcncgttgctgcgcatctgcttccccgcgcactctgcttcaatgaccgaatgagcacaccagcgaggagtttcccctcggccccggtgcctgcggctcntccgggcctctcgtctactgtagccgtgctccgacgancggagnccatgacaagccngcccgtcgcncaactctccctccctccctcaaaaggtccntcnaccctccaagttcgccctcccgngntcctncagaanacacccaaggcgccantcaaantggatcccgtaacgtnc

SEQ ID NO: 91416 - DNA, 598 bp, Triticum aestivum
  unsure (1)..(598): unsure at all n locations
  Clone ID: PAT_TA_91416
cctcaccctcgtcctccccgtcgaccaccccgtcgtcgccgccgccttccccggcaccggccctcccgcgcccctctccctccgcgatgatttgaagagtctatcttctggagatgtccatttgtactgcaaagcatgctcagcaagattgacaaaacagccactaagggacgttgtggaaatgccatctttaaattgggaggatgtggctgacaattggtttggtggatgttgcacatcattcggaggggcaagtgagaagttaatatcacactatatcaatgcatatggtcgcctgcagagaacaactctactaagatgctacctccattattatagagaaggattatcttgagactgatatagtgtcaagagtagatacttcantgccaatgttgattttgttgcactanaagaagtatgttaaagttactctagaaagcgatnatactgctgagaagataaaattgaataattcanaagaggaggtatgcatgaaaagaaattggtctaacactgcgactcaattctttggaaaggtcctgtatgatactggaaaaaatgaggatcctngacgatatgtggacatcaactataa

SEQ ID NO: 91417 - DNA, 651 bp, Triticum aestivum
  unsure (1)..(651): unsure at all n locations
  Clone ID: PAT_TA_91417
gcagaacaaacccgaggtaatacagcaagaggtactactcttaaggcaagaaattgacttgcttcaaaagggcttaaggtacatgtatggagagaatgatataaaccacatgaatctcaatgagctgcaagccctggagagtaaccttgaaatttgggtacacaatatccgctatacaaaaatgcagatcatatctagggagattgagatgctcaagaccaaggaaggtatactgaaggctgcaaacgacatacttcaaagaaaggataattgagcagagcgggattctggacaccggcagcaacatgatgatgccacaatttcccttccagcgaaccatggaggtgggatactacttctagcctaaacaacaacctatcaagctatctcgccagttcgggtttgagttcaacaaggctaccctttatggaaccacataaccttagtgtgcactcatgttttaaaaggagaaagaaattacatcgtcattacatgctttcanagtaatcgcctcttcaaattggacgtccaaatgcatgatttcgcattcccccactacaggnaagatancttaccnatacgctaccantacccaatcgatnntcaaaggacttaggatcaaacctgggntgccccccccgnnnaaaaaaa

SEQ ID NO: 91418 - DNA, 625 bp, Triticum aestivum
  unsure (1)..(625): unsure at all n locations
  Clone ID: PAT_TA_91418
ctcctccaccccctcctctctctcctctcctccctcctcatccgcgcgcgcacatcacccagcgctcgcgtgctcgcctcccggaccagtcactgccgcgccgctggggctcgtccgccgcgggtttccacggggaaggagccgcgacgggggtaggccccaggcggtgcacacttcatggggaggcaaggaactaggaggcgatggggtcggatctggtggtgctangtcngagctcgattccccgcctcccgaaccagccgtcgccgcgtcgctggggctcgtccgccgcgggttttcaatggggaatcacacaacagcagcacgcctcctccttctcctcaacgccagagccgccgnactctccttctcctcgctctnancntgccgcgggcgcatccctccctttcgatntaattcatctgttcaaatgttggttggttggaagaacttgaacgccactgnatagcangttgcttgtnagtcgtagnanttntccttgcaatanaatttcnagtatggatggtacctttcaaatctaactatananatgtcggaaatccanaaatattntgaatcaatcaacatnggtancaagggnaattaacttgnaaattcccctgta

SEQ ID NO: 91419 - DNA, 627 bp, Triticum aestivum
  unsure (1)..(627): unsure at all n locations
  Clone ID: PAT_TA_91419
gcttagctttgtcttgttcgggaagacagatccatatgttgctatgattctcggtgatcaagtcataaagagcaagaagaacagccaaacaactgtgactggcctaccaggagaaccaatttggaatcaagattttcatatgctagttgcgaatccccgcaaacagaagttgtgtattcaagtgaaggatacagttggtttcaccgacattactattgggtactggagaggttgatctaagctcactcaaagacacggtacccaccgacaagatcgtcacattatacggagggtggggcttcttcggaaagcggtcatccggcgaggtcctcctccggctcacatacaaagcgtactcnaggacgaggaagacgagacgtcaaaancgagtatccacgggctacatttcggacgangacacctaacttgtccaactcgacgnacaagcggggcattcaacggnatgagaggagaatccatggactgctggcccttgctctnancaggatcaagtatgttcgcactganacaaaccaggggggccgtacaatccctaaggatctatacccccaaggctcnttaactctacggaaaccnggtacaantancctganaaccttcagnggg

SEQ ID NO: 91420 - DNA, 246 bp, Triticum aestivum
  unsure (1)..(246): unsure at all n locations
  Clone ID: PAT_TA_91420
cgctaaacccccancacgcgcccgcccaccaccgtccccactctgttcccanngcgcccgcccgccgacncgcggcanccacancccgcctgcatcatggcctcgtccancgcggccgcggngctcacctgcctccacnccgccgcgcaggtctcgcggntccctccngcggtncaacgccttcgcgcgcctcncngcgacccactcnaagtncgnggcctggggnanggcggcngtctccgtctc

SEQ ID NO: 91421 - DNA, 584 bp, Triticum aestivum
  unsure (1)..(584): unsure at all n locations
  Clone ID: PAT_TA_91421
cgacggcgaggagggctgcagcctcttcctccgctccatcggcctgcgagagtactccaggtacctcgccttcaaccacccatgcagccacgagaagcccctcttggctcatctcaggttcttcccctgggtggtcaatgaggtctacttcaaggtctggaggcagggtaggaccggctaccctcttgtcgacgccggcatgagggagctttggggccaccggctgggctgcatgaccgcatacgttcgtccgtctcaagttctttggtcaaggtctccaactgccatgggcgctgggggatgaattactcctgggacaccttgctggacgccgaccttnnagagcgaccctttgggctggcaattaatctcccgggtctccgcctgatggccgttaactccaaccgcattngacaaccgccgttntaaggtacaatttcgaccaanccggganaacttccggcgatggntgcccggaactgggcaaggtacaacggaatggtacacaccctggggatcacccatcngttcngaaggtgcaagaatgacnangtcaaatacctctccaatgtnagcaaataaac

SEQ ID NO: 91422 - DNA, 569 bp, Triticum aestivum
  unsure (1)..(569): unsure at all n locations
  Clone ID: PAT_TA_91422
gagcagcacatggccgtcaactactacccgcggtgccccgagccggacctcacctacggcctgcccaagcacacggaccccaacgccctcaccattctcctcatggacccccacgtctccggcctgcaggtgctcaaggacggcgcccagtggatcgccgtcgacccccggcccaacgccctccgtccgtcaacctaggcgaccagtacaggcaattgagcaacggcgcntacaagagcgtctgggaccgcgcggtggtcaagccggcgccgggancgcctgtccgtggatcttcctgtgcccgtncaacacgcgtgatttngcccggnggacactcctcgggacgggaacacccgtntacgcaactacactacaacgantctacagattctnggcaagactggacaagacatgctggntcttaacggtcaaatgntcgtttgcgcaactgctcaacaacgtggtgatgggcncacnagcaacatnccaataaaatgcccaagtgngggtancaatgttgactgttttgctaaaaactnncaacatttactgnntgttccaaaacaann

SEQ ID NO: 91423 - DNA, 443 bp, Triticum aestivum
  unsure (1)..(443): unsure at all n locations
  Clone ID: PAT_TA_91423
gttcggcgaggccgtgtggttcaaggccggctcccagatcttcagcgagggcggcctcgactacctcggcaaccccagcctggtccacgcgcagagcatcctcgccatctgggcctgccaggtcgtgctcatgggcgccgtcgaggggtaccgcgtcgccggcggcccgctcggcgagatcgtcgacccgctctaccccggcggcagcttcgaccccctgggccttgccgacgaccctgaggcgttcgcggagtcaangtgaaggagatnaaaaacgggcgctcccatgtctcaanttcggttctcctgcaagcatcttaacggnaaaggcccctncnaaaacttgccgacaattctccgacccgttaacaanaagcctggcttngcaacaatttctgcccgnaagtaactcaagggttttttctgggaacnaacntcaattc

SEQ ID NO: 91424 - DNA, 225 bp, Triticum aestivum
  unsure (1)..(225): unsure at all n locations
  Clone ID: PAT_TA_91424
acaccatcggcgcacgagactcgcggcgcccaccaacctcgccacgccggaaccctagccagccagccagccagcctgggtatcgccggagggcggcgccagtagcgggagacgagagggggagaaggagagcggaagcggaacccgcgcggtgtagattaggaggggaggagggggctagatgtctgtgcngntcantgcngcngttanaaggtngtcaatgag

SEQ ID NO: 91425 - DNA, 434 bp, Triticum aestivum
  unsure (1)..(434): unsure at all n locations
  Clone ID: PAT_TA_91425
agagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtcgacatcgacgccaacggcaggaaggtcggcaagaagggcgtgtaccagtttgttgacaagtacggcgccaacgtcgacggtacagccaatctacacccgggaggaatggtctgaatctggtgaccgctacgccggcggaacgaacgggcttcctanctggggcgttaactcgccggctcctcgggggggggtcctccccntttaaaaaanaaagnttncccccggtnaaaaacacttcngtttnanaaagggcggntctcnttttaaa

SEQ ID NO: 91426 - DNA, 600 bp, Triticum aestivum
  unsure (1)..(600): unsure at all n locations
  Clone ID: PAT_TA_91426
ctcccacgctgcctccctctctccctcgaaaccctaacccgcgccgcctccatgcccccccgccggccgccaccggccgccgccgccgctcactcgggcacccagccacgacctcacaccgcccctctcctcttcctcccgcctcacctctctctctccttccaaaccctagaccacctccctgccccgtccccgtcaccgaggaggagctcgcgctcggggaggatgaggagacggccgcctccatggagcagcagaaggaagaagggcacgcngcggcggngaccaagangcgcatggcgcanccgaccaaagaaggcgggaacatggcaacggngaaaaagganccgattcctcgacgagccgtcctcgccgaccaaggccgctaaaggatggatgagagatttgaggtggatattaagtcaggaagtctactgcacaacaggctgacccgaagctacaataacatggaggatgccggacggaggctgangagttgaatactgaataaaggantgcactgtcatttggcaagaanagcttgacnancaatattattcgacatacaatcagcanttcgtatcagataattaaacatgt

SEQ ID NO: 91427 - DNA, 491 bp, Triticum aestivum
  unsure (1)..(491): unsure at all n locations
  Clone ID: PAT_TA_91427
gctttacctaccgagaagaagagagaaaaaaggttcgagtgcgttgcagagtgagaagagatggctccggtgaagctgtacggcgcgaccctgtcgtggaacgtcaccaggtgcgtggcggcgctggaggaggccggcgtcgagtacgagctcgtccccatcaacttcggcaccggcgagcacaagagccccgaccacctcgccaggaacccctttggccaggtgccagctttgcaagatggtgactgtacgtcttccgaacaacttgctattgcaagtatgccntgccgcaaagaacaagccaagactttttgaaaggaggcgacatcaaggattcaacaatggtggatgttttnntccaggttgnanggccaacaattanacggccntncttaaccccattccctttcaatggccttaccancccaagctttggggaaccctnaccaaaaggcattnacgaaactttntaaatttnaaaattnnggaat

SEQ ID NO: 91428 - DNA, 573 bp, Triticum aestivum
  unsure (1)..(573): unsure at all n locations
  Clone ID: PAT_TA_91428
ttgccgtagagacagggggttttcctccttgaatatacatgagctacaaatttacattttgaagggaagagaacagagaaaataaaacaggacacaatatagatgggacaaacataacaaggaagcaaagtaacaaagcagagaaaatcacaccggcgcgacggccgcactgtgctcagcgccgtgcttggtgtcatcgtagtgctcgccatcgccccacaacgcgtaagcctcctcaccgttcacgggntcgtccgccaatggcgaacttttcctcnggcatgcgcagcgggacgaaaaggcggatgacaacacaagatnatggacgtgacgacaacttccacccgatnacgaaaagagcgctccggggatttgcttcccgactggggcccccccngnacaacgtntnaaagggccccgggagtttgncaaccggnaaggataaatncaaaagtttggntccgnnaaaaaggccttagggaccccccaaaaagccgggancccttgtgtggttaaccccanggtnntccaaccctttaaggacttggcccttntgngcacaacnagggttca

SEQ ID NO: 91429 - DNA, 592 bp, Triticum aestivum
  unsure (1)..(592): unsure at all n locations
  Clone ID: PAT_TA_91429
ttttttttttttttggctagaaattcatgataagttcaccaactaatggcaattacgtacagtagtatataccacacatacatacatccaccaaaacgatccaaatcactgcgaggctacggactccacatgttcgccaaaagctgcggaattacaacggaattccatacagccagaaaaaacgaaaagtaattcccccaannaaccccctaccttaagcggaaccccgacccccaatcgcccacccccatttcgcgttccaagagaacgaccgcagcaatcttgattcttttcttcagagatcatcatatatccatccctctccttccccgggaacgtgccgggccaggcggttcaaccaccgggcgcgagccggcgggcgccgctgccgccttctttaaccctgggcttgccctccttccgntccgccttgcggaanagnacgggaagagnacgcnaatatgctggctnaactgccgcgcctccgnaaaggcgctcaatcgcctgcgtccatgcgggcgcggggcctctgctcgaaagcagaaganaggtcanaaagactttaaggaggctgcgatngnaaggggggcgt

SEQ ID NO: 91430 - DNA, 543 bp, Triticum aestivum
  unsure (1)..(543): unsure at all n locations
  Clone ID: PAT_TA_91430
ctcgtgccgaattcggcacgagatcagatcagagaacagagcggagcggataaactcgagttcgatcatcaccaaccatgtcgtgctgcggaggcaactgcgggtgcggatccggctgcaagtgcggcaacggctgcggagggtgcaagatgtaccctgagatggacgagggagtggaacaccgcctcccaagaccctcatcatgggcgtttgccccctccaagggcacccgtccttccgaggccgccgccgagaacggagggtgcaaagtgcggcccaactgcacctgcaaccctgcactgcagtgatncatgaagctcaatcaatcaantcaaggagatggatggattgncctgataaagnccantaatattatgcatgatcncaacctttttcgttttaattgcaaccaanataaacaanttaacctaccgtaccanctattaaggataaccttcccctggggttgacctttcgtttangnnctgtccggaatccnttccactgtcaagtcgtccnattgtnacatataaaaaaaaaaaa

SEQ ID NO: 91431 - DNA, 248 bp, Triticum aestivum
  unsure (1)..(248): unsure at all n locations
  Clone ID: PAT_TA_91431
ccactcnccancccangctccangacncncgcgagcgatccatggtacgccctccgcctctcctcntccatnatcctctgcccggcngtcgcggnagcttcgccctngtctgccgccgctccccgngncgnctctttcgtntgcgctgtngcgcgcggggtcctgnccctccgatcncacctngcnccgccaccgccgcagggacntctttaggcacatctcagccttcgncgatgccgnggtctata

SEQ ID NO: 91432 - DNA, 259 bp, Triticum aestivum
  unsure (1)..(259): unsure at all n locations
  Clone ID: PAT_TA_91432
cgcatctgtacttgctaagccagcgcactctctcttttanccaagttaactccaatccattaatggacnatttcaatncaanctngcatnctgcaagtnccgggaattnacaatccacancatggnttccgctttcccntccancgttggagctccggngtnaaaccccgaccaatttctctggaaaaaagngaaaaaacaaggccgtgcgttttaantaanaacaaaggggggaacaanatttanataangggggtca

SEQ ID NO: 91433 - DNA, 564 bp, Triticum aestivum
  unsure (1)..(564): unsure at all n locations
  Clone ID: PAT_TA_91433
gtcgcccccagcctccaccctcacccccacagccaccacaaatcgacggcctcgcctcccaccgccgcccgttctcatcccctcccccggttcatcagagaggaaaattggcaggtcnagcgaccagatccacccacatctggccccgttgcaactggcgacgaccgcggtgttggcgggcggcgccaacatgccgctctcggccatggagctgctcctgtcgggccacccaaacccgtctgtcgcctgctcgcctcccggcggcatcttctccgaacacacaaccgacggcgggtacgtgcttgtgttggcgttggccgctgctccacaagtcgtgctcgacccgccgggtgcggttcccttcaagcgcgccnacgctagtgtccccgcctangcctaacaacggcaaggaccggnaggcnaatgaggtatctccgggcaatgacggngtttcaaaccattcatggaggtgctgctggacggtatgccccgtgnaggttttagggcntggcatccctnaatttgggcaactccgggccttctcncaanntatccanggtccan

SEQ ID NO: 91434 - DNA, 447 bp, Triticum aestivum
  unsure (1)..(447): unsure at all n locations
  Clone ID: PAT_TA_91434
gtcgagtgggtggccgctgctcctttcacctacaatcaaatattcagagatttgtcacgctacaacaagattattatgcagcaatttgcctgagttttgaagcagcagacagccccatcagatcggccaggtatgatttccacggccaatggaaacccacctgggttgcccaatcagatctgcctggagtcatgggcgccctgtgcgatgacgacactgtccgtatggtgggacgttccgagtaccccgacgggatacctgggtcaccgggaaaggactcgtgcctgcggcgtaactcctctctagcgtttctgataccaaacaaaggccgacgggaattatcggtccgccaaccaacaacaagacgataaaactggtggngccaagggcgaaacttttcccgctgccccggagcttcaagggnttgagcaatcangtgatcagata

SEQ ID NO: 91435 - DNA, 574 bp, Triticum aestivum
  unsure (1)..(574): unsure at all n locations
  Clone ID: PAT_TA_91435
gcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaagttctgcctggagcccacctccttcaccgtcaaggccgagggcatccaagaagaacgagccgccggccttccagaagaccaagctcatgacccgtctnactacacccttgacgagatggaaggccgctcaagtccgggccaacggaacctcaagttcangagaaggacgggatcaactacgcggcgtaacgtgaactccccggaggcaacgctgccttctcttaacgtcaacaatcgtcgcaacgggaagcccaaagttaaangggccttctcntgccaataaaagggtncgcnttcccaaccaaaggcctgggggtccacggtanaaaaccttggctaaccccgggggaaaggaaaaggggattgcaaggaaatnaa

SEQ ID NO: 91436 - DNA, 502 bp, Triticum aestivum
  unsure (1)..(502): unsure at all n locations
  Clone ID: PAT_TA_91436
atgctccaccatcgatgagaagacccaggtggtggccagaggcacagcgggctacgttgacccagagtacctgcttgagtaccagctcacccacaagaacgacgtctacagctttggggtcctccttctggagctcctaaccgggaagaagccgctgtcaaagcaacggaagagcctcgtggtgatggttcaggagtctatggaggatggcacgctccatgaactccttgacagtgaaatagtcggtgatgctagcatgggagtggcccttcaggctgtggagttggcgactcgatgcttaagttatgccaaggaacaagangccggcgaataaggcgcgttnccggaggtgctccaacaactggtanaccaaagtgcagctgccgctgggtgttggagtgtcacagccttactgtcacggatatggagaactgcatgtcatctgagaacgacacaacggggattcaaccntgagaagaaacccgtttagcaaaaaatccct

SEQ ID NO: 91437 - DNA, 583 bp, Triticum aestivum
  unsure (1)..(583): unsure at all n locations
  Clone ID: PAT_TA_91437
cgggcctctccgccgaccccgagaccttcgccaagaaccgggagctggaggtgatccactgccgctgggccatgctgggcgcgctcggctgcgtcttcccggagctgctcgcccgcaacggcgtcaagttcggcgaggccgtgtggttcaaggccggctcccagatcttcagtgagggcggcctcgactacctcggcaaccccagcctggtgcacgcgcagagcatcctcggcgaggcccanggggtcnaagctgccgccggggtaaaacgggtccacgatntcgccgagcgggccgccggggaagcngtaaccctccaaggggccaatgagcaacaactggcaggccctcntgccgaattcgacaaggggggggcccgtancaaatntcccnaaaangggcncantaaacccgcncaanggccgcnntttaaaantccgacnggaaaactgggttaccaacttancnccttaagaanccccnttccaaatgggtaatacaaaaggcccacgttgccttcaaaatnccaactgaatgnaatgganccctttacggcataacccgcgtgtggggtacccaactt

SEQ ID NO: 91438 - DNA, 593 bp, Triticum aestivum
  unsure (1)..(593): unsure at all n locations
  Clone ID: PAT_TA_91438
ctcgtgccgaattcggcacgagggccgggctgcccatggcaggactacccgcagccctatcgctgctcctctcctggtgcgccgctcgacctcctccttcctcccactcaggtgcgccgccggccctcttcctccctccctccctgctgcgccgccggccctctccctagcttcagctcgtgcgcgccgcgggtcctctccctcgctccacatcttgcgccgccggacctcttcctcgatccatctcctgcgccgccggtttcctttcttgctgcctctcctgcgctgccggcgtgtcggacgttcaaaaatctcgtcccccctttgggttagcgtagacangcaagggggcggcattacaacggtgggagantgcacactangaccgaccccaagctttatggactagcaagaacctaaacaaaaaaattcccaatttnntcccctcaaatctccantccctgctcattcanaaatctacccgagatccgcacancacgccggttctctaanaagggaaggatngaccaactcgggccggaaatcgggaaatgatccctgagaagtgancggacnagtgtnaacaaaagngg

SEQ ID NO: 91439 - DNA, 570 bp, Triticum aestivum
  unsure (1)..(570): unsure at all n locations
  Clone ID: PAT_TA_91439
gcggcgtccagcagcccgtggtacggctccgaccgcgtgctctacctcggcccgctctccggcgaccccccgagctacctcaccggcgagttccccggcgactacggctgggacaccgcgggcctctccgccgaccccgagaccttcgccaagaaccgggagctggaggtgatccactgccgctgggccatgctgggcgcgctcggctgcgtcttcccggagctgctcgcccgcaacggcgtcaagttcggcgaggccgtgtggttcaaggccggctcccagatcttcagtgagggcggcctcgactacctcggcaaccccagcctggtgcacgcgcagagcatcctcgccatctgggcctgccaagtggtgctcaaggggcgccgtntganggctaacgcgtccccgggggccgctcngcgagatngtggacccgctctaacccggcggcaacttcaacccctgggctcccgangacccnaagngttcccgactaaagtgangagtnaagaangcgcccccaattttcaaagttcggtcntctgnagcatctaacggaaggcccccagg

SEQ ID NO: 91440 - DNA, 501 bp, Triticum aestivum
  unsure (1)..(501): unsure at all n locations
  Clone ID: PAT_TA_91440
gtgatgcgcttttagtgggaggaggtgtccccgtcaatgacgaggcgcctacaatgacttcataaatcataagatgatatgtcggctcagtctcttgaagatgctcatagggtaggacatgcgtgtgagtgttcataggggtgagtgtgtatgcgcgtatgtatgagcgcttacgtatgtactgtgttaaaaaagagagtaaagctacacgtacctattatttataggggctttcacagagtaatctttgttcagggaaattttacaaactaatccaacatggcaccttanggcatctacagtgtgatgctgtcatatttcaacgtcgcagagttttggnaccgattcaaatanggctacantcacaatgtanctggttccaattttgtgcataccgaaggtgacacataatanaatnnataaaancactacanaatcctcttaccaaaangtntgancgtttaaaaggtcaaccacaattanatataanttaggtttttg

SEQ ID NO: 91441 - DNA, 598 bp, Triticum aestivum
  unsure (1)..(598): unsure at all n locations
  Clone ID: PAT_TA_91441
tttttttttgatctccaaagcttcatctcagttggcacaatattattatgccagtttgcaggcgaaacatacaccgcaaagcgaaaagatactcaacacggtgaacgagaatattatgctaatttgcaggcgaaaccaacaccagaaagagaacaactacacacttacacgtatctgcgagctacagaacaggattcatcaagtgtcgccacccactcgtaaatagaagtgccaattataggacggccgaatcaatctacaaagaaatgcctccagatgctaaaaatccttccagtacgtactctatatagctagatcttcctctctcccgaatggcctgctacagttgatctacaaagcaacangtcacaaagtctgaacttaaaacggcagacggttccgtgtttccaagctgatctggcatttcatcagaagttgtgctgcaagtacaattcctcctgtggcgacccnggccaatctcntcctcaatgacgcagacanccctaagctgcnccgacgtcctccanccgtggtgtcggcancaagtcggttcgacctgangattcncncnggacagncacctgggaactttcaagag

SEQ ID NO: 91442 - DNA, 559 bp, Triticum aestivum
  unsure (1)..(559): unsure at all n locations
  Clone ID: PAT_TA_91442
cctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaagtcgactacctgatccgctccaagtgggtgccttgcctcgagttcaacaaggttgggttcatcttccgtngagcacaacgcatcccctgggtactacgatggccggtactgggacaattngaaactgcctaagttcngatgcaccgacgccaccaagtgtnacnaaggtggaggaagtcaagaaaggagtacctgacgcctatttcgcatcaatcggattcgacaacatgctcaagtgcattcgtcaactnancgcctnaaacaacnggctcaagancccggaaggctaaanagtc

SEQ ID NO: 91443 - DNA, 192 bp, Triticum aestivum
  Clone ID: PAT_TA_91443
ttttttttttttttttttttttttgtctgtaaatgcaaggccttttgattctttttcatggccttcactatatctgttggcttgtgataagttttacaaattgtccttatttcccaatctgcttcccctttaatccagcaatgagacaattgttgcaaaattcaggaaaccaaccactgattacaaatgctc

SEQ ID NO: 91444 - DNA, 395 bp, Triticum aestivum
  Clone ID: PAT_TA_91444
gttatatctgctttctgcaagaataaggattttgaaggagcagtggatgtgatgaaggagcttctcgagatgtgcatggctcctgacaaggtcttattgcatgaattctttgaagctctctcaaaggctaaaaagctccacctagcagaagatctgtggtcagctgataaaggtggaaagtttattccatctatctactatactggtgattacaggaacaacggcgaagagaaaactgcatgttaacacgcagtgacctcaatggagcctcattagaatgtatgattgggtttgtctgggagaacaatagaacttaaatccttctgcttgtacaaatgtggaatttgtgttggcacatgcctatgagcggatctgtttgggttaaatgaaaaaaa

SEQ ID NO: 91445 - DNA, 577 bp, Triticum aestivum
  unsure (1)..(577): unsure at all n locations
  Clone ID: PAT_TA_91445
ctcctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaagttgggttcatcttccgtngagcacaacgcatcccctgggtactacgatggccggtactgggacaatgtggaagctgcctatgttcgggtgcaacgacccacacaagtgattaacaagtggaagagtcaagaaggagtacctgacncgtacgtcgcatcatcggattcacaacatcgcaagtgcatgcgtaactnaacgcctnaagcacgggtcaagatccggaaggctaaaagtatcacacggcaaattaatgcatgcgtt

SEQ ID NO: 91446 - DNA, 597 bp, Triticum aestivum
  unsure (1)..(597): unsure at all n locations
  Clone ID: PAT_TA_91446
cctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacccaccaagtgatnaanaggtggaggagtcaagaaggantacctgaccctatgtcgatatcggttcacaaatcgtaagtgangctaantnatccttaacaacgggtgcaagatccggangctaacaccatcacanagcatattaatgcatgcatttaancgaatgttgggttctccattacttcaatn

SEQ ID NO: 91447 - DNA, 481 bp, Triticum aestivum
  unsure (1)..(481): unsure at all n locations
  Clone ID: PAT_TA_91447
ggaagagtagcatccatggcgtgcatcaataccttgcagagctgctccatgttcaaaggggccaaggctgaggccanaaggggcaaagccaccggcgcaaggagcttccnggtgccgggcgtccaacgttcaatggacgggaacnggctccggntcnggctccaacaaaaaccccacgccatcatctccggggaatgggccnaaaattntccctcctcaactaacaagaacttcggggctaacttcaattccancaanaacaacancancaaacaactttccaaagctggcgattaaaaaangggggccctccttgcnaaggcattttaaacccctntttaatgncacaaangggcaanancttgtggaggtttaagcacntttaaaccctgttaangcncccgtttttaaaaaactcccaaaaattccnggggctccttnaaaaaaattttcangggtntaaaagggccaaanaaaattt

SEQ ID NO: 91448 - DNA, 405 bp, Triticum aestivum
  unsure (1)..(405): unsure at all n locations
  Clone ID: PAT_TA_91448
tcgagttttttttttttttttttttttttatcttaaacgaatcncaaatcctggattatgaaagattangtgggattttacaaggaacttactaattcanaatgtgccanggacaccattactacgaaaaatgtcattaaaggggacccattacaaacgtgtcaaaattgccttgcanaagttccactggtccccaagtaaagaccggnaatcaatttcntgnttcnccngaaagactgggtcancaaggggaatcnaancaagttaagctgtacaanaatgcctanttcaaacntcaatttgggaagatcaataaagatnaaaaagcaacaatgacntngnaacatcctcaacaatantcgccacacgaacaaattcancccngaaatgggggaaacccattca

SEQ ID NO: 91449 - DNA, 569 bp, Triticum aestivum
  unsure (1)..(569): unsure at all n locations
  Clone ID: PAT_TA_91449
ccgcgatggcgctctccccctcgtccttcgccgggaaggcggtcaaggacctgccgtcgtcggcgctcttcggggaggcgcgcgtcaccatgcgcaagaccgcggccaaggccaagccggtgtcgtccggcagcccgtggtacgggtccgaccgcgtgctctacctcggcccgctctccggcgaccccccgagctacctcaccggcgagttccccggcgactacgggtgggacaccgcggggctgtcggncgaccccgagacttcgcaaagaaccgggaactggaggtgattcactgccggttgggcaagcctgggcgccctcggtgctcttccccaactgctcnccccaacgggtcaattttgcaaggcgtttgtnaaaggcggtcccaaattttnaacnaaggnggctcaataactcggaaccaaactgtcaagccaaagatctcncattgggctcaatcttctaaggcncctcanggtacnctcccggggccctcggaaattttaccctcaccggggaattaacctggcttcaaaactaaggttcggncaaggangantaaaagcc

SEQ ID NO: 91450 - DNA, 232 bp, Triticum aestivum
  unsure (1)..(232): unsure at all n locations
  Clone ID: PAT_TA_91450
tatganttgcattttcntcatccatttaaanttgttcaaacatangatattccaanatcacatcccaatccatganagaangggattgctgcatcaccnactgaccnantgaccgaccgactganagatactaacacatgttgtttcttcctcncgtnaccanctctaattaaccccggnacagagcgatactcgagttcgcgatcattacacnagacagacagacgactca

SEQ ID NO: 91451 - DNA, 667 bp, Triticum aestivum
  unsure (1)..(667): unsure at all n locations
  Clone ID: PAT_TA_91451
gttgactggaaccccattacagaacaacattggtgaaatgtataatttgttgaacttcctacagcctgcttctttcccttctctagcatcatttgaggagaagtttaatgaacttgcaacagcagagaaagtggaggagctgaagaaactggtagcaccacatatgcttcgaaggctgaaaaaagatgcaatgaaaaatatccccccgaagacagagcgaatggtgcctgtcgaactgacatcaatccaggctgaatactaccgtgctatgcttacaaagaactaccaagtactgcgtaataccggaaaaggtggtgctcatcagtcattgctcaatatagtaatgcagcttcggaaatttgcaaccatccatatcttatcctgggaactgaacccgaatcaagttcaccagatttttgcatgaaatgagaataaaggctcaacaaattaactttgttgcattctatgctcaaagtgttacacagtgatgggcatcgtgttctaattttccagatgactaaactcttgacatcccgaagatancgacccggaattggcataaacantnaaagagnaatggtcgtgtcgtgggtgacncaagcacatancttcaacagaaanacgtttgatttgtacaacggcatgcntgtattgacnanacgtacan

SEQ ID NO: 91452 - DNA, 592 bp, Triticum aestivum
  unsure (1)..(592): unsure at all n locations
  Clone ID: PAT_TA_91452
cgaccaccagcgcctcctactgtcagcctcagctcactcgaagttagcaatggcggccgcgaccatggcgctctcctccccggcgatggccggcaccccggtgaaggcctccagggcggcgcccttcggtgagggccgcatcaccatgcgcaagacggcgggcaagcccaaggtggcggcgtccagcagcccgtggtacggctccgaccgcgtgctctacctcggcccgctctccggcgaccccccgagctacctcaccggcgagttccccggcgactacggctgggacaccgccgggcctctccgccgacccgagacttctccaaaaaccgggactggagtgattcantgccgctgggcatctggggcnccctcggctggtctcccggactggtcgccccaaagggtcaattcggcaagcctntggtnaaaggcggtccaaatttcaataagggggctcaatactcgggaaccaacctggggaccccaaaagaactccattgggctcaagtgggccanggccctgagggtacctcccgggggcccccggaaatntggccnttacccggggantnancccgggcnccaggac

SEQ ID NO: 91453 - DNA, 625 bp, Triticum aestivum
  unsure (1)..(625): unsure at all n locations
  Clone ID: PAT_TA_91453
ctcgtgccgaattcggcacgagggcggcaccatgctcgtgtaccaggacaagctttccggcgacgagcttctgtcggattcgttcccttacagggagctggagaacggcgtgctctgggaagtcgatggccattgggtcgttcaaggagcagttgatgtggacattggagccaatccctctgctgagggtggtggtgatgatgagggtgttngattgaccaaggccgtgaaggtggttgacattgttgacaccttccgtcttcaaggagcaacctgcttttgacaagaagcatttatctcccacatgaaacgctacatcaagaactctctgccaagcttgaaggggatgacctagatccttcaaagaagaatgttaatccgccacaaatacctcctaacaagctcaaggacttaattcttgttggcaaaacatcatatgatgcgcttgtgttcgcctacacaaggaggaactgctgatcaacttccgtacttgcanatggcttaaaangcaatgcnatccacgtngcnaaaatcaagcgtctcatantttgcnctaacaanggtgcatcaancncaatgttgggtnataacgtcaatgttatgtctaaaacttcnaaatttggat

SEQ ID NO: 91454 - DNA, 600 bp, Triticum aestivum
  unsure (1)..(600): unsure at all n locations
  Clone ID: PAT_TA_91454
ctcgagttttttttttttttttttgcatgagaaaataaaggaccgaagttatcggtgctcaacaagcattcgagtatttgagtccatgagaacacaacacaaaagaggcatacattgataatttttagtacatttgcatgaagaccgagtaggacctgatggtacatgccaaacaagatctatcattttgcctcctattttaagtgattgttgctactccgagcttcatctgttgggaatatatggcaacctccatgaactctatatacccttcatccggctcaatccaccttggagaaaatatgaacataggctccagatccaanagggggtgaaagcttgcacagccatgcatagacttccttcaaattgggagtttcttctccggcttccgtgggtgggttggcgacatgtnggagaatggcgcttggggtaaaaaaaaggatgggcaaggccaaccctggtnacccggncaaatacaaccaattctggtcccttaaganaggcaagnccgcttgggnagcaaacgcaaggacagacataggactgatggactcgctaagnanatcncctgtagnacgatgcncacatcgaaactgg

SEQ ID NO: 91455 - DNA, 284 bp, Triticum aestivum
  unsure (1)..(284): unsure at all n locations
  Clone ID: PAT_TA_91455
tgagcttgaggtcagtggcaggcaggcaagcaagaaaggaagaagaagaaaaaaggacatggcatctgctactctcctcaagtcctccttcctccccaagaaggccgaatggggcgtcgcgcgccaggtcgccgccccgagggtgtcatggtcgtcngcgccggcgcctacnacattaacnncntcaagaccgcgaaaacnatcgcttcgccggggcgcggaatcctggccatggacnantcnaacgccacctgcgggnaagcgcctcnactcgattgggcctg

SEQ ID NO: 91456 - DNA, 628 bp, Triticum aestivum
  unsure (1)..(628): unsure at all n locations
  Clone ID: PAT_TA_91456
ttttttttttcaaataaggagtatatctcaacatgaaacgcaaggatcgatcatcatacaaaaatacatcttacaccattcttatccatcccaggctaaacaatgcctgatgctgtcaataaatagcacagacaaaaaaaattgcaatcaccagctcactcgattcagttgccttcttagcaaatacagttgccagcatgatcatttgagctgcaagacatgggaactttttttggtacaaaaccatggaagcagaaaagcctccacaaaaaaacctccgccaacttcataagttaatggggcaatttcctgcataagtaaaacatgtgtacatacatacaacaattgggtgaaacgacctcaagcttgaagtgccatttngatgttnaaggtgggttgcaacccagaatggttttactcngctcaatgccacttcccggtgctgaacacngantnaaacaaagctnaacctcctccgtggcaactctccaaaagtctccattcgaccaaaccncanctcactcngtggtgaacctcgacaagcagcaaatcatggctcancanaanaggttggacactttacnncattagttgccagcgcaaggatcgctacccactagtcgggaca

SEQ ID NO: 91457 - DNA, 662 bp, Triticum aestivum
  unsure (1)..(662): unsure at all n locations
  Clone ID: PAT_TA_91457
cgcgcacgtcccacacatcgaccgtgccctcccacccacacatcgccaccaccacccaccgtcccgtctgaccttgccgcctccacccatgccgcatctgacctcgtctccggccgccgctcccgctctccccccccctcacacacacacaccagggcttcgatctggacctctgtctgcacgaggggacgtctgcgcctcgtcctcgtcccacctcaggcgccagatcgagccggactcgtgtcgtcatcaagagccgacctcgacggagatgagaggaacccttcttcctccgtcttccttcgacctcgacctcggcatgttgacctcgctccataacatctcggtgaaccactactgggatgtggcgtcgactaagcactgcacatggcttgctcgccggcacgcgcgtgcgtgcttcgatgcgcggcgcttcgtcgagctgggacggaccgcggnatcgctgggagcaanactggaggagggacagatctgctgctgcgntgtgtctcggagnaattgtgccctcgccgactaacaaatcggngtcgcatnactccgcagacctctaatctcgggagnaataaggtcatggtaactcaatacntcatccngaacagttctaactatattgacagcngtgatgacantaatntcaatna

SEQ ID NO: 91458 - DNA, 525 bp, Triticum aestivum
  unsure (1)..(525): unsure at all n locations
  Clone ID: PAT_TA_91458
ctcgtgccgaattcggcacgaggttacaatatttttttgtttcggctgtgacgctacgtacaatcttccaccatgggcgtcgacgacggccacggcccacgcgccagcaccaatggcccgccgccgctcccatgcgtcggcgttgtagtggtccccgggggcttctcgagagagccagctcacgcgatgccatgctccgtggngcccagtaccggacagatgggggatccgtcgagctatgccgtcgccggcaagctcctggtcgccgcggccggggcgctcgcgggcgtcctcctggcnctcgtcgcgctgcacgcgtacagcggnggccgtcnccggcgctcgcgcgaccgcctccgtctcctccacngcctgcccgtcatctccgcggngncgtccacgncngcgtngcngtggcncctttcccgaaggggctggaccccnagngctccgcgngctcnccgtggtcncgccggcactgacccggnganntctgtgtgctccagggtctaancccggaagagc

SEQ ID NO: 91459 - DNA, 603 bp, Triticum aestivum
  unsure (1)..(603): unsure at all n locations
  Clone ID: PAT_TA_91459
ggagggcattcctccggaccagcagcgtctcatcttcgctggcaagcagcttgaggatggccgtaccctcgctgactacaacatccagaaggagtccacccttcacctggtgctccgcctccgtggtggtatgcagatttttgtgaagaccctcaccggcaagaccatcacccttgaggttgagagctctgacaccatcgacaacgtcaaggccaagatccaggacaaggagggcattcccccggaccagcagcgcctgatctttgctggcaagcagctggaggatggccgtaccctcgccgactacaacatccagaaggagtccaccctccaccttgtcctgcgcctgcgtggtggcatgcaaatcttcgtgaagacctcaccgggaagacatcactctggaggttgagagctccgacacatcgacaagtcaaggcaagttcaagacaaggaggnatcccccggacaanacgcctgatcttgctggcaaacaactgaggatggcctaccccnccgactaaattcaaaaggntcaacctcaacttttcttgcctgctggggaatcaatttcnnaaaacccccggaaaacancacctgngttga

SEQ ID NO: 91460 - DNA, 643 bp, Triticum aestivum
  unsure (1)..(643): unsure at all n locations
  Clone ID: PAT_TA_91460
ggaacggaaccaacgaatccccagccaatctcgtctccgatcgaccccaggctcgtcgaatcctcctcccccgccgcctcaagatgcagatctttgtgaagaccctcaccggcaagaccatcaccctcgaggttgagagctccgacaccatcgacaacgtcaaggccaagatccaggacaaggagggcattcccccggaccagcagcgccttatctttgctggcaagcagctggaggatggccgcacccttgctgactacaacatccaagaaggagtccaccctccaccttgtcctgcggctgcgtggtgggcatgcagtcttccgtcaaagacctcactgggcaagacatcaccttgaggttgagagctccgacacatttacaacgtcaaggcaagttcaaggacaaggagggatcctccnggacaagcacgctcatcnttgctggnaagcaactggaggatggtcccacctcnctgactanacatccanaagggtcaacctcaacttgtcctgcgtctgcttggggaatgaaatnttcgtgaagacctcacggnaagacctcanctttaggtggatctctacacaatncaattnaaggcaanttcagacaagnggnattcccggccanaagcctntnttng

SEQ ID NO: 91461 - DNA, 680 bp, Triticum aestivum
  unsure (1)..(680): unsure at all n locations
  Clone ID: PAT_TA_91461
gaaataatcgattctttttatttgtagaagataaagaaaatttgtttgggtccagccgtccagaatccattcccaccgcctacgaatccattcccactaattgacaagctcttgtcacttcctaatacagtagtactgaaaaaccagcagtcatcctctccaccgcccttcacatctcccccattccccatttctccatcaccagctccctccctccatagccggcggtcaagcaagattcacagccactgatcccccctcctcatgtcgaatctgggccgcagaagtggcaagagaaggcctccgagctcggcatgctccgcgccaagcgcgctctaagctccatcgggaggcggacgcgggaggcgcaagactccacgcctctcctctgccctgctccttcttcgaatccaatcgcctaagtgctcnaaggaggcatccagcttggnatctctcggngaaacgggccctcctctctgttgctcgccgcngcatgaaccctcaactcccngntgattgncaactcaagtaatcncctctccgacctacgcctgatgaacttgtnacanggagaaaacatcccaaatggganaaatggtgngagtantaacaatctccttcagaatcgttgaaananaagtngcctcangggnantctccgtggaacagggaaaganaat

SEQ ID NO: 91462 - DNA, 614 bp, Triticum aestivum
  unsure (1)..(614): unsure at all n locations
  Clone ID: PAT_TA_91462
ccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttangtagccaagaggaaaagaaagcaaaagcgattccccgtagtagcggcgagcgaaattgggagcagcctaaacccgttgaaaacggggttnttggaagaacaatacaagcgtttttctnctaagcnaacggtttnatnccgcaccctaaattgntaagtncaattacccaagnatnactacttaancncctgaccccanttcatggggacattgaancccntttnatnaanaaggcaanttncaagggnaaanccctggttacccatacnaatttacccttaggaaaggngaaanancccatngttagggaaatnaactnaaacttctgannccaacatgggaaggnaantattcnaaccctcctntnaaaanaccgggaccanngcatggntngtaaggacggaccacggcctncnaaggattaaagggatncccgttggccaaccgggtttccacaanaa

SEQ ID NO: 91463 - DNA, 487 bp, Triticum aestivum
  unsure (1)..(487): unsure at all n locations
  Clone ID: PAT_TA_91463
gggaaactttgatccgcctcaacaactccgtgagttgcatctaagcatcccatccactcggctgccggcgtgggttcacgtctcccgtgttccaatgctctcacacttagttgtgagcctcaagtctaaggaggatcaggatttggatattcttgggtgctttgccaagagctcaagtagtctgcagctgggtgctgccgtcgaaagtggcctcaagcatcactgggtccttccggtgcattccccgaggttgangtactttcccacgtccngtaccagcaagtttccnaagaggcgctatgccaanacnggatcccttcacttttatncaattttactttgatcctantttgcggatcaactttgggaaactgcttcaattnaaaaattggaattggaataacaccaatgcnccccctttgatcaataatgangtgataaacttcattgggcaacatcnaacaaccaacttcngttaanaagtatt

SEQ ID NO: 91464 - DNA, 632 bp, Triticum aestivum
  unsure (1)..(632): unsure at all n locations
  Clone ID: PAT_TA_91464
ccaacgaccaccagcgcctcctactgtcagcctcagctcactcgaagttagcaatggcggccgcgaccatggcgctctcctccccggcgatggccggcaccccggtgaaggcctccagggcggcgcccttcggtgagggccgcatcaccatgcgcaaagacggcgggcaagcccaaggtggcggcgtccagcagcccgtggtacggtcccgaccgcgtgctctactccggcccgctctccggcgaccccccgaactactcaacggcgagttccccgggcgactacgntggganacgcnggcttttcggccaaccccgaaacttntgcnaaaaaaccganctgaggtgatttcaaatgcgcttggcangctgggcnccttcgttgttttcccngaantnttcnccccaacgntnnaattcgngaagccttttgtttaaaggcngtccaanttttaatttaaggggggntcaaatacttnggnaaccaactggttgaacncaaaanactcccanctgggcctcaagtgtgtatggccccttgaggtaacnctcnccgggccnctcgggaaatttgaccgtctacccgggagttnaaccctggctcccagacccaagntttccgncnaagnaaan

SEQ ID NO: 91465 - DNA, 521 bp, Triticum aestivum
  unsure (1)..(521): unsure at all n locations
  Clone ID: PAT_TA_91465
ctcgtgccgaattcggcacgagtatacatatggtgacatgcatggccaatttccgtccaagctaaggcggagtaaaaactgtacaaaccagctacaatagctagccggcaaccagaaaaccgagtatgactgaaaacaaaaactccctgaaaataaatacttgggaaaaccgaaaagggtaagtagctagggctaaggaagaggcacgcaggggagatcaatatttaatactactataatctgaagctaatttggtgcgcaagaactcctatttatcaactggaagctgcaaataacatcctttcaagatgcacatttcctccaaaactncaccatgggttgttccaacattngtgctttaacgcttcctnataanctngccttgatttgcaactgcangattttgcctttctttccnggtttaaacatccaagcaaatggnaatgatattgccaagnaagaaccccccacaagaaacggaacttttcaatttaaggngtctccccaaanaatnagagtaa

SEQ ID NO: 91466 - DNA, 628 bp, Triticum aestivum
  unsure (1)..(628): unsure at all n locations
  Clone ID: PAT_TA_91466
ctcctatgcangctatanacctacntannacagccatggcccccaccgtgatggcctcntcggccacctccgtcgcncctttccangggctcaagtccaccgccggactccccgtcagccgccgctccaacggcgctagcctcggcagcgtcagcaacggtggaaggatcaggtgcatgcangtgtggcccatcnagggcattaagaagttngagaccctgtcctacctgccaccgctcagcacggaggccctcctcaagcangtcgactacctgatccgctccaagtgggtgccttgcctcgagttcagcaaggttgggtttatcttccnttagcacaacgcatccctgggtactaacgatngncncgtactggacantgtngtaactgcctaagttcngggtgcaccgacccacgcacgtgatcaacnagtggacgaggtcaanaaggagtccctgacgcntattccgntcatccgattcnacaacatgcncaagtgnantgggtcannttatcgccttaanccacgggcngctagantcggnangccaaaaagtcatcacaacggcnaaataagngattncgnttntaanctgaaatcttgggtttccttcattanntctgtgtc

SEQ ID NO: 91467 - DNA, 590 bp, Triticum aestivum
  unsure (1)..(590): unsure at all n locations
  Clone ID: PAT_TA_91467
aggagatcgagatggcaactgcatatgctcctccgatggcgagccaggtgatgaagagcggcttggtgagctccaagccgcgggggctgtccggcgcctcactcaccaggaggccccgcttcgtcgtcaaggccgtcaagtctgacaaggggacgtaccangtgggtccagcccatcaacggcgacccgttcatcggcagctgggagacgcccgtcacctccaagcccctcgtcgcgttgggtactctccaacttccccgcgttaccgaacggcgtcaaccgctccttccgcgaatcaaagtccgctcncccanggtntntctcgtcggccttcggctcaacggccgctccgcaaaagcaatttacggcaaggggaacctcngggcaatcgctctntcaacctnaagtttgctcacaagtncgggtcccncttaacagggggncctcaacgggccgngttaactaacggcgcaaaagagcgacaantcanancgaagtggccantnacgaggttntctcggtgtccggcgcatctggccaattctctcactctcactncaatttttagtatatatgttgattcatgggaa

SEQ ID NO: 91468 - DNA, 625 bp, Triticum aestivum
  unsure (1)..(625): unsure at all n locations
  Clone ID: PAT_TA_91468
ctcgtgccgaattcggcacgagcctatctctcgcattacattatttgtcatttgcctcttgttttcctctcccccacttcacccttgccgttttattctccctctctttcccaatctcctcctctctttcccgtttgccttttcccgttgcctttttgtttgctcgtgtgttagtttgcttgcttgtcattatgtctgaaattgggggaaattattgctgggcatgggtgataataatatcatgggaaaatttgaagctcctgctgaagaacccctacctatcatacaaaaagatttcgaaccgttgggggnaataataattggggaaatgagtaatccaaattccttactgtgccggngcttgccctcctaggntaagtctatcctcaataaaacaatatcctggcggacccattgcangcttacgttgaactntaaaggaatttatgcatatcaccttctacacaaaaggattccaagaatttcnataacnaaancctccgtaanatgtgcnacaaatttggccaagaatanatataataaagaggaaagaatcttgcgataagggggagccggctcctcaaaaataacccctgtaaaaaataaggttanccctgcaagtggt

SEQ ID NO: 91469 - DNA, 318 bp, Triticum aestivum
  Clone ID: PAT_TA_91469
ttagatcagtgtggtgcctagaatctactgcgaatattctaatggctaatggtactactgtgcctgtacgtacgcaccttcacgccggcgcttccggccagcgccgacgacctctatccgcaggaccctgtcggagaaggcctcgttgtcgaaaggcgaactccgaagcccgcgtccacctccgcctcccccgccgtctcccggccccggcgcccgacccgaatgacgcgtccgcctggcgggcatgcgcgtgcgtcgcccgcctcccgcacccctgccctctggggaacgcccggtggcccgtaaccctaactaact

SEQ ID NO: 91470 - DNA, 460 bp, Triticum aestivum
  unsure (1)..(460): unsure at all n locations
  Clone ID: PAT_TA_91470
ctccacacaggcccgcacaatcaccgtaaccaagctacgcggccgcatgctgtaggggggtgcggccactaacgctgcaaggtgtgaagccaaggggcgctcctcgcatggccgcgcgtccaccttccttttctcacctcccacagcgccgtgacgaccatgaccatgggcgggctgggagttgggtggagcagcagcatcagctgtgggaatattgggttgtagcaaatcaaatcaccgggtgggtagcaaaaatctactacggttgcaagcaaaacggcgtcatcgccatccgcgggtcgcaagcttgagataagaactttgacttttttcnaatgcggttgtaacttttaataaatgtcggttgcacttttctttttccgtccaatggttcctttccacgattcnancttttttttaaaagcccgatgacttttttccgcccctnaaaaaaaaaaaa

SEQ ID NO: 91471 - DNA, 618 bp, Triticum aestivum
  unsure (1)..(618): unsure at all n locations
  Clone ID: PAT_TA_91471
ggtggttttgaggctggtatctccaaggacggccagacacgtgagcatgccctccttgctttcactcttggagtgaagcagatgatctgctgctgcaacaagatggacgccaccactcccaagtactcgaaggcgcgttatgaagaaattgtcaaggaggtctcttcctacctgaagaaggtccggctacaaccctgacaaggtccctttcgtccccatctctgggttttgagggtgacaacattattngagaagtccaccaactttgactggtacaaanggccaacctcccttnaagcgcttgaccaatttaaacgagncccaagaggcgttnaancaacccctccgctttncctcccagacgttnanaaatttgggggatttggactgtccaattgccttntttanacngggtcaacaacccgggaggntttgtaacttttgncccangggtccgaaaacgaggcaatcctttaaatcacaatnatcncnctgaaggnctcccggtnnaagtcggttaactcaaaaantncctnaagattaacctgggttgttcacaancaagatacctgcaagagaacaattactccagcacannacncctgcaattgaangtnn

SEQ ID NO: 91472 - DNA, 616 bp, Triticum aestivum
  unsure (1)..(616): unsure at all n locations
  Clone ID: PAT_TA_91472
gcgccggccacaggccacagctgctccaaccgccaccatggccgccaccgccaccgccacgtccctaggcctcgctctccaccgccgagaccacgaccctagctcccaccgccgccccgtcccctcctcgtgcctgacctctacctccgcctaccgcatccgcagggccaagtgctgccgcaggggtgtgcctccaccgtccgccgccgccgccgccggcggtggtctggaaggtgaggaaatgatattagcaccatattgaagattcacttnaacaacgaaacgatgccttcaatcaaagcacaaaagtacttcctccatggctgacatgtttctcttagcagctccatggctgacatgtttctcttaacacctccaacaacaacctaacagcatctcctgttttggctacctcaaaacaaaccatgacanacccataatacacatccccaaatccagggggggcccgtaccatttccctaaatgatcntattancgcgncacggcgtcgtttaaactctnacnggaaaactgcgtnncaantaaccctncaaaatcccnttccactgngtattacaaaggccgaacattncttcanattccactaaggaangan

SEQ ID NO: 91473 - DNA, 592 bp, Triticum aestivum
  unsure (1)..(592): unsure at all n locations
  Clone ID: PAT_TA_91473
cgcccgcgtgctcggatcagagcccacccgaacccgcgcgtgctccccaaaccctaaatccccaacggtctcctgcttccaaacccccatcaaacccatcccgccctcgatttcccgcccaatccccgctccccgccaccgcgcgatcccgccgcgccgtctcgcgccgaccgaattcgaatcccgccgggggcgcgagctcgaggcgggcgggagggcggtcgggcgcgcaattccngcgcgcggctgcgtctagctccccccggctcgccctgnatggtggcgcggacggcgtngctgaaggagaaatttaacctaactccggtntgggaccgccacgcccgccaaggtgctcgacggtatgaccggtcnggaacggcnggaagacaagaaggagcagtatgagtgaccgcgcgggcancaancggaactgcancggggacnattccggaaggcntttgcgcgggcggcngtccgcaagcctcaagcgccggnttgantgacgcacgctcggcgtngaccctcctggagtcttcncggtactaagactcngganggcgnggcttcaagcaactcgcggcggngtccaaca

SEQ ID NO: 91474 - DNA, 585 bp, Triticum aestivum
  unsure (1)..(585): unsure at all n locations
  Clone ID: PAT_TA_91474
gctaagcgaagcagcaagcagataaaaggccattataagtggtggcgcacgcgcgcgcgagcagggaaggtagtacgcagcggcgggaaaggggagatggcgatggccagcgcgaggagcagcctggagatcgtgccccacagcggcgacctcgaggtgccgccggcggacgtgccgcggcaggactcgctctaccgcgacgccaccaaggcccgcgcacggcggccaccatggccaaggacaactgggtgaggacgctgcggctgggcttccaatgcgtggggatnctctacgccgacctcggcacatcgccgctctacgtcttctccaacaccttcaaatacggcgtccggcacaaggacaactnctgggcgtcctctcctcatcatctacacttcctgctcttcgcatggcaagttatctcatcgcgctctagccaacgacacggcatggtggaacttcgcctctatcctatnccaagtacccaggtggcctatncnaacacaagcgnggacactctctcaaccacggatttcgganaaganngccaatggtnaaaactgtggnacaanaccgcaaccacnn

SEQ ID NO: 91475 - DNA, 559 bp, Triticum aestivum
  unsure (1)..(559): unsure at all n locations
  Clone ID: PAT_TA_91475
atgagccccttcatgtgtggcttcattttgtcaacgctgatgattgggttgtggtgtgggcggtcgaggtgaaggctgtaccagaggagcaccagggcaacctccggcatgcagaacagaaccacatcctcgcccagccactccgcggccaatgtgtgtgccgtcaccagtagaagtagaagcaaggtcttgcggagcaactccgacgccggtgcactacccggaaaaggatcaggaggcagcttcatcatcatgcgcgtcaatgccgccacaatggagctcangaacaagagaaactgtgtgaaggcgaacccatatctgcaccatcgtccatttgattcatcaccaaacaacgccccaaacgtcaccaccactatgatctccaactccataagtgtccttgatggtatcncctcgacaatanaaaattgtgggnaantttcgaacaatgncccaatacaacgattgacttaaatanatgccccaataaaataatggcatnatggaaaaatgaaattanacaaacccattgattcaacaattcaggaaaaaaaaaaaa

SEQ ID NO: 91476 - DNA, 295 bp, Triticum aestivum
  unsure (1)..(295): unsure at all n locations
  Clone ID: PAT_TA_91476
ctcgtgccgaattcggcacgagcagcacgccacatcctctcccggcacgacgccggccgccccccccccccacccaccaccaccaaggnctcnccccgtctcctcctatcccctccanggcctcgccccgtctcctcctatcccctccagggcctcgccccgtcggcccttatcccnagcacggnctcgccccgcntcctcctctcaccaccgcggccttgcctcgncgccaaccccgcggatcttccctggatngattctgccgccttcatcctactgccccagatgatatcga

SEQ ID NO: 91477 - DNA, 613 bp, Triticum aestivum
  unsure (1)..(613): unsure at all n locations
  Clone ID: PAT_TA_91477
tttccgtatctcaggatcccaacatgaagagagttctcatggacatcctccttcaaattgacgagcgggagtacaggagtctcactggatcaacgttcgatgcaaagctgcttataaatataatccggagagtaattgggagcaagaggtacttcattgttattgatgatatatgggatgtgaagtcatggaaatttataaaggatgctttagatactcgatgtggaagtagagtagtcataaccacaaggcttttgggaagttgctgtcaatgctgggtgatgtttacaagctaaaagcactttctcattcgcactctgggagaattgtttaatacaagattatttggtgggcaaagacaatgtccctccgtgtcgtgccggaggtacctgaaaaacttaagagcaatagtccttgggttcctcgcaaacaaactaaccattgggatgatagctaatggtacaccaccacattctgtaaagctcnagggggggccngtaccaattcgcctatatgatctattaccgcctcacggcgtcgtttaaactccgacgggaaacctgggtaccactaacgcctgagaaacccntccaacgggtatacaaagcgcaca

SEQ ID NO: 91478 - DNA, 677 bp, Triticum aestivum
  unsure (1)..(677): unsure at all n locations
  Clone ID: PAT_TA_91478
ctcgtgccgaattcggcacgaggcgccgtccgtccgtccgagaaccaagatgagctgcccctcctcctcctcctgctgcggcgtctctcctccggtcctcgccaatccccggggtgaattcgctgctagttgctccacaagaacaactcaagaaggcacatttcttcggttcaaagccatcctcccaaatcatctacagccaacatcatcgcatttgtcccggagatnaagtaatccccttgggcggaaagcatctttgggacatccngcaggtttgccaaatcctgtttttccttcaaacgggctcccaaacctctccaaattggtgganccataatggagaacatcaaaacctctggtccaaccggaaggcgccgaaagaagcaaagacttctgatgttggncttgtcaacgggantaaccggngtgnccggcnaaaaattntcnatgtcctaacggaaaaagggggtcctgtccnattttggttaaaaagccganaaagnnaggacatgttngggcaaatgtggacttgatntaggtgatgtacaaagggaaancccncattcnanttnttaagggattagaantcccaatnatttcatcatatagggcaaggagtatcncggaaggaanntttcgaggannnttttttaccaataaggcctccnggggggggg

SEQ ID NO: 91479 - DNA, 447 bp, Triticum aestivum
  unsure (1)..(447): unsure at all n locations
  Clone ID: PAT_TA_91479
ctcgtgccgaattcggcacgagaactgctagatctagagtagccccgttaaagcccaaacaaaaaccccgctgcgagatctgcgcatctcgccacaccacaaccacgacggccatggcggcgccgcgcgtcctcctcctccttgccgccgcggccctcctcgccgtctcctccgtccggggaacgcttcnggcgaaagggccccgccgggcgcaaagtgctgggtgctcgtcgaagatntggccgttcgctcatcccactccgcttcctttcgntcgctccaaagcccgccggctaaatttngggnttccgcctcncccgaacaacccaactcttcgctcnaacgctaaggtcagtactctaanaangctnctgccttngcccaatcaacccccctttnggggtttggttggcnaaagctgtcccgggatttaacnaacccnggaac

SEQ ID NO: 91480 - DNA, 649 bp, Triticum aestivum
  unsure (1)..(649): unsure at all n locations
  Clone ID: PAT_TA_91480
cgcccccgagccctcgacctgctcccgacctgcgccgccgccccgacccactgcgccgccacccctacctgcgccgtctcccagacccactgcgccgccgcccagtgttcctcttcatcgtcgtcgtccctgggccaaggctgaggagccgccgcaacgtcgccatcgaccacctcatcctctacctccggccaccgcgacgccatccgacggtttgtccgtcttcactgcacccccgtcctcctccgagtcatccccaaaaccgcgatacctcatctaaaggcctagattatgaagaaagtttttgaaattccaagaagactaagggagaagcaactatnaggtccagagaattacagaagtgttgtccnttttaagtaagttatcctgcctaacngcactattttttnggcaatgggaaattccatatgtgatgctgctgtacnataattccnaacttttgaagctgcgcatttttccgggattgttccaacggtgttcaaaaaaaaggtcanaantccgaatggggttgaactgcnaatgtcgtacaatcacaagacatgnttcagccaaacaattatcgagggtgnggctcaaatgcggnacntcaagggtaaanttctagaagcgnacntctgntaaaaaaaaa

SEQ ID NO: 91481 - DNA, 515 bp, Triticum aestivum
  unsure (1)..(515): unsure at all n locations
  Clone ID: PAT_TA_91481
cgacaacaagtctcgcccaaagccgccggcagcagctgagccgcgattcctctccgccccccgcaccatacaccggccggcccgggacctgattcggcagcagcagtacaactccatccgcacgcgcgcgcatggccgaccggggcgggaggtgatagtngggggtccccggagatnaagganttgtggggaaangnccccggactttggcnngggncttggttgcnggtncnggcaaagccgcgctnngccgncggctncaatcgccgttaatggctccgcctaanggttnncccgggtanaacgcctttntgcnatttnattcnttcnatggattcaacntttttgacttgganttncatttcttganggaaanccttaaattcaaanaatttcaanatgtntttantnacttatttccttnggaacnggtttcngnatccccctttgcnnatctgccaatcngttaaaatctttnngaggaattcttctcanaaattanaatnctttgaaat

SEQ ID NO: 91482 - DNA, 269 bp, Triticum aestivum
  unsure (1)..(269): unsure at all n locations
  Clone ID: PAT_TA_91482
gcagccgcagccgcagcgcgaccccgcgaggaaaccctaccgccgccgcagcaggagcagccatgggtatcgacctcgtcgccggcgggaggaacaagaggaccaagcgcgtcgcgcccaagtccgacgatgtctacctcaagctcctccgtcaactctaccgtttcctgggtgaggaaggaccaaagagcaatttcaacgccgttcatcctcnaagagntctttcaatgacnaagactaaccgcccgccgtctcnatgcgccgcttct

SEQ ID NO: 91483 - DNA, 621 bp, Triticum aestivum
  unsure (1)..(621): unsure at all n locations
  Clone ID: PAT_TA_91483
ctcgtgccgaattcggcacgagggggtcccagatgataaggtttctagcaagaaagatattggtcatcatacaagccgtggagagtcagttatcgacaaaccaaaatattcatctgaggcaagaaaagatgcatttcctccggcaccttcttctgaacatcgaaagaaaagtaccactaaacatgaaaaaccaagtgggaaactgcactaagtgttcctgatgaactttgctcctttttacgnttttgctttggatnggcaagtgttatgggaatggcaaaatnggatttaccatttacanacttnatggaaaccaaactatcnaagnaaagngttcaanaanacactagatnnccaagngaactggcatttttnattagaactaggatgaatttggaaancaaaaaggaatcncaaacattttttnacaaggnaanattttnnaaaagggaaaattggaaggaaggggacattttganatcntgctgaactgaaaanatggtttgnccaanaaanatttgtganatctgcccattaanaaaaaangnttgttgccnggatntanacctaccattanannttcaaaaaanggatggaaccncntggaantttttgntggtt

SEQ ID NO: 91484 - DNA, 495 bp, Triticum aestivum
  unsure (1)..(495): unsure at all n locations
  Clone ID: PAT_TA_91484
ctcgtgccgaattcggcacgagggcggcgaagatggtgtcgctgaagctgcagaagcgcctggcctcgagcgtcctcaagtgcggcaagggcaaggtctggctcgaccccaatgaggtcaacgagatctccatggccaactcccggcaagaacatccgaaagctgggtaaaggatggttcatcatcaaggaacctcaagaagattcactccagtctccntgcaaaggagggcacatnnaggccaagcaagaaggcctcactccctggatatngtaagccttaggggtaccaaggaagctaagtcccccaccaagttnctggtngatgcggagggatgcccttccttaagcncttcttgcgcaanaccgtttaggccaagaaatttnacaanacatgttccatgacatttncctgaaggccaagggacattttcaaaaacaagagncctcaatggagatnccacaancccaaggttaanaaggaaganagaaaccc

SEQ ID NO: 91485 - DNA, 438 bp, Triticum aestivum
  unsure (1)..(438): unsure at all n locations
  Clone ID: PAT_TA_91485
ctccaggccgccgccgctgttgcttccggttcgccaccactcgctcggtcgctccgctcgccgcacccgcactgcagtctgcatcccccttcccttccccatggccgcctcgccttccctccacgccccccgcctcctccacctgctcccgaaacccgccccgactctcggcaggcccggcggcggcgcctcgcgacggcgccggcgtccggctgtgccgccgttcgaaggaacgggagtcggcggggacggactgggtgcccccgttccccccggagcagcggccgtnaacgantacgaagcgctgggcgcgtcgctgccttctcctgggcggcggggaactgcgcctcnatgtcccgctcgcttcagggggggccgctttgcgtcttcgtcgtcgnttnnccgctttngcgcgcngggggnccgggggnaancctg

SEQ ID NO: 91486 - DNA, 370 bp, Triticum aestivum
  unsure (1)..(370): unsure at all n locations
  Clone ID: PAT_TA_91486
ctcgtgccgaattcggcacgaggcccaaacaaaaaccccgctgcgagatctgcgcatctcgctacaccaccaccacgacggccatggcggcgccgcgcgtcctcctcctcctcgccgccgcggcccttctcgccgtcgcctccctcggggacgcttcgggcgaagggcccccgcgggcgcaagctgctgggtgctcgtcgacgatctggccgtccgctcatcccatccggcttcttcggtcgctccaagccgcnggctaattntggagttccgcttcgccgaagaaccnagttttgntccaacgttanggtnanaactctaacaaggntcnngctcttngcccaatgaacccgctttcgggnttnggtgg

SEQ ID NO: 91487 - DNA, 641 bp, Triticum aestivum
  unsure (1)..(641): unsure at all n locations
  Clone ID: PAT_TA_91487
tgtcgttctcctactagcctcaacctactgcttccatctgtcatcacaaattccataaaactagttgatgtgagaaacgactctccggctttctcattctctaactctgccatacggctgccgtccggcctcggccgcgagagcgaggagggcgtggaactcgccgggccggtggaggcagggttcgaagcggccagcacacggccggttgcccggttggtcgaggtccggttgccgtcggacgagggcatctcttccatctcaatacagtactaagacgatgaggaggagatgctatgcagttagaacagcagcgtcaagtttancacccccggcggcctcgcggtccaaaatggatggtctacggcgatctgtntnagacaaccggccaacaactacaaaggtctggcctccgactaanacaacacatggngacaacacatacaagggcaacggctnccaacggcggtatccttggncacaacgaaaaccgtggnnaggacctacaanttggnaaaagcccaanaggtgctnaacgggccancgaaaacgggcanactaaacnagcaagcanctagnggcntatacccnctcangantaggttaaagncacttttgatcatccggaattaaaanncctt

SEQ ID NO: 91488 - DNA, 427 bp, Triticum aestivum
  unsure (1)..(427): unsure at all n locations
  Clone ID: PAT_TA_91488
ctcgtgccgaattcggcacgaggcaccccagcagcgcgcgcgcggcaatggnggacccggtcgagctcatgcggcgcatctgcctctgtttcccgccgcggctgtcgcctacgcagcgctccagagtgccgccgccacagccgcaatgcctcggggtctgggctcgcctccgcttcccaggctctgcgctgtcgctccggtgccacgcgctcgacgccagcaagccgtcggnggtcaggggggagccgngcgaggagtacgacgacgatgaggagcgtacttttccntgacatcgtcgatgctgtcagaggtggactacctctggggagagcaccaagggggatttnaacgtgcncangangacctccgacgcgctcngtgggaatggnaagtcaacattgcatggcctatataggagatagcttgg

SEQ ID NO: 91489 - DNA, 638 bp, Triticum aestivum
  unsure (1)..(638): unsure at all n locations
  Clone ID: PAT_TA_91489
ctgagacagacaaaccaccgggcggccgggccacgcgcggtgtaagccagaggggaccacagtagaagcgatggcatctcgccgaggccacggaggcggatgcagggtgcggcagaaccaacgcggatgggtgacgcgccaccggcaggcgaacggcagcttgaacccgggcacggcccgatgcagcttcgatgtcngcccgacgggggcaactttgttagcgaaggtcatggagattgcgtttnaacngcagaccaacttcagctttggtgatccnatnccggagccngacggggtttngccaaggaggccaagcgctgcgccaagcngggatatttttatganccattatgtttattttntccacacgttatttcctgatanttttnngaaaacacttnatcttttanaagcatcacatattactactancanatnacataaggctttgtcctttccgaacnaacattttttgctctttcntttgangtcaaaccttaataatgntgatgtacanttttnnatcattnacaagtcancgcatctctcnacatanacannccaaaaanantnctcaancgaacggtnaacaagcaaagtntctaccangatncnccttggaacggaaggccctcccc

SEQ ID NO: 91490 - DNA, 582 bp, Triticum aestivum
  unsure (1)..(582): unsure at all n locations
  Clone ID: PAT_TA_91490
ctcgtgccgaattcggcacgaggcgacacacaccatacccacgccactcacgcacagtcctgcctaagctaagctaaacagcagcgagcaatggcgtccacctcctgcttcctccaccagtccaccgcgcgcctggccgcctcggcgcgccctgcgcccgccgtcgggcgcacccagttttccgtctgcaaggcgcagaagaatgacgaggctgcatctgacgcctgccgttcgtcaccagccgggcgcgccgcgctgtccctcctcgcccggtgccgccgcatcgccgttaaagtctcccccgccgccgccgcctacgggagaaagcaaccaacgtttttccggcaaggcgaaagaaanaacacgcttncnttggcgtanacgggaangggtttnaaatgatgattcccggcaaagtgggacccaacaagacgttanttccctgggnaangtctccctacgaaggaaattntnaagccaacaacaactctcccttntatcaacccacttcaagaaaacatcacgatanggtccctgaggatncncccaagtcgggttctccnggcaaaatcctanggggaa

SEQ ID NO: 91491 - DNA, 653 bp, Triticum aestivum
  unsure (1)..(653): unsure at all n locations
  Clone ID: PAT_TA_91491
gttttggacttgcagtgcaaaattcctctagccgattaggtttacgcaaacttttagaccatatacagctaatgtccgacagtaaataaatgaatattatactatccaaaagttgatccatgtccagtacgtggtgttgactgttcataacctagaacttgtggcttatgcaaccccgtttccagtccatgcccaagaaacaggtgtcaattgtaccttgggtggataaattacaatattgacaagagattacgtttatagaaattcaaantccatgcaaatcctaaatttgccattatttcctcctcctggntacctccaagtgaagcacttgggataattatcccttttaactttaaatatacccctcccgtccccaaaaataatggcctcaaanttaagtacaactttggtacaagactaantcaaaattntagacacttattttgggacgggaggagtatagctggnggtaactccncaaccaaatgctaatccaactaactantccccaacatgaagcatgcactcaacaaatcaaacgcatggaaaggcactaatatnaacctgctaggaaaaggccccaaatnangaanttcatcaanncattaatataatacttcnttcatancaccaaaccattgcttctttan

SEQ ID NO: 91492 - DNA, 639 bp, Triticum aestivum
  unsure (1)..(639): unsure at all n locations
  Clone ID: PAT_TA_91492
cacgccgcgcaactacacgctgctggacttccgcatgtacatccgggacatcttctcgctgccgcccgacggccttggcatcccgtacaaggaggccaacaagaacgcgagcggcggcgtcgacggtggcacggggaaacggaagccgcggctcatgctcatcaaccgcggccggaacaggaagttcgtcaacatcccggagatctccgcggcggtgcaggccgccgggttcgaggtggtggtcgtggagccgcgccgtgacctgaggctcgaggagttctccaaggcggtggactcgtgcgacgtgctgatgggcgcgcacggggccgggctcanaaacttcttcttcctcccgcaacgacgcggcgatgctgcaagtggtgccgtggggccacatggagcactccggcatgatattctacgggtgcaagcaaggagatgagctgcgggactcaataaacatcacgccaagagacacctctacagaantacgaangacaaccgcgtgatgacccgagtcataatacaaggtggaactggataatacacngctgacaggatagtaantaccgattgtcaactcaaagnctcgaccagatangttaatttnactagtcaaaatgaaatttanttangacc

SEQ ID NO: 91493 - DNA, 577 bp, Triticum aestivum
  unsure (1)..(577): unsure at all n locations
  Clone ID: PAT_TA_91493
ggagccgccactccccaccccgcggaccatttcgcaaacctagatccaagccctcgtcgccggccatggccacccgccgggccatctcgtcggtcctacgcaccgcctcccgcatccgcgccgcctccccttccccgtgcccccgcgcgccgctccaccgcccgtccccggccggcttcctgctcaaccgcgccgccgcctactccgtcatccgccgcggcgcaagccgctccggtcacgccgccacccactccgataacacaccggcactaagataccgatgaattcaccggcgccggtgcgtgggtnaagtgttccaagtcattggggcgttgtggactnccgttcgacnaggtctccccccattctgacggcgctggaggtgtccacaacacatccgccttgtctccaagtggacacattccgggagaacttctcgcacatcctatggacggacggaagctctccgcggcaacgcttctcaanacggtcccgataattcctgttggaagnaacttggctataacattatgggacaattntaaagggaattaaacacatnctgcacatctaacct

SEQ ID NO: 91494 - DNA, 668 bp, Triticum aestivum
  unsure (1)..(668): unsure at all n locations
  Clone ID: PAT_TA_91494
tgcgcccaacatgtctagatgatgtcttcggccaagatctcgtaggtcccaatggaatcttgcgtggactaattgaccaagaccgtgtgccgtcgatgattctctggggtggctcgggcacgggtaaaacgactatcgcacgctgtttggcagatcgtgtaggcagtagatttgtggaaataaatagcacaagctctggcgttgcagagtgcaagaaaatctttgcagaggctcgcggagagcttagcctaagcggacgaaagaccatcatcttctgcgatgaaattcatcggttttccaaatcccaacaagatgtcttcctaagacccgtcgaatccggtcacatcacgttgantgggcgcgactacagagaaccctccttcaagggtcaanaatgctttacttctcgttgtcgaactttgtcctanctaagtcacaatgaagatatatcaagattctcnaaaaaagcgttgccgtgaagaacacagcatcagcacagactcattgatacggattactcataccncagaatttcggtgggatctcgaacgcctgaaccgccnaactncatgactccaaatagccncatacaagtgaccaaacacgtacaaaccnnttacacgacnggtaaacagancaattgcttnaaccataggangtnaagaccn

SEQ ID NO: 91495 - DNA, 641 bp, Triticum aestivum
  unsure (1)..(641): unsure at all n locations
  Clone ID: PAT_TA_91495
tttttttttttttttttttagacctcagcatcacattgtattttaggcttgtcactagggatgccggttggctctaaataccacaaactgcttgatcgggccaacaccaacagcgacaattctttaccggtaagaattacaaactttcccccgcgcgcgccgcgtctgcttgcactcgcacattatcgatcactgcgtcgtcggcgatggcgacttggcggaatcgtcgaagagagcctccatctcctcgagggtcctccccttggtctccggcaggagtgcgtagacgaaaacccaggacgctgctgcgcaccccgcgaagatgtagaagcttccgggcatgcccacagctccgtacaagcgatatgaagncatccccaacacggcgctcatcaaccggttaacgccgtgccgatgcagtgccctgcgcgcgtanccggagcggcaggtctctgacccgtacatcaaattactggccgaacccangagaagncgcatgaacctgcggggcgtcagctcgtgcggnggcacangcgngtccgccgcttgcgtcggacctcaanaaaagctacacagtaagnaggcatccgccncctgtanaaatggacccgcacgtacaaaagacggtaaaggcnactgga

SEQ ID NO: 91496 - DNA, 506 bp, Triticum aestivum
  unsure (1)..(506): unsure at all n locations
  Clone ID: PAT_TA_91496
ggcgccgccaaggccgacgccaagttggcggtgaagagcaagggggcggagaagccggccgcaaaggggaagaagggcaaggccggcaaggaccccaacaagcccaagagggcgccatccgccttcttcgtcttcatgggcgagttccgcgaggagttcaagcagaagaaccccaagaacaatccgtcgccgccgtcggcaaagcggccggtgagaggtggaaagagcttgagcgaatccggaaaaggcccctatgtggccaaggccaacaagtcaaagggcgantacaacaaggcattgctgcctacaacaagggcgaaancccttctnctntttncccaaaanaaaggttccggcnaaggaggntaagagggaaattagggaggacctanattcaattcgggtttatgccacattaccatttanggcaccaataggacnagaccattacaatganaaaccnactntcaaagntcccnggnggaaatccgaactcnttnaaaagg

SEQ ID NO: 91497 - DNA, 580 bp, Triticum aestivum
  unsure (1)..(580): unsure at all n locations
  Clone ID: PAT_TA_91497
tccaaaccctagtagcgccgccgccgccaggtaagaggcgagatggtgtccggctccggcgtgtgcgccaagcgcgtggtggtggacgcccgccaccacatgctcggccgcctggcgtcgatcgtcgccaaggagctgctaaacgggcagcgtgtggtggtggtccgctgcgaggagatctgcatgtccggcggcctcgtccgccagaagatgaagtactccgcttcctccgcaagaggatgaaacaaagcctccacggcccatcaattcgggcccccgcaagttcttctggcgancaatccgcngtatgattccgcanaaaacccaagggncaaggcccncttcccaagttnaaggctnanaaggcttccccccctttcaaaagncnaggcaatgcatccccaacgtcaagntcnaagttcancttgnaaagtngcccncggcaatntccaagagtcgttgatanccaacataaggantngaaaggagnaagagcaggtcanaagggaacatngcaaccctaagcaaaggaccngaaatggaacatggttgtcntatcaaantaactntncaattgaan

SEQ ID NO: 91498 - DNA, 242 bp, Triticum aestivum
  unsure (1)..(242): unsure at all n locations
  Clone ID: PAT_TA_91498
ctcgtgccgcttcctctcactctatcctcaaagggggaagaagggatagagtggggagcggagctgagcccacttcagcgggagctctactcatggccatggtgacctcnancttctccgcccacccgctctcgctcangccncagctnggccccaggccntantgnctccacctcnncnccttccngcgcntcngntcccantgnnctcctcgccnncgccgacggggaggnccccgtcga

SEQ ID NO: 91499 - DNA, 493 bp, Triticum aestivum
  unsure (1)..(493): unsure at all n locations
  Clone ID: PAT_TA_91499
ctcgtgccgaattcggcacgagaccgattccccttttcaatggagctccggtgcacggcggcatcgcagcccggcaccagcccggcgacgcgcctccacaccagccccggggatgcggcccgcaccacacaagggcgacgcgcctcctgtggttgggcggcggcgcggtagcgggctccaccgttngaggcgccgcccccggcgatgttggcccgcaccgctcccggcgacgtgccccatccaacaaccgacgcgcctctccgaggtgagaacggcggggtggacaacgcgcgcgnggcggnttggggggagtctcgcgcacatggactcgacttgttgaaacccntgcaactggttcaagttcncctgctcnccaaagccnaaccgggcnactccggtccgctcctataatnatgcttncanactaaccntggctcncccggggcggcaatacaagncccctccggttaanaancatnatagcntggccaag

SEQ ID NO: 91500 - DNA, 571 bp, Triticum aestivum
  unsure (1)..(571): unsure at all n locations
  Clone ID: PAT_TA_91500
ctcgtgccgaattcggcacgagccgcctcctctcggctccttcttccttcgagtttcagccatgggtaaggagaagactcacatcaacatcgtggtcattggccatgtcgactccggcaagtcgaccaccactggccatctgatctacaagcttggaggtattgacaagcgtgtgatcgagaggttcgagaaggaagccgctgagatgaacaagcggtcgttcaagtacgcctgggtgcttgacaagctgaaggccgagcgtgagaggggtatcaccattgatattgccctgtggaattccgagaccaccaaatactactgcaccgtcattgatgcccctgtcacctgacttcatcaagaacatgattacnggtactcccaaagctgactgtgctgtgctcatcattgatccacactggnggttttaagctggatcncaaggatggcaaacccttnanagcctccttgcttcatccttggagtaaacanatatcgctgctgcaacaaatgagcacatcctaantatccaaggtcttagangaatgtcaagaatcctctactgaaaaagttg

SEQ ID NO: 91501 - DNA, 643 bp, Triticum aestivum
  unsure (1)..(643): unsure at all n locations
  Clone ID: PAT_TA_91501
ctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcttacctgccaccgctcagcacggaggcctcctcaagcaagtcgactacctgatccgtccaagtgggtgccttgcctccaantcaacaaggttggntcatcttccgtngagcacaacgcactcctggggtactacgattgccggtattggacaatgttgnaactgcctaagttcnggtgcactgacgccaaanagtnatcaacnaaggtggaggagtcaagaaaggatacctgacccgtattccgcacaatcggttcnacaaatcgtcaagtgcatgggtcagctcatcgctttaagcaacgggcncaagatccggaaggctaaanagtnntcacacangcatantaaatgcatncattttaancganatcttggttcctccattaacttntantgtcanaaagntagtcaagtcagtca

SEQ ID NO: 91502 - DNA, 585 bp, Triticum aestivum
  unsure (1)..(585): unsure at all n locations
  Clone ID: PAT_TA_91502
ctcgtgccgaattcggcacgaggaacaacacgggtgacggcggcgtggtgctcggcgaattggggcggcctgcctggtggagcgctgtgctgctcgccgggtggtctcgacctagggtggttgttcagcgaattggggcggcctggtgtgcggcgtctgcctaggtctagtgcggcgctgtccgcgaagctgtggcaggcaattgcgtcggcagtactgttgtttgggattgaaatttgggttgggtgcacgaggggaggtgagcaaccccaattctaagtgatttccatttcaaaaattccaattaacttccacttaattaanttgccctttgtcanttcttcccaaatagataatttgatcncctgattaataactggttcgctcaataaaactangaagaanatccggtaggcaagttacttaactttngacaatggttaaaaacnaaatttccaaagttgttggattatcccaaggaatttggtttaatttncactctnaaggatttggaatcttcccaagtaccaggaaacataattgttgtcaattggaaactacagatacnancacatgaattagtta

SEQ ID NO: 91503 - DNA, 289 bp, Triticum aestivum
  unsure (1)..(289): unsure at all n locations
  Clone ID: PAT_TA_91503
gggggcttggatagggcgatggctttgancatgtctttganancctcggcngggtgcttgcgcttcttcgcaccatgagcntcgaaggttttggntagaancatnganatcacgtcagccggtgcnccaccgtccanccaagagaagaagcngagananaatagtgaaaggaggaaccanangaggganaagcgaagtgantangggttttcttcaanagangaagctgacanagaagattganatgatggctgcttcgtccgtccaacttactacngnaaaggangga

SEQ ID NO: 91504 - DNA, 539 bp, Triticum aestivum
  unsure (1)..(539): unsure at all n locations
  Clone ID: PAT_TA_91504
ctcgtgccgaattcggcacgaggagcggataaactcgagttcgatcatcaccaaccatgtcgtgctgcggaggcaactgcgggtgcggatccggctgcaagtgcggcaacggctgcggagggtgcaagatgtaccctgagatggacgagggagtgaacaccgcctcccaagaccctcatcatgggcgttgccccctccaagggcaccccgtccgttccgaggccgcccgcccgagaacggagggtgcaantgcggcccaactgcacctgcaacccctgcacctgcaagtgattccatgagnctcaaatcaaatcaaattnaaggagatggcatggatggacctgatgaaaggaccaatagtaatttatcatgatcccaacntgtgttccttttnaattgccacccaagataacgaatntancctacctaccanctanttatgattaacctgcccttgtgcttgacctntgcngttaagnncttttcngtnatccttccaactgtcnaatcctcnaattanacataanaattggntctct

SEQ ID NO: 91505 - DNA, 172 bp, Triticum aestivum
  unsure (1)..(172): unsure at all n locations
  Clone ID: PAT_TA_91505
gaccgccgccgccgccacctccacccgctcctcacctaccccggcggngaccccccaggtacaccccgaatggcgacggtggtcacggcgtcggncacngcggnnacccgcttcacgcgcctgnngggcgtcnccctccggngcancanctgangccctcgcacngnggtgc

SEQ ID NO: 91506 - DNA, 622 bp, Triticum aestivum
  unsure (1)..(622): unsure at all n locations
  Clone ID: PAT_TA_91506
cgccgctgaggaggtcgcgaagacggaggaggtccccgcgccggcggagaccgaggtcgaggcgcctgctgcccccgtcgaggtcgtggagaccaaggaggaggcaccggccgccgccgagacggaggatgccaaggaggccgagccagcagctgcggccgagccggaggccgaggcgcccaaagagacagaggcgccagccgtggtccgagacagagaccaaggaggccgttgctgaggcagagcccggcggcggccggggagtgaaggaagaggccggcgcctgctgcccgaagcccacccggccgctccccgctgctgctgaaggaacaccggtnggaggcaaccgcngcgcggcagangagcccggccccgccggtggcaacctcancgtnttaagcgccaccgccccgganggaagactggtggtcaacttcaacngcggggcctttgctcctaacttgcacggcgtnatctatcaaccatnaattggatgctatgcttttacaaagtgtgatgggaacctatcccggtcccctnactggntaataaatgtttcnggcaatcanccaattcggtanacaacaacacaacaagcaattcccgaacctnctgnttgtaa

SEQ ID NO: 91507 - DNA, 507 bp, Triticum aestivum
  unsure (1)..(507): unsure at all n locations
  Clone ID: PAT_TA_91507
tggaaatccgagatgcatgggtagggttcctcctccatgccgccagcaagtcacggccggagatgcatgcggcgcagctggccagaggaggggagttcctcaccttcgtttggctgctcatggcccactgcaatctcgggaactctaggggctgcccaatcgggttgctacctataagtggtgatgttcaagtggcgctgtgtcttccatattcgccctccaccacaatcctcataggtgctgcacaggctttgtacgggtttccgaccacggcacgcctttgcgttctcatcgattcggcataagtcgggattcatccccattgcgcttgtgcgctgctcaaaataatgtgcttccatcccgttagtcttcttttccnaccttgtctcttttaacttgcaatgtattcaagacacacgtttatttatccattgttcaatgtnacacacaacaacacattactttcatagccttaancatctgatgnacctgctgaaaaaaaaaaaa

SEQ ID NO: 91508 - DNA, 296 bp, Triticum aestivum
  unsure (1)..(296): unsure at all n locations
  Clone ID: PAT_TA_91508
atacggaacgggcctcgtctccccctccgtccctccccccgccttatcctctccggaccggagcgagcgagngccccaccgctccctgctccccgctccctcccgatggngtccctcancaccaccaccgcctcctcgccggncgccctgcccncggcggcttccgccnccccggccacggnntcgtccgtctcgcccaccgcngncgcctccaagcgcccgcacntcgccggngacgacccgcnctggcgcntcgnggcagtcggntcngccggnatcngtctcgtctcgcgcat

SEQ ID NO: 91509 - DNA, 317 bp, Triticum aestivum
  unsure (1)..(317): unsure at all n locations
  Clone ID: PAT_TA_91509
ctccccttccggttcgggttctggttcggttcgggttcggttcgagagagaggccgantagctagcctagtctagggtttcggtagagaggaagtgagatccatggcggagacggagtaccgctgcttcgtgggcggcctcgcctgggccaccgacgacaacaacctccangcaggccttcagccagtacggtgagatcctcgacgccaagatcatcaacgaccgcgagacggcnaggtcccgtgggtnccgcttcgtcacnttcggcagcnanngagtccatgcnccagnccaancgnggacatnancggcaanga

SEQ ID NO: 91510 - DNA, 640 bp, Triticum aestivum
  unsure (1)..(640): unsure at all n locations
  Clone ID: PAT_TA_91510
ctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattccgagaccctgtcttacctgccaccgctcagcacggaggccctcctcaaagcaggtccgactacctgatccgtccaattgggtgccttgcctcngantcaacaagttggntcatcttccctnnacacaaccatctcctggggtactacgatggcccggtattgggcaatgtnggagctgcctatttcnnggtgcactggacccacacagtgatcacgnaggtggaggagtccaagaaggataccctgacgcgtatgttccgcatcaaccgnttccacaaatgctcaagtgcatncgtcnacttcatcgcttnaaagcaacggntgcaaagatccggcaaggctaaacaagnantcacacnagcatataaaatgcaatgaattttgtaaccngacatgcnttggtttcctccaattacttctaattgtccaaaaanggtagtcaagtcagg

SEQ ID NO: 91511 - DNA, 566 bp, Triticum aestivum
  unsure (1)..(566): unsure at all n locations
  Clone ID: PAT_TA_91511
ggccggcggcgtggtgggatggaggagaacggtggcctggtggatcgagggcggcatcgagttcgtcctcaatctggtggtcaagttcccacttcgggaagcgttcgccgataaccttgagcacccggatccgatgccgctgaggctgctgcccaggggggaggttggcgctcttggcccggaggattcaaatggtgaatctggttaatcgggaggcacctggatggaccaaaaggttaagactaaggaatgcaccgccggacagaacttttgtgcgcttcatggatgagcgcactgggagcaatccgatacggaatttgacgaagaactgacgaagagtgtgattaaaccanaaataggaacaatttcgatccttggtgagccatacacttctacaacctgtatcnatgagaatttggatccnatattaaatatgggaaaactgactgaatcaaggaagaacaatccaccaagaatattgtggtgtccctaatctgtctacgaatacaagttggttctttcgncatttggtcggaaatgcttgatnagtagtgnacacttttgtt

SEQ ID NO: 91512 - DNA, 557 bp, Triticum aestivum
  unsure (1)..(557): unsure at all n locations
  Clone ID: PAT_TA_91512
ggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgtacgaaaggtnggaggaggtcaagaaggagtaccctgacgcgtatgtccgcatcatcggattcnacaacatgcgccaggtgcagtgcgtcagcttcatccgccttcaaagccaccgggctgcgaaggagtcccggcaaggcctaaacagtcactcaacgacaggcatatataaagtgccattgcattttgtcaactccnacattgcttgggttttccttccccattancttcctattgttcccaaaganangtgtnagtccangttcaatgttccaacatggtcgagaaaacagccctatnaaaatgctacnggggctangttatnaaggnccatatatntccatantcgacaantacntttaanggaaaaaaaaaaaa

SEQ ID NO: 91513 - DNA, 381 bp, Triticum aestivum
  unsure (1)..(381): unsure at all n locations
  Clone ID: PAT_TA_91513
ctcgaggatggtcgcacccttgcggattacaacatccagaaggagtccacccttcacttggtgctcaggctccgtggtggcatgcagatatttgtcaagaccctcactggcaaaaccatcaccctcgaggttgagtcctcaagacaccattgataatgtgaaggccaagatccaaggacaaggagggtatcccaccggaccaagcagcgtctcatctttgctgggcaagcagctcgaggatggccgcaccttgcaagactacaacnatccanaagggatcaatctcaacttggttccnaagcnccttgnggtatgcaaattttgtcaannacctcantgggaaaaccaatcaccnccaggttgatccccaaaacacattga

SEQ ID NO: 91514 - DNA, 638 bp, Triticum aestivum
  unsure (1)..(638): unsure at all n locations
  Clone ID: PAT_TA_91514
cttcttacattttgtacacatattgtaccacttcacatttctcctccttacagaggaccacttcagcgctatcctttaaatcatattcaatatcccttcctgccctacagaacgttagtacatacaacaaatttttcctctcacaaatattcatcaccctcttacaataccacaagatgcttctctctaggagggacctgggagttgttcaacggaaccccctaaagccgattcctgtatcctttaatgaatacattcaaaggtacccgatgaagaaagacaagcgtacttccaaaaggaaaaagaagaagatgataatccaatatctcaacatttgtaacttcctgntcaacttgggcnattatgccaatnggaaaaatattggtntaaggttttaggnanccctanacggcacttattccccttaancccgtcttcnanccnaaaaattttagccattcttggtccatggccaagcgattaanattacgnaagataccnancgggaaangnctccaactacaatggcatctgggcaaanaatcctcaaaatgnttcancctcaaggtaaccttaacacatcgaaataatgcgganatacctgangaacccntttttttcaaaaanttcaanggntt

SEQ ID NO: 91515 - DNA, 299 bp, Triticum aestivum
  unsure (1)..(299): unsure at all n locations
  Clone ID: PAT_TA_91515
cacacggngactagtcatggaggcgagggttgcagcaggggtgcccgcggacgaggagtccggcctcctccccggcgcgcgcccgccgccggcagccgccggccganggcggacaccctcctcctcctcngcggtggcccagcgccgcgcgcccccgccggcggtctgggcgacggtggncgggcncctgtggatgcgttttncttgaggtagcacggccacgcnctgcgcttnttccntcnggggcttcgccntctcncnttcctcngggcgattnactnatgngattncttgcccgt

SEQ ID NO: 91516 - DNA, 540 bp, Triticum aestivum
  unsure (1)..(540): unsure at all n locations
  Clone ID: PAT_TA_91516
gagccgccgccaaccagttcccctcgggatccttccccacccaaccggcgctctcctctggatcccctcgatctaccaaccagcgcagcccatggcgcccgatcctctgcgcctcccctcgtccaggagcatctgctcctttgcccgagcctccctgagcttctccctcctcacgcgctcgagaccagcagctctccttggagccggccacagcagtagcccaaggccgaccccgcgcctctccctcggtccctcctcctcgtccttctttctcccgctctctctctcacaatccctctctctcttgcaagaattccctcgtcagcatggngccatcgcagcccagtcgccggagccgttgttgcgccgcanggagcactcttgcgtcgccaagatccgcgccctggctcggttcggcggtccgtngcctcgcccgtcaggcctcgttctccctgcttgccaantcgccgcncgtccgtggccgctcnaatcgcngtccgcgagngacggttggcgttcggcgctccgcgactgtccaga

SEQ ID NO: 91517 - DNA, 638 bp, Triticum aestivum
  unsure (1)..(638): unsure at all n locations
  Clone ID: PAT_TA_91517
ctcgtgccgcaagactccatttgctggccgcttgtatttcttgctttttgcaccccgaacatcatatggagtcttgtccctgcttgtggttggtcgaccggcttttcgttttcgttttggaggacttagtccttcgaagttccccactgcactcccttcagcgtccgctcaagggtgcaattgctgcaatgggttctttgtcttttctcttatgttgatcatttttgtcttccggccccattccatcctgcacagcagctagtgggtgtcagcttatccactgctcccttcaaggatgtccattgcaaaaccatgcttcccgggatttgcatctcccagcctgaacnnctcaagtgcatgtgtgtacaaaatttcaatgcctgtagttattgattcancaagaatgctacccttctgaaaaatccacaagtgggctggcaacaatctcttgcgtccttcgtccacngcttcaacaaatgctttgctngtaatggctaanccaaggaatcnaaggacttaaancgttacaacagacaacagtgtgtcaaaatgcacatcgaaacaaccanttcctcgcaaaantcacttgtcaaaccncacaattggaagttcncgatggaccttncaaaaggtttcct

SEQ ID NO: 91518 - DNA, 565 bp, Triticum aestivum
  unsure (1)..(565): unsure at all n locations
  Clone ID: PAT_TA_91518
atcccacacacactgacccagccaccgcagatggtgagcggagccgtgtaggccgaccgccgcagctggctgtgatactcgccggcgccgagcaccaggccggcgtgctccgggtccgagccgagcgtctccatctgctgtcatgggcggaggccgaggggcgagtgacgcngcggtcgccgaggccgccgccatctgcgcgctaatcgccgtcgcccgagctgaccgtccccgaacgccatcgganccgccatcgtccgagctgctctcctcccgccggcgaacttncgaccgtccntgacgggccggctggaggcaacggcgggtccacactttgggcctctcctcaatgancaangactctcgtcctctcctccgggttaccggacccgggattntcggttncccngcgcccggaggcnaaggngcaatcctgaacggcaaactcggctcatncncncccaacacggtacaagngatccatggcnacggactcctntctctntangggcgctccgtnccggatctaaacggggcannanccaatttgcaacctgcaatgtcc

SEQ ID NO: 91519 - DNA, 488 bp, Triticum aestivum
  unsure (1)..(488): unsure at all n locations
  Clone ID: PAT_TA_91519
gcggttgtagcagtagcgcgcacaggggaagcgcgctatagctattagcagcagcgagcttccattaagcgcgctgctgcaacacttgtgtagcaagtagcgcgggtgaaccagcgctactgctatacgttagctgtagcgccttattaagtagcgccgacccccgcgctactaaaaggcccaaaacccgcgctgctgataggttttccctaagtaatgccatccgttccccacacttntaaagcaaaaggcaacgggtcctcccgtaagttnccggagaagccggcacccgatttgtccgcaacggcacctttngccttgcacattccgccgcgtccaactgcacaacatttttccngcngccgcaagtggcccatgcacattttaccnctgggggtttttgccaacgcagcatgggcgtccccttgctngtttggnnttcctgactccgnancccctcngggatcgctccaaacatcctccctgga

SEQ ID NO: 91520 - DNA, 367 bp, Triticum aestivum
  unsure (1)..(367): unsure at all n locations
  Clone ID: PAT_TA_91520
ggataagagagaaacacagagcaagaagataagagagaagcaaagcttgagatggcgcaaaccatggcgtccatgaccggcctgtcgcagggcgtgcgtctcccaggcccggccggcaggcgcgccagcaggttcaccgtgagggcgtcgtcggcggaggccgaggccgccggccgccgcgcggtccttggcctcatggccagcggagtcgtcgggagcgcgttcgctcaagtgggtgcacgccggcaccgtcgcggcataaggttttgggccccccgccggcgtctcccggtggatccccccggaaggacaatccggacnaagnaaaggactncaacttgcccctgaaaacggtttaacttgaacc

SEQ ID NO: 91521 - DNA, 465 bp, Triticum aestivum
  unsure (1)..(465): unsure at all n locations
  Clone ID: PAT_TA_91521
gtgccatgtcgcgcatcaaagtaatgtatttccgtgaattccgaggggaacaaagcgagattgccttcctcaagctcttctataagagcgcgaagatgctggaggctgctgtggtaattatggcgaacccaagcttcacaccgtttcgggcagatgtggcgttttccaagagcgtggcaagcgtctaaggtcagtaggtgccaagccagcatggtcttggagggcacaggcctgaaggtgggcaagcgtggagttcaaaaatgcaantatttcccatcccgaggaatctcccaaacgaaagccacaacctaaggcagtaangttccctggggtgttgctgaactagatcaaggtgtggnacctnaaccnctcnatttngnaaccacccntccatttgtgggctggatactgggnggacaaacataccangattgggattttgctggcggtgttaaaaaaaaaaaa

SEQ ID NO: 91522 - DNA, 587 bp, Triticum aestivum
  unsure (1)..(587): unsure at all n locations
  Clone ID: PAT_TA_91522
ctcgtgccgaattcggcacgagggaggccaagcaggctgggcacattcggtcctcttcacagctgatttaagggttttttcagggaaacctctcgaggagctaaattttcacataatcacaaagagaccttcggaggaggaagtagagcagttaaagaaagttccaaagatgttactgaaacgtgaaaattcagaagataaagatacggacagaaatatagaaaatgatggagattcaagcagatcatatcaatcctcaaattagcagcaaccaatccagcattccctaatgaantttgggttattcgatcaaaatgttcactttatcttccaacaagcgctgcgtacttcaatacaatccgtagtacttttgagtatcatttaattacatttttaccggacgatagatctctaacattctttantaancctaattatcgtagatcccacaatgaaagtcaaaatcaagccttaaaaaaaaanaaaanaaaaacccnagggggggcccggtaccatncccctanaggancntttngcgcccacgggcgtcgtttnaactcctgacgggaaactgggtaccaataacn

SEQ ID NO: 91523 - DNA, 456 bp, Triticum aestivum
  unsure (1)..(456): unsure at all n locations
  Clone ID: PAT_TA_91523
tgagaaacaacttcaaagtgaagatattgctgatgctacaccacaaagggacctgatgacacaagatgatgtctccctcaagaagataccagagcctcaaattgatgcctcttctgccgaactgacgaaggatccatcagagcaagatggggctgcatctgggtgagaacttgtcaagagtctcaaagtaagctaactgttgagcagacgttggaatcccaagacgctgtgggtcctcaaagaggcaactggaccaagataatgggatctaaaaatgatgccaagcattgagcatcatcaagatcncaaangngttgcacccggnaaagttccanttggagcaaccattgcaacaacaaaaagatcatctacagagcaaccattgggacctcaacatgaagcaaatgacaaggtttaaacaaagctaataatgatcatttctgagganccattgca

SEQ ID NO: 91524 - DNA, 574 bp, Triticum aestivum
  unsure (1)..(574): unsure at all n locations
  Clone ID: PAT_TA_91524
atcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaactcgacgagaagaggaacacggacaagtggaanggtcttgcgttcgatatctccgaccgacaagcaaggancccaanagggaaaggaacnngggggacccctcttccaaggcgccaagggcnnaagggaccacnaggcgtctcangtcctacangtanttnagcaagggaccaanaantcnatttnanaaccaagggaggttccaaancgcccgggttcnntggnaacttggttggcaattcccaaaaatntaagacctggccaaatnaagntccatcaactgggnaactggggaggnagggcaagggantcatccatgcaactgtctcnncaagtggnataaaccaacataagnngcgggggg

SEQ ID NO: 91525 - DNA, 501 bp, Triticum aestivum
  unsure (1)..(501): unsure at all n locations
  Clone ID: PAT_TA_91525
ctcgtgccgaattcggcacgaggtttttttttttttttttttctgttccgaatttttcaatttttcgaaatgtgtatttcgacaatgggtgcatatgcatctaggagccaaaacgccgcatctttctcaagacaataatatgtcatgtgtgtagtactaatttctgaaatatgaacagaatggcgaaacacagcaacgacaggccggaagtcgctccgcaacttcaatgcaccatcggctctctcaagtgaacaacccgcatcgatnggtccccgtccgtcgatttcatcaaatcaaccaanggttaatcgattaatcaatgtancacttgcctcccctgggaactccaaccatnttgcccggccngggtcccaatccnggngcaaacgtaagccnccancctccaanannccccggagncctgaactgtttncaacccatcaacagncatntcacngggnatccggttanggccccccnaactggaaaacncntacaacc

SEQ ID NO: 91526 - DNA, 602 bp, Triticum aestivum
  unsure (1)..(602): unsure at all n locations
  Clone ID: PAT_TA_91526
gtgacctttcatgtcggcggggagagtttcttggctcatagggccgtgctcgccgctcggtcatccgtattcagagcggagctctttggcggcatgaaggagaaagctggcggtccgattgaaattaagtgacatggaaagtgacgtgttcaaagccttgctccacttcatatacacagacgagtatgagcctgttcctgaagatgaccgatggatgtnaaagcacggagagaacggtgatggctgggcatctacttgttgcagcaaacangtacaaatccaagggctgaagctgatatgcaaaganagggttgcaactcataacccctgaatccnngggacantttgggncccaaccngacaacangttcccaagggatcaaggatccgctttgattccccccttcgccttccattttggaggcattatgacatcccaaaaatactgccaacatnctcaaaggactgggtggnaantccngccccccaaantnaaagcgcaaagtttttcangcattagatggggnaancacgttgatcaatcaattagancagggctacattccagtggtgagtcaacantcattcaacaganngattgt

SEQ ID NO: 91527 - DNA, 436 bp, Triticum aestivum
  unsure (1)..(436): unsure at all n locations
  Clone ID: PAT_TA_91527
cacaagaattcctcccacccccaccgtctcgccgccgccaccaccgccgcagctagataagaagaaaaaaagagagagaagaactcgtcgggagggctcgagatctggtccgggagagagggaattcttgagatcggaatcggaacaagcgggcgcgctcgggatcggggttaccatacaatttttcccaggaacctttagtgaatgtgctaatggagtcaaagggtggcaaaaagtctagcagtagtaggtccctggatgttcgaacaccctcggtacagcattgaagacttcgacctgctgggaggcgccaagaattctctgctgcatactccaactgcgcgaaagaaccacccggaanctttttgggatcccttcccntatttaagnttttaatcattttatccnganctttcnccnacatctcncgggttgc

SEQ ID NO: 91528 - DNA, 623 bp, Triticum aestivum
  unsure (1)..(623): unsure at all n locations
  Clone ID: PAT_TA_91528
cgatcaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaatagctccaaggccaacaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcacccacgaagccgtcctcagctcctacgagtactcagccaaggactcaagaagtacgacttcgacaacacatgggaagcttctaatcgctcctgcttcatggacaagctgttgtcatctctccaaagaactcatgacctgccaacatcaagttcaccatcttgggtatctggggangaaaggtcaaggaaatcattcantgcaacttgcctcccaaatggnatcaaccaatcatgatatnccgaaactgnaatgaacccgngagcagcaagnatagnangtact

SEQ ID NO: 91529 - DNA, 311 bp, Triticum aestivum
  unsure (1)..(311): unsure at all n locations
  Clone ID: PAT_TA_91529
ctcgtgccgaattcggcacgagcctctatcctcttctcccctaaataaccccgccgtaccgctctgccatggccgccgccanactccgccccgccctcctctcctcctgcnccctccgccggctcgcctccgcctccgcgccgcgcgcnccccgcctcgnccagcccaaggtgcaggggttcgnccgggctcgcctgtcctacccggccgcnttcgccgcctccgccatgtcgacntcntctggggccaaggangcgccggtcaacancncgggnctgcangtctgatgctgacccggtcancaatgggct

SEQ ID NO: 91530 - DNA, 614 bp, Triticum aestivum
  unsure (1)..(614): unsure at all n locations
  Clone ID: PAT_TA_91530
cccaaacctcgcgttcttcctctccccgtcgagcgccgccgccgccccgtctacgatctcaatcccacagtcacgactcgctgccctcccctgttcgctgcaactcgcacctcacctcaatcgccaccagcctccccctccaatacatcgcctagaccgccaacgcccgatgctcgccctccgctggatcggcgctgcccgatgtgtggtatgcgagagtctggctgcagctgcgtggccatgacacggctcacacggtagcgcatggcgtgtatgcagcagctcgcaaacagcagcgggtcgacacgagtggtgatgggctgtagagctaccgcgatggcggtcgtgcagcatatggagcgactctaacaggcangctgctgagcgcgagtanggctcggtagagagcataagtccagcacatcgacgagcgcatcatggccgggcaancgggcaatgatgtagccgagtggtggtcanctaagtgcgtactaaccttacagattaggggataggngtttggaaactcatgatcaatctaattcaaaacactcacaaaatctgtataagatgagtctctcacaatcatcaagntctattggttgnnagatgtn

SEQ ID NO: 91531 - DNA, 386 bp, Triticum aestivum
  unsure (1)..(386): unsure at all n locations
  Clone ID: PAT_TA_91531
tggagaaggccaaggcgcacgacgacccggcggcgcaggcggaggcggaggccaggaaggaggagcggctcctcgaggtggaggccgccaagcaggacgcctaccgccgcaacgccgccgtcgccaaggacggccgcgccgccgccgtcgtcaaggatgagaaggaggcggccgccgacgacgaggctgaggccgtctccgcctgacgactccttcggaaaccacctcctccagtattttcgtttgttcgatcgactgtacgtattgtattgtattgtttggaatgctgcgttcatttggaattaatcttgtgggaaaanctgttattantggngattatgagatgggaacagangcggangacgaatttttttaaaaaaaaaaaa

SEQ ID NO: 91532 - DNA, 549 bp, Triticum aestivum
  unsure (1)..(549): unsure at all n locations
  Clone ID: PAT_TA_91532
ggaactgagagctcatcaagaaacctctgacgcttcacaacggtctgctgtggccgctccgttatccccgtcatcttgtgattctgtccctggaggaaaagatgaggtttcagtcattaaagcagggctaagaaaggtaaaaatcctcaggcatatagtgtcagctcgacggtccaagaagacgttccaaagcgatgaaggcagtgaagataattgctatattcacagtgatggtactgaatatccatatggtaccgagcctgtggatgaagatcttgatgatagaacacatgaagatgaagttgccggattcaactatcaagaaaccttcaatttatggtcactgcatccgtcaaccaagtttggtgaccaanaaggacgggtcnattanatcaaccggnaatctgatccggtaacaagtttnatgaacacatcatcaactgcgttggaacgtttgcaactgttaaacgggtacctccttggggaanaggaacgggttacgcactaaaggtaaagggacncgtttanaaaccatngaggngtntgaat

SEQ ID NO: 91533 - DNA, 313 bp, Triticum aestivum
  unsure (1)..(313): unsure at all n locations
  Clone ID: PAT_TA_91533
cctagccctcgcagccgcagcggcgcgcacacctctccctcctccctgaagacagcgccgccgtcggcgagagcacaggatggcgaccgtgcccgctcccgcaagccaagaaccgcgggctccaangggccnaacgttgaaggatntcaacccccacgagttcgtcaaggcctactccgcgcacctcaagcgctccggcaagatggagcttccggagtgggttgacattgtcaagactgcaaggttcaaggagcttccaccttctgatgctgacnggtactacatcagggctgcctcgatggnaaggaatttc

SEQ ID NO: 91534 - DNA, 373 bp, Triticum aestivum
  unsure (1)..(373): unsure at all n locations
  Clone ID: PAT_TA_91534
gagagaactagtctcgagttttttttttttttttttgagaatataatgatgataataataatataattctccaggatttcaataagttaggcccagcagtatcattacgccataggttcataagatgcaccaaccaatataacacaaccagtagcttagtattattaccccatgttcataagatggcacatgtccatattgtgcactaagtaaccagtaacataagatggcaccaatcaaaacaacacagccagtgagggaatctgctggagggcattctttagtgagaaaaggcagcaacaacagcaacacaatccttggttcttcaacttccgggtactctggttccatagncttcaannggggggggggc

SEQ ID NO: 91535 - DNA, 583 bp, Triticum aestivum
  unsure (1)..(583): unsure at all n locations
  Clone ID: PAT_TA_91535
gtaaatcttaaaagcactgagatattggagcatccaaatgtccagatttgcaatgaaggccgtcaatctgccctggtggagatactggagatcctgacagttgtatgtgaagagcacaagcttccattagcacaaacatgggttccttgcaaatatcgaagtgtgttggcgcatggtggtggtgttaagaaaagttgcttgagctttgatggaagttgcatgggggaagtctgcatgtcaaccagtgatgtggcatttcatgtgattgatgctcatatgtggggattcccgagatgcctgtgtaagaacaccatctacagaagggacaaggagttcctggcaagcgtttanccaacacagaccttgcttttcaaaagaancancagttttgtaagctggataccccttgtgcactaagccntangttgggattggctggctgcttgccaaatgttacaancctaaacnggngatgatataaatgcaaanttccngcaaccatntaagagganatgtcaaanctgttgggtcaaataagtcgataacatgtcccctaancnaagnactgnaatgggaacaanaa

SEQ ID NO: 91536 - DNA, 581 bp, Triticum aestivum
  unsure (1)..(581): unsure at all n locations
  Clone ID: PAT_TA_91536
ggttaaagtacgcacaaatttccacgagttcttgtctgttgttgctactaccatctaatactggttgttggttcagtatgacgcacacaagttggtattggtccatcggcttctctagtctagattacaatagtcataacagctgccctatttactaacatgggaggacaccagcgtcggttctcactaatcaattcttcctctaagttaaatctctagctatatgccactgaaacattgtgaacttattcattgttccattggacaatttggttcaaggccaacatgttagtcaagacagtgagtnncacagaagggacntgggaaaanaacatttcccaaccagntgtcnaattttcctttgcagggaancaccangggtgataaacaagngggnaaaacctccaacggggncaaagggttttttggcccnaaancccttcnnantgggaancctnttacanatcctgaaataatcaagtacatantattccnagggncatggatgtcctaagtcctccantgaggaatgtcancccgactgtcccantanttgtcaaagggcttttccaaaagtgaac

SEQ ID NO: 91537 - DNA, 600 bp, Triticum aestivum
  unsure (1)..(600): unsure at all n locations
  Clone ID: PAT_TA_91537
cggcatcctcctctcctccgataatacaaataccatggcccccgccgtgatggcttcgtcggctaccaccgtcgcacccttccaggggctcaagtccacagccggcctgcccgtcagccgccgctccagcggcagcctcggcagcgtcagcaacggcggaaggatcaggtgcatgcaggtgtggccaattgagggcatcaagaattcgaagaccctgtcttacttgccacccctctccacggaagcctcctgaagcagtcgactactgattcgctccaagtgggtgccctgcctcnagtcaacaaggttgnttcntcttccgtttagcaaaacattccccccgggtactacgacgtccatactggacaatttggaaactgctatgttccgggtgcaccgacgcacacaagtgtcaacnaggtggangangtcaanaaggattaccctgaancctaagtccgcgtcatcngttctacaactgcgcaaaggcaatgctcaacttaacgccttaagncacgggttcnaagatccgggaaggggctaaanataatnaaaaaggctanccanataaatnttgtaantnnctttgtcacaccncgt

SEQ ID NO: 91538 - DNA, 272 bp, Triticum aestivum
  unsure (1)..(272): unsure at all n locations
  Clone ID: PAT_TA_91538
ccacttgcgctaccccgctccccgctccccgcaccccgcagccatggcggcgctctgctccgccgcctcgccggccgtcgccagggccgcggcgctcggtctgtccgcgcgcggccccgcctcactccttcccctgcgcctccgcatccgcgccgcctcgcgctcctgncacgccgcgccgcgngatcncggcctcgtggcgcgcgcggnggcgcttcnccgcgtcggccgcctccaccanggnatnacggcncggacgtntacancatgat

SEQ ID NO: 91539 - DNA, 634 bp, Triticum aestivum
  unsure (1)..(634): unsure at all n locations
  Clone ID: PAT_TA_91539
gagaactagtctcgagttttttttttttttttttattcatgctaaataacaagatataatagatgatggtcacaagacatgaaaggataacgcaccagtacgtacgtgcgtcatttcacactgaaaaacacagacaggttccggttcagaaagggagaaagccaaaacaaaagttcacagctattaatcgcgacaaaacgtatgcacaggataattgagtaagcgcattgttggatcctccagatttaagcaccaagctcctgctgacctgaccatcagtaagtaaccacctcactccatgtgtcggcatgtgcaagagcaactccaagagaaggtaacggccgggttcctgctacgacctgttcaagcangccatttcaaccatgggattgtggttgcaattatttgacaagcttcaacgctagaatctgcaaccacatctgaccaatgtactgggcacaccntgcacgggcggaactccggccgccggcagcgcggggaagaacaagcggtggtgtgcgtagggccggttcctcgcccgctgtangacgccgntccgcccgcnctgggaagcgactccctcaaggcaatcggtnccgggccggaactcctcgtcggagctccgcgcccgtng

SEQ ID NO: 91540 - DNA, 486 bp, Triticum aestivum
  unsure (1)..(486): unsure at all n locations
  Clone ID: PAT_TA_91540
ttttttttttttttttttgtagcatgttcanaagttcaatctcaatcatcaagttctcccaggaatgtggaaacgttgtgacgaatcgtantgccccttcaaggacatgggggctcaaaanaagcaggttacatttgcnaagaatctggttcanctaatacgtgagactacacagctgcatcaaacaananacattacgtgctaaattcgtgtttaccagactgaangatgcatcatccgnngagtatccanangatgaacatcgctgtcgcatttccacaagcaccatggancacctcatcacaaggctaaatggtggcgncatcgctcngatcccagccannaagtctgtctaccgnggtcatagntcgtgaacaagncggtcacacattccccaagnttgtttgantgctgangcttganaccgcaggggtgcacntttangactccancntgcggtccntctgaattcgcctgtgataacaa

SEQ ID NO: 91541 - DNA, 638 bp, Triticum aestivum
  unsure (1)..(638): unsure at all n locations
  Clone ID: PAT_TA_91541
ctcgcgtccgccgcgcccatcctcgtccgcgcctgcgccccgaccgtgctcgccgcctcccgcccgatccaccggtccaccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcagaacccaacggaggctgagctccaggacatgatcaatgaagtcgacgctgatggcaatggcaccattgacttcccagagttcctcaacctgatggcccgcaagatgaaggacaccgactcagangaggagctcaaggaggccttcanggtgttcgacaaggacaaaacggttcatctctgctgctganctccgcacgtcatgacgaactcggcgagaaactcaacgacnaggaagtggacgagatgatcgtnnaaccnacgtcnangtgatggcagtnaactatnagagttgtcaaggcatatggcaaatgagcaccaaacgtgtccaagacagnggagatntgcatgcatattagtaagatcacctaatgangatcanttaacacctactnctnacnctaanggttgngaccaatct

SEQ ID NO: 91542 - DNA, 628 bp, Triticum aestivum
  unsure (1)..(628): unsure at all n locations
  Clone ID: PAT_TA_91542
cctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcttacctgccaccgctcagcacggaggcctcctcaagcaggtccgactacctnatccgctccaagtgggtgccttgcctccgattcaacaaggttgggtcatctcccgttgagcacaaccatctcctggggtactaacaatggccgtattgggcattnggaacttcctattttcggntgaatgacncacaaagtgataacgaagtggaggaggtcaagaaggataccttaccctatttccgatcanccggtntgacaaatgcgtcaaggcattcncaantnacgctttaancaccggntgcaagatccggaaggctaanaatantcacaaaagcatttaatgcatganntttaacccnaaatcntgggttcctccaatacttcaatgtcnanaaantgtgtcaagttattcananggcagaaannt

SEQ ID NO: 91543 - DNA, 373 bp, Triticum aestivum
  unsure (1)..(373): unsure at all n locations
  Clone ID: PAT_TA_91543
ttttttttttttttttttgcaattcgtacagggttttattgatcnatgcaaacaacgacaattcacagnctcacttggntcaanngtcaataatcganngaagcttanctctctctgaaaagctcacagttacactctcgacgtcaatantcnactgaagcttanctctctctgaaaagntcanagttacactctcnacgtcaataatcgactgaancttagctctctctgaaaagctcanagttacactctcgagccaacaggnangcancaggcnccnccaaatagntangtcacgcggtctcatgccgacattcgagcnagntcctcgccngcacgctcgccgngtngacagccggcnctcctgtcgtca

SEQ ID NO: 91544 - DNA, 516 bp, Triticum aestivum
  unsure (1)..(516): unsure at all n locations
  Clone ID: PAT_TA_91544
cgaaatcaactcatctttccagcagcactcttggttttccaagttgaggcctgattcaatctttcctttccgaagcatgcatatgcattgcatatcacatcccgcatatcatgccatgttttgcgtcatgttgtttgcgcattacaccatggttgattgttgtttcatttgcttgtgttcttgtcttgggtagagccgggagatgagttcgtgttcgaggtaacccgttgagtccgtttacgaggatcaagctttcgtcttctcggagaactttgcaagcaagatgaccataccctcgaaacacttcaacctttgcctggcnattgctcgctctaatggcnagcctaagctacaatacctacacttgctaatacatgcctcccaaaatgccaagttaaacctctnaccaacttgtcccaacaacgttggttggcaagttancgctttgcnaaccccctanacgttgccaattgaagngaaatggatttgggtcnaantcggananggattttggga

SEQ ID NO: 91545 - DNA, 611 bp, Triticum aestivum
  unsure (1)..(611): unsure at all n locations
  Clone ID: PAT_TA_91545
cccgccgccgcctcctctcggttccttctccttcctcggagctccagccatgggtaaggagaagactcacatcaacatcgtggtcattggccatgtcgactctggcaagtcgacaaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgatgcccctggtcaccgtgacttcatcaagaacatgattactgggtacctcccaagctgactgtgctgtgctcatcattgactccaacactggtggttttgaggctggtatctccaaggatggcagacccgtgagcacccctcctngcttcaccttggagtgaacanatgatctgctgcncaacaagatggncgcacaatcccagtaccaaaggccgttatgaggaaatgcanggaagtcctctacctgaaaagncnggtanacctganaaggtccctcgtccacccgggtt

SEQ ID NO: 91546 - DNA, 480 bp, Triticum aestivum
  unsure (1)..(480): unsure at all n locations
  Clone ID: PAT_TA_91546
cactcgtgtgctctgctctcttgcgctaccagctaactaggtgggcagctcagctagtcagcttcgggggcactccatctctgatctctccatgtccctcatcaccgatgaccccgaccgctccccgcgggactgcgccaccaagcgccaccaccaccaccactccggtggctggcgacagcgacggctgctgatcgcggcggcgtcgggcgcggngtcactgctggcactgtgcatcatcctctggctcaacctccgcccctcaagtccgcgcttcacgctgctagccgccaccgcaaccttctccaacgcaagcaacgggaggcggcctcntgcacctcgacgcggcctcatgganacaancccaangcccganncgcgngtctaacanaactcccgggngggngctnctaancggtttcaantgcaacgccggccttccggcgtncaacaggccaaggnaacccntntttaacctcc

SEQ ID NO: 91547 - DNA, 268 bp, Triticum aestivum
  unsure (1)..(268): unsure at all n locations
  Clone ID: PAT_TA_91547
agaactagtctcgagttttttttttttttttttttttttttttttttttttttttttttttttttttttttttcncttcaaaatgagctacngtaattaancagcgtgagccncttcttaattagtagtagtacgtaagtttanacgtcnaaatcaacaanactgccnaacttggctgtgcnccgtacncccaacgggaccncccatcnacngcaacccttgcaanatgcnactganagctacccatacaacagcaaaaaagaaaaag

SEQ ID NO: 91548 - DNA, 610 bp, Triticum aestivum
  unsure (1)..(610): unsure at all n locations
  Clone ID: PAT_TA_91548
tagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaantcgagaccctgtcctacttgccaccgctcagcacggaggcctcctcaagcaagtcgactacctggattcgctccaagtggntgcttgcctccnanttnaacaaggttgggtcaaccttccgttgagaaaacgcatccctggggtacnatnatggccngtactggcaaggnggaactgctagntcnggtgcaccgacccacnaatataannaggtnggaggagggcaagaagatacctgaccctattccgnatancggtttgacaaatcgcaangcatggncantnatgccttaacacgggtcaagatccgnaagcaaaaananagacaggcntttaatgcatgaattgtaaaccgaatgcttggntctccaatactctatttccaaaaantttggcagtagtcana

SEQ ID NO: 91549 - DNA, 597 bp, Triticum aestivum
  unsure (1)..(597): unsure at all n locations
  Clone ID: PAT_TA_91549
ccaaactcgaaaacccaccacgccacttctcccacccccctcccctcgctcgccgtctctctcagatcagatcggataagatcagagagggtgcgatctcgcggtttctgctggagacgtcggccgttccgcgaatccgaaggggccagattctccgggcgcctgcttcagccatgatgtcgcggtcgtataccaacctgctcgatctcgccgagggcaacttcgccgcgctcggcccggccggcggcggggcgcggcggaggtcgggctcgttcgggatgaagcggatgtcgcgggtcatgacggtgccggggacgctgtcggagctcgacggggaggacgagtcggagccggccgccaacaacagcgtcgcctccgacgtgccctcctcggtgtcgggcgagcgcctgctcgtcgtctccaacaagctccaatcctcgcgcgccgccgcccgacggccgcggtggtccttctctgggacnacactcgctgtcctcagctccgcgacgnaatccgacagatgagtgtctcntcggcgggtncgcgccanatccctcgcgacaagacagtcccaaggcttacacgctcgcnctccng

SEQ ID NO: 91550 - DNA, 592 bp, Triticum aestivum
  unsure (1)..(592): unsure at all n locations
  Clone ID: PAT_TA_91550
atcgggaagggcagaacggacccagcaccgcgcccctgctccgacccccccccccaccgacgccgcgcatcgccgcgtgcttcgacgcctctacagccgcgtatgccccctccctcgaatggccaaggcccacatcaccgagaactgccacgaccatcgcctcccccctcggttgatctacaccaccggccgccccgagcatctccggccacccccgcacctccccgagcgcttccccgacctccctacctcatcgatgagcaccgggaccccgatggctgccggtgacccccagttcgactacggtgttgacgacccgtccttcttgccagaggaaccagttgtcgcaaccagatgctggagcccaggagccagacgccaccgtcgacgatggctcctactacactggaggtgctactactacgtgcagcccgctgacaacggctaggagtagttaggaggatccaagcaagaggctgcgctcttngattgtatccagtttgngcaaccttcttaagnaaactgttaactagncgtaccanatattgtnctccgcgatctcaagatcacattgtatcngactaaaaaaaaa

SEQ ID NO: 91551 - DNA, 590 bp, Triticum aestivum
  unsure (1)..(590): unsure at all n locations
  Clone ID: PAT_TA_91551
ccaagatgattttcaaaaagggagatgacctccgccaggatcaattggtcattcaaatggtctctttaatggaccgattgctcaaactagaaaacatggacttgcaccttactccatatcaagttcttgcaactggacaggatgaagggatggttgaattcattccttccagcccgcttgcacagattatatcaagaacatcgcagtattacaagttacctgcaaaagttccatcctgatgaagatggtccttttggtataactgcccaatgcttggaaacttttataaaaagttgtgctgggtactccgtcattacatacattatggggtgttngagacangcatccaagataatctcctataagaaatgacgggtgccttttccaggtggacttcggtttaatccgggtccagattcaaagcanttcactcaaatgaaactatnnaagaaatggccaggcatnggtgganaanaagccatccatcaagatcaatctnangcgnaaacatanacatcttaggataaaacaaccttaacngatcctcncttgatggaaattagtatccaaaatccaccggggaatggacc

SEQ ID NO: 91552 - DNA, 595 bp, Triticum aestivum
  unsure (1)..(595): unsure at all n locations
  Clone ID: PAT_TA_91552
cttgaggtggagtcgtctgacaccatcgacaacgtcaaggccaagatccaggacaaggagggcattcccccggaccagcagcgccttatcttcgccggcaagcagctggaggacggccgcacccttgccgactacaacatccagaaggagtccactctccacctggtgctgcgcctgcgtggcggcatgcagatcttcgtgaagaccctcacaggcaagaccatcactctggaggttgagagctctgacaccatcgacaacgtcaaggccaagatccaggacaaggagggcatccccccggaccagcagcgccttatcttcgctggcaagcagctggaggatgtcgcacccttgccgactacaacatccagaaggagtccaacctccactggtgctccgcctgcgtggtggatgcaaatcttcgtgaagacctcaacggnaaagacatactctggaggtttaaactcnacacatcataacgtaaagntaagtcaagacaaggagggnttccccggacaacaacgcctancttgcggaacactgaggatggccnacctccngctatactcaaaagngtcancncactggggtcgcn

SEQ ID NO: 91553 - DNA, 251 bp, Triticum aestivum
  unsure (1)..(251): unsure at all n locations
  Clone ID: PAT_TA_91553
cgccgccgccgccatgcatcccgacgccacctccccctcccaccgcatcgcccgcgtcgccgcgcacctcaacccgacacgcccgcangatggacgagggcgcggngctgaggcccgcggtgtgccgcgccaagggcngngcgccggggttcaangtggcggtggtgggcgcggccgggggcatcggncagtcgctgtnctctgctcatgaagataacccgctcgtctncntgatccatctcnacgacgtc

SEQ ID NO: 91554 - DNA, 641 bp, Triticum aestivum
  unsure (1)..(641): unsure at all n locations
  Clone ID: PAT_TA_91554
ctcgtgccgaattcggcacgagcaggtccttccctagcacctgggaaggacctgttcaataccctgcgggaaaagcacgggcttgctggcttccagaagctgatcaaagagaagatagttcctctggcgggagacgtcgggactcgcaacttcgggctcgacagctccacatctgacgacctgtgtcaggagatcgatgttatcgtccatggggctgcaacgactagcttttatgaaaggtacgatgttgctttggcatcgaatgcattaggagcccaatatggatgcgaatttgccaagaagtgtcctaatctgaaattgttgcttcatgtttccactgcttttgtagctggtactcaagaaggactttactgggagaaagcactaaagatgggtgaagcattacggccggttgccacttggacattgaagctgagttcaactggttgagaagncaangntgaactcncanaagcgaanatggtggttaaaacaatcatccgngaagtagcatgaaagaactggctcaagaaggctgcaatttgntggcaaatgttatcattncaagggatggggaaantncttngcacaaagggaaactccttcctatatcaccacanggncanactncanatcattcg

SEQ ID NO: 91555 - DNA, 235 bp, Triticum aestivum
  unsure (1)..(235): unsure at all n locations
  Clone ID: PAT_TA_91555
ccgccggcaaccaacgccgtcnacgagaggttctcgtgcaccaccatcccatcttctcctcgccgcctttgggaatgcggngcaatgtggaggagcgcgcgcactgacctcgccggnaagcatagcctgcgcggcggccgcaactgccaccgcaagcacgtcnaggacgggtagatcgcgcgtcggcactcnccggtcggttcagtgcggggctcggggtccgggcccgcnggtc

SEQ ID NO: 91556 - DNA, 351 bp, Triticum aestivum
  unsure (1)..(351): unsure at all n locations
  Clone ID: PAT_TA_91556
ttgagattaaagggggaaaataaacccaaaccactcgccgaacagtacaacaacccccancccccatccccgccgcccctgaccggcgccatggccgccgccggagagcggcgcctcctcgtcggcctcctcctcctgggcccttatggtctcggcgcaatgcctggancgngcngggccaacaaaanggcccgcgcntnaaagcggcccccnaaaaaagcgngantttaactccccttnaaangtggtggnggnggcaanggngaaacccanattntacaaaatttccnggtgggtcccgcctncncgcccccaaaatatanngggttaacacgnaagggngttnaaaag

SEQ ID NO: 91557 - DNA, 310 bp, Triticum aestivum
  unsure (1)..(310): unsure at all n locations
  Clone ID: PAT_TA_91557
ttttttttttttttttatttcgcagctatcacttgcattttcttcatccatttaaactgacttcaaacataggattccaacatcanatcccaatccatgacagaagggattgctgcatcaccgacgaacacnaccgactgaaanataacacatgttgtttcttcctcgcgtaaccatgctcnaattaaccccggacagagcgacactcgagctcgcgatcaaaaacaccacatcgactgaacgacacatacnactcaagactgactgacacaggaacacgacgacnacgacactgaagataacttgctga

SEQ ID NO: 91558 - DNA, 614 bp, Triticum aestivum
  unsure (1)..(614): unsure at all n locations
  Clone ID: PAT_TA_91558
gtaacattacactactgtatggctacttgcttacttgtacatattattttattgaatgcaaacttcctaagaatcagttaccttagagtgcccaaacatagcccatgttaatgtttaaatgattgaagaatttcatacgcacattttcaacgtttctcttgataaatataaaatgcactgccgaggaaatgagtcaaaagactacatcaataattgactactaacagtagtagctggttgaagtattgttcatcatttatatggagaagaatcttctactgtaaaatcactggcacactgaaatttcaaaactaaacatgagacttaccattangtgaaactaattcatcactgcaatcgaacccaccatgatcacgatcacacgtgcagaagctgtngaatgttaanccgctttcatcaactgaagcatgacaaacacctttctgattacaattcnangcatcctgangagatatagacatatagtctgagaatttgaagtatatttggtgctgacccgaagcacaanntcctcctggatagaatagatgatcatgtcgatcctggatccgtacaatanatacgacngtacgcgctggccgctgcnaaaccac

SEQ ID NO: 91559 - DNA, 611 bp, Triticum aestivum
  unsure (1)..(611): unsure at all n locations
  Clone ID: PAT_TA_91559
gtcctggtccccttttctctcttattgaattaactaattcatttcctttttacttttggattttttttgatttgatttggcattattcaacaataaaaaaagaaaaatttcgacaaattccttttttttaattatgtgataattatgagaaccaatcctactacttctcctcccggggcttccacaattgaagaaaaaagtacaggtcgtatcgatcaaattattggacccgtgctggatgtcacttttcccccaggcaagttaccttatatttataacgctttggtagtccagagtanagacactgacgataagcaaattaatgtgacttgtgaggtacaacaattattaggaaataatcgagttagagctgtagctaagagtgctacggacgggttgatgagaggaatggaatgattgacacgggagctccctcaatgtccngtcggtggagctacnctggacaanttcaagttctggggaaccgttgacaattggtcctgtnatataatnaacttcccatnaaanattgccccgccttacaattannncaattaccacttgaaaggnataaggcgcattttaccctacccatgnggaaaaancattgg

SEQ ID NO: 91560 - DNA, 616 bp, Triticum aestivum
  unsure (1)..(616): unsure at all n locations
  Clone ID: PAT_TA_91560
tcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacangtgatnaacgangtggnagagtcaagaaggagtacctgaccctacgtccgcatcatcngatcacaacatcgcaagtgnatgctcaagctcatgcctcagcacgggctgcaagatccggaaggctaaagtatcacacggcaattaaggcatgcgtttaatcnaatcttggttcctccataactctgttgtccaaaaaagn

SEQ ID NO: 91561 - DNA, 153 bp, Triticum aestivum
  unsure (1)..(153): unsure at all n locations
  Clone ID: PAT_TA_91561
ctcttctcccctcccgcatccggtantagcaagcactctgcgtctctccctttatccccgcccgcatggntgctctcctccgcacggnggncgcccttgngaccccgnccttcgcctgcccgcnantccccgcgccggacgatgctctgcgtc

SEQ ID NO: 91562 - DNA, 631 bp, Triticum aestivum
  unsure (1)..(631): unsure at all n locations
  Clone ID: PAT_TA_91562
ctcgtgccgaattcggcacgagaccagcacagccgcgcatccaccgttgctagcaaggtcgaccaagcagcaccgagatggctgctgccttctcctccaccgtcggtgccccggcttctacgccgaccaacttccttgggaagaagctcaagaagcaggtgacctcggccgtgaactaccatggcaagagctccaaggccaacaggttcacagtcatggcagcggaaaacctcgacgagaagaggaacacggacaagtggaagggtcttgcgtacgatatctccgacgaccagcaggacatcaccagagggaagggcatcgtggactcgctcttccaggcgcccacgggcgacggcaccacgangccgtcctcagctcctacgagtactcagccanggactcaagaagtacgacttcgacaacaccatgggangcttctaatcgctcctgcttcatggacaagcttgttgtcatctctccaagaactcatgacctgccaacatcaaagttcaatcatcttggtactgggagnaaggtcanggaatcatccatncnactgtctcccaaatggatcaaccatcatatatgccgaaactgaatggaacccgnagcacaagnataggaantacgg

SEQ ID NO: 91563 - DNA, 188 bp, Triticum aestivum
  unsure (1)..(188): unsure at all n locations
  Clone ID: PAT_TA_91563
ngcgacgtgggggcgganggcaccacgtgcctcatcgccggcgccgtggncntcgcgctcgtcggnactgncttccccagcttcttctcncgcgaggacacgtgccccnatgtgcgacggngccgggttcgtgcgcacgtcngganctangntgcgggcgaacgcggccagnagggnccacagcgcag

SEQ ID NO: 91564 - DNA, 358 bp, Triticum aestivum
  unsure (1)..(358): unsure at all n locations
  Clone ID: PAT_TA_91564
gactgaaatggtgagagaccatcttgatacacgttttaaattctaagcctgcgtcggtgacgtagcatgaggctccctgggccgcagttttgcccgaatggattttgacagcagagctggatccaggggttggttggtgtttcgccccccacttaaatatgtacagctgtatatcaggaggtatgtaaattaggcaccctgatgcaatctaggaggtgtttggattanagagtggtaacgcaaatggtaagggaattagtcacgctggaaacggggatgtaatggacaanctctgttttgtttggtcatttccctgtaaaggaacaatggcgtcttcttccngcaaaaaaaaangagc

SEQ ID NO: 91565 - DNA, 669 bp, Triticum aestivum
  unsure (1)..(669): unsure at all n locations
  Clone ID: PAT_TA_91565
cagcaatcacaagccatttcagagataagctgggtcagggaggctacggttctgtgttcaagggtgtgatattgccaagcaatgttcatgtcgctgtcaagatgctagagggcaatcctaactgcaatggagaagatttcatcaatgaagtctccaccatcggtaggatccatcacgttaatgtggtgcgcctcatgggattctgctcagaggaaatgaggagagcactggtttacgaagtacatgcctcaaggttctctgggacaagtacatcttctcatcccgagaagatttctccttggggacaagctgggcccgaaatagcattgggcattgccaagtgggattgactaccttcatcaaagntngtgacatgcagatcttcactttnacatcaaccacacaacatcctcctcnanaacatttttccccaaaagtggctngattgggctcgccaaaacnataccaagggacacactttttgcaacgagaccctacgggaacattggnacatacccccgaataaccntactcggnttaaccacatcggngttaancttgggagcgctgcaaaatccgagaaaaganncttcaatcggaancacanctaacctcctgggngacggtatcaaaacanggtaanccccngttttacnatcancnggaaan

SEQ ID NO: 91566 - DNA, 300 bp, Triticum aestivum
  unsure (1)..(300): unsure at all n locations
  Clone ID: PAT_TA_91566
naangtccgggacaaatggcatggccattgntccagcagctcctgctcatcnccgccgncancactgcggcggcgtcttcctcancgannacgcctgatgggccggggccctggncggagcagttccacgcagtgctgttcangaacctgaccaacgtctcgattncntnaacgggcccgccgctccgcctgcatgacntgtactacnactggccncgnaggcgnaacctgaagctgatcngnnaccagctctcagggnacccnctgtacnatctgtagtggaacaacggcagcaggttc

SEQ ID NO: 91567 - DNA, 390 bp, Triticum aestivum
  unsure (1)..(390): unsure at all n locations
  Clone ID: PAT_TA_91567
cttctccctgttgctcctagtcaccgtccgtcgagctcgctggtgtgcacacgcgtacgcggacgtgcccgagctgcggacacgcgtccatggccatggnctcgacgccgcggctatttaagccctcccccgagccattctagcacaccagttaccctcctgcactcctctaggatctccccagtactagcccgacctcgagcangctctcctcgacccccatcgccgntatggccgccgcagccatcctctaaaattcggccaagtcgagctccctctcctccttctacagcancagcgctcnacccaatcctcgnaagatnctncccatcnactccgtcngtcggtcggactcacgtagccccaatctcatccaagnccgnaantctc

SEQ ID NO: 91568 - DNA, 565 bp, Triticum aestivum
  unsure (1)..(565): unsure at all n locations
  Clone ID: PAT_TA_91568
aacactatcaattttggtgcgtgaatgaccctgattcttgctggacctaatttatcaagtacatgcaatctctcgaggaaaggtgcattctcaatgaccatatcgtgaaacacctcaactgacagccttgggcggcacaagcaatgcacataaatcacacgtgcattcgccgaggtgatgtgggggctagtaaacccatccatcgcatgaagatgaaggtactccgagcactatatagccgatgagcaagcgctcctaancctccttccgagatgtgcatgtcaaatgagcaccaaggtgcttaatttangggagatgcagagancgccttggcatcaatcccggggaaaaatgcacttccctgaatgtacatggtgcancgttggcacaaggaagacgccgacngcngcacnagcgtaaggccaacatgaagntgantcccccnaggagcacggacttacgncccgcgtccgaattcancccnttcgcccaacggcgnnaggcggaagacttacacacanncntcatcggagctcccctnnancgacgggaggcgatcccctcg

SEQ ID NO: 91569 - DNA, 224 bp, Triticum aestivum
  unsure (1)..(224): unsure at all n locations
  Clone ID: PAT_TA_91569
actctctctaaggaactcggcaaaatagccccgtaanttcgggagaaggggtgccccctaggnantctctacctacccacctgtgtcggtttcgggtacaggtacccttttgttgaaggncgntcgagcttttcctgggagtatggnatcagttacatacttcaccgccgtngngcctggtagtcancctcngtgccgaancaatcgctatnccacggggctca

SEQ ID NO: 91570 - DNA, 217 bp, Triticum aestivum
  unsure (1)..(217): unsure at all n locations
  Clone ID: PAT_TA_91570
tggncgcccatgcagctctcnccgccacccgcatccccaccagcgcccgtctgcacagcaangccgcctccaagcatagggtcnacttcgccganttctccgggctgangncggggtcgtgctcngtcancgccgcngccanggangngtccttctccgangtcctcggagcccagctcttcgccagcgcttccngngacaacaccgttnganagcc

SEQ ID NO: 91571 - DNA, 365 bp, Triticum aestivum
  unsure (1)..(365): unsure at all n locations
  Clone ID: PAT_TA_91571
agtgancctctagttgactagctcgntgatcatcagatggtcatggtttcctgactatggncattgnatgtcattgnnancgagatcacancattagtagaatgatgtgatggncaanacccaatcctanacatagcacaagatcgtgtagttcgtttgctnaagcttttctantgtcantgtatcagttccttggnccatgacgattgtgtaactcccggataccgtangagtgctttgagtgtnccanacgtcacancgtaantgggtgactanaaaggtgcactacangtatctccnaaagtgtctgttgggttggcacgantcaagactgggattngtcaanccgttatgacnaanaagta

SEQ ID NO: 91572 - DNA, 666 bp, Triticum aestivum
  unsure (1)..(666): unsure at all n locations
  Clone ID: PAT_TA_91572
aaagatgaccccttcttcctatatattaccaaggaaaagtaatccttcttttataggcgaaattatattggattttatatgtatataattccttaattatatgagaccaaaaagaagaaatgacacgagggttctatatatagatagagaaagaaagaagaagaaaatagaaagaacaagaaaattatgatgtggaaaagaagacaggaattgtgtacaatgggcattgtacaacaatttaattggaaaagggatgtagcgcacttggtagcgcgtttgttttggggtacaaaatgtcacaggtcaaacctgtcaccctacctatactccttcctcctttaataggaagtagcgacgaattaattaaantaagtgggtaaacttgaattggtggaacatacgtacgtgagaacattaggaatagaaaaattccttttggatgaatgaacccctaatcnattcggtanacccggctccaaaccgagctagtcaaacccanagncgngtccancnacttagncaacaanttaatactnacaaatgatgtacccattcattngcccccncggcngagngcacaaaaaatgccacaagtcatgtccaccgntgatacatccataacccataaggattgcaacatcataaantcccattcttcgggaaaag

SEQ ID NO: 91573 - DNA, 470 bp, Triticum aestivum
  unsure (1)..(470): unsure at all n locations
  Clone ID: PAT_TA_91573
cgccgtcgattcgaacctcccccaaatcagcagcagtcgaccggaggcgccgccatggcccgtaccaagcagaccgcccgcaagtccaccggcggcaaggcgccccgcaagcagctcgccaccaaggcggcgaggaagtcggcgccgaccaccggcggagtgaagaagccccaccgctacaggccggggaccgtggcgctccgggagatccgcaagtaccagaagagcacggagctgctgatccgcaagctgcctttcnancgcctggtccgctagattcgcaggacttcaaganggacctccgctcnatcccacgccgtctggccctccangaaggcggcccagcgtactctncggcntttnnaggacacaaactgtgngcnatcaacccaancgngtcancatnatcncaaggnatnaactcnctgcagatccgtggngaanggctaactnccnnccgtgaacacgta

SEQ ID NO: 91574 - DNA, 410 bp, Triticum aestivum
  unsure (1)..(410): unsure at all n locations
  Clone ID: PAT_TA_91574
catantacanccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcatgtcgactacctgatccgctccaagtgggtgccttgcctcnaagttcagcaangttgggttcatcntcngtgagcacaacgcatccccngggtantntgatggccggtactgggaaatgtggaagtgcctatgttcggggtgcacgacccacacanntgtnacgaaggtgg

SEQ ID NO: 91575 - DNA, 289 bp, Triticum aestivum
  unsure (1)..(289): unsure at all n locations
  Clone ID: PAT_TA_91575
agaacctgcagcatggctggctactgcggcttgtggctggcggtttattagccaatgttgttggagaaattatacttttgccattcgttcacagaatgatcaagataaggtaaacaccatcatgaaaatagaatgctacccgcctgcttcggcctgactttgtacattagaatagcatcgacagcagattcatgacgtctgaattggccaaattaacctgcgtgtcaaatactggtttgaatttcatgctgatgtatctgccatccaaaaanaaaanaaaaaaaaaaaa

SEQ ID NO: 91576 - DNA, 655 bp, Triticum aestivum
  unsure (1)..(655): unsure at all n locations
  Clone ID: PAT_TA_91576
atagcattaaaagcagttttaaatgtgtgtctctgtaacttcatctgacaaggacgcagtgaagacatttgacatgtttcaacagaatgcatatgactagatagacagaatttgaggtagaagcatagaaggggttagggtccgatcacattcacttagttcaagaaaatggcaagttcgaatacatagctataattgaatgctgtagaggacagaacacacacacacacacacacacacacacacacacacacacacacacacacacacacacatatatatatatatatatatcangaaaagaccaatcaacattgcgaagatgaaccttgaggaaaatcaatgttganggagaaaccantatgaagataatgcatccatgacccaaatgaaancttngagaaatttggnggggggttcccaccatatagaatattagccaaacacggcacattacatgggctccgaatcaattccacttaagtatcacacttagngnaatntcattaatgaagatatcgtactcgtgnttgcacancaatcacacancatancgtagantcgccatcaaggcatcnggtcnaganttancncctacttaaacctttcaacagggttgaaaaacgcattcctattnctanganagtctcccaga

SEQ ID NO: 91577 - DNA, 433 bp, Triticum aestivum
  unsure (1)..(433): unsure at all n locations
  Clone ID: PAT_TA_91577
ctctaatataatttgtacatgtagtacttgcgtggatacatttacacgcattcaacacctgaaaatacatgcaaagaaaaaaaaactcaactgaaaaataaaaaataaaaaacgaaaacaaacatgtgcagaaaacaaaagcaagcacaaggagaaaaaaaaacatacacacactaaaattgagatgcatttcatacatgcatgtgcgtgcaagagacacgaattggngacatgcntgcatgcnanggaacccatcctgcactcaagcaaggatagacagaaaaatcgactgaacaagtgacangatnagtcgacctcctacacatgtntccagtcncaaagcactttgatcaacgggcacaaatttgnctgaccagnaatngaaaactcnatcccctgantgttctnanntgaccggcatgttacggagaac

SEQ ID NO: 91578 - DNA, 642 bp, Triticum aestivum
  unsure (1)..(642): unsure at all n locations
  Clone ID: PAT_TA_91578
atcagatttacaatggacatgttcttctaagttatttggttattgcagaagaagtgttgtggtgagtcacgttccattccactcgtatgtatagccctggtattaattgtatgcagttatatcgaaccaaccatagtacacatactttcggcactaccgaagggggcagtgtctcgttcccgcccatacggcgcgccggtcgaacaataaagttgtgaggtcaaatcgaccttatctcatgtaccgtcgtactgctacatctttgttggagaggagtgcatggttcaatgtgatatttgactcacccgtgaactgcacaacactctggacagcaaggcatgggcgccatggcgttgtaccactccactctaagggatgcatgtgttctataattttaatactgtcaccttccctctctgatcaactccatgccatgcactccttttgacatgaactggntaatcaacgctccattgggatacattaatcactcgtataatgtgaatccgtttgccatgtgtncatcaaaatcataagggcattcacactgaaaatcatccacttcctaacgttcccatgaaacatcaaacaattcatccatcaatagctcctcatcctnggcaatccactnagnaanactta

SEQ ID NO: 91579 - DNA, 261 bp, Triticum aestivum
  unsure (1)..(261): unsure at all n locations
  Clone ID: PAT_TA_91579
gagagagagagagagagagagagagagagagagagagagagagagagagagagagagagagagagagagagagagagagagagagagagagagagagagagagagagagagagagagagagagagagagagagagtttttttgggcanccaaattttcatttcgtcctcgacagggaatancacttcatccggtaagganctncatancacttancagttcagactncatgaacgcccatcanaggatgncactacgcgtc

SEQ ID NO: 91580 - DNA, 628 bp, Triticum aestivum
  unsure (1)..(628): unsure at all n locations
  Clone ID: PAT_TA_91580
agttctcggacctcaccagcgaagagttcacggagaagcacctcgggtaccgccaccagcacggcgtggacagcacgccggtggccgcggtgaacatgtccaatgctcagttcgactccacgccggacagcgtggactggagggccgcgggtgccgtcacccaagtcaagaaccaaggctcatgcggttgttggtgggcgttcgcggcggtagcggcgacggaggggctcgtaaagatagccactggcaacctcatctccatgtcagagcagcaggtgctggactgcacgggcggcgccaactcctgcaacggcggcgacatcaacgccgccctaagctacgtcgcctcgagtggcggccttcagccagaggaatcctacgcgtataccggccagcagggcgcgtgccgcagcacagcgccagcccaaactcggccgcctcatcggcgcccccgaatggtggaacncacgcgacaangcacttcaggactccggcanaanccgtggcgtgccatggaggctacctgactcaacatattagggctntcacggaactctctgtganaaactaacacgnttacgtgtgggcncggacgaacggggnagctcggtgtaanaaaatggggggg

SEQ ID NO: 91581 - DNA, 418 bp, Triticum aestivum
  unsure (1)..(418): unsure at all n locations
  Clone ID: PAT_TA_91581
caaacatgtggtataatggcgactgcttaacatggaaaaaaagaggcgaaacgatgaactcaattcttcatttcaaaattagcacatcttcatttcaaatgaaattatgttgtttgtgcacacgagcgcttagaggcaaccgtttgcataggcctttccgccggcaaccaggatattttctcacccttttcacctaggccgccaacatccacccccccaccgcccgcccgcgtgtcactcaattagtccacccaatctccatcgccagctccccctccccaagatccactgcagaaccctctccggcgccggcgtgctctacctagccgtgtgcctgcccttcagcgtcaaccctanctccactgtcattcacaangatgtgggtgcccgcgcctcgcatcntgtttgctcgctagcc

SEQ ID NO: 91582 - DNA, 552 bp, Triticum aestivum
  unsure (1)..(552): unsure at all n locations
  Clone ID: PAT_TA_91582
gagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcnacgagccccgaaatgtggcgctgcgcggatatgaaatccaccgtcgacggcacctgcggtgggccctgcaagaagtactgatcggctcatgccagcatgatatttccgcctaaaatgaaataaaagctcagacgagatgagcanngtcatcgtgcctaagcntgtgtgtgtggcaacanatatgttacaagtatgcctgtcttcgtcgcgtgtttccccccnagaaaaattgggttctttgttaatatccggataccncgttaaaaantangattgncntggggaaaaaaaaaaaa

SEQ ID NO: 91583 - DNA, 590 bp, Triticum aestivum
  unsure (1)..(590): unsure at all n locations
  Clone ID: PAT_TA_91583
acgattgatttcagcagtgagaggacacacaactactttttggtccatcatgccattactatgttctaccgtattcaatttgttgtccagttcaatgaacctgcacaaggattccccaggaattgcaacagtgcgaaggagctttggaatttgctataatgtgttgattgtacttcatatgttctgctttacaggtgatgtatcccatactctatattataagtacaatagtattgccttactttggaaggaatgcagcgcattcttgtaatataaaatgatttatgtattgcacggtacaaaatgtaacatcacatgtaagatcactgtataaataatgtattggcacaaatcccgtgcgtacaacgggataaaaagaaaaaaaaactcnagggggggccggtaccaattcccctataggatcgtattacgcgcgccaacnggcgtcgtttanacgtctgacgggaaaacctgggtaccaacttaacgccttgcanaaaccccttcgcaactggctatacgaaaagccgacgatgcctccaaaatncnaccgaaggcaatggaccnccgtacgggcatanccgcggttg

SEQ ID NO: 91584 - DNA, 607 bp, Triticum aestivum
  unsure (1)..(607): unsure at all n locations
  Clone ID: PAT_TA_91584
agtcaatatatgagtttttgtaatccactgctggtttatgcctgcttaatcatgccttctgtgactataggccttctggtctataggcgtgtggcggctgtctcgcttangcctggtctcggggcgtgacaccatgtttccagccttcaccggctaaactcggccaacattgcgttcatcccaaaaaaaagatggggcggacgacatctcagactttcggcccattagtctcatccatgcggttgctaagatcatcacgatgatgatggcatgcaactcatcttgcctccacatgtcagcgctcgtctctaacacacaaagtgcatttatcaagaaaaaanatccatgataacttagtatgcttgcaacttggcatatcgtcttcaaccgaaacaatctccaaccttgatctcaagtagatataaaaanctttgacccgtccanatgggacnactnacggcctactagaanaacncttcaagcgatcaaattgggnttcggncnctcncacggtcaaaaaagtccccaangggntgaggancaacaataggtgntntaaaggaacctttcccaantggctnattacccccanaatcncaanntaaaa

SEQ ID NO: 91585 - DNA, 559 bp, Triticum aestivum
  unsure (1)..(559): unsure at all n locations
  Clone ID: PAT_TA_91585
ctcaagccggacatagttcggcaagggtctcctgacaaagagagagaccttaatgaatttagtacgtcgcccaggggcgagtgctgaaagatatccgtggagaaaaactccatgatcggtgcccactcagtttcgataggcacggtcgcgggtggttcggagcccgtggccggggacgaatccaagggttcaagcaacacaggctcataagggataaattagtattccggtctatccgcccgctgagtgtgcggctcccgtnggcggntccatccactcctcctcctggacggcgcatctgctccagctttaagggccggagtaaatacatgtgtgatctccccgaacaccgtccgacgacagactaatccatgctcatcctgacacgcggtgcgcctgacatggntccanccgtccatgnnaatctccccngtgtcngcattatattcaacttcaaactggcctgatggcaagggctacccgattgctcaaatggcaaggagttggccgcagtacnaancgcnaatacaagatcgtccggggaagaaacctacctgat

SEQ ID NO: 91586 - DNA, 345 bp, Triticum aestivum
  unsure (1)..(345): unsure at all n locations
  Clone ID: PAT_TA_91586
gcggctcgcaggagaaacagttcgcagctcgaagcaagtcaggagtccatgcatgtacagtggttacattccctccatgcatgtacaatagttatacttccttggaattttgctggcaaggagtagtagttgagggctcttcncgtggaggttcaatggggaatccatcaagttaaccccgacgcattaaatatgcaactcaataatcctcctgtgcgtcaatgtcctanaactgggtcaaccaaagaactatgcccgccggttgacaaaccaacaagcgactcctggaacaaangcggtctcaaacaaaagacggagggcnacgacacatcccaaggggggggg

SEQ ID NO: 91587 - DNA, 340 bp, Triticum aestivum
  unsure (1)..(340): unsure at all n locations
  Clone ID: PAT_TA_91587
ngtgaagggtctggcagaagctccaatggntttggcacctctgatttcggcagaccaggcagcattaaggattaaccaatggntcagaggatttaactgtgtacagctccgatgagcctttcgaccactcgtgtttttcttgcatgaatgagttcaccantctctctgtgtaatttgttttgtatcttgggttgtttgagaagatgtatgctttgtgaatatttgtgatgtttttangacanaataattgcgatgcatgcgcctggtgctcgttgtaattcntggggaaacactcatcttgtgccctcattgaaagtttgggctgggcgccatttcaaac

SEQ ID NO: 91588 - DNA, 605 bp, Triticum aestivum
  unsure (1)..(605): unsure at all n locations
  Clone ID: PAT_TA_91588
gcaacgtcagctccgattcgccggcgacgcgcgcggcaggatggctccgtacctgctgaggtccgccgttgccatccttcgccgacctaccccgccgtagaccttcctccgccgctctcccatcgacagctcccggttcttcgcctcgggtggagctgtgagggtcgaaccccgcaaaaggagctacagctttaagggaattccggtttggtggnaanctgaccacaacaggaagggcactacaattaccaaggaggcctacttgggaggagatatgaaataagatgaaaattatgatacctccttttctcnaattcctcnaagggaancaacaaccaatggccttcaacatggcacaaagagagaatnattcagantccccaatanganatggacattgctcaacaacctctttgttgcaactgcagtgatccattccaanacctagatataaaaccgaatgacatagcaggatacaagacaccgaagactgaacagggaagataaacatttcaagagtataaagaagagggaactganagacncgatatgngganaccgnctccgcaaggaaaggnctaaggaagttcggaancgnggaactg

SEQ ID NO: 91589 - DNA, 532 bp, Triticum aestivum
  unsure (1)..(532): unsure at all n locations
  Clone ID: PAT_TA_91589
acaacgtgaaggcgaagatccaggacaaggagggcatcccaccagaccagcagcgcctcatctttgctggtaagcagcttgaggacggtcgcaccctcgctgactacaacatccagaaggagtccaccctccacctggtgctccgcctcaggggtggtatgcagatctttgtcaagaccctcaccggcaagaccatcaccttggaggtcgagtcttccggacaccattgacaacgtcaaggcgaagatccaggacaaggagggcatccccccggaccagcagcgcctcatctttgccggaaagcanttgaggacggccgcaccctcgctgactacaacatccagaaggatccaccctccacctggtgctccgcctgcgtggtggatcagtcttcgtgaaagacctcaacgggcaagacatcacgctcgagtcgatcttcnacacattgacaatgtaaggcanntncaggacaaggggggttccacggacaacaggtcttatcttgcngtaacacttaggatggcgcatctgg

SEQ ID NO: 91590 - DNA, 553 bp, Triticum aestivum
  unsure (1)..(553): unsure at all n locations
  Clone ID: PAT_TA_91590
atggcaatcggggtggttctacatcaccgagccgcacgaccctgcatgggcagcggcccccgagttccaatctggcatccccacatggctcacctcctagaaagagaagggcctgtcctggggtagttcgggagagctgaccggactccgaaacatgtattcaaaaacatggtgaacaagaactccaaatcgtcaacgttatctangtcatgctccaccgccggttctccccgtgccaaacaatgggacttcaacttngtggganttcgaccccggcgcaanaccgaatcctgaacagtcctttngacacaatccactaagatcctggagggtgctgttcnaaancgcgaattcccctccccattattgangatncccgattcaagcgcgagcaccaagccatngcgnaagcgctttacttcaacaaggnattatttttaaaaatggacccaatcggattaaancccataccttgacaaggacgggtaggaatggcggacatatcaatgtcgggtctttgtcgaaggccananacgctctctgaaaatgccna

SEQ ID NO: 91591 - DNA, 656 bp, Triticum aestivum
  unsure (1)..(656): unsure at all n locations
  Clone ID: PAT_TA_91591
ggaaaccacccctgcccacgacttaaccccctggccccgcccctcagcggtagtaccgtggtgaggggcggtagtaccgcttagccgtataagtggtagtaccgctctgttgggcggtagtaccgctccttcacaacggtagtaccgcccagcgcaactccaaccagactcaacacacattgtgcaaaacgaaagacgggaaacaacggcaagaagaccaacaagagcactagcaagagaacaagaatcacacacctctatacgagagggcggtggccgaggccacctatgtttgagtcacttggtatggcaccgcgaagaactatccttgggcccatgaccaacgctcgtctttgaagcacaagtaccatcaaaaatggctaatgtgaaagagtgagatcagtttatcattgtgggggcagggaaagtcattgagagaacaacatccccctactcatcctacacctagacaagaaacacagtgaatgtnagggtgtcaaaggtcaaacacattctcaatcaanatattactcatgctaactcgcaatctgctcatcaatggctctgaaaatactcangtttcatatgttncatattactcatncactcgccaaatatccgtgaatgnacaatccatncttgctnatttccggttg

SEQ ID NO: 91592 - DNA, 174 bp, Triticum aestivum
  Clone ID: PAT_TA_91592
gcaggagaggatgttgctgcttggttgctttagaatcgtatgagataatctattagacaaatgcgtcaggatgacattttttcattaatttgttacatggatatgtgtaccagataatttgcgtagcgacccgattggctacatgaagatgtttaacttaccaaaaaaaaaaaa

SEQ ID NO: 91593 - DNA, 332 bp, Triticum aestivum
  unsure (1)..(332): unsure at all n locations
  Clone ID: PAT_TA_91593
ggaaagagagcagagcttctgctgcctctcctcgtccaaggctcgagctaacagtcgccggcggccatggtcgctgccgtgtcgcctccgggcgcggcgggagcggcgacgatcatcgcctctttccacggnacccactgcgcgtccccgtcccgcgccgcggcgcccaggccgcggtaccacagcagcncctgctgcttcgccgcnaagcccacgccggcggccgcggtgtcgtccgaaccggngcaagaccacgacctgnatgacnangggggttcttcgcaccnccaatngagcggaacgccangccgtccacgcggtanaagcgccgt

SEQ ID NO: 91594 - DNA, 632 bp, Triticum aestivum
  unsure (1)..(632): unsure at all n locations
  Clone ID: PAT_TA_91594
gcctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttatcttccgtgagcacaacgcatctcctgggtactacgatggccggtattggacaatgtggaanctgcctatgttcgggtgcactgacccacacaggtgatnaacgaggtggaggagtcaagaaggattacctgacncgtattccgcatatcggatcnaaaaatcntcagtgaatgctcactcatccctnaancacgggtgcaagatccggaagctaaacactcancacacagcatttaatgcatgaattttaacccgantgttggttctccattacttctatttcaaaaaatnngtcagtcagtcn

SEQ ID NO: 91595 - DNA, 607 bp, Triticum aestivum
  unsure (1)..(607): unsure at all n locations
  Clone ID: PAT_TA_91595
ttggntgtatactttggagatttaccatgcaacatcttttcacctagtagtagtactactactggtttatgtatagccatatacatttagtacctattgcaattttcatttctaagatcaatttggtatcccaggtccttcaacactgtcttctttgttcctgactataaaaattgatgcatgtgccctgttctaaagtggaaaatcattgatagcttgtactactcatctgttctgttaacttgcactgtgctggtacttgtcatttgcaaaatacatctcaattttcgctgttatgagaatgtatatgcatggtttcgtgttaaatctgaagttctacagcaaatttcatcgttatgagaattttatatccatggattaacttgantangttncaattttcaaanttataattgcanatgcnggttcattctcaaangttgggggnnaanagcccaggaaganaaccccnagnaaaccacacatcaagcgtttnaccacnggagaantngtgtgnaaccaatnagtgaaataagtggantttaagcnnatacanatgccnagctgggtgtgtnnaaaatacccnatggncgctnaacaatattng

SEQ ID NO: 91596 - DNA, 622 bp, Triticum aestivum
  unsure (1)..(622): unsure at all n locations
  Clone ID: PAT_TA_91596
gagagatccaatctcggaggggctctcgcccctcccatgccatggaggccatggaccagaggggaaatccttctaccatctagggaggaggtcaaggaagaagaagaaggaggggggctctctccccctcgcttccagcgtaatcttcaccaacaacttcaccgccatcatcaccaattcttgccccctctatgcagcggtgtaacctctctcttacccattgtactatctaattaaacatggtgctcaactctatatattatttccaatgatgtatggctatcttatgatgtttgagtatatctgttttgtcctatgggctatttgatgatcaagattgatttgagttcatgttttattattgggtgctatcctatggtgctctctgcgtcacgcaagcgtgagggatcccgctgtagggtgttgcaatacatttacgattcgcttatagtggggttgtgtgagtgactgaaacacaaaccgataaggggttgttgcgtatggataaaaagacttgttgcttaagcnangtgggttacttaagatcttanagtntgatgctgcaaattcatcataatgatatatcagttagaatattactagccccccaaaantnataagg

SEQ ID NO: 91597 - DNA, 622 bp, Triticum aestivum
  unsure (1)..(622): unsure at all n locations
  Clone ID: PAT_TA_91597
aancttggtcgccaagtttggccacctcctanaaggccattagggctgatctcctggggnttagggtttcttangagggtgtttaagctcaataaagatcaaggctaaaagcttaggggaaaatgcaattgttgtacaaaatgcatttctggcccagaagtgaaaaaaatttctacagcaaaaatattacaaaaagttatgcaatatttttgcatggaaagatgtgccatggtcctaagaatatttaggaattatctcagattgttttgagcaagaaaaattgangttgctttgnagcacaaagttctgaaatgaacttagnagagaaaaagaatattttccttaaaggaaanntatcatttaagaattttgggaatttntgggagggataagtgggataggtcacttgggtnaaancaaggatattccaattancagtccatttaanttntccaaaatccaaatcanccangggaaaaccacgattanaccaattccgganngaaaagaggaaccccggtaaaananacaaggaanccaggcttaaaaccncccatttagganatccgtcccaggggggccggacnaatnccccaaagnnnctatccccnncacgcctttt

SEQ ID NO: 91598 - DNA, 618 bp, Triticum aestivum
  unsure (1)..(618): unsure at all n locations
  Clone ID: PAT_TA_91598
caggagccttatggttgtcattttattatatgaaatgcaaatgccacgtagttgctttactttatcactatgcattagcgataattgtagaagcaatagttggcgagacgaccacgatgctacgatggagatcaaggtgtcaggccggtgacgatggagatcatgacgatgctttggagatggatatcaaaggcacaagatgatgatggccatatcatgtcacatattttgattgcatgtgatgtttatcttttatgcatcttattttgcttagtatgatggtagcattataacatgatcccttactaaaatttcaaggtataagtgttctccctgagtatgcaccgttgcgacagttcgtcatgccgagacagcacatgatgagtgggtctaataagctctatgttcacgtacaacgggtgcangatagttttgcacatccgaatactcgagggggggcccngtaccaattcgcctatntgatcctatacgccnctcacggcgtcgtttanaantctgacnggaaacctgcgtaccaactaatcgctncanantccccttcgcactgcgtatacgaanagccccacgntgcctccaaagttncaccnatgnaatgga

SEQ ID NO: 91599 - DNA, 298 bp, Triticum aestivum
  Clone ID: PAT_TA_91599
gaacggcggcaactgcggcatggccaccttcgcctactacccaaccatggacggctcttaaacaccactactactacatcagttggtccatgcatcatagaatatggtttatcagctataagctactagtacgtacaataccagtaccatgcaacatgcatgcagctgcagtacaacatatatatggattttttttttgaataaagcatggatcgtctagaaatgatccatttgcctatgtaatatataaacttgtatatgaaaaaaaacactactagtactaaaaaaaaaggggggg

SEQ ID NO: 91600 - DNA, 642 bp, Triticum aestivum
  unsure (1)..(642): unsure at all n locations
  Clone ID: PAT_TA_91600
cgggatcgctcgaggcctgcagtacctccatgaagactcccagctcaaggtcgtccatcgcgatctcaaagccagcaacgtgcttctcgacgccgatatgagccccaagatctcggactttggcctcgcgaggctcttcgggcgaggccagacgcagggggtcaccaaccgtgtcatcggcacatatggatacatggcgccggagtacttgatgcgtgggaactactctgtgaaatcggacgtgttcagcttcggggtcatggttctggagattgtgacaggaaggaagaacagtgacacctcgcaatctgaagatttgttgaccatgatgtgggagcattggacggctgggaacggtgctggagaagatggacccgtgcatgaacaacagcttctcgggagagcgacgcgaggangtgcatccaagtagcgttgttgtgctcaaggagaacccggggacagccgatgatgtcggantgggcatgatgattggagtaaanatgtcctcggtgcccgtcaaagcggttcatgctcanacaagaactcgtgccgatccggaacggtaatanttacattcatgntgtgcccaaatcgtngttacgagtaatccaccaaaaanatggganactccattaaaaaaaa

SEQ ID NO: 91601 - DNA, 610 bp, Triticum aestivum
  unsure (1)..(610): unsure at all n locations
  Clone ID: PAT_TA_91601
gtcgcctcctcctaaaccactctccctatccccgtgtccagaatctaccccccggctccaatggcggcgaaggaaccgatgcgcgtgctcgtcaccggcgccgcaggacaaatcggatatgctcttgttcccatgattgccaggggagttatgcttggtgcagaccagcctgttattctgcatatgctggatattgaatttgctgctgaagctcttaaaggcgtcaagatggagttgatcgatgccgcatttccacttctcaagggagttgttgcaacaactgatgttgttgaggcttgcactggtgtgaatgttgcggttatggttggtggattccccaggaaggaaggaatggaaaggaaggatgttatgacgaaaaatgtttcaatctacaaagctcaagcatctgctcttgaagctcatgcagcccccaantgcaaggtttggtgttgcaaaccaacaaacacaatgctccatcctgaaggatttgctcaactatcctgagaagacacagtttttgaccgcctaaacacaacaggnatcgtcnattcnanaactggngcaattttgacgtaanatntataacngggaacatctcatcatanctang

SEQ ID NO: 91602 - DNA, 642 bp, Triticum aestivum
  unsure (1)..(642): unsure at all n locations
  Clone ID: PAT_TA_91602
ctccaggccatccagtcatcttgctgttctctatgctgacactctcagccacggctgtgcagaaggagactactccagagcgtcgtgtccagtcgcaggaggagatctcggctggcgaggcttactcatctgtaagttcgctctgcttcggcttcattcgttttttctttctttcggctacttgatttatttgtgaaacatggatcattgtggtgagcttcatcctaatgttgatgagggtgcgtcctgccatcaatctgacaccttctcctttgtccagctgaagaacttgttcaatactgtgagagctcaccactccaacctcgtggagatatccacaaagttgaacgacgagaacaaagccatcattgcacgtcttatggatgagaaggcgcagctcgaacttcancgcgacaagttgaanctggatcatacgttatgaaaaaacagtngaggaacttccgccgagtaaccaaaaaagaatctcccggactaatagacagtaccacctgatccccgtancgaactataacatgcacaaagtcctatttgctgngtactcggnanatattgaaaaatgnttgctccggcactcatcaattaggtaanattaaataagtangcatcnaaacttttaacagn

SEQ ID NO: 91603 - DNA, 280 bp, Triticum aestivum
  unsure (1)..(280): unsure at all n locations
  Clone ID: PAT_TA_91603
ctgcagccccnccgttctcgggctcacnggcatcgagnggcgggctgtgggaggaggtgnaccagctcgtctgaangaggagggtgtggtgactaantgatactgntgcancggcagcatatactactactanttgcnacgtagaaattgtanattagatttgttgtgaaaaatgcttcacaatatgattaatttcccnanaattttanancttacattacgtgtncacatactgacattaaanctngaactttctcntcacgaagtgtgaattantcca

SEQ ID NO: 91604 - DNA, 608 bp, Triticum aestivum
  unsure (1)..(608): unsure at all n locations
  Clone ID: PAT_TA_91604
gtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcangtgtggcccattgagggcatcaagaagttcgagaccctgtcctacttgccaccgctcagcacggaggccctcctcaagcaggtcnactacctgatccgctccaagtgggtgccttgcctcgagttcagcanggttgggttcatcttccgtgagcacanngcatcccctgggtactatgatggccggtactgggacaatgtggaanctgcctatgttcgggtgcaccggacgccacacaatgatcaacgaggtggngnaggtcaagnangnataccttgacncttatgtcncatatcgatcnaacaantgnccaagtgcattgcgtaagttaacccctnnaagcncggttncgaggntccggaaggctaaaantcatcacgaanggccatattaagtgcatgattttgtnacncggaatnttgggttcctcccaattacttctnatngnctaaa

SEQ ID NO: 91605 - DNA, 624 bp, Triticum aestivum
  unsure (1)..(624): unsure at all n locations
  Clone ID: PAT_TA_91605
aacatgggaacaagagtgcttaggtttatcccgaacaccccagcactcgcggcatgggggcagaagccgaggactagccatctctcagattggataaacggccaaacagaaggtaatattttaaattcacacaagcgttgcatagcgcatatgaaacaagttttcatcatacaggatcacacgagcaagtttactcaaatattacatccttggaacattcgtccgctacaagacgggcacccttcaggacaccctcataataaatttgggggggtgcgatgctctttgccctgtggcggcccttccttgatcagcttcacggcgtctagcttggccactgcacctttacatgggcgaaagccggcgtgaaccttcgatgcaaaacggaccgcttgacgacctccagcatgggcaagcatcaacaagccgcctcaacaaggctgaagtactgttcngaaggactcnccaggcacagcggacataagccctcaaggctgttcggcgcctgtgcactcgacagctgctttgcnggtactaaaggatcggtgtcggtccaatntcnggacaaananttaccttgggntcccctcgcctggaaanntgcggatcgancccgcgggaatt

SEQ ID NO: 91606 - DNA, 656 bp, Triticum aestivum
  unsure (1)..(656): unsure at all n locations
  Clone ID: PAT_TA_91606
ggggaacccaaaactttttcaaaaagaaaagcgaaagtgagaaagacgagcattattaaagtgggagctatccttgaacttggttcatgctcacggaaactttgtgaatcttgattacagaaacttttcaacaaaaataattatcccttgtacaattccattatacaataaaaataatgtgccaaggtttttcttttggatgtttacaatgcttgttggtttgtgcggtgcaggacanaaactttggctgtaatgcgcgattttacatttttttacnggaacatcaaacggttctgaaactttttgcactacctttcnatacaatttttttatttttcctaagtttttcagaatttttggagtaacagaaatatgttgaatgttcatattactacagactgccttgnttaagacagatccgtttttgatgcatagttgcctgttttgatgaaactattantttcaacantggattaagccatggaaaggttnnctacatanctanaatcancannaatatgaatnggttgaacancacttagntaggngtgctnatancaacgtntaagaacttccggtanttgtngnataantgtcaantcagnacctccaactaggagnggagcaaaaccnagctggagccaggacccagaang

SEQ ID NO: 91607 - DNA, 639 bp, Triticum aestivum
  unsure (1)..(639): unsure at all n locations
  Clone ID: PAT_TA_91607
gatatcgagaaggtcatgcacttcatataatacttcaagcctatgcactacacaccatctaagttcatacaacgctgatacaaaagaaaactatctaggggttagtgtagatatagtcacatcattaacactacacgactgatttgtagtgggtgcttctttgtcccccgtgaaatatgccgggtgcttaggcttatctacgatcatggtcttgttgcttagcattgcgacaacatccaacatggttggtcgatcaattgcactctcttgtacacataacaatgcaatgttaatgcacctcatcatttcttccgaatgaccgttgggaagcaatgccgtatcaatgagatcgacccagctttcctcttcaaataattgccaagcatgtccaaggaggttgatgaaatttccacattcatgagaatccttttccgctaaggattcaagatcaaaacaccgaagctgaagacatctgatttgatagagaagagacgtggaaagcatactcgggtgcatgtaccaagtgtacaactacttcctgtacattgctcgtgtattgaccgatatttgcantcaaaccnaaatttnatcattncntcagaaatttctggttaaatcnantnacccaccaaatctann

SEQ ID NO: 91608 - DNA, 634 bp, Triticum aestivum
  unsure (1)..(634): unsure at all n locations
  Clone ID: PAT_TA_91608
agtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacgaggtggaggaggtcaagaaggataccctgacgcgtactccgcatcatcggattcacaacatgcgccaggtgcagtcgtcagctcaatgcctcaagcaccgggctgcaagatccgnaaggccaaacagtantcacaanggcacatataaagncaatgagtttgtaatcnaattgcttggttcctccattgcttctactgtcaaaaagntagcagtcagtanaatgccagaag

SEQ ID NO: 91609 - DNA, 357 bp, Triticum aestivum
  unsure (1)..(357): unsure at all n locations
  Clone ID: PAT_TA_91609
ctaaactgggcctaaaatgctccgtggactcaccaaaagatcggccaatgatgcaagatgtttatgctgaaatcatcatgatcaaggaaacattttcagcattatgcggttgaggaaatagatcgaatattgtagacataagttatccaaaggtgcatcataccttatttactatactattctcgggtttttcttttgctcaagatcattcaagttcttggctcctggtatttcctcccatctagtgttcctttcatgtatgatcacttctagattacagcacatatgtacaatgaaataaagtgggagggagctcccaaaaaagctcttcacgtttttttactacananaaatgca

SEQ ID NO: 91610 - DNA, 605 bp, Triticum aestivum
  unsure (1)..(605): unsure at all n locations
  Clone ID: PAT_TA_91610
gaaacatgtggatccaaatcaaccccttacgaagcaacgcataaactagggtttaagcttctgtcactctagcaacccatcatctacttattactccccaatgccttactctaggcccaaataatggtgaagtgtcatgtagtcgacgttcacataacaccactagaggagagacacaatacatctcatcaaaatatcgaacgaataccaaattcacatgactactaatagcaagacttctcccatgtcctcaggaacaaacattactagcatcaactacaaggagtaatcaacactactagcaacccataggtaccaatcccagacttagagacaagaattgggatacaagagatgaactagggtttgagaggagatggtgttggtgaagatgttgatggagattgacccctcccaatgggaggatcttggtgtgatgacgatggcgatgatttcccctcccggagggaanttcccggcagaacagctcgtcggagcctagttgatccacaaggttccctcntggcgcggatccgtctggaaactggctatgatttttctcacaaagatcatnagatagtggcacggaggcacagggccacagt

SEQ ID NO: 91611 - DNA, 370 bp, Triticum aestivum
  unsure (1)..(370): unsure at all n locations
  Clone ID: PAT_TA_91611
ggaagatcaaaatgtacgactacatcaattataaaccgcaaggtcacctaacgatatattcaaattcaacataatgtggattcaaaaattgaaatttgagatcctggcatctgtaatcatataaaaagggacattactctttctttggtgggaactgatttgttttttgttgttgttgagggaagtgcaaatcgatttggtactgtgcagggtaatcttgttctcccgattttttttacatttttcctgtagttttttcagtggcatctatagcantataggtaacagggaacatgactctcctgtgtcttgtatnaattgtttttttacacgttaagtttgttctgccgancaaggnatccgcaccttg

SEQ ID NO: 91612 - DNA, 382 bp, Triticum aestivum
  unsure (1)..(382): unsure at all n locations
  Clone ID: PAT_TA_91612
caaacacctaacgtgcgtgcaccgggcgcggncagagcgtgtgttttgcacgcgtcggcaccgagctcctgccgtgtctctgttgccttcccctctcatcctgatcctcctatggatcagcccaaccaccaggaacctcgccgacaccctcgcttggnccctaccgccgtccacgacgactaagaccgccgctcgacgagtcccgcacnaccacgtctctgcccgacccgcgtggcgcgtcccgantangcccagctcctcccaggagtaattgcgggcggccaccgccctcagngtccactctgcctacctcaacggnctcanctgggcactgtantgatcgccgccggcggtgcttatccnctggacggcgcnganccga

SEQ ID NO: 91613 - DNA, 667 bp, Triticum aestivum
  unsure (1)..(667): unsure at all n locations
  Clone ID: PAT_TA_91613
cgcagcttcccattcctcgccgccgccgccgcttcgtacccgctcgaagccgacccgaccatggcggacgtcgacgttgacacggaggtggccgccggcgcgcagccgaagaagaggacgttccgcaagttcagctatcgcggcgtggatctcgatgccctcctcgacatgtccaccgacgaccttgtccagatgttccccgctccgcgcccgcagaaggttcaagaggggtctcaaagaggaagcccatggcgctcgtcaaagaagctgcgcaaggcgaaaaaggacgctccctgctgggtggagaanctgaccagttgaggacacatcttccgtaacatgatcatttgtncccttgaaattaattgnanccttaaccgtgtctacaatggcaaacttcaaccaagttngagattaaccctgagatgattggcattacttgcagattctctactccctacaaccaatnaacatgtaggcccgtattgtgcaanatcttccggtcatcctcctaaatattancgcttcnacttgaaagatcanaagncaactggtggattcatccacgtcccctgtttgacatanaacaatantgtcgttncanattctatgaanacttcacaatgcnanactttcattaagncaattagggccgacattcccaaag

SEQ ID NO: 91614 - DNA, 628 bp, Triticum aestivum
  unsure (1)..(628): unsure at all n locations
  Clone ID: PAT_TA_91614
gaaacatgtacctgtggacctggcattttacattgctcgagaagttgcttgtgctttgttggagatgcacaggaagctagttattcaccgggatataaaaagcgagaatgttttggttgatctggattcgaagaggagtcatgggacaccagtagtcaaactctctgattttgatagatccattcctttgcattctctatcccatacatgctgtatagctcaccttgggcacatatccacccaatgtttgtgttgggacaccttgttggatggctccagagntcttcangccatgcatgagaaaacccantatggactgggaagtggatatctggtccataatggatgttttanattccgagatgctacacttcgtatacccnacgaggacaacaagatccagaatatatgatctcataatcaaggaagaacaaagccaaggtaactaangattanaacntctggcaatggcnaccatnacaggctaattgggataaatctatgccnngcangaacgaatcaatgtnatccacantgaccaaggacncnntagggccaaggcacaanttnatccttgcctacaaancattactngntacctngcccnataaacntggnngcctcccca

SEQ ID NO: 91615 - DNA, 451 bp, Triticum aestivum
  unsure (1)..(451): unsure at all n locations
  Clone ID: PAT_TA_91615
gtgcaccgacgccacacaggtgatcaacgaggtggaagaggtcaagaaggagtaccctgacgcgtacgtccgcatcatcggattcgacaacatgcgccaggtgcagtgcgtcaagcttcatcgccttcaagccaccgggctgcgaggagtccggcaaggcctaaacagctcactccaccaacgggccaacatataaaagtgccatttgcngtttttgtcaactctgaacattgctttgggntttcccttctcaatttaccttncntgttttgttcccnagaataatgttgtattccaatngtcaaggntaccaacatntcncgaaaaagcatgctntatgtgaaatgcaatccggtgnctatgtntatgcacatgcacatattatatttatacancntgtcgactagtatcgggtatnataangagaaaactttggaacncntncaaaaaa

SEQ ID NO: 91616 - DNA, 466 bp, Triticum aestivum
  unsure (1)..(466): unsure at all n locations
  Clone ID: PAT_TA_91616
gtgacatcgagtcggggtcctgacacctcaaaacaattcctgtcatttattttggacctaggtgatttacaaaggaaccaccagaacccttttgagttttggctccaaacaaactcccctggctagtccttagcaccctcaacctagatccatcaagatccactcttccacaattcaaaattttcaatttttgcttgctgcaagtttgaaccagaattgccaaatttggtgaaattcatcctttttcgtctccaaaaattcnaaagataaatcaagccaccccttgatgcattgagaagccacctcaaccaaagataactccaagaaanttttcacatgccaaaancattcatcaancacccnggcgtgcactgttcctggcaatatcagtaaaatcnnagatgacgttgggttcagtcacatcgccgttcttnaagcccgggncatncgctatnccncttggata

SEQ ID NO: 91617 - DNA, 420 bp, Triticum aestivum
  unsure (1)..(420): unsure at all n locations
  Clone ID: PAT_TA_91617
ctggtacatggacaactgtttggactgatggacttaccagtcttgatcgttacaaaggacgatgctatcacatcgagcctgttgctggggaagacagccaatggatctgttatgtagcttatccattagacctatttgaagagggttccgttactaacatgtttacttccattgtaggtaacgtatttggtttcaaagccctacgtgctcnacgtttggaggatcnacnaattcccccnacttatncaaaaactttcaaaggcccgcctnagggnatcaaatttnaaananataattnnaanaattaanggccnnccttaatgggaattcccntnaacccaatttggaatttnccncaaaaatttaggtanancgtnttangatgtccacgtgggnggctnntttcccaaaagttntgaa

SEQ ID NO: 91618 - DNA, 279 bp, Triticum aestivum
  unsure (1)..(279): unsure at all n locations
  Clone ID: PAT_TA_91618
ngatgcactananctacaagtgtatnaaagctcaacaaaacaanctangtgggtgtgcanccaactcncttgcncacaaanacctangacattttgaggaancccatcattggaatatgcangccaagttcnataatgaaagattcccacnagtatatnaaagtaacaacatatganactctctancatgaagatcatgcgtgctactttgaancacaagtgtggtaaaaggataagtaacattgtcccccccccctttggggggggggcttccttcgg

SEQ ID NO: 91619 - DNA, 219 bp, Triticum aestivum
  unsure (1)..(219): unsure at all n locations
  Clone ID: PAT_TA_91619
ccccattccccaccttcctccgccagatttcgcccgccgggcgcgaggaggagccaacccccccatcctcccgaccctcaatctcccatccgagtccgccgggtcctctggattctccgcccaggccctgatcgctccggttcggttcgcacgaattcgatagggcncgttttcatcgggagggatgntgctggtggncaaggagttcggcgcgntgtc

SEQ ID NO: 91620 - DNA, 471 bp, Triticum aestivum
  unsure (1)..(471): unsure at all n locations
  Clone ID: PAT_TA_91620
acctacatagcacagccatggcccccaccgtgatggcctcgtcggncacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctccagtncagcaaggttggttatcttccggtgagcacancgcatcccctggggtactacnatggccggtactgggcaatgtggaactgcctatgtccgggtgnaccganccacacaggtnatnaacgaggtgcaagaagtaaanaagatacctgangctacgtcgcatagcggtttgaaanatgcccag

SEQ ID NO: 91621 - DNA, 593 bp, Triticum aestivum
  unsure (1)..(593): unsure at all n locations
  Clone ID: PAT_TA_91621
gcgcattagactaatgcaaatatcatagaaaagaggtattgattgattgattagactgtctctgctactgtattacatagcatactcatgttagagcaactccaacagggtgacccaaacggacgcgcgctttgtccgcttttccgtccgtttggatcggccaggcggacgtgcgcgtccgcattctcaaatgggtcggcttgaccgcccaacaggaggcggagccaaaagtgtcggcgtggaaaaaaaacagctccgcagaaatgaacataattaaacataattcccggtcaaccgccagccaaatccacttaaacctaattaaacattaaataaaacataaataaacctgcgcccgcanctgccncccgcacgctgccctanactctccgnatgcccttgccctgactcgacgtcgcatcnccggtgagtcnatgaagacggaacaaggcaacccaccgaacgccnctggtacctcaaggaactcctccgggtcgctggggcgnggaatncggtaccggcgtctctctctctaagcgggtcccnntccttgaaatcggcctanatngcgccccttggcnccctgngncatg

SEQ ID NO: 91622 - DNA, 158 bp, Triticum aestivum
  Clone ID: PAT_TA_91622
tcatgcgtgactgtgtgtagaataatgctgcaagtgctgggtcagcgggtcaagtatggggccggtcgatcgataaagaccggaaaggaggcccgaccattttacacaaatgatatttagaatgagattgcgtatatttttttctaaaaaaggggggg

SEQ ID NO: 91623 - DNA, 195 bp, Triticum aestivum
  unsure (1)..(195): unsure at all n locations
  Clone ID: PAT_TA_91623
tcggaaagcagctcggcgagtgacgcactacttgcaaattgcgactgctctttgccttctacgtatatgttgctagtccaagttgccctcttgtttatattttacttgcattgcatgctcaatcacttaacttactagtaagtgtgtgtgtgtagcaccatcttaataaatcggctatgtaagtgcacnanctct

SEQ ID NO: 91624 - DNA, 637 bp, Triticum aestivum
  unsure (1)..(637): unsure at all n locations
  Clone ID: PAT_TA_91624
ggtattccatttgcagccttgaaagaaacaatgtccaaattatggtagaaattgctcttctaatttctgtcagcaacccgtatctcctgcatgcaaattcatggcagcaagaccagaaaaagtaaatcatcatgtatttatgtagacacgaagcaagggatgaaaacaaaaaatatttatcccaaatgtccaatgtcgttgaaacctggcaaaacagagttaagggcatgaacaccatgattagaaaaatcaaacataacctagacacggcaagcaaatccctacaccaaaatccctacgtccaaaagtaacgatggcacatgagaaatttgaatgctagggtgtgggatcaacttgaggcggcagagactcacctgtatttaggaagtgtagatttgtactggctcccttacngcacantctctcctcggcctacaacatcccatgacaacagccttgttatcccggggtcacaacagtgatggtggagcatgaatatggnaatggncanagacggttgggaaaggaaagggtcatgaggnggtttagatgcnaaccattgggggagttccacacggtactgaanatnataggaaangcacntntgaaacacggatgatgattggggcccanttaa

SEQ ID NO: 91625 - DNA, 607 bp, Triticum aestivum
  unsure (1)..(607): unsure at all n locations
  Clone ID: PAT_TA_91625
aagtactggggccctcacccgaccaccggcgtcttcggccccgccgcggtcgaccccaagctggccgccagcctcgcgccggcgagcgccgctgcgaatggtggcgcctccgtgctggaccagaaggtgtggttccgcccgctcgaggacgtcgagaagccccccgtcgcctgatcatcgccgacggcgacgatagcccagctcgacatctctatcactccgcttagctgggctcgacttcctacttataattacatataatctgtagtggtgtgctcgtgctatagtacagacatggcaggcaccagaaccagtagtagtaacgcggtgttgctgcccggaataaagagcgagcagaagatgtgtgatgatgatgacagtgatgttggtgggctgtgatgtatcccgtcttaaacaagtgctattgcaagtgtttggnaaaaagggggggccggtaccaattcgcctatatgagtctattaccncctnacngccgtcgtttaaactcggaatggaaaacctggnttaccaantaanncttgaacaatccctttccaangggtaatacaaaagccgacgntncttcaaaattccacctaagggatng

SEQ ID NO: 91626 - DNA, 621 bp, Triticum aestivum
  unsure (1)..(621): unsure at all n locations
  Clone ID: PAT_TA_91626
cttgttgcattctacatggcatcatgttgttaatcgcagaattgtgacattcttgttttcattgccatttgcaaatcgtgcatccgattccggtgatctttatatcgatttcgaccaaaatcatctcatctttccagcggcacacttggtttgccaaggtgatgccttgttcattctttctcttccgaagcacgcatatgcattgcatatcacatcacgcatgtcatgccatgttttgcatcatgtttcttgtgcattgcaccgtgattgattgttggtcctttgcttgtgttattgctttgggtagagccgggagacgagtatgtgattgaggaacccgttgagtacgcttatgagaatcaagctctccgtcaactctaagaacttgcaggaaagatgaccgtaccctcgaaatcacttcnaccttgcttgctanttgctcgctcctttgctagcacaatacctacacttgattaacaagacnccatatgcaagtaaggtcgaaccaccttccnacaaacgttgntggcaagtaccgctttctnancctctaaancntgcaattganggaaaataattgtcctgtgganaggtatgntggaacatnanaacctgttatta

SEQ ID NO: 91627 - DNA, 201 bp, Triticum aestivum
  Clone ID: PAT_TA_91627
agcagttaaatatatacacccggtggtctttggtggtccaataataaacattccaaactatttacaaatatgtattctgccccttatacagacccagctctgcaactcaatcatagctgttacgcacaaattgttccatcatactccatcaagagcgccaaagctcaacaacaacaacagagccagagctccatggggggg

SEQ ID NO: 91628 - DNA, 356 bp, Triticum aestivum
  unsure (1)..(356): unsure at all n locations
  Clone ID: PAT_TA_91628
attgccaatggacagcggcgaggaactccatccattgcttgtgggatggagatacccctctcgtccgcccctcggacatccgagtccatgtagatggcttttacaaagccctattctcgcccacccctcggggtggggctgcactggcccccgacacttggtcggctaaccagttagtatctgacgcggcaaatgccgccttggtggcacctttctcaaaggacgaggtcctcgtggccattaagggtatgaacccctcctcggccccaggtcccgatggactgcccgtgacgtttttcaaaatgttctcgcagaccatcaaactagaggtcatggncctctttgatgaattctac

SEQ ID NO: 91629 - DNA, 564 bp, Triticum aestivum
  unsure (1)..(564): unsure at all n locations
  Clone ID: PAT_TA_91629
ttttttttgagtaataacatctggggttacatagattataatataggcggcatttgtacaaaagcaatgcatgtcatcattggagaccaaggtaaggttcatcctatcatagagccaaattagatgtttttaaagccacaagctatgcatgcagaaggcctgtgttgctgttgatggtccatttagagcacatggatgatgagagtcgggcggtgctctgtggtaaggttgaaacgggaaggcgcagatatctccttcatggatgtttgcacaacggcggaactctgaccagtttctggttattgttgctctcntttcggttcccaacatgatatgacaattgggtgtcaaactacngtttgcnagcttgaccttgagcatgtcatcatcnggattaatgtacttttcaggnttaattggngtatggacctgaaaataatccgttggcctgctgtccaaagttttgttacgggcaaacatgtatttgaaaccggnatttgcggggaaattgaanaaantnccaaatggnccnaanacttaattatgcccatgaaattctttaaa

SEQ ID NO: 91630 - DNA, 622 bp, Triticum aestivum
  unsure (1)..(622): unsure at all n locations
  Clone ID: PAT_TA_91630
gatgaccacagttcatgccatgactgcaacccagaagactgttgatggtccttccagcaaggactggagaggtggaagggctgccagcttcaacatcattccaagcagcactggtgccgcaaaggctgttggcaaggtgctcccagagcttaacggaaagttgactggaatggccttccgtgttcccactgttgatgtttctgttgttgatctgactgttagacttgcgaagccagcaacctatgatcagattaaggctgctatcaaggaggagctgagggaaacctcaagggcattttgggttacgttgatgaggaccttgtttccactgacttccagggtgacaacaggtccaagcatcctccgatgccaaggccgggattgctctgaacgacaactttgtcaagcttgtctcctggtacgacaacgaatggggatacacaccgcgtggtcgacctcaacccgtcaaaatcacacacaaattaatganagcatacagggaaaatggttgcccaaaggatgtcaaanctctctccgagaataattttgaaggattagcactaaactttatggtgacccgatgtggttggctaacgccaattggggataagtctgctnacna

SEQ ID NO: 91631 - DNA, 521 bp, Triticum aestivum
  unsure (1)..(521): unsure at all n locations
  Clone ID: PAT_TA_91631
cacgcatgcagctcacccccacaacctcgctcgcgtcccgatccacactcgccggcgccaccagccgtggctccttcggccagcgaaccctccgccaccgccggcaggccttcgtcctcccattcctctgctccgcctcctccgtctccctccttccccttcctgtgggcagggcggccagcgcaggaggtcgctttggctcctccagcaaggcgggcggcacgtgccggcttgagcagcttctccagcggggcgggctgcgcgagcangagatggctggtacgggcagagcggccggcgccggatgccgccgcagcttctccagcggggcgggtggcgcgagcaggagatggccgatgcngcagagcgcccgngcgtgngagggcgctgcgtgcgacgcgcgggcggacgacgggncgtgcggngtnagcaaggcaccgccgnncgggaaggcccnacgggaagggaaaatctctggttgggctcgggccggcgtggganacggatagatccctcggtaa

SEQ ID NO: 91632 - DNA, 611 bp, Triticum aestivum
  unsure (1)..(611): unsure at all n locations
  Clone ID: PAT_TA_91632
cgacaaacttattcagctctttcttccacctcctgaatagttcttccatcctcttaagagcaaaagacttgattaattgctctttaactgggttctctggattatcctctggcggtagggtgaaatttgacttcagctcagtccaaagatcatttttctgcatatcattgacataagacacctcagggtcttctgtagccggcttaaaccattgctggatgcttatcgggatcttgtccctaaccagaaccccgcactgagcaacaaatgcgttctttgttcggatgggttcaatcggttggccgtcgggcgcgattgctatgatctcaaacttttcatccgagctcaactttttcttcgggcctcgtctctttaccgaagttgtgctcgattcggagggctataaaaaagaacaaagacttaattaatatgtgtacataccaaaacaatgaatgatcaatcagctatcagcacaggttaactaatatatancctggccggactcggttcggcacggagcctcataaggtcncttctgcacggaatgggnacggagcgtctaagtctctctgcacggataagtacgtacagtctaacccccttnaacacgg

SEQ ID NO: 91633 - DNA, 244 bp, Triticum aestivum
  unsure (1)..(244): unsure at all n locations
  Clone ID: PAT_TA_91633
aaaacaatccccaatccctccgcccgcccgcccacccaccactgctcccccacctcnttctcccctcccagatctgncgggtanngccctcgccngcggtgttgggtccgcnatgcctcggacggngcggggggcctcncccctgctccgcnaccacttcnacnccctcaacgtcncctcagcccnctgntgctctcaccgcctcaatcnctggtcttggcannccaatatccattcttcctag

SEQ ID NO: 91634 - DNA, 624 bp, Triticum aestivum
  unsure (1)..(624): unsure at all n locations
  Clone ID: PAT_TA_91634
gacactacttcctccgactctcccgggctaggctcgatagcagctgagagtccggcgggctcaggaatcccgtcttcggacccggtgatgcactccggatctaaggctagagcgagggttggggtcgcgaacccttggaagatcaagtcccctcggatatcagcgacataatctagatttccaaaactaatctgtgacctggggcatagctgtcgatctgctctagatggccaagcgagttgactcgcagtgcgaagccgccgaacacaaagatctggccagggagaaagacctccctcagggcagcattcttgtagaatactgatggagccatcaaaccttgtgacgatgacacaacggaagtctcaatgaaagcaccaatgtcggtgtcaaaaccggcagatcttgggtanggggtcccgaattgtgcgtctaaggatcgaaggtaacaagagacaggaacacatttanccaagttcggcctcctgatggaggtaatacctacttctgctgatanctgggtgaatatagggttanaaagtnattaccccaggggggccgtaccaaatcgcctanntgatctatacnncctanggctcnttaactctacngaaacctgggtac

SEQ ID NO: 91635 - DNA, 222 bp, Triticum aestivum
  unsure (1)..(222): unsure at all n locations
  Clone ID: PAT_TA_91635
ngaacgncanancattcctcnggagcaactatcacaatttgnnatatnacancagacaattacaactgcatgtattatgtncaacaantatctnaggctttgnactaaactgatatttttcctaaaanccanctctttcntcaaaggaatgtncagtngggcagagattatattcctttcctaataagaatcttgttcctcatcaggatatacagtactaca

SEQ ID NO: 91636 - DNA, 605 bp, Triticum aestivum
  unsure (1)..(605): unsure at all n locations
  Clone ID: PAT_TA_91636
ccgacgctcaagcccccagacgccgcagcgccgccactccacccgcagcggcaaccatggcggtcggcaagaacaagcgcatctccaaggggaggaagggtagcaaaaagaaggccgtcgatccgttcaccaagaagcagtggtatgacatcaaggcgccgctgctgttcaccagccgcaacgtcggcaagaccctcgtgtccaggacacagggtaccaagattgcctcagagggtctgaagcacagggtgttcgaagtatctctagctgatcttcanaacgatgangaccaggcctacaggaagatcagactccgtgctgaggatgtgcaagggatgaatgtcctcacaaacttctggggcatggacttcaccactgacaagctcaagtctcttgtaaggaagtggnagacactcattgaggctcatgttgatgtnaanacactgacaactacatgctccgcatgttcaacattggttcacaaanagagccaaacaagtgaanggnattcnanccaacaatcagttanaanntcgcgcanatggtnaattatggcaacaactcaacttnattangactntanantatcctgagtattgaaggan

SEQ ID NO: 91637 - DNA, 627 bp, Triticum aestivum
  unsure (1)..(627): unsure at all n locations
  Clone ID: PAT_TA_91637
tataacaagtggtaggtagcgcgacatagcgatagaacgaacaactagcaagcaaaaatagaagtgatttcgagggtatggtcatcttgcctgaaatcccgcaaggaagaagaacgagtccatgaagaaagcgaatagacggagtcgaacgaatcctcacaactccgaaacggaactgaagctaaagagagaagcaacccgaaaagaagcaagcaacatagtaaacaaccatcacataaacatggcatgatgcacaaacaagtatgatgcatgtccgctttaaatatgcatggcatggcaaagtgcacagacaaaactacaagttaagtggagctcaatatgtaacaagttgcatattgatgaaacatcacattcatttatttagttctctcccatttatgtaccaacaatattaaatgttgtcaaacatggcaagaggtgaggcaaaagtaaactacacattttaggcaatttaagtgaggcagaaacaacaaataaccttccggtaatcccacatgtaatttacaatggagcaacacanttaacatctggggtgttacagagcagtactatcagtttagcaatttanaantntggaanttaaagtgncattgcacacgnggaana

SEQ ID NO: 91638 - DNA, 632 bp, Triticum aestivum
  unsure (1)..(632): unsure at all n locations
  Clone ID: PAT_TA_91638
tcgagttttttttttttttttttaatgaatgaagagtattctcatgaaagatttgacaaaatcaactgggtcgtggctattgatttccatgctagtgtcactgtcttttgtgcagccggctgcatccatgactagcagaagtttttgaacgatgttctgcacaccctagcataataaagctacagctagatgataaatagtactagccccacatgcattcttcaagcaacagaaaaacaagaagggggaggaaaaaacaccaaccaatgcgttccttcaccatttctccgaccatgctgcagctgttcctgctactctccttggtctctcccgccacctcatgcaccgagcangagaagcatgcacttctccagttcctcactgggacgtcgggagatggaccctcgccacgtcctggcgccatgagacagattgctgcaagtgggaaggatcatttgcaatggagatggggccgtcacttanatctcctggcatctaaaggacttgaanggcgntctcgcaactctcgccgactcaaagctgctcagtaaccttcgaaantcttctcanagcctcaatggagccagnccncanagacacgccttagtagttacggnaatgaacngacactc

SEQ ID NO: 91639 - DNA, 609 bp, Triticum aestivum
  unsure (1)..(609): unsure at all n locations
  Clone ID: PAT_TA_91639
agcccgccgccgcccaagcaccccgccgccccgccgacgccgacgccggtccccgccgactgcttccgcccgacttcgattcgcgattggattgtcaaggccgctcgccgccgccggaggaggtcggggaaaggaagccaccagctagccgtccacgccaggcgcgacggggttcccgctccgctggttggacccggaagagcacgtacgtacgagatcgaccggctcacagagcgcggccagagcagcttctgttcccaccaacgccgtaccccgcggcagaatagtgcgcgacgccttcgccctgtgctcgtggcgacaccggggcgaacagccgagcgcgcgcccctggcccggncccgcggcaaggcaacaccgccggttggttaatcctcgtggtctcttgcataatgtcctcgcctgtcaacgtcactggttgtgtcaatatcccggtgcatgaaagtgatctcctggtgatccaatctgagaaaanggaatgcaagtaagctactncaacaattttggatggataacnatagaagccgaattgcttaaataaggaacttggttatgatgttgataatttgnttgctnggaactgaacaaang

SEQ ID NO: 91640 - DNA, 596 bp, Triticum aestivum
  unsure (1)..(596): unsure at all n locations
  Clone ID: PAT_TA_91640
cccattgcaaagatggagtcggtgacattactcatcgctctcgcggcccaggaatcatggaagatacatcacatggatgtaaaatctaaatttttgaacggcgtgatagaaggagatatgtatgtgaatcaaccaccgagtttcatcaaagagggagaagagcacaaggtactgaagttacaataagtcttttatggactatggcaaggacctcgggagtggaacatcaaacttgatcgggcattgctttttcttggatttgagaaagccccactagagcatccaatgtacaagcggggtgaagaaaaggatcgtctactgattggcatctacgtcgacgacctattgattactgaagcagatgaagaggtgattgcaaagttcaacctacagaagaaagagtttttcaagatgaatgatcaagtcttttgagctactacccaggatcagcatcatatcgttgtgtccggtgtanctttggntgtgatcaatccctatagtttggcgtacgtggtccggcacattgatacagcagtacgcagcttgttacgncggtgcggaactcagaaaatctacaagggctctgggtcgtcgtg

SEQ ID NO: 91641 - DNA, 575 bp, Triticum aestivum
  unsure (1)..(575): unsure at all n locations
  Clone ID: PAT_TA_91641
catagtatccttgtgcctacttcaaagtaacttttgtaattgaaaattaggttgttggtagaagccaaattattcttatatagatcatattccatctttgtttgctataaaaattgcgaaaaactgttccatgcctcaactatatgaaagtcatatatccttttcatttggttcctcaaaagtaatcagataattgacttgtattatctttatttagctctactataaataaccagattgacgaactgagctgttccctaagatccatgaataagcatgtgagccaattttctgaatcgggtctaggttcaaaggaataagcatcaaatcatatttattttgtgctgcatttaaatgggcactgcgtattgctacaagatagttggattgtgtacatatttgccacttgagctcaactcgccttgttcnacactaaatcctgtgcaagagagaccgatgaaagctgaatggagacgtgaagactggatctcaatccatttgacaacgtggcacgggactttggtggacnaaanttgcncnccgatgtttgcttcgatgtaaaattcncncggcct

SEQ ID NO: 91642 - DNA, 626 bp, Triticum aestivum
  unsure (1)..(626): unsure at all n locations
  Clone ID: PAT_TA_91642
gggtatctccggtgggtgctacctacagtactaggctaccaccgatccgcgtccacgagtcaagcaggcacgcgccctcggccactacctccggccgccgcgcgcatccttgccgcagcagcctgctcatgcagcgaacgacgagcagccgcagacgcctgctatccacgaacctggacgccaatcgacgagcgagcagtatgcgtccctctctgacccgggccgcctgacttctcccttcccatgtgggctgcagcagcggtacattgagaaaacccaatacctgcttcagctccttgtcacgaccaaatatttttgtttcatttggcaaagaagtggtctctggcctgactaatttgtcaaagcgatgtgtaactccatgaagcaccatagtgtcaatctgtctcgaaagatggttaacctcaactgggacatcantcagtttgttgaagctgccttggatgacagtatcaaagaatcaatgaaaggaattggctgcattgcctcaacttgaacttcttctaatacanctgaatcacaagaaggcctcggctnanaantgatcctnaattagangnatacaaactcntgggttccaancgcttatangaggttnatgaggaaat

SEQ ID NO: 91643 - DNA, 615 bp, Triticum aestivum
  unsure (1)..(615): unsure at all n locations
  Clone ID: PAT_TA_91643
ngganncgaggcgcaggnagggantgtggcannagcgcnccngcccctgaaaaatggcggcctccctctggctgctgcatctcccttctcctcctctccacagcatcgncttcctctcgancaaccactgcccctctcctctttccgcgcctgcgtcnccctctgtctgcacaggaancacgcaccggncactagccanaggcaatcttgcctgcagctcatctnngtaggctcctcntcttctgcttcccctgttgtgaccanggatcaatangnaccagcacaagnatcataggcgacntcaccantcnctgntcnggaggctgtcagatantactataaggatgacccancttcacggggtncaaagggtnncggccgtnnggaaacggccangggntaactngngaagncggtcatgggcngaaaacngccgtcccttattcnctgggacataaaggctaccggngtgcctnctctcactccggagaggtanggantttgnanacatgcnnctcataanggangggcgtatctctccnaattacaangggaaaggtcaactaaggatgnngaccattccggtaagttcattttaactccnaattggttngg

SEQ ID NO: 91644 - DNA, 599 bp, Triticum aestivum
  unsure (1)..(599): unsure at all n locations
  Clone ID: PAT_TA_91644
acaacatcaagaggtccagccatggcgcccatggtggagtggttgccatggtttggatcggcggtggcgagcgccatcttcttatggtccatggtgcagaaccacgtcccggacaccctccgtctctacctcaccacccgggcagccaagctcgccgcctgcttcaacccttaccacgagatcaccatctccgagtacggcgccaagcgattccagcgtagcgaatttttcctcgatgtcgaggcctacctgagcgatgcctgtgctcaccatgcacggaggctcaaggccgagctcggcaaggacagcaagaacccccaaatcaccgtcgacgaccacgaggaggtcaccgacgacttctccgggaaccacactctggtggtatgcctccaagcagcaatccaaggcaatgtcatcagcatatacccggccgggatganagcgattctaccgggttgtaattcntgagtgtaatcatataagtgtgatgattcaatatagacatttcctantgaggaaggaggttaagatatgatccccacagtcggatgagattcggctttaaataaagagcaaaagccatcaaangaaaaagaaat

SEQ ID NO: 91645 - DNA, 607 bp, Triticum aestivum
  unsure (1)..(607): unsure at all n locations
  Clone ID: PAT_TA_91645
gtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactcgtacgtacgtgtgttggtgtgagagtatacgtgaataacgagcgtctgatctgatggagtcgagcaagggtgcgtgtgcgtgtgcgtgtggtttgcttgctcgctctcccatgctctgcccatggtgtccttgtgtgtatgtgtgtgatcctcccgcgtgccaagccaccgaccaacatggnagcgtctctccaagccgcgctacgctgatccggcaagatcggggccgggctcctccgcgcggcctcgtcnnactncgccgggcgttcgggtcaacctgngcaagattactgtcctgaatcgaataaggangccaagaatncccaaccncaaaatgcggtttccnccaattggcncccgtcncgggngaagngggggg

SEQ ID NO: 91646 - DNA, 573 bp, Triticum aestivum
  unsure (1)..(573): unsure at all n locations
  Clone ID: PAT_TA_91646
gcacgaccagcctggtcagacgggcgtgaggccggacgcagccaggctcggggcggcgatttaaggcagaagatgaggcatccgcgacttgaagccgcgcgtggagctaaaccgcttggctagccagcggaggggaaggcggatcagcccggtggtcggcgctcgacaaagcggccggcggtttgagcttgggcagcccggtttgaccacagcagcggcgaagaggatcgccccgaggcggtttggcgcagctgcgtgagtggagtcaacggcgtggtgacttgaggcaacangtggaggtgactcagacttgcggcgatttggaggcagtaattcaaagcanaggcacggcaacaaagtggctgaaccggagttgacggcttgaaggcccatattggccggcgtcatctcaggaggccnagcgcatcaagaggaacggtatggaatcggtgcgcttgatcaccccgacataaccgntaggnaanccnttgcttaccgggggtaaagnggagaanggccatagcgtacgaaacngacaggccgtccaaatgngacccgaaacgtaaaanagtn

SEQ ID NO: 91647 - DNA, 501 bp, Triticum aestivum
  unsure (1)..(501): unsure at all n locations
  Clone ID: PAT_TA_91647
gtccgtgcatatacatagccaccgatagcattcacatacgagcatgctttctcgagccatgttggtacatgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaanctgacgcactgcacctgacncatgttgtcgaatccgatgatgcggacatacgcgtcagggtactccttcgtgacctcctccacctcgttgatcacctgtgtggcgtcagtgcacccgaacataggcaacttcacattgtccaataccggcatcgtataccaagagatgcgttgtgctcacggaagatgaaccaaccttgctgaacccaaggaangcaccacttgngcggttaggtancactgcntnaggaggcc

SEQ ID NO: 91648 - DNA, 619 bp, Triticum aestivum
  unsure (1)..(619): unsure at all n locations
  Clone ID: PAT_TA_91648
gggaaacatatccggcagctgagatgctgctgttagtgtgtcgtctgggtgcaggaaagggtttcttggctcaccacagacaccattgttttgcatctggtttcccacattgagggaatcgatagctggagattggaccctaggcatttgatttgggagatgatggttcataaacggtgctattctttgcagctggctaaggctctgcgtcgcgggcatgcaggctgagttcaagcccatggccatcggcggcatgagttggtgggcaccagggtacatcatgggcgccatcccagtagtcatccacatgatctgaacttgcagttgcagagacttcaagtactcgattgcttcgtctangatggacgccttgtcgctcttgttgcaatggggtacgagctcctgcaatgcttcatcttttcgttgatccgattccttcntttccgctccgantggttatggacctcggaacacnatccttcgctttgccgccggcgctgcggcgggtccattacggctcanatcctcngaacctcccgnggtaccaatngncctccctctaaanatacctggctccnccaaaaaaccggnccccccggaagtacaaccggcctacgct

SEQ ID NO: 91649 - DNA, 192 bp, Triticum aestivum
  unsure (1)..(192): unsure at all n locations
  Clone ID: PAT_TA_91649
atcanagngtatattccaactccgagatgcttactccagtccttattnggattgctagagttttncatacttgttagcatantttaggattgaaananacttctggntgnntcatatanaanctttcctcaanaaaagtgtccangaaacaatgctttgacatcctatctgcaagatttcagaantaacgca

SEQ ID NO: 91650 - DNA, 554 bp, Triticum aestivum
  unsure (1)..(554): unsure at all n locations
  Clone ID: PAT_TA_91650
gccaaagcgactttgaatacctcatctgctgataagtcaatccggagtttaaatacccggcggctcttggccgatggcgatttaatacgcctccattgtaagccggaatttgtacaacccggcggcttatagcctttgagaaaatcaagaattgataacccttttgagacaccaatttcaatctatgatgatgggcttgaatttaatcatttatgtaattcatagctctgtaaatcctgtagagtttaaacaacatatgccccggcgacttaacgtcaaaaaccagggcgggtaaccacccaaatgtagtcttatcctgcacataattagatnacaagatcccttggcggtttaccgcaaggcaagtcataatatctcacatataaccactgatgtgtaaaaaggagtcacagataagcctgttatgaatcataactttgaaacataactataataatatatcatacctngtganatgaattttcactgccggcttatgtncctggcataagggaataaccaaccttaaaatcagacttcgaagtttagatgca

SEQ ID NO: 91651 - DNA, 649 bp, Triticum aestivum
  unsure (1)..(649): unsure at all n locations
  Clone ID: PAT_TA_91651
tttttttgaggaatgggtgtcttcctacttcagccaagcttcaattccaggaggaaacattttacatgtcagtaaaactttcaattcaaaagtatcaatggatagtctactagttccgactatttttctatctcatcgcccacaatgctttcttttagaaaaagtgaatatgggtgcatactaacgttggtggtgtagtaacgtagtaggctaagccactgactggaactgcttgcccaaaatatctggatttcttccatttgcccagcaaaatgaccaccttgttcttttcaccaaacttcacgtacaccaactctgagatgatgtatangaatatggccattacatcctggaagagtaagggtgcaaaggacangtangaaagcttgatggcatagttcatttgcatactaggcacctcactggatntcantggcaacgtngcatggaagccttgcangctgaaggacaannaaaagaangngcactggaaacanactaccatctccgggaggcccgaatccgtaacttaagcatcaagacaattgnnntccatacaacgaannatgataaggaggatgaaactcccatgtgatacaagccgccacgttacttananaangggtaanctccaaaanatngtaaattg

SEQ ID NO: 91652 - DNA, 200 bp, Triticum aestivum
  Clone ID: PAT_TA_91652
cttcctctgtgctcctctcccatctctatgctttcacgtgcatccggttttgattcctcgtgtgatatccagtgcgtgtgcaacctggattaatcttagttcggactggagatatgaataagtaggcatcgatttagcatttccactcgcgcaatctgttattgtgagttggagaattcagatgctgttgtgaaaaatgc

SEQ ID NO: 91653 - DNA, 530 bp, Triticum aestivum
  unsure (1)..(530): unsure at all n locations
  Clone ID: PAT_TA_91653
tcgagtttttttttttttttttgtttatactgttttttgnttaggagatgtctggaantccntatttaaatcccatgcaaaanaacagaagcnaaggcaaangcnagaacaataaaattanaanttcttcctttncngagggantgcangtcntcttaaacnccnaatcggcacaagaaannncctttttcntgtgccgnttcttcctgtatcaaaatnnnaatcctttttcntcctaaatcgncaaagattactacttcatccttattcgggtctgtctcttggacctcttttncttntgcttaggnttagcccgaggtaatggacaannagaggggaagaanatatggaggggganaaanttcttgtgattgagaacaaatanaagtgcttggcatgtttaatnaagtcaacttcaaatttacagnaattttgaaaaanaaaantancccgcgaaggttttttttntnttaagcnaaatgaatanttgggtnaagtttatagattcnacccaacaantcaagaattca

SEQ ID NO: 91654 - DNA, 672 bp, Triticum aestivum
  unsure (1)..(672): unsure at all n locations
  Clone ID: PAT_TA_91654
gtcctccgaacatagaatcgaacgataagcttcaaaaatcaattgatatcccagagctcgaaccactaagtccggaagatcttcggataccggactcaaaattgggtcagggtttggatttaattccatccacccagacataagcgctctcttgagcatgcatcaacaatctctagaaacggtccaccacttttgggccagattcctccttgtcaaaaacaagatcaaagattgccgtgacaaagacgcgatctcaagcgtttccgcaacaattgcacggacgagggatcctcaaacgccatcaaccgccatcacatattacactttactgacttgggcaactacatgcaagaantacagcgcatgggaaanccctaagaaactcnangcanacggtgggggaccanatccccatcaaccctcgttcaagacaaaaaggnacacctcaagggatgcccgggacaaatggtaaagaatacaanccgtttacgggggcaagangtctagaaggnggncnacgggcatgcaaaatcacacaacacggatacatacaaccaagcctananatttggcactcggaatggcaagacgggagaatctcacagatacccangaaancccagagcagncctaagtatncgcctcnaattcctaatnggaaggaanncganc

SEQ ID NO: 91655 - DNA, 660 bp, Triticum aestivum
  unsure (1)..(660): unsure at all n locations
  Clone ID: PAT_TA_91655
gtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctccgagttcagcaaggttgggttcatcttccgtgagcacaacgcatcccctggggtactatgatggccgggtactgggacaatgtggaagtgcctatgttccgggtgcaccgacgccacacaagtgatcaacgangtggaggaggtcaaagaagganacctgacgcgtattccgcatcaatccggttccgacaacatgcccaagtgcatgcgtcaanttcancgccttcaagccaccgggtgcnaggancccggcaagcctaaacantcatccacgacaggcatatataaagngcatggaattttgtcaatccgaatgcttggggttccttcncaattaacttctaattgtccaagatagttantcatgtcagtcaaatgctcagaaacatgtcttaaaagcatcgtgctagtaataacggccatattttaatantcacaaanctttangaaaaaanaannaaaaaaaaaaaa

SEQ ID NO: 91656 - DNA, 635 bp, Triticum aestivum
  unsure (1)..(635): unsure at all n locations
  Clone ID: PAT_TA_91656
acttcgagtcggcaagaaagtgactcgactgagccgccagccgaaggggatggggatctgtactgcttattgcccccaagaaatggaaattcaggcaggagcagcagtgattctaagcgttcaacttcgagtcacaaagatgatggggatctgttctgccggctgtcaaagaatggtggacattcaggtgggagttctgggggatccaagcgttccgttggtgtaagaagtgtgtttagggccatcaggcggagcagtatttctccagtgatatccattgactttgaaacatctgctgataagagagatggtccggttcaatgggtgccaccgaacttcttcttccgtgggatctatggaacctgaggatttgcaaaaggaacactactantctccaatgtccctgaaaaggtgatcaaaggaagtctgaccgctgccgcctgcgaaggaatcttccaccatgaaagaattcannttggantggcaaaatgtcatggttaatggcatgagcccaaaccttaaatcttgacccggaaaaaacctgaatcgancnccaggttcacggnnttaaaggngtcattcanggggncaaaacaattcttcctaagngggaaggncccatanggnatctanaa

SEQ ID NO: 91657 - DNA, 554 bp, Triticum aestivum
  unsure (1)..(554): unsure at all n locations
  Clone ID: PAT_TA_91657
ctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcagctgattgacataactgatgatggatatgtcagccttctaactgagagtggcaacactaaggatgacctgaacttcccactgatgatgttctgcttgggcnagttnaagactgggatttgctgatgggnaaggactgatcctgtcggtgatgtccgccatgggtgaagaanaatntgccctgtgaaggaaaccggtgggggaaagtaacactgtncgtggtgcctactgcnatattggatcnaggttccgggtttgagaacacatacataggatcaaatattgttgggtaaaaatttgntcaaattgntgtttttaacgatgcnca

SEQ ID NO: 91658 - DNA, 489 bp, Triticum aestivum
  unsure (1)..(489): unsure at all n locations
  Clone ID: PAT_TA_91658
cgaaagtgaaatttccacgaagccgcacgcgttggtttcgatctgctctgctcgaaacatccgccgcggaggagcggacacggcagcgcgcgtgggcacgatccgtctgctggtcaggcagccatgcactccggcgacgcgtcgaccancgaggatcctcgggcgtgccgggggccggcgaggcgccggngcctgcggagccgcgtgaccgccgtccgggcgccgcacgctcgccgncntgatgcgggagngcgcgctgnnngcatctcccgccgggcggacgccgtngcgcctccgcctcgtgaacccgtcctgngagcgccgngntcgagtccccgcncngtcgccgtggcncacgngggcgncccgcgacggntgtccgnnctctncgtcccnanntcggttctcncgttctnncgggngcggagacgngtgccgtcccnanctcgncttgnctgggcctcganggggtcactgtnctctcgtcgg

SEQ ID NO: 91659 - DNA, 669 bp, Triticum aestivum
  unsure (1)..(669): unsure at all n locations
  Clone ID: PAT_TA_91659
gcgaccgcctcttcttcgtccaaacgccctcggactccatcagcttcccctcctccggcaggcgacaacacaggggtcaccttcgacttcgggtccctcagcccaaggaggaagaggaaagcagtagaggaggaggtggaggaggacgagtaagtattgttcctttctaccatctccaccccctcagactgtgccacttatctcgacttgtgttcatctttgcagggacgcggagacgctggcccagagggtgaagagggccaaggcttcggcaggcgctgctgcgcatcgctgggtggtgttgagtagtccaagacagcagccccggcacagccccggcgtaagtccatccttcgcccctccgtcaacgtgtgttggggggnacggccccttgggtgctaaccttgccgcgattcagganggggacacaacangcggagcacagagggctaccccaacangccgcccgagggcttcccggaaggagccancacgagccatgaacganggagaagagggnatcggcgtgtgnttgctcatgcaaaatggggggagggactnctcagccggacggtancantgcctcctccngtcttttctcgatctgatttgctcgccaaccttccgaacanattcctnggggccangggcnanctataaatccagntg

SEQ ID NO: 91660 - DNA, 639 bp, Triticum aestivum
  unsure (1)..(639): unsure at all n locations
  Clone ID: PAT_TA_91660
gcaaaactacttagaagcctacaacaaagcaaaggcaattgcagatggacatgaagagcagggcaaaagcgcaaatgcttctcttgtggataaatacaactcctctaagcggtcggtatctcttgtgcagaagcaccgagagagcaaaaaggagaaaaaaaagcagaagcaacaacgagggaaggaagaatgggaggagaaccacccatggaagccntgggaccgtgagaaagatttaacctgtgggcgagnaaaatgtggtttggatccaagagaacacggcacaaggactgtcgtcccgtttctcatccnggagctggngnaaangactccctggggaggatttgngcaaactcctgcttngaggnacccaaaggagcatgcctatnagnggcggtacnaggtnttttttgggcccaacccanttttnngggggaaaaaaccaannnaaaaggggttggtntttnnaaaaaaanctgganttttttcggaaaaaattncttccaaaaaaaaagnggtttgctgggattntaaagtnagtgtananacccangtngtcccnnctgttnttttgcaangnaancctttncgaacttaaggggganaagggtaaccccgcnngaaggcctgnnttagcac

SEQ ID NO: 91661 - DNA, 653 bp, Triticum aestivum
  unsure (1)..(653): unsure at all n locations
  Clone ID: PAT_TA_91661
gtttatcttttgacgtattgccgtatttgcagattttctgtttgtacagctgcaaatctttgctaaagactagcaatatattgtatcatcttggttcatgtattgcttatagatctgctagtatattgtttgatgtatcagctagggggttcttagttacaattccacctctgttgtacctctggttcatgcattgtttgatgtactgcatatttctctgttcactgccttactcttgttctggtatgttttgtatttacagatgcagatctttgtgaagaccctgaccggcaagaccatcaccctcgaggttgatcctccggacaccatccgacaacgtcaaggctaagatccaaggacaaggagggcnccctcccggattaagcagcgtctcacctcgctggcaagcagctcnnaggatgggccgcacctgggctgactacaacatcaagaagganccacacccacttgtgctcaagtccgtgggtggatgcantcttcgncaagacctgaccgggaagacacacctggaggcaanccncgaacatcgacactgaagcaagataagaaaggaggatccccggacaaanngccacttctgaanaactcagatgcgnccttcgacaaaatcaaagngcaacncacntggcagg

SEQ ID NO: 91662 - DNA, 646 bp, Triticum aestivum
  unsure (1)..(646): unsure at all n locations
  Clone ID: PAT_TA_91662
ctcgattttcggaatgacagcaaaagcaaagatccgttgcagatctggcggagtaaaaaacagacttaatagaggatgacgtcacggcggattatccggagtccagaggatgacgtcactccgggttatggccttcatgtgaatagtaagccggagattttttctgtcggaagagtggaagattgatgtgagccggctcaaatcaatctggggcctaatgttgaggatatagaccttagatcacccgcnaggaggggccgggttactccgcgtggcattacnanaacccggagccaatttgaagacnatggncagagatgggtgagacccggatatggctaaacccgttattataatattattatagtaaacttgtagtataaggcaagtatatttanancccgatcgggacaccttataaaccgggccgggactctganggcgttgggcgncaacctcctatataaagggacacccggcacgtttnangagganaatctatcaanaccggnatactgttaacncctggaacgtacctaacatacaccaacnggngaggtttcctcacgnagggccnacataaaaccctgttctgccgaaaccctagnttcattnaggncanaaatctancgggggcggacattcc

SEQ ID NO: 91663 - DNA, 614 bp, Triticum aestivum
  unsure (1)..(614): unsure at all n locations
  Clone ID: PAT_TA_91663
tcccccatcacatcaccacagcccgagacgagatcgatcgatcccatcccatccggccggagtaacgcggcggcgacgggactcctctcggcggcggacaaccagccactgactggttcaatctttttgtcggagccgattggccggacaggcgaaaaggggatcggcgggacgataatcttgattattcacagaaaggcgccggcttttagcggcggaggacggcgatggacccgcaggtggcggtgcagggcggggactgggtgtccggcggtgacgccgctgctgaagtgctgtgcctgacggtgatcggntcctcctcgcgcacccgcgggcgcaagtgggtgcccaaaggcacttnaaactgctcaacaantcctcttcgcntcttcctgcctgctcacttcgtgactcggcatcctnanntcaaaactctccatggggncacccgttaactctcacgcacgctcgcnccctcggtaccgtccctctctcgccgcgaaaatctcgctnactacatacggttggaanaggaactccatgcaaacggtctngcaacgcganaccttgccgtgcaccaggaacccaatcnttccanggccntcccngaaacc

SEQ ID NO: 91664 - DNA, 688 bp, Triticum aestivum
  unsure (1)..(688): unsure at all n locations
  Clone ID: PAT_TA_91664
ccatgctaagcgggtttctcaggtcgagtgtttattcactcgccatcgcacgagaaaagggcggtaatagggatgcccagtcccaaactgcaaaaagaaaagagcttacaaataatcaaacaaaaactcccaatggagtcataacctttacatttctgcttgggaaccgccactagcgtgtttagcatggaagatattgataactgatggtcgtgaagtgaataagaagggtgcatgtcttaaaataccatttacctctattttaaaaacttggagctctgggcacctctgcaaatcactgcttccctctacgaaagggactatctatttacttttaatgttggtgtcatcacttctcaaaataagcaccaagaacctggagaacactgttgtcatgctggatgcattggtgtataactaagttgggtgcacatgactaatctttccaccatgaattacaaggtgactggttgcttgaactttggggggtccgcattaagtttgcgnccaanaangntaacgagatacattatggcatattanacatggtgtttganactgtgcaattgagaactatatgccccantgntaagtcatgntcagtaataatttaggtatgccaaggtagtaaacctgcgaaactggggttactatttnnaggnaaggttaaagnttctttntnatanag

SEQ ID NO: 91665 - DNA, 657 bp, Triticum aestivum
  unsure (1)..(657): unsure at all n locations
  Clone ID: PAT_TA_91665
gagagaacaagacaatgaagaggatgttccaccctgacccaaacaaaagctctcacgagttcgagcaagagtctcaagaaatcatcccgtcgaacaaatctttgatgacattcaaaccgggagaattgcttgctctaaaacttgtttagctaacttttgtgaacattaatcattcatttctagcattgaacctatgaaggttgaataagcattggaagatccggatcggataaatgccatgcacgaagaactacacaactttgggaggaaccaagtgtggacgttggttgaaaagcccgatgagaagcacaatggcattggaaccaaatgggctgtttcggaacaagcaagatgaagatggacaagttgtacgcaacaangcacgtcttgttgctcaaggctacactcaagtagaaggtatggactatggtgagacatgtaccccgttgctagagttgagttagaactaatacatcaattggnttatcaaatgttgaaatgattgtcacacaaaacaatctacactactacacgcnaatacaagaacatcagcacatcatcttanatcgctngagaacatagacacacacatcacantcgtagaatcagcaaatctcatgganatagacattncacaaggttccacgnggaangcta

SEQ ID NO: 91666 - DNA, 530 bp, Triticum aestivum
  unsure (1)..(530): unsure at all n locations
  Clone ID: PAT_TA_91666
gtttttctaatcttattacaggcccagtgacgaaaactgacaaagagaaactgcaccacgaagcatgcacgtagggagggagagggacgcacacccctagtggaatttgcaggttgagacaccgttcctgaaagctgcgggcagggtgtccggtgtgatgtgagggcaccccttgacgcgcagatgaatgggacctgtgcagcgcccgaggcccgacaaggacgacagcagcgggcagtcggcgatgctcacgtccctgagcagggggaacgcaactttgggcatgtcattgtcattccacgccaccagttccttcatgtcgtccagcacgatcttcttaagcttcgggaacgcnccgccgccgcataagccgccgtcgattctcgcaacaacacaaanctccttgatttcgggaactcaaagnacnggaagctggccaanggccggaanggccttgagcttccngcattcttgaggtanagggcgtcantttcantccgctgancaagtagggnagcctccnggggtac

SEQ ID NO: 91667 - DNA, 635 bp, Triticum aestivum
  unsure (1)..(635): unsure at all n locations
  Clone ID: PAT_TA_91667
caacatcttcagcttcgacatgagcacacttcttcacacctttgttcacctttgcaggatgaactttacgcttcttattttctttcaacaaagaccgctcttgaagaggagacgaagaaggcttcttatttgtcaaacctcgtggactccgatgaacagaggagccaccaagtttgcttggaccaattttcacagcaacactatccacatcagctttgctattaccaggttgggaaccagctttcacacgtgggctacgcctctgtgtgccatcaggatttcaatctgacatcttcctcttcaaaacatctttcttctccttaactccatcatgatcaaacacttgcgtcaaacnagtttcatcaagtttgncntcacatgcatgtcacttcangngatcatcttgancangntgaagaaccgcatcaccaactacantgcctanacantnggagcttgcgcanatcancanactttctgnanacaggaagncnttngcgccgttcaancccttcctcgggaatnatantctcgtnctaccttatcnncnggggggccggtccaatcgccagagggccaannccgagccnnggcgcgttaaagtcngacggaaccgtggttccagntangggggg

SEQ ID NO: 91668 - DNA, 204 bp, Triticum aestivum
  Clone ID: PAT_TA_91668
tagtagatcgtcgtgtctccttaattccaaataagtacctcacaagctccattccacaacttcttacaaggtcttagttcaactaatgattccataaactaaacaccatcaatgctctcgctgacaaacaaacacaacaatcaatgttggattaaggaacacaagataaaatactacaggttctccccttcaggatgaccatat

SEQ ID NO: 91669 - DNA, 653 bp, Triticum aestivum
  unsure (1)..(653): unsure at all n locations
  Clone ID: PAT_TA_91669
agtagctagtagcttcgccccccttgccctcggaaaggttctcattcctcactagatctagttgacttgcttctacagcaatcaatctatctatatgttccggacggaagagagagtttcctacattcccattcccatgaactaaacatcgggtaccaacaatctggaatcccgtgctaaaacctacagatatgcacctgtgcggaccaacctggcaatcctcctgtctattctttctatctggactagtgcttcccactggagcttactacttgactagagcacttgaacttgttagtttcattagtcagtttcctagcatagcaaagtgagtttcccatcaacgggattatcatcctgttgtttccatgaacatcaaggtacatacatgaacctgtcaacggagcggaacatatgatatgaaccaagtagattcgtctttttgctcgtaacgttagtagtactcgctcattagtagtgaactatgataattgtgaggagtagtttcaactctagtagtaattcgagagtagacgatcatgtcaccaagagcagaatctccnattcggaaaggcttctcaacaagaagagataatcagnttacacatcggcngtacacaacacnacacnccggcttttangggacaaccncc

SEQ ID NO: 91670 - DNA, 626 bp, Triticum aestivum
  unsure (1)..(626): unsure at all n locations
  Clone ID: PAT_TA_91670
ccaaagacggcttcacctacgacggtttctctaatggcgtgctccggcttgatggtgtagcttcaatcgcaagcagagctctcatgctaaccgatggtgttgcccggagtgtaggacgcgctttcttcggaggccggttcgactctatttcctcattctcaacaacctttgtgttcgtcatcactcctccttactctgatttgagcgcatacgggctcgcctttacgatttccgccacgacggattctttgttggatgccctcccgtctcagtacatgggcatgttcaaccgtgaaaatgtaggtaatgtcacaaatcgactctttgctgttgagcttgataccagccanagtacagagttcggggatattaatgntaaccatgttgggatcgatgtaacaccttggggccnacaatcacccctgctgggtactacaagcaagatggacgttcncgaattgcnacttattaanggaaagccgatcaatatggtggttatatgaantccacaagngaagcagttagacttnttgngcaagctcagaccacggttcaaaatgtatcctaancgtttaaagncaataanttgnttgcctgaacggaattaggcanaacgatacggngtg

SEQ ID NO: 91671 - DNA, 596 bp, Triticum aestivum
  unsure (1)..(596): unsure at all n locations
  Clone ID: PAT_TA_91671
tttttttgaacctaaaaaagtctttacgccttaaacctgaaatcaacccagaagtttcactttttaacaacatgatctgcactggacaatcagagagatatgacaaatatggaaaattcatgaagattgtgctgatgatggttctgatgtgaacatgacccccattgatgaacaacaaaagggagggccatgatggtctgttgttggggaaggagagcaagcacaagaaagctaggtcgcagcaaggcttggcgcatctccgatatgttgtcagcgccatcctaccaaataatcttccttcccactgctgcctcagtcgtgctgaacccgctggagctgggatgcatagcccaagggagacaagccaatgacgggcataagctcctaacatttcctttagaactgcangtgccaccgtcactccatctgaaaacaacttggctagtccatctatgacatgatcatctaaaaactcttggctancgtatatatgaaacacaattccattagtatgacaagaaaatcacangntaccaactgaacagtatcacagacaacataagccatgcaaagntngcatgtgcaaaaaaaaaaaa

SEQ ID NO: 91672 - DNA, 356 bp, Triticum aestivum
  Clone ID: PAT_TA_91672
acgcgctgaacatatattgtacgcagtactattcgtttttggtaaattggttgccgatcgagcagagcagatgtgttagcactggaaaaacagcagcaggtggactaagagtagaagatcttgcctgcttcctcctctacgcatggagcattcgccgtctgaactcttgagtttgaatggaggaaatgtgtccgttcagttttcccctgagatgtcgtgttcttcgtacgaatccttcgcacctcgatatgagcgtgtacatgaaggctcatgaatatatttttctttaacatgtaatcgtctttgttctagagtaacagcatttttactgggttgtgcttaatgttaaggggggg

SEQ ID NO: 91673 - DNA, 645 bp, Triticum aestivum
  unsure (1)..(645): unsure at all n locations
  Clone ID: PAT_TA_91673
ctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatgggcggtactgggacaatgtggaagctgcctatgttcggatgcaccgacgccacgcaggtgatcaacgaggtggaggagtcaagaaggagtaccctgacgcctatgtccgcatcatcggattcacaacatgcgtcaagtgcantgcgtcagctcaatcgcctnaagcaccgggctgccaggatccggcangctaaacactaatcacacaggcattaaaatgcattcagtttgnaatccgaattgcttgggnttcctccattaccttctaatgtccaaaaaatggangccagtatt

SEQ ID NO: 91674 - DNA, 631 bp, Triticum aestivum
  unsure (1)..(631): unsure at all n locations
  Clone ID: PAT_TA_91674
cgaagaccaattcaggtccttctctagccaggaggtgagccgcattggggctccggacttgaatttgggagccgcagcccaggtggcgtcgcggggctctgtgacatagaaccacagttgctgccaccccttgacggtctccacaaaggtacctttgggccatgtgacgttgggcatcttgctcaccatggcacctccacactctgcgtgttggccatccaccaccttcggcttcacgttgaagatcttaagccacagtccgaagttgggtggaatgcggaggaaggcctcgcacacgacaataaatgccgagatgttgaggaaagatttggggctaagatcatggaaatctagcccataatagaacataatccgcggacaaaggggtggagangaaacctaacctgcgtacgaagtgggggatgaacacacctctcaatgggcttcgggtaaggacatatgcccntggcagaagctggtgggcgattcttggcaagtaccggctccaagctggggatgtcctcactnacggaggagcatcactgcctgcgctcanatcggcatggcaatgcttctgaggaaaagataggctggcgtggancncaggggccgtaccaatcnctanngagcc

SEQ ID NO: 91675 - DNA, 651 bp, Triticum aestivum
  unsure (1)..(651): unsure at all n locations
  Clone ID: PAT_TA_91675
gtcacatcgctttaccagatcctcagcatcagcatgagccgtcaaccagtagaaaccatgacgaaaagctttagcaaccagggatattgaaccggcgtggtgaccacaatcgccttcatggatctcacgcaaaatctcttggccctctttaggagaaacacaacgctgtaacacacctgagacactgcagtggtgtaacttgccattatgaataaccatggactttgatcgccggactatctgtctgggccaagaacttcatcatctggtaactccctgtgggtcatatacgccaaatatgggaaccgtccaatccggaattacatgtnaaagcagccaccaatgggctcccggttcaaggaacaagtaancctcctatgtaggcaacttaaacagacggntatgcaggatatctagaaagtattggggtgggaccggtttacgttcaagacccaaccgacttaaanatttgctgcttcgttttgcgccgttaatagctcaactgataaccttgaaatgtgagcacataccattctcgtcaanagcgcatgagnggtctaaatccaatgcagaanttgagcacagtaggnccccaagggatattcacanaggggngaagnanttagatctcatagatttngggggaatcca

SEQ ID NO: 91676 - DNA, 374 bp, Triticum aestivum
  unsure (1)..(374): unsure at all n locations
  Clone ID: PAT_TA_91676
ggcacaccaaagcaccaaagcatctccaagggtactcctaattagcatatgacctcaagactaaacctctccttgacaacaaaggcatacttagaaaaaaaatgtttctagatgtaatgctcccctggacagcaaactaacaaaataagatagctccaaagagccccttccttgcaacctagctagagtagtaaacgaataagaagccacagctcctttaccaaaacctagccttcctgcatgcaaaaaggaacaaacccagcagggttcctaccaacgtccaagccaagaaataaaaggatatgtccacaccccactaaaaacaagcacaaatcntttgggcctcctaccaagaancangacaagagagaaaa

SEQ ID NO: 91677 - DNA, 613 bp, Triticum aestivum
  unsure (1)..(613): unsure at all n locations
  Clone ID: PAT_TA_91677
ctggttgttgatccacttgcgggccggaccagacagataaactgccagataagagcattgccgcggcaagtccacgtgatcccatttatatacgggcacatacatacgccaatcccatcctccttgacctgaccttgagatcttgatcggatcaagctggtccaagaaacaggccggccacaaagctctggtctgttgccggccaggacaggcatggaggaagaccaagagcccggggctccgggctccgccggagagacgcctgggtctcaaagcacggcaatggcgtcggcgacagcccggaggaccctgcagggagcgccggcgacggcatcactcccctggagaacccctgctgaagagaacaacacgtcactccaccactcgccatggtcggcgccaaggctcgcactcnagacctcnatacganntatcnagaacatctgttcaagcacgactggaggaccgnccaacgtggngtgctgcaatacactcctcaagtggccctgggtcccgggggggtctaacggggtangggtcctataactcccatcaaaattcggctaantgtcaatggcactctagganaaagnatggncggtctcactccggt

SEQ ID NO: 91678 - DNA, 643 bp, Triticum aestivum
  unsure (1)..(643): unsure at all n locations
  Clone ID: PAT_TA_91678
gtgagggtggtgaagttgttggtgtagattgcggtgatgatgatggccccggcggcactccggtgccaccggaagtgagggcgagagagccccctctttcttcttcttccttgaccttctccctagatgggagaagggtttcccctttggtccatggtctccatggcatgggaggggcgagagcccctccgagattggatatgtctctctgtctctgtttctgtgctcccagatctggcctttcaccgtttcttatattcccggagatcggtaactccgattgggattgaaatttgaacatgatttttatccggatattagtttctttcgggagaaagaagggtccaaaccgccttacgggtgtccacgagncagggggccgcgccttccaccctgggggcgcgccctctgcctccgtggggcctccgagcacactcgcgttgatacactcccaaaaatcacatagattccaaaaaanctcatcantttnacctgttggacccttgatatggatttctgcaaacannaacatgaacaaacaggaanggaacgggcacagataatattanccaaatgtcgattcgggtcggaaaaactcagggggccggaccattgccaaaggagcgatanccgnnatggctcg

SEQ ID NO: 91679 - DNA, 559 bp, Triticum aestivum
  unsure (1)..(559): unsure at all n locations
  Clone ID: PAT_TA_91679
caactccatcaagacgctcacgctcctcgcgccgctcagcatcttcgccgacgtcgtggatctcggcgccatgggcgtcgtgcttggccaggacgtgtccacgtggctgtccgaaaagccccccgtgttcgccttcggggggcccgccgagctcctgtacggcctcggcgtcgccgtctacgcgttcgagggcatcggcatggtcctgccgctggaggcggaggccgcggacaagcgcaagttcggcggcacgctcgggctgtccatggtgttcatcgccgtcatgtacgggctgttcggcgccatgggctacctcgccttcggcgcgtcnacgcgggacatcatcaccaccaacctcggngccgggtggctctcggtggccgtgcagctcggcctctgnatcaacctcttcttcanaggccggtganatgaaccggtctangaggtcgctancgcctgctctacgggaancggtaccctggggatgcgctgggtctggncgtgttcngggccatggnatctcggcnaattcgngattctctcgcncntcggaaaagtc

SEQ ID NO: 91680 - DNA, 369 bp, Triticum aestivum
  unsure (1)..(369): unsure at all n locations
  Clone ID: PAT_TA_91680
ctatacttagttttggggtcccgaagtgatttccatgattgaccaatctcggggtgcgattacgtgtggtcatcaacactctcaatttcggccaattctggtccgtttcgtgcactattactcactgttctgggtcccagagcgatttccatgattaacgatcccaggagtgcatttacgtgtccgtcatcaacactcatagttttggccaattctgacccgtttcgtggactattactcaccgttttcgggccccgaagcgatttccacagtcgttcaaccccaaggtgcgcttacatgtcggtcgtcaacactcgcagttttgctcgattctgacccgtttcgnggngtattactcacnattttggg

SEQ ID NO: 91681 - DNA, 615 bp, Triticum aestivum
  unsure (1)..(615): unsure at all n locations
  Clone ID: PAT_TA_91681
aagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcaagcaaggttgggttcatcttccgtgagcacaacgcatcccctgggtactacgatggccggtactggacaatgtggaagctgcctatgttcgggtgcaccgacgccacacaggtgatcaacgaggtggaagaggcaagaaggatacctgaccgtactccgcatcatcggatcgacacatgcgccaggtgcaatgcgtcagctcatcgcttaagcaacgggctcaagatccggaaggctaaacactactcacacggcacattaagtgcatncggtttgtaacncganatgcttggttcctccattacttctgtgtca

SEQ ID NO: 91682 - DNA, 636 bp, Triticum aestivum
  unsure (1)..(636): unsure at all n locations
  Clone ID: PAT_TA_91682
actaccacacataccatgcatcaaagtataaattagtatgaaactgatcatcaacttggtccgattccttggaaatcctttgaacggcatatatatactaagaaaaagcaacaagttttacaattcatttttcatcatccgtgtaaaacgcgagatgcatgccaaggaagcccaacaactagctagtttataccaacaaaaataaatccttgagatgtaggaattaggctattgagtagttggaaaaatccatgaatgatggatccacaaacacttgcaagagattcttttcctgatggtctcttcaagagagattaacttcacatcaccagtgacatgtaatgtggtatgttcaactacgtagtaagtatataagtggtattttctattgggaaatttatcaagtcactgcttcatgtagattaacttgagtttgcttgaatcaaaaagtgatttaatgaacataaagagganactaaacaccaaaccagtttcggtcatcangggatgtcantaaatctggggggaagagggcagcggtagccacagtacgccgctcgtatccacagtcagcgtcaggaaagagnanggctaacgtccttgctctcggcgtccaggnacggcaaccggaaaaag

SEQ ID NO: 91683 - DNA, 559 bp, Triticum aestivum
  unsure (1)..(559): unsure at all n locations
  Clone ID: PAT_TA_91683
atcattggagggattgagagttagaaagctcgaagaaggtcaacaatgggggaagaacactagctcaaaggataaggttcattggggaagaagacccccttttataggtgggaaaaaatccaaccgttacgctcacagcccgcaccgagcggtactaccgctccaaggagcggtactaccgctagggcggtagtagccctttgaaacacaacagtgaggaggcaaaaaagccagaagaaccgtcggagcagtagtaccgcttgacctcatggtactaccgctaggggtagcggtactactgctaagggtagcggtactactgcttgcgagcggtactaaaaaattacatccgtgcctaccaccgctagagttgtgacnagtttttggtcctgagcggaagtanccacggaagtatcncggtagtaccgctcccaagagcggtactaaaaatttcatccgcagaaccccttttangacacaaaactgacanaantntgcaaacagctcgaattcnngaaacaattgttgnaantgcgaaaggntacaaaanctgangaat

SEQ ID NO: 91684 - DNA, 651 bp, Triticum aestivum
  unsure (1)..(651): unsure at all n locations
  Clone ID: PAT_TA_91684
gaagaaagtgttagaagcctgccgcgggaagatctgctcaatcaccattttaatacgagtcgtccataaggtccactttagtgccacaaagataagccaaaataagtggcgtttgaggccaacccgggtcgccctagattgcagaaactgtgccaagtccagggcctcctagtcgggcccaagtgcctcacggaggaagctccaaagatcccgcgccgccatgcacgagaacatgatgtcggtcctgtctcccgggacatcacaatggggggcaaaggcattgcccgggccgtttcccttgaggaccactgtcctatagggcaaacagtgatgtagcactaccacatgacatcctgatttttggtggcacggngccttccatagagncataccactgtatgggaggcgagtggatacncctgataaccaaactaacggagatcncccccaaggagaaaanccgggaatgggtcacnaattccacaacacatgcggacnattcctaaactttcaanatccctaaggcnaattncaaggatggattccagtccaccaaaagcgngaacaaatcncggncccaatngnaaattatccaggtccccagtanagncaattggcccttgaaacccggnttccccattnaccanaaan

SEQ ID NO: 91685 - DNA, 439 bp, Triticum aestivum
  unsure (1)..(439): unsure at all n locations
  Clone ID: PAT_TA_91685
cttccatggggatctcgccgtcgccgagcgaccgcgccgccgctccggccaggctgccgccggtgcggtactacgtgccggccgtctgggagataaagcgggaggaggaccccgtccacgacccagactcgccgcaagtccccgagccaggtcggcgacgacgtgccgctgggtttttcncaaaaaccccaaacccctccccctcctggctgtcccgccggacggcgttcgagcgccacctccccgccacccacgacgagccgccgccgccggaaagaaccgcccgcgcggcgccctgaggaaggaagaccggacctgtactactgcctcaaagacggcnacgacccgantgcttgcgcnggtgccacaagtccaanacaagcggtacccgtgcaccgntgcggnggtanaangctaccccggaaangngtcaantaca

SEQ ID NO: 91686 - DNA, 491 bp, Triticum aestivum
  unsure (1)..(491): unsure at all n locations
  Clone ID: PAT_TA_91686
ccccaccgctacaggcccgggaccgtggcgctgcgtgagatccgcaagtaccagaagagcacggagctgctcatccgcaagctgccgttccagcgcctggtgcgggagatcgcccaggacttcaagacggacctccggttccagagccacgccgtgctggcgctccaggaggccgccgaggcgtacctcgtcgggctcttcgaggacaccaacctctgcgccatccacgccaagcgcgtcaccatcatgcccaaggacatccagctcgcccgccgcatcccgcggggagcgcgcatagattgcccaanggaaaagcatgttagactgtccgttccgtcgcctccgggtttcagatnnngtttagcantaggcaagagggacttttatttggtngtanaaaaaanccnggttggctaattggtacaatgancnttcctaatccgtcaaattgttgggttgtgccaaatcaaacaatcctcattgttccgngn

SEQ ID NO: 91687 - DNA, 628 bp, Triticum aestivum
  unsure (1)..(628): unsure at all n locations
  Clone ID: PAT_TA_91687
cacgacatatatgtgccatgacgtgactccatgccacatttgatgactttcggaggagtttaggatttatggggacttaaaaaccgagattctaaatctttgaggaggagccaggacaccggtacggtagtaattcgttcccattcctggcatgagaccgaaacatgcacccaaggacacatgtataatttttttcctagccattttggtgaactggagcatgtatttgtagttccgatttgaattatgggacattaaatgcctangaaatcaattagtgtataaaaaggccaaacgaaccctaaataatttaaatttcancagggatatcatgtccttccatgttgcctgtggnataaaatacaacgcggaaagaggagtgattactttcgcccacaaggggaacattttccctatcggacacaagcttctttganagaactcatttttaagagtttgtaataaactgggccaaattggcaagtttaagatgactatgnanaacggtttcaaanaatattattggagacaacctttatgncagtanganatcgtcccggannaanctgggangacaaatncaggtcgattatcaagtacgnaagccaaatttatcccntaaagaggg

SEQ ID NO: 91688 - DNA, 553 bp, Triticum aestivum
  unsure (1)..(553): unsure at all n locations
  Clone ID: PAT_TA_91688
cctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggcctcctcaagcaggtcgactacctgatccgctccaagtgggtgccttgcctcgattcagcaaggttgggttcatcttccgtgagcaaaacgcatccctgggtacatgatgggcgggtactggacatgtggaactgctatntcgggtcaccgacccacacantttcaacaagtggaggagtcaagaaaggatacctgacnctattcccatatcggntcncaacatgcccaagtgcatgctcnctcnacgcctcaaacacgggctcaagatcggnaggctaaaactntanacaggcatataaa

SEQ ID NO: 91689 - DNA, 618 bp, Triticum aestivum
  unsure (1)..(618): unsure at all n locations
  Clone ID: PAT_TA_91689
cgcacgtccgtttgacttcaaaactcaaactacccgtgtaaaatattggctgacagcgaagtgtagtagtactattttaaaaaaaaggctgccatgcgttcggccgggatcgaacccacaaaacgaggtatacacccccgcaaccactagtagtactcgttggagtacaacacaacctagaatcgccttttgttgctagttgtacgtacattgttccttacaagaaacccctaataatgcaagaaaccactaaaatgccaagaaactactaccacttgcatatgtgggcagacttaagataaaactaccttatcaaccattgtacatgctcttaccaacaaaancctcgagtgactcctacctccggcccgtcnacctatcatcctcgaccatgggaccactaccgccgccggcaaaagcgantcaaaaccgccgggggtgcggacccatnttgnngtaccccggtgcaactctgtcgggcctcggggcgctantanccaanatactcctcnaatctgtcngcaaggttgcnacnatacacanacacgnggttccncntcgcccctaagnacattggtcangggggcgntacatcccanngagtcatacccctacggc

SEQ ID NO: 91690 - DNA, 538 bp, Triticum aestivum
  unsure (1)..(538): unsure at all n locations
  Clone ID: PAT_TA_91690
aatgcatgcgcatgctgcatgcatgtactggtctagggtttcgcactgtgaacattctagcacgcccgtgccattgtttacatgctgtctgcaactagctaggagcctaggactagcactactcatgaaatgtattgtagaatgccacaatcactagcagagaaaaccaaagtttcaggactccactacacagtggagaggtagctaactttagtagattcctttcacttgcaaatattttgagaacttgcagtctctttcacatctagctaacttccgtagtgtccatatgtgtgtgtacaggaagaaggatgggtggtgtgcagggcgttcaagaagaggacggcgtaccccnaaccggggcatgatgggagaatggggtcaaactacccntacaacgagtcaatgccatgtctaacggccgttcccnggcccnaacatgggtcnactacgcggaacggccaaatgggcaagggcccacttnaaggagagnggncaantggncgggccccccctcagnataactcaancactctcg

SEQ ID NO: 91691 - DNA, 621 bp, Triticum aestivum
  unsure (1)..(621): unsure at all n locations
  Clone ID: PAT_TA_91691
atcttgaagaaagcaatggacacattgactccaatagcagccttgcaggatggtatgggcttggaagcaagaattgagacacaaaaaataaaacaaaaagatttggttcccctgtctgtcccctacaacacagcgtgcagtgatgctgaaggaagtgcagttggtaattttagtggcctcagagctccagaacgcaaacggaaaccaggccgaccaaccaccagcagggacaaacctccatacgacgaccagagtgcaaagaataatcacacactcctaatgtgcatgctgcgaatggttatgggcacaagtaagtgaacttgcttctgtagtatatgccgggaaccaggacacaagaccccacatgcccngaagagagtgacatgcctcacaaagagaggaaagaacaaatgctcaaactgtgggtttgtggccacaggaagatactgcaacaagcctaagtctctccatgttgtcccatcnacnggtccacccagcacactgtgaatgatatcccacattcaatcatctnatnaggtcgttnccatcgttcaaacagaaagaatgtaaaanatggantttcgtcgtanggncatanctcagnnaataagttcatttgtt

SEQ ID NO: 91692 - DNA, 191 bp, Triticum aestivum
  unsure (1)..(191): unsure at all n locations
  Clone ID: PAT_TA_91692
gagatgatgtagaggccctttgtggtggattccccctccggcgaagcgccggcgatggctccaagatgggatctcgcgaatacagaaggttgcggcggtggaattaggttttcatggttgcttctgatgtttttatggtacgggagtatatataggcnaaggaggtaagtcggttgatgtcaaaggggggg

SEQ ID NO: 91693 - DNA, 399 bp, Triticum aestivum
  unsure (1)..(399): unsure at all n locations
  Clone ID: PAT_TA_91693
ccgccatggctgccccaaggttcgccggcagccgcgcccacctccctccggccacaactccagcgggtgaagtttctgacttgccattggagttgacctgaagctccgttggggaggagcattgtcgctgctacagattagggaggagggtcgaggcagccacgaattccatcctgcactacttcaacaccggcctattcttgcatgaatcttctgccgtgaggatttaatgcagcaagggccatttgtttgacagaaatagagttgttaccgcaagagaggtacaaatcaaggaccgaggaggaatgcgtgtggatttgatctaaatgatgtgattgctttgtnatttcatttaattaatanaaaattgatgaggantgnaagaaaaaaaaggggggg

SEQ ID NO: 91694 - DNA, 629 bp, Triticum aestivum
  unsure (1)..(629): unsure at all n locations
  Clone ID: PAT_TA_91694
tatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttatcttcngtgagcacatgcgtctcccgggtactacnacggccgctactggacaatgtggaantgcctatgttcgggtgcaccgacgccaacaggtgatnaaacgaggtggaggangtcaanaaggantaccctgacgcgtacgtccgntcatcggttcganaaatcgcaagtgcaatgcgtaagttcatggcttcaaccacggggttcaaagatccgnaaggctaaaancnatcacagggcnaattaaangcatngatttncacncggaattncttgggttctccattgcctctaatntccaaaaaatnntgcagttaat

SEQ ID NO: 91695 - DNA, 645 bp, Triticum aestivum
  unsure (1)..(645): unsure at all n locations
  Clone ID: PAT_TA_91695
gctttgtcaacttagtccacaaacaattctagcagtagtgaccattggatttgaattgaatggtactactggttcttcaatcgttgctcttcttgcaccagccgcccaaaccagcgccggtgagaccgcctgctcctgcctccagtggccggctatgttgccgttgaggcctcaccgccccctactattgccacctctggccaggccctgtggcgacggcagcctcacaccgtagccgaaccagtgaactctcatactcctctccacgtggaatccactgccgcatcttcctcggctccgcgtcgtccccttcccaggcctcgccgtcatccaccgccctgggtgctctcggcgaggcatggtcaacgtggtcaaggaatgacttccatcggaagagtactgtacgtggagagctgacagctgggtccacagccatagcaaggaagtgctccttantacgtggaaaataatgatcctcacctgacaacagggaccatcggacnatcactgtattcatgaaaaatgttcccctgaatgctggaccacactnatctaaaataggaatggtcatattanggaaaaaanatctcccaatgtaaacacaagtaatttnacnatgaagctgnataggccactgttanaatt

SEQ ID NO: 91696 - DNA, 507 bp, Triticum aestivum
  unsure (1)..(507): unsure at all n locations
  Clone ID: PAT_TA_91696
ataaaggatgattagtcgagtatatcatgtgtgttgttctaaacaattatattgtgtagagtgacattttttacagaagaactggacaatgtacgcccgcctactcctccctggggatctactggctccaccagatgctcttgtgctcgctggtaagcacgtccctgctctcactgatcaatcccacaatcttcctctgcaccggcatcatcgacacgagcatgttgcgctgagtgttgtctttcttcggtttgatcttcctgagctcttgaagttgtgcttctatgaagcctcctccctcctctgtctctaattttgccaatgaggccgatgatcatcaagccgcctcactgtaatcaagaagcaatactttgggtgcaaagagaagaagtaccacaacacaaggatgggaagaaattaacnttaanaaganaattacaagaaggaacaacgaangtatanttaaagcaaattntcaagtngnaactagtcccnanngggaaacag

SEQ ID NO: 91697 - DNA, 525 bp, Triticum aestivum
  unsure (1)..(525): unsure at all n locations
  Clone ID: PAT_TA_91697
cagacagacagagcttgagagagcgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtcgacatcgacgccaacggcaggaaggtcggcaagaagggcgtgtaccagtttgttgacaagtacggcgccaacgtcgacggctacagcccaatctacacgccgggaggaatggctgaatctggtgaccgctacccgggcggaacgaccgggttcttatctggccgtnacctcngccggctcctcnggggggggtcctcctcgtctanaacaacacgtctcccccggtaaaaganatctacgtntaananaggccggtctctgctncatcactctctgtaancacgttactactcctgtgaatgnttaacaangatcaaattatnatcnaacaaaaaaaaaaaa

SEQ ID NO: 91698 - DNA, 527 bp, Triticum aestivum
  unsure (1)..(527): unsure at all n locations
  Clone ID: PAT_TA_91698
cactgataagcagcaggcacagctcgtagctcctccttcctcctccatctccatggaagccaccaactgctccattgctctggaaaccgcagaccatgccgccgcacacggcacaagcgcgcccgctctgctcctcttgtcttcggtggccgtgatcggcgcgtttctggtctacttctacgcgccattctgggccctcaggagggtcccggggcctcccgccaggtttcccctcggccatctccatcttctcgccaaccatggaccagacgtcttccgcgccatcgccaaaggagcacggcccatcttccgggtttcacatggggaagcaaccgctgggtgatcgtggcgaatgcggagctgtgcaaggaggtgggatcaangaattcaaggaatccggaaacgggagnacccgccgccgaaggtggggtnctgnacaaggacggctcttctcaaaagggatccaactggnctcaatnaggatacgnggcccgcctacaacggnccggtcgccggctntccgacat

SEQ ID NO: 91699 - DNA, 169 bp, Triticum aestivum
  Clone ID: PAT_TA_91699
gggagtatttgctaacacttgatgaagctagtaatttatttcatgagacctggtatgtccatctcatcattcagcagagaagagaacatcaaactgctattttggccattctcatgtcctattgacacacatattggaactaagagtgtgtgagatcaaaaaaaaaaaa

SEQ ID NO: 91700 - DNA, 483 bp, Triticum aestivum
  unsure (1)..(483): unsure at all n locations
  Clone ID: PAT_TA_91700
gttccctcccacttcaggctcttctttcggccgggattcgatcctcgaagatccatctgcggttgctgctcttgttgcttcaaatccccggaaggtctgctttgctgctgctgaagttctgctgcatccagctccccttggctcgttcgtggcgctcccaagtcatgcctcaaggcatccttgtttgcgcgcttcgctgccggccggtgtgtggcgtcgatgcccgtttcttcaagccctgcattgccgcgtgcttcttcgattgcgccgttcaatggggatgtcaactcggaggagggtggaagcttgttcgagctccgtactgggtgaagagctctgtctcccgaccaacgacaagcacccgacgatcctcgccttcgtttcccctccaaccggcagaagatcgtcaagctcatcacaaggactgcatcgctgctggagcgggacacgtaaagttgacncatgatcctanaatgcctgatc

SEQ ID NO: 91701 - DNA, 360 bp, Triticum aestivum
  unsure (1)..(360): unsure at all n locations
  Clone ID: PAT_TA_91701
gnagaatatcttgattagctcgttccgcttgaccattagactaggggtgagccacggaggaaacatcaagtcgaatatgctcccgttgacaaaattctttcatagcacctttagatagattagtgccattatacgttataatactgtggggaaaaccaaaacggaagatcaccttcttgacaaattgaattgtcgttgctgcatcacacttgctaaccggctctacttcaacccacttagtaaacttgttaactgccaccaaaaggtgggtcttcttatctttggacctcttgaaaagcccaaccatancaagcccccaggtcgcaaacgaccaagtaattggaatcatccttaactctc

SEQ ID NO: 91702 - DNA, 608 bp, Triticum aestivum
  unsure (1)..(608): unsure at all n locations
  Clone ID: PAT_TA_91702
ggactgctttgaagtattcagaggaggaacccgcattgcaatgccgaagacaatctgcatgccggacacatcgtcattgaagcttggttcagggttactgagggagtcctggattaatgggtcctcgggcgtccgggctatgtgacgtgggccggactaatgggccatgaagatacaaggcagaagatttcttcccatgtccggatgggactctcctttgcgtggatggcaagcttggcgttcggatatgattccttcctctgtaaaccgactctgtataaccctangcccctccgatgcctatataaaccggagggtgtatccgtatagagaatcacatcatacaggctagacatctagggtttanccattacgatctcgngggaaattaacncctggtaancncaggttatcaagnttattcaancaggagtagggtattaccccannaaaganggcctnacctgggtaaanatcgtgccccgcaaccgttacaatgacttanaccaaatnggggaccccnaccgaantcncggttttaaacnaaaaggtanagggnctcttcaataatagttgggcccttgnnaaatncccattcagggcaatcc

SEQ ID NO: 91703 - DNA, 329 bp, Triticum aestivum
  Clone ID: PAT_TA_91703
tttttttttttttttttagatcttgcacgacaatttcatttgactattatatgtaacacatatatgtctgcaaacaacacattaatcaaaataatagtgttaagaatgatagaaaatggaggtggctgcctggctgaaaaggtaagcaagggtgacttgctcatagatcattttcttcagtatcactcaaacatcattacagaactacatacctgagtaagagagattgcaatgtcttgtcaatatgaatgatggttacttgctcatgcatcagtaaaatacaaaataaatcctccaaagaagaactataaacccttaaaaaaaaaaaa

SEQ ID NO: 91704 - DNA, 233 bp, Triticum aestivum
  unsure (1)..(233): unsure at all n locations
  Clone ID: PAT_TA_91704
ctcggttcccggtccggtcccgttccgttcgttanggtttagtagnagcggggaanaggaangantggnggangtcnagtnccgctgcttcgtcggcggnctcgcctgggccaccgacnaccagtccctccanaacgccttcnccaagtanggcgacgtcatctactccangatcatcactgacagggganacggtccgatcccgctgnttcgngttcgtcaccttcgcagtc

SEQ ID NO: 91705 - DNA, 300 bp, Triticum aestivum
  unsure (1)..(300): unsure at all n locations
  Clone ID: PAT_TA_91705
cgaccgcccacgatgatacccgtcnggcactacngttcnagngtgtattagntatgctatattagtganaatattcgatgntgtacggacaccaanagatgatgtacttttgcttataattgttgaatgcatgctaatttgaatactactttattttatgatttggttttgcttantgaatgctcatattggataagttctccttcatcccgttgtgcnaagacantttgggtgnantaatgccnctcaggnaatgaaaggagngacctacgtnncatcacngncnagcaaaccatgatt

SEQ ID NO: 91706 - DNA, 632 bp, Triticum aestivum
  unsure (1)..(632): unsure at all n locations
  Clone ID: PAT_TA_91706
gcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaagganaacccngacnctatgtcggaataatcggttcacaacatcgtaaggtgaatgcgtcacttcatgncttnancaacgggctncaagatccggaaggctaanagtaatcacgaaggcatattaagncaatganttttnaancgaattcttggttcctccattacttctattgtccaaaaaaggaggcagt

SEQ ID NO: 91707 - DNA, 634 bp, Triticum aestivum
  unsure (1)..(634): unsure at all n locations
  Clone ID: PAT_TA_91707
caggaacctgcctggggcggagcccaggagaccggcctccggaggcggccgccagaggctgacagccccggcgccgcgcgcgagaagtaggggtagcagcaggagtggaacgacggcgaggcgggaggtggcggcggcggtagttccggctcccatcgccggctagctgaagcagagcgcgtgtggaactggatgcaggcgaggcaaatctggcacctgagtcttctcgattcttagtagcagctgggttgcaggagccagagatgacgatctactgcaagattaagtgtgcatctagcgagactatgcgcctcaatttttatttttactttttgcgggggctatgtgcctcagtattcgaggctctttcttcaaacacgaaagacaagaccgaaacttcaaagacatgatctgaattctcatataatatggcatggtccctcaaaaggggggcccggtaccaattcgcctatatgagtctattaccgcgctnatggcgtcgtttanaagtcntgactggaaacctgngtnccaacttacgctncagaaaccccnttccanctgggtatacaaaagccgacnattccttcaaantnccaacnaagggatggaccccttacggcataaccgggtt

SEQ ID NO: 91708 - DNA, 572 bp, Triticum aestivum
  unsure (1)..(572): unsure at all n locations
  Clone ID: PAT_TA_91708
gccttatataccacaacttttggtctcggttggtggcgcaaaccgggaccaatacacccttttagtcccggtttgtgccaccaaccgggaccaaaggtcagttttcagcagcccaaagggcgggaagcaaagacctttggtcccgcttcgtggcaccaaccgggaccaaagaagggtactggtcccggtttgtgccattgatacgtctccgtcgtatctataattttttattattccatgccaatattctacaacggttacatacttttggcaattttttatactatttttgagactaacatattgatccagtgcccagtgccagttcctgtttgttgcatgttttttgtttcgcagaaaatccatatcaaatggagtccaaatgggataaaaactgacagagattttttttanntatatgtgaatttgggaantgggatcaacgcgagacgatgcccgaggggccatganggtgatgggcgcgccctgggcctcngtggcactccgtanggggttggggccttcttcgcacaanaaancaatatcggntaaacagtcaaactcagccatcg

SEQ ID NO: 91709 - DNA, 247 bp, Triticum aestivum
  unsure (1)..(247): unsure at all n locations
  Clone ID: PAT_TA_91709
ctcccctttcccctcccccttcccctccaacgccgggggcggatccacccgccgccgcctgaatcccttccccctcctcccgccactaggggacctgcgccgccgtanccgtttcccttcttcctcgcaaacangtcaccaggtctcctccctcnctccctttgagattttgangnaagganagaggccgaancatggggaagagaaaggcngatgntaagccaccaantaggaatangatggacac

SEQ ID NO: 91710 - DNA, 230 bp, Triticum aestivum
  Clone ID: PAT_TA_91710
tttttttttttttttttagagacacagcacagaagacttgatggtctctgagggtacaaagaagataactcagtcctcacacacaaaacgaaaagcctttacaagtacgagcgtttattactgcacatctgagctctctcatctgatggaaacaaccagtcttaccatctgcaatgtagctgttcgacctcacaagggaacactttagcagataactgaaaaaaaaaaaa

SEQ ID NO: 91711 - DNA, 288 bp, Triticum aestivum
  unsure (1)..(288): unsure at all n locations
  Clone ID: PAT_TA_91711
agatgctggncgtgttcgaccananggtggccaagtgcccggngggcctccgcagcccgccggcggtcggtgcggcggcggggggcngaggcgcggncgcgctgatnaagggnttcgccggcgncaacaacgncgcggtcaacgtcancctcgnctccnccggcntgctcncctactcctcngtcanaaggancccnctcntcaccangatnttcgngntctgtaaatgncatattttgcctgttccatggacatgtnngaaaaattggcaacctgaangaagcatta

SEQ ID NO: 91712 - DNA, 656 bp, Triticum aestivum
  unsure (1)..(656): unsure at all n locations
  Clone ID: PAT_TA_91712
tgaacatggacatacacatattcttaggaacaaataagaaagataaatggagaaggaaaacccaaagcaatgtcagagttgacaaaactgcaatggcactttatatatggcctgtcgtgagtgagctgtttaggccttgccggactcctcgcagcccggtggcttgaaggcgatgaagctgacgcactgcacctgacgcatgttgtcgaatccgatgatgcggacatacgcgtcagggtactccttcttgacctcctccacctcgttgatcacctgtgtggcgtcagtgcacccgaacataggcagcttccacattgtccaataccggncatcgtagtacccaggagatgcgttgtgctcacggcagatgaacccaaccttgctgaactcgangcanggcaccacttggagcggataagtagtcgacctgcttgnggaaggcctccgtgctgagcggtggaagtaagacaggtctcgaactcntgatgcctcgatgggcanactgcatgcactgatcttcaacgttgctgacctgcgangcaacccgttgaacgccgtnaccggaagccggcgtggctnancctggaaagaccacgagtggctccgccaatctacaagttacatngtcacncagggggccgnacaatcncctaata

SEQ ID NO: 91713 - DNA, 229 bp, Triticum aestivum
  unsure (1)..(229): unsure at all n locations
  Clone ID: PAT_TA_91713
gctgagcagtctatgtgtaatgcatgtatttgctgctgatgctacactgctgccttgccttgtgcttttcctatcagtctgttgtcagtcttcactgctgctagtgtcatacgcagctgcgtgagaaataagtttatcttgatgtgcacttcctataaactagatgatttccccgtgcgntgctgcggaaacttaaaatatttttttgggcttgcttcaaaaggggggg

SEQ ID NO: 91714 - DNA, 417 bp, Triticum aestivum
  unsure (1)..(417): unsure at all n locations
  Clone ID: PAT_TA_91714
ctataatanacacgttgatcttttagctgtgtgcggtgccccctccanagttacacacctcggtcatatcancatngngcttaggtgaagccttgcgttggtancttcatcatcanagtcgccacgccgtcgtgctgacagaactatccctcggcctcaactacatcaagtagttcgagggacgtcatcgagctgaacgtgtgctgatngcggagttgtcgtgcgnntggtacttggnttcgttggctngcgactacgttcgncnacatcangncgcgttgtaacacncttcagctttcgggnctaagagggtacntggacanactctccctcncantggtatgcaactcctaanngatnttgcatgancgttngtcaatttttggnnctantgagttccccattacaagtttcggc

SEQ ID NO: 91715 - DNA, 396 bp, Triticum aestivum
  unsure (1)..(396): unsure at all n locations
  Clone ID: PAT_TA_91715
ccaaaggaaatccactccaatccaatccccacagaaatccccatctcaaaaccctagcccgtccgatcccggcgagatggccancccgagggtgttcttcgacatgaccgtcggcggcgngccggncgggngcatcgtgatggagctgtacaaggacgcggtgccgcggncggtggagaacttccgcgcgctctgcaccggcgagaagggcgtcggcaagagcggcatcgccactgtactacaagggnagctcgttccaccgcgtgatccccgacttcatgatncaangctngcaanttcaccaagggcancggnaccggcggcgagtcnatctacggngagnagttcgccgncgagaagtnctncaanaatcanaccaagcccggatcttctcaa

SEQ ID NO: 91716 - DNA, 256 bp, Triticum aestivum
  unsure (1)..(256): unsure at all n locations
  Clone ID: PAT_TA_91716
gntcatattatcgtgctctccagctattctccttttgaaanatanactccccacatggttgtggcttangggcgacatcacngcntnctggacagggagaagacaccttggattantgntctcatgcatgctcccatgtatnacagcanctaatgcgcattttatgnagggcgngagtatgagggctgctttcgagaagtgtgcttgtcaacgtngaangtggacttggananttgcaagtcatgtanatgcctat

SEQ ID NO: 91717 - DNA, 454 bp, Triticum aestivum
  unsure (1)..(454): unsure at all n locations
  Clone ID: PAT_TA_91717
gcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaaggtgcatgcatgtgttggccatcnnagggatcaagaattcgagaccctgtctnacctgcnaccgctaagnacggnggcctcctnaagcaggtgggactacctggatccgtccaagtggggtgccttgcctttgatncnaaaaggtcggtnaatcttcccgtggaganatgcnntccccgggnactannacggcngctagtgganaatttgnaagtccctatttcgggtgcaccgacgccacanagtgnttaacgaggtgggggnggccaaaaangatacctgacnctta

SEQ ID NO: 91718 - DNA, 635 bp, Triticum aestivum
  unsure (1)..(635): unsure at all n locations
  Clone ID: PAT_TA_91718
gtcggatctgcaatagtgggacgagaaggaggagtaggaatatgaggcatagagggaggtgtatcaggaaacgtgagaaaagagatatcctctactgaaaaggtcgaagaggatggtcgtgggtagaatggacgagactcatcaaaagtcacatccctagaaatatgcatccgtcgaccgacaggatcccaacaccgataacccttatgttcatcactgtagcccaaaaaaaaacacactccaacagactggagcggtatttgggtgcatctccggggggcaaggagaacataacaaacacaaccaaacaacccgaagagcagaataaccaggagaatgatcaaaaagacctcctaagaggaatactccctgtnagagcaaatnaggtttgaatgtttatgaatatgtggantggagacacctcaacccaaaatnangcgggaaatangcgcatcacatcgcacaacttctcaagaagggacnatcttgcctcaacacccatttttacgttgacgccggacaagagatttacaagatacctgctcggaaggaacaccacattgggattancccacagatngacaacccaatagttaagacnattgacatgcgtaaacctaataaanacncctcaa

SEQ ID NO: 91719 - DNA, 412 bp, Triticum aestivum
  unsure (1)..(412): unsure at all n locations
  Clone ID: PAT_TA_91719
tcgacctcccctcctcggctctgtagaaagcggcagcgtcggacatgctacggggtagatctgctaacgctcctggagagctccgaattcgggtaagtaacaagtaatttacttttacatgcttgctttgcatgaagaataccttacccgccgctattttcttcaatgcctcaatctcctgggagggcttgtgggttccggccttagtggctttggcactctcaagagccgacgcaagtccggatcccgancttccgagnacgctccaatcncgngtttttcncacganacctggantcttggcgactcctcaacccgcgctcttgtnctctcgctnggggngcncaaaggcgaatgtttcggctnggaacgccccttaaggtcgcactcnttnggggccctgnataccacg

SEQ ID NO: 91720 - DNA, 217 bp, Triticum aestivum
  unsure (1)..(217): unsure at all n locations
  Clone ID: PAT_TA_91720
ntttctanagctatttccatatctttttttnaagtaannaggctancctctatcttcttttntatntntagattncantatancganncctaaaaaanactacatanctattaangaggactcttccgcctatgatanaaatatatcacggtcagnaaagttgtttctntatttttatttgcnctctttaagaatttcaatttcattaagaaatgat

SEQ ID NO: 91721 - DNA, 651 bp, Triticum aestivum
  unsure (1)..(651): unsure at all n locations
  Clone ID: PAT_TA_91721
ttgctatacaactctcgtttaagattttttgtaggaaaacttctctctaaatgggaaggcccttacattatcgaggaggtctatcgttccggtgccatcaaaatcaacaatgctggaggcataaatccgaaggtggttgataacccacaagtataggggatcacaacagttttccaaggtagagtattcaacccggacgcaaggggagccaaagaatatctcaaagtattagcagctggagttgtcaattcaaaccacacctgggaaacttaagtatctggttagaaaggtatttaagtagcaaagtaatatgataagtgggtgggtaacgggtaacaaaagtaaagacatcaaaagaatgtttttgggatttaatagtgattggtatagtacaacaagaaaantaaataagcgagaccatatatgggaacccnttagnaccggttaacgatgggtattagcccggtgcgttcgcaagtacatcatacatanggngcacggactacccattcacaatgtaagtagnatgtatcaataaaagtatcctgctnatggaaanaatgcagnntcttgccacctcgtgaaangggnctatggaacanggaataggccctttataaaccggnaanattnaatggatnangnccccac

SEQ ID NO: 91722 - DNA, 651 bp, Triticum aestivum
  unsure (1)..(651): unsure at all n locations
  Clone ID: PAT_TA_91722
cggaaagaatcccaattattgtcaccttggggtatgcggatcataactcgtaataggtgtctacaacttgcaagatcggatcaagaacacaaatatattcatggaaacataaagggttcagatctgaattcatggcactcaggccctagtgccagcattacgcatagcaaagcattgcaacatcaatctccggaacatagttggatactaggagtcaaaacactaacaaaactaactccgattacatggataanctccatccaaccacaccgtctagcaaagcttacgatgggatacccacgccacggcgtttgagatcatgaattgggtgatggatgatggatggatgatatgatggcgatgattcccctcctcctggggancctggaatgggccccagttctaccgaccccgatgaacaacangaggcggcggcggtcccgtattggtaaacgcgatgaccttctccccggatttttccccttccaacntgatatatggagtggagttnaggcngtggaggccaagggaccacaggaaagggngtgcctcaacctggggtacaggganccctcanatgatctccgcaaantttaatattggnaatcccangntttaagcatcgagaanttattcgaaaataataggatt

SEQ ID NO: 91723 - DNA, 400 bp, Triticum aestivum
  unsure (1)..(400): unsure at all n locations
  Clone ID: PAT_TA_91723
cccaccatgagaagaggcgccgccgcggccgtgtggggtcgcgacgggggtcgcgatgtgcttatggggacgtccgcacccacgcttgggcggcggagagccgggcccctcttggcgggccttccccttctctgcggccgagaacctcttcgtaggcgccatgggggttgctactagcattgaagcaaggaagaagaagcgagtggagcangaagagatgancaacgggggtccatccctcctcattttatanttggagaaaggcaaccggggaccccgnnattnataagtaatggatgattttcntggnaatgaanaaaaatcctccaatcaaggaatttttttagnaacttgggaaancgnnaacccanttcaatcaatcncaantnaaaccgggcca

SEQ ID NO: 91724 - DNA, 604 bp, Triticum aestivum
  unsure (1)..(604): unsure at all n locations
  Clone ID: PAT_TA_91724
cctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggcctcctcaaagcaggtccgactacctgatccgtccaaaatgggtgccttgcctccgagttcaagcaaggttggggtcatcttccgtgagacaacgcatcccctgggtactacgatggccggtactggacaatgtggaactgcctatttccgggtgcaccgacgcanacaagtgatcaacgaggtggaagagncaaagaaggganacctgaccgtactccgatancgggttcgacaacatcgcaagtgcatgcgtcantcatgcctcaagcaacgggctgcaagatccggaaggctaaaagtcatacaacgggcanatataatgcatgcggttgnacccgaattgttggttcctccattacttctggtgtccaaa

SEQ ID NO: 91725 - DNA, 245 bp, Triticum aestivum
  unsure (1)..(245): unsure at all n locations
  Clone ID: PAT_TA_91725
ctagccatcgtcccgcgccccgtccatggacaccgncacgctccctctccgcctcctcccctcgagaaccccantcctccacaccgccgccttcctccccgcaagcgcctctctctccgtcaccgcgtccgtgccccgctccggtggaagccgaggcggaggaggtggtagaggatgccgcggttccggagcctgttgangtgcanctggctgctgctggcgcggngaaggacncngacatcttc

SEQ ID NO: 91726 - DNA, 628 bp, Triticum aestivum
  unsure (1)..(628): unsure at all n locations
  Clone ID: PAT_TA_91726
tcgagtttttttttttttttcttgggctatctttgaagcttgattgcacatggcagtagcattctccttcatacctggtcaaccattgtatttcttttgcgtcttgcgggacaacatataattctgttcttaggtttccttgttgtctttcgatccagtctagctatttgtactgcaaaatgtatgcaagggcaatgaactgcaatttaggcttttcacacaccagcaagtgttttgacaggttaagtacattggttgtatatgatctcatagtattccaacaatgttatatgctttctcttccactttgcaccttccttttnaatgtgtaatgtatatttcccctcctacacacttctccgctgggggaataataatggatactgcataagcatgaagttgaatggtcccctgatatcttgggcccatgtcttggnagtgaacatgttgcctgcctttccatccgtgttgtacatcacaaccaagntgaaacacattgcagaggnagcatgcgtataaccagttggaaaacacttcaaattaccctgcaatccanngtttgcagccatacncacaaattttangnccgcaatgngtcctgnccttgctcgagtncngcanccgatan

SEQ ID NO: 91727 - DNA, 431 bp, Triticum aestivum
  unsure (1)..(431): unsure at all n locations
  Clone ID: PAT_TA_91727
ggacggcgggaagaagggcggccgggagcgcaaggcggcgcaggagcgcagcgaccgcaagtcgggcaccgggatgagcggcgacgccaagaagggcggccgcggcggcaagttcacctgggagggcgccgacggctacaccgacgaggacctcgacctcgtcgccaacaaggggaccggggccggcgcctccgcctccgcctccgggaaagagcaatcctagggggctagggtgtntttcgcccggcctgcccgcccgtcgccttcccgtcncgatcacataggnctctnaanccgtgtcgggtacacatttttcaantaaaaaattgancgtggcgttttgggcgtgtantancatctatnccaagnactaagtggacttgctaattaggtattgaaaaaaagggggggcnccnggtnacaattccccc

SEQ ID NO: 91728 - DNA, 643 bp, Triticum aestivum
  unsure (1)..(643): unsure at all n locations
  Clone ID: PAT_TA_91728
gctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatccgagggcatcaagaattccgagaccctgtcctacctgccaccgctcaagcacggaggcctcctcaaagcaggtcgactacctgatccgctccaaaatgggtgcttgcctccgagtcaagcaaggttgggttcatcttcccgtngagacaacgatccctgggtactacgatggccggtactgggacatgtggaactgctatgttcgggtgcaccgacccacacaggtgtcaacgagtggaagagncaaagaagganacctgaccgtacntcngatcatcggttcgacacatgcgccaagtgcatgcgtcagttaatcgcttaaancacgggctccaaganccggnaggctaacagtcatcacaagggcanattaaatgcatgcggtttgcactcgggaatgcttggtttcctccattacttctgttgtcaaaaantgtagtcantaagtcaaantcnaaca

SEQ ID NO: 91729 - DNA, 623 bp, Triticum aestivum
  unsure (1)..(623): unsure at all n locations
  Clone ID: PAT_TA_91729
gtaaactactcatgtttcatcggaagggcaatagggttgatgtagatgccctccgtgatcgaatccccctccgacaggatgtcaaaaaaggccccaaggtgggacctcacgggaacaaaaggttaaggcggcggaaaagtattttcatggctctctctaagggttctagaatatatgtgaatatataggatgaagaagtaggtgaggggatccctggagggggcacaaggcagggggcgctcccctaagggcacgcctccaccctttgccaccactccgtggtcttttgccttgggctccaatcctcctgggtgtcttccgggcccaaagaaaatcatcatgaagtttatcccgtttgggcnccgtttgaatccttttcccgcgaatccaaaacaaggaaaacaagaatggnactatgtcctagttaatagttattccaaaataatattaaatacataataagcatataacaccaanncagtatatatacatgggacaataaaattttgatacttggggactacaagcncctaanttattccaancgcctcaggggggcggtaccaattccctaagngggcnattannggtcatngcgcnttaactcnnctgaaacctggtac

SEQ ID NO: 91730 - DNA, 415 bp, Triticum aestivum
  unsure (1)..(415): unsure at all n locations
  Clone ID: PAT_TA_91730
gcaatggcgtccacctcctgcttcctccaccagtccaccgcgcgcctggccgcctcggcgcgccctgcgcccgccgtcgggcgcacccagcttttcgtctgcaaggcgcagaagaatgacgaggctgcatctgacgctgccgtcgtcaccagccggcgcgccgcgctgtccctcctcgccggtgccgccgccatcgccgtcaaggtctcccccgccgccgccgcctacggagaagcagcaacgtggttcggcaaggcgaagaagaacacggctttcttggcgtacagcgggaaggggttnaaactggatgatcccggcaaagtgggaccccagcaaggagcgtgantccctgggnaagtgtccgctacgaggaaattttnnngccacaacactcccncgttataatcaaccccat

SEQ ID NO: 91731 - DNA, 595 bp, Triticum aestivum
  unsure (1)..(595): unsure at all n locations
  Clone ID: PAT_TA_91731
ggagatgcgatatgatatttccttcgtggttggttttttgtctgttgttttgcattttgttcttgttatgcatctcgtctcatgtcatcattcgcattgcatcggcatcattttcttaaaacttgcatttgttcgtcgttgccgtttctcccttttgccttcatcaccttccctcggatcgccttgcccgcgctgaccgttccagaccaatcgagttttcgcttccctcttgaccgtgaccacctaacctctctacaaccaccgaccccctcttncatgcgtccgaaaaacttgcccngaacccgaaccggtctgtcgntaccgatgggtccggatcatcccctancgtctataaaaatctccgttttcttantnggactcccgagcctatcttccgtccgtccgattacatcnggnggacagatanccctaagctaaaccaactgcantnatacangctaaacgagacaanccctaatncagggatctccaaccgccgccgcatctctcngatctcanggataaccagtnnatccacacaacactcgactcncctcattccantggcaacacgnaggcctcctcncgaaaacct

SEQ ID NO: 91732 - DNA, 583 bp, Triticum aestivum
  unsure (1)..(583): unsure at all n locations
  Clone ID: PAT_TA_91732
ggcgcccatcccttcttgcttccttcctcctccccactccacactcgcccccgatcgagacccctctgctcacccaccagctccgcgccgaccgcctcctcctcctcaccgccgccctccctccgcttcctccgccgcggctgcgccgccgaccggagccggagagcgacgacgatggccgcggtaagtctccccgggggacggcggcctgggtccacgacctcatgtcctcaggcgtcancgcggcatcgccctcggnctcctccgcttcttcgnnggagctcgccaagcncggcgtctggcgaccanaaactgaataggaaacttgtncacataactaatgggatggnatcctggctcttttgggctcttttaantccgggnagnatgctctttcttngctgaactgcacanaggataatatntaaggatgctctaatggggctangaatanaaaaatgaactatngcaaataatgaccgtntggngacacagggaantcnaaaggacacgtntaagctagacagaattggcactcgtntatggngaaactcaatgcancacttctgnntgtcctggatga

SEQ ID NO: 91733 - DNA, 586 bp, Triticum aestivum
  unsure (1)..(586): unsure at all n locations
  Clone ID: PAT_TA_91733
gtctttaccaaataggtatactcaatatctttttatattaacaaaacatgcccagcaatcgcttggatgcgatgcggtacttaggtacaaaggataaaacatcagatattaaattggcatgcttaaaaggtgtaaaggcagctcccgtcgtcactcctcgccgttgggtcgaagttcttgggcagtctggtcggtgcatcctgccggtacaggcaaagtaccttgctgtgcccctttacctcctcctatgcagcaagagatggtgggtgtgtatggagaatgttctaaccgtagaaggaaccatcttcatccgcatcctgggttagcatcacccaagagctgcctgggtcaatgtaggtgtcagcaagtgcacacgcttggacattgtcctgctccctgggacaagcatgtgcccgtaccctacacttctccactgtcactttggctgctcaaaaggcacggncctcccgcgantaacagctcttgcaatgtctcgataccggtnaagcaccatnggcactcgtcgcgtaaccganaccaaanacnaaaaatcntggatgcctggaagngcgacatttacacggcc

SEQ ID NO: 91734 - DNA, 653 bp, Triticum aestivum
  unsure (1)..(653): unsure at all n locations
  Clone ID: PAT_TA_91734
gcgaacttttttatatacattgnnctaaaggcanntaggaantacgacanaagaaacaagacnaccaaatagagtanacagatcaataatgaagagaacaaanatgaacacattttgantttttttnaatcataaacatnaacaattttaganaaatgaacaactttancatatttgcaacttgtgaatttatnaanaaagagannagtatcataaaaatgagataaatttttgaaaantagaanaataaaagcagagcaaanacaatgaagaaaatgataaataaaaaacaaanaacatgaagaaaacaanncagaaaacgtatcctaactacttgggccggtcatctgcagttgttccgctggatgagggtggcttgcagctaaggacaaaaaaanccgggccctttantggcaancnagggtggctcncattggggaataaanaaggcggcccgagtgcnanccagnttggactgcaacgggacaaaaaggtggcctaatnncngccagggtggatgcactgcnaaagaaagcgacccatncaatcatggggatcacgggaaangtaggcagtgcaacnggngccaatgacaaannnggcccatncatcatgggntgaacanagtggccatcancagggcttacnacaag

SEQ ID NO: 91735 - DNA, 192 bp, Triticum aestivum
  unsure (1)..(192): unsure at all n locations
  Clone ID: PAT_TA_91735
gttcattctatggacctgaccaatccatttgactgttgtaagancctggnttttggcccttttctttttcttttgatttaattggnttttgctctgtttatcttttttgagtggttccatggncttgccacctgggaaatcancctcatttnccctcncaantggntccncanttctnaaaancttgngtaa

SEQ ID NO: 91736 - DNA, 575 bp, Triticum aestivum
  unsure (1)..(575): unsure at all n locations
  Clone ID: PAT_TA_91736
tcagaaattggtatgaccaaagatgctattgtatataaatgggctcctgtagaactgttcttcatctttacagtgctgttgtatagaaatatgctgaattttctgctctgattgttgctcaaagaaatttagcaaaaaaacggggtcctgggagacgccgctgctgcttgagggccttggagaggcccttcgtgtcgtgatgatttgcaggtaccctgagaggccttgnagtttgccggaatgtcgattaacttctgttcccggcaaatcgggtactccatatgtcctattttcanncaaaggcatgctgaaatttcccgtgaatttaacatgactttgctaaaaatcggacatatgangtacttgctactaaagcatgggccggggatcttaatacttaattaantagatnaaangccctttatcctgttgtatnaaccatangngggcaataaccaatgttangcaatgttangccaaccaagggctcggaccaaacccaatgtgnaactaatggtgcccggatcncnggcntaaancaaatgttcccanggttagggcccggtanaaaacca

SEQ ID NO: 91737 - DNA, 471 bp, Triticum aestivum
  unsure (1)..(471): unsure at all n locations
  Clone ID: PAT_TA_91737
tgtggatccggttgcagctgcggctcagactgcaagtgcgggaagatgtaccctgatctgacggagcagggcagcgccgccgcccaggtcgccgccgtggtcgtcctcggcgtggcgcctgagaacaaggcggggcagttcgaggtggccgccgggcagtccggcgagggctgcagctgcggcgacaactgcaagtgcaacccctgcaactgttaagctgcatgcactccgtacgtacgtgtgttgggtgtgagagtatacgtgaataacgagcgtctgatctggatggagtccgagcaagggtgcgtgtgcgtgtgcgtgtggttgcttgctccntctccccatgctctgcccatggtgccttggtgtgtatgtgtgtgtgcatgttcccctgtattgcttcatctatccccactaatggatggagtgatgaatatgtnagaatgnaaattacctaattaacactcctaa

SEQ ID NO: 91738 - DNA, 178 bp, Triticum aestivum
  Clone ID: PAT_TA_91738
cccggggaggcgctccatggatctcgcgagttggtccaggtccttgtgccaccgccggtacctcgagttgtagtagcacgccaggccgacggccatcactgcggtggtagctatggatccgaggacggaggacaggatggtcaccttcaggcgtcgaccgttggggatgtcgtgtagg

SEQ ID NO: 91739 - DNA, 625 bp, Triticum aestivum
  unsure (1)..(625): unsure at all n locations
  Clone ID: PAT_TA_91739
tttcctcctcctcctcctcctcctccgcttttcccctcctccgcctccgtccccgagccgcggccggcagatatttctccccaaccgatccgaatcccgctgcccccgtgctccgcggcccggtccggagaccccgaaaaatccgcccttttcccctcctcctcttcttgattcggagatctcctctcctctccgtcccctctccctccctccctccctccctctctctctctctcccccggccgagcgagcgcgcatgatggcgtcctagctagctggccgcgatgaggaaatccggcggcggcggggaggacaaggtcatgggcccgctcttccccaggctccacgtcaacgacaccacgctcaagggcggcggcccgcgcgcgccgccccgcaacaagatggccctctaagagcattagcgtcccctccaacgattcgccgcaacacgncccgccgcgccacgcccgccgcagctangccgcgtctctccgctcgcggaanatgtggattanaactccttcaacatttgtgngctaaacaactgtcgttnccnanaacagacaatcatngnggaggatcaanggagnttaacaagtaaaaaagacctancgagatatgcgat

SEQ ID NO: 91740 - DNA, 620 bp, Triticum aestivum
  unsure (1)..(620): unsure at all n locations
  Clone ID: PAT_TA_91740
ggaacgggaacaataggtgcccgcccccctattcccacccgcactgctccatgatggaattgccctccattaatcctcctctaatcattccaaccactcttcctttttcctccctccctggagaatcctccccgtaatcccccacttaatcgccattagtttacacctaattaagaccactctctcctaatccgcggcttaagggttaagacacacacccttctcctccctccgttggtttgcttgccacacctcccttccctccacacttgttagttcgccgttgcaccggcccgctccganaggggacgaggtcgccgtgcgtgcggcggcatgtctancgccggtgatcccggcggngggatngcaaggcctgggcgcgcggcncggtgccgccgtggactcggnangagatactggtcctatccaggggaaacnggtggtggantaccgggcgcngaagggcaagggagcacggncggancgccgctgagcgacaattggcggtgtggcgantangccggnggacgcgttgaacgggcccttcatgccgaacgtggacaactcccgggatanagaantaggatggaccccctgctctngnnggaggagtctttggc

SEQ ID NO: 91741 - DNA, 659 bp, Triticum aestivum
  unsure (1)..(659): unsure at all n locations
  Clone ID: PAT_TA_91741
tattttaaaggcttcctacttcccggatacttcgttccttcatgcggaactgggcactcgtccatcccagatttggtgggtgattctggaaggaagatatattatgaaacaaggaattataaggcgtattggcaatggccagacaactcatatctgggatgacaattggatcccgaaggaggcttcacttcgccctatagtctcactagtttttgacccacctactttggtgtcagaactcttgctgccagctatggtgacatggaataaacctctgatccgagctaccttacttccaatcgatgttgagtctattctgaagcttccggtatgcacaagaaatgtcaacgacttctgggcttggcacccggatagtaagggccgtttcactgttagctcaacatataagttcttgataacaacaaaaatccagatggagaactggttggagggtcgaagtggccatccagtanggagcgggaagaaaatcttggacccaatatggaattgcatccctcgaagncaaatgtcattggngntacangtatcctgcaacacgatntctaacgcntaatagtcaccgaatgctgcacttgtgnacatatcanggcatgcttatactgncatgnaaggnctgggccaagagtgnaanaacgatc

SEQ ID NO: 91742 - DNA, 654 bp, Triticum aestivum
  unsure (1)..(654): unsure at all n locations
  Clone ID: PAT_TA_91742
ccgggttccacttccaaaaatctcagcagactgccgagaggttgagcacaccggtattgtacgcacattcaaatacaatcatggtgactgtcttctatggaagatagcaatttcccgagttcccaaccgctcttggaattacaacaactatgaagttgttgctatcttcgacaagcttgttgccgtccttgctggtttgactcgatggttattgctcaaaaatcagtttctattcacggatgagtactgtgatgcaattgaatacgagggccttgtgtttgctgccaccagtcgtggcactgtttttgcatggaatcattgtttcaagtatgtttgtcttccatcgtaattataattgtttcatccacatgcatgcgggttagcaagtttccctttactaattaacttcntctgtgttccaaagncctgcgaacattcaacaactatacttgaagattgttaaccaanggggagatgacatggtgatgatnacnacatgaggacaacaacgccatatacaattggngcctncaacnaatccaaggttactctctgnggtaaanccacgagatntatgcnaggacaaggtatcccaaggcgannccgggcntcaaacngtganggatccgangnaaagggcagccaacctcccaa

SEQ ID NO: 91743 - DNA, 418 bp, Triticum aestivum
  unsure (1)..(418): unsure at all n locations
  Clone ID: PAT_TA_91743
ttgatcatgtgttgacttttctcaactccataagaaacaattttatatatacgtttgcatttttttaatacagaactaactttttttagtatctgatttacttaatgcttgttgtaattttttttgtacatcagaaactttgttatacatgtttaattttttaaaaatataggatcaacattttttcatataaaaaatgaaaacagtgaaaaccaacaaaaactaaaaaggaaaatccaaataaagccaccgtaaaacaatgaaaaacagcgaaacccnaggaaaaaattaaagaaaacanaaacccaatgaaanagaagaaatatacaaaaagaaatccccactaagaaaatacaaganatcacaatagaaaccanncagaaanaaagnacacaggtgaagaaatanataaatccga

SEQ ID NO: 91744 - DNA, 662 bp, Triticum aestivum
  unsure (1)..(662): unsure at all n locations
  Clone ID: PAT_TA_91744
tggaacaataacaggaaaggagtgccctgtgggactatatggaacattttgtacggaatgcccagttggaacatataaaaatgttgctgggtccaactcatctctctgcaccccttgttctttgaacgctcttccaaaccgtgctgacttcatatatgtaagaggtggtgttacccagccatcctgcccgtataagtgcatatctgctaagtacaagatgccaaattgttacacaccacttgaggaagttatatatacttttgggggtccttggccttttgcggttttcctattctttgcaattattcttttggcactcatcttaagtgccgtaagagtcaagattggtgagagtgaagtcacgtatcgggctacaagtgcaatccacaatgatgcctatgcntcctcgccttttttgcttcnttggctgaagtactggggccaacaaggcagaagaaacacaaagccatgtgcacagaagtactcaagggactaannattcaanaacnnggaactccctaacccccccnaatcaaaattggaatggtnnnaggagctttaaaccttttccatgganaatttgaacaaccnttatggggaagttttgnaaaantncataattcaaacctggccggctgaanatggcaaaaaaaacaccctnn

SEQ ID NO: 91745 - DNA, 186 bp, Triticum aestivum
  unsure (1)..(186): unsure at all n locations
  Clone ID: PAT_TA_91745
aaaaagattataaagattcccttcattaattancttccaangatcgaggcgacagctgcaccccattttaccgcttcggctcctggattcttgcattttcctactttatccattccgnttataaataagctcaggggncattcacttttcccccttgcgtacttcttcntcgtcttcctctcaacg

SEQ ID NO: 91746 - DNA, 426 bp, Triticum aestivum
  unsure (1)..(426): unsure at all n locations
  Clone ID: PAT_TA_91746
gcaggaccaccctacctaaaggacgtccgttccatagaagaactccatttgcgaaaaagaagggcaagaagattgtgaacagatagctagctaagatcgattgtatttaaatcgtagacttcatttctcgattgtatttcatgggcactttttgaactatcatgaatattttttaatttcatggacactcgatctcgatccccctccatctcgatcgctatcccacctcgccagatccggtccaccggccgccgccgccgaccgcccgcaccctctcgattcccctactcaaccgccgccgccgaccccccgcacccctcccctactcaaccgccgccgccgaccaccgcacccctcccctactcaaccgccgccgccgaacccccgcancnccggnacctccccgctcaacggattaanggttga

SEQ ID NO: 91747 - DNA, 181 bp, Triticum aestivum
  unsure (1)..(181): unsure at all n locations
  Clone ID: PAT_TA_91747
cgcgacagtaattttttaatgccgctggaagagcagtactaccgcctagtgtgcgatacttccgcccgggcgatactaccgcgatgacccgcggtactaccgcgccgccgcgagcgggtgagggtcaagccggggaggggggagttccaactcccccatnnccactaanncnccccccaac

SEQ ID NO: 91748 - DNA, 341 bp, Triticum aestivum
  Clone ID: PAT_TA_91748
caaatttagaaaaaggtcccatagttttgctgaaaaagcattgggtccccatagtgctccttgccaccgccgcaccatgcaatcaaaacgaagtgctgccgctaggcacccgtaggacggcttctgccgttggccaggttagcggcgtgtcggggttgacggatgctgccggagctcccttgctttccaatgatggtggtcgaccggagcggcaggagacgagcttgtattgagggagccgacaatggcgaagctaattcccgtgggaaggagaggtgaggtgctccttgcggaatccgatgacgagtgcgcaagacgccgcgacaacctcttctgctgct

SEQ ID NO: 91749 - DNA, 571 bp, Triticum aestivum
  unsure (1)..(571): unsure at all n locations
  Clone ID: PAT_TA_91749
cttcgttatggtgtggttcatccaaggtgccctcaaagggtattttgcaaacctcgcaaaattcagctaatggcatatctttaacaatgtcatataaatgaaactctactgatggaggtgatttcttaggggaaaaatagaagttttgcacaaaagtatttgtgagtacgagatactgatgacattggtcgcagaggaagtcagtgaggctggctttctcaattaatagatagaaatcctcataaatcccaactctcctcaagaagtcatcgaaagggcattcacacggccggacctccatggtgcgaggcaaattaaatttgggcttctgttcttcttccttttgtttttccttcgagtttcgggtcgatgagcccttaaaatctcttcattatttctgaaataatctaaaaattttagtaacttcaaataaaagtgaaccaacttcaataaaattaatagcaacaactcccacaagtgcctanagcctatatcaagcattagaacactggnacatataaactnacatgcaagcccaggggggcccggaccaatnncctanaaggagcct

SEQ ID NO: 91750 - DNA, 606 bp, Triticum aestivum
  unsure (1)..(606): unsure at all n locations
  Clone ID: PAT_TA_91750
aatacttgtctaaatgtcgaaacatgtggcaaggacaagccaacaatccaaccggcatgaaaaggtttgactactatttctaatatattcagtagctatgttcaaattaagggttaaatatccttttgccctcagtggtgtctgtgtgctcagttttgccctcagatgcgaattgtgctcagttttccccctagtccatgcgcaccgactcgttccgtgaactctgccgtctccgtcaggtcaacgttttgactcggcccttacatgtgggaccaggtggcanagacggccaattctattcaagaccgttgcacgcatggcttgtgggacccaacagagagctgttgagcagaaagccgttgcgggtgtgctatataagcgggcgacacacagcggcggtgaccacggcgacagagaacacggcggagacacgggagagagaganancccgcngtgggaactanctttggagggcncacgtgttgaatccctccggtccganctccagtctctcaagtccgcgcactcactactaggaaagctttctngaagttacaatnacgttgttgggnccacctacgaaatncagtngcgggnnaaanccac

SEQ ID NO: 91751 - DNA, 282 bp, Triticum aestivum
  unsure (1)..(282): unsure at all n locations
  Clone ID: PAT_TA_91751
acgaggtgcaggtcgactgctaccctctccttccgagctatgccacaaatacaatgtgcgctctgcaaggaggacgaggtgcangtcgactgctaccctctccttccgagctacaccacanatacaacgtgcgctctgcaangaggacnaggtgcaggtcgactgctacctccttctccagaggtacgccttgaaaatcctaccgngtgaanagcaanacctcccactcgaggggcttagctgcaacccaatgcttgcctaagtttttgaaaatcctaccgc

SEQ ID NO: 91752 - DNA, 589 bp, Triticum aestivum
  unsure (1)..(589): unsure at all n locations
  Clone ID: PAT_TA_91752
gcagcctaatcgattcacctgcacatgcttaatcgaaggtacaaactgccgtgcacattctttattttccctgctttggttcctccttttctcttgcatatttggtttcatttgttctggaattgagctaatggcgtcgatggaagctcgatttactcgaaccgattcggttgcacggcgcggcgggatggtttgtggcggcaaaaaggtatgtgtcctttcaggttctatcaccaattcaacgatgtttgattgagagtttaaccaggcattactcacagtctgatgcgccggatgccgattgttgcaagtttgttatgattggggattcataatttcaatcaatcaagcacgcccatgttaacccaaccttgccgctgctcgttctcaatctctcacttctgaaaaccttcttaagcaacaatgggcgatctatgtccgcaactagttccgatatcctgtcctcanctctcttccaatcttcncactaggaattttacatggagtgtcttgtgccaaaaatnactgttaaagncaatnacaaaacgccagncacagaanacaacactgnacncaggggncttgtaaa

SEQ ID NO: 91753 - DNA, 179 bp, Triticum aestivum
  Clone ID: PAT_TA_91753
ctaatcctggttcgttggaaccatataagcccatacccagaactccgattaagaaaaaaatggaaccgcctgcagtatacaaaataaactttgtagctgaatatagacgcctcttccccccccacatggataaaagtaagtaaacaggaattaattctaactcccacaaaaaaaaaaaa

SEQ ID NO: 91754 - DNA, 307 bp, Triticum aestivum
  unsure (1)..(307): unsure at all n locations
  Clone ID: PAT_TA_91754
ctcgcatcccccacctttcccctccctcctccgaccccaatcagaccaatccgcttccgaccccaacccatgccctcttccatcgccacccacctcctcaaagccgccgccgcaaagcccctcttctccccccgcgcggcccanatccccgcgctcccccgctcgcccgccgcccgccgcccgcccgcgcccaccgccgccgcctgccgctggttccggtggccgtcgcccgcnanggggctntgatcntcgcngnattcnggccctgctgaggggatngnatctgacnggacgggggccaggaggc

SEQ ID NO: 91755 - DNA, 598 bp, Triticum aestivum
  unsure (1)..(598): unsure at all n locations
  Clone ID: PAT_TA_91755
ccacaacatgcacagccacaacaccaatgactgccaagagcttagggccatccacgacgggcaccttggtcgtcgccccgagcgcaatagtcgaggctatggccgcggaggaggccgatgcggaggacgctaggacaaccgcgacccccgtcaggactggcgcgatcagcctcgccgaggaccgctggcagggccagctctccgagggccctggagggattcagctcatgaggactcctcaagggtaacatttggctccctccgctgcctccgcacagaggaggaacgattaccaccaccaagatatgtngctaagggttccaaagacctccgcgccatcgcttgcatcctaagtggcgctcatccctgcctcccatcgcatcttcaagaanttcctccgggaagttnaccgcctcccccaacttcaaggacattctgtcaattggccaantcncatcaacttnaacccaatgacactcaatncgcaacactgcaangattccnaagccttgctcccanaataanaattcccttacaaaanccttcaatggggccgggtaaattcccttcaaacttcnaaancaaggccnntacaant

SEQ ID NO: 91756 - DNA, 599 bp, Triticum aestivum
  unsure (1)..(599): unsure at all n locations
  Clone ID: PAT_TA_91756
gggggtattaatttccctagttaggatgcatgacgtacctccggcataaagtccgcctttggtttccccattcctctccttgtcctccccttatggcacttgataaggtgcgcgagccagcatcctggttagtacaagatctgatgaatcttcgggaagtataatgacagcatgttcggtcacggaattacttacctggggtatctggacagttgcagtcngaggcccgcatcctctatggtgaccaaacactttaatcaatgatccgaaagaataatggatacatccctcngggcgttctgccgaagaaatgctaaacantcacgtcccttccaagtttaaccccacatacgagangccacnttgacaccgnaaaacctgacnaactaacatacttgattactngncaaagattganaccttccttangngatccnaatgaacttngcaatatcanaagtcatcaacgattccaatccaacccttgttgaccccatcantntgcggaggggaaaccgaaggcgggnggcgccanttccngcccaggggggccggtacaattcccaanatngtcnataacccncaaggcgtctttaaag

SEQ ID NO: 91757 - DNA, 249 bp, Triticum aestivum
  Clone ID: PAT_TA_91757
cttgaaaacagcacagtacatcatatagctagttcaacttcataagaacaatattagaacaatatatacatttcccttatcaagatcatccaggcacgtcttatccacctctgcttttggttcagtaagaacctgttttgcactgtccaactaggaaagtgcctcctccttcgccaacaccatcttagcaaagtctgatttaaaaacccgagggggggcccggtacccaaattcgccctaaagtgagtc

SEQ ID NO: 91758 - DNA, 312 bp, Triticum aestivum
  unsure (1)..(312): unsure at all n locations
  Clone ID: PAT_TA_91758
aagtattgggtgtagttaatattcgagtgtgtgatacgtccattttgtatcatgcttttatattgatatttattgcattatgggatgttaatagacatttatgtcacaatacttatgccttttccctcttattttacaagggttacatgaagagggagaatgccggcagctgggaattctggggctgggaaaagaagcaaatattaagagacctattcctgcacaattngcaaaanccctggaaaccccacgaaagcaantttgggatatattaaaaatattggggcgaagaaacacaanagggatcagcac

SEQ ID NO: 91759 - DNA, 606 bp, Triticum aestivum
  unsure (1)..(606): unsure at all n locations
  Clone ID: PAT_TA_91759
gccaatcccctcctcggtcacataaaaaaagttccatataaattattatccataaaatagccagacatacctataaaataggaacacatcatcagctactcactccgtaaaattacggtaacatcatttgatttcgttacagccacttttatgcgccatataggttgcacacatgcatgatgtaaaattactggcatgcaggaggtaatattacggtgctctcctttgctttacggaagagagaagttcctttttcaaactgtaactttaccccacatgcttttgtttcctacgttttgagttctgtccgtngagagataggctggggtgaggagtaagcattccccacccaggatgacgaatagcgcaagtcaatgaacattcaaatttacacatcgatatcgcaaggcaatgaacatcaaatttacacatccgatatcgcaagcaatgaacatcaaattaattaacagttacaactcngctcaccctgaacngaagaccagcatcgtcagaagtagttggcccatgatnaaagattggtgagcctattgtcactgtactgtnaccnaagagtgnnacaccaccgctgcaatctggtanngntgg

SEQ ID NO: 91760 - DNA, 343 bp, Triticum aestivum
  unsure (1)..(343): unsure at all n locations
  Clone ID: PAT_TA_91760
tgtaggttcctcttgcagataaacctcacagaatacttggaagtggcagatgttggtaacagagttgggaccgatgtcttgaggggtgcagctgaaaattggctagtacatctcggaaattttttgaaccgggaggggctaaaaactcgtcccgaagatgattaacaaacnacgactactctccaatccttggtgtaggaggatttcctggncaanggaacctnctatgggntaaaactttcttgggcnaaagnnccaattttaaanaaggtaattaattgccccccgtatcccaagggggggggccggtaaccaattcnccctaaaaaggangccctnttaa

SEQ ID NO: 91761 - DNA, 548 bp, Triticum aestivum
  unsure (1)..(548): unsure at all n locations
  Clone ID: PAT_TA_91761
cggaccagcctactggcgcaccgcaacgatgagcaaggaactcatcgccatgtcttttgtgctgatgctctcggcagctccgccgcaagcatcggccgcagtccatggagccaccagagggatcctgtatatcccttctaatgactccttgggctcactgcatcacggggtgcggggacatcgacttcacctatccctttgggtatagggccggctgcttccgtcaaggctttgatctcacctgcaaccactccaccaagcatcccaagtctttttggggcagcagtactgtccagatnactccgcatgtactccaactacggatattatgacccctatatctacaacttacaacgatcctaagtacaaatacgtncgactcatatggaaggccctgctaaaggagaagncaccccangaatggaacggtnaaactnttgcnctnaggttgggctggaacggnaaggtntgcangggcggttaaaattttcnggggnnggattaaaaccccggnnanggaaaaantccctttaangggggggagnaaa

SEQ ID NO: 91762 - DNA, 572 bp, Triticum aestivum
  unsure (1)..(572): unsure at all n locations
  Clone ID: PAT_TA_91762
ggcgcatcagtggtctagcgtgtcctacagtcagcacgactctgataccaagtgttgtggcaccccagctcagagcaaccagtttacattgcattgcctccccagagatcaagtcttctggcaacacacaacaacttggtacagaaaacaaccgctttattgatgctagcggaaacataggtctgatattacatcaagtagcgaggccaagcggcacacacagtgcagctgaacaatatgtacattatttaatgaacatgagtgagcctcgatcacgataactacgcgacagcggaatgatgacgaagttgaactccatagcacatggacaccgatgtggacacgatctagaccggaagctctccgattcgaaaacgacttgcctgaaatctggcatgacacccaggtcaagtacattgaatgtactgcaagctcacaacaaacataagcataatggnaatcaatatcatgacaattatcngataatgaatgcaatcatactactgatccggtgaatcaactgtgnnacgagtcatcngatccttacanaggntactctaccaacgggatat

SEQ ID NO: 91763 - DNA, 578 bp, Triticum aestivum
  unsure (1)..(578): unsure at all n locations
  Clone ID: PAT_TA_91763
aagacgtgttcctcgacaacttccagggcacatacgtgcgaccactggacgccgatgatttgagccacattactcaacaacccgaagagtcagccaggaaattctggactcggttcctaactaaaaagaaccagatagtcaactatccagacgcgaagccctagcgacttttaagcataatatccgtgacgagtggctcgcccgacacctcggctagggaaaacccaagtccatggcagctctcacgacactaatgacccgcttttgcgcgagcgaggacagctggttggctcgcagcagcaccacgccacattctggcacttcgaacatccgtgaaaataatggcaagccacggcgcaacagacacaagcacgggacaacagcgacaacaccgaagacacgacagtcaacgccgaattcagcggnttcaaatccggtcagtggaagaagtcgttcaaaagaaacatcanggacatcaatctggacgcatacgggacaccatgacaaatcatggaacccagacaagcagcaacacacaacagagacggatggtgttaaacangnagaataacacngaa

SEQ ID NO: 91764 - DNA, 320 bp, Triticum aestivum
  Clone ID: PAT_TA_91764
accaaacttctctagttttgcaaaaagatgcccgcacttgttccctatttacaaacaactccttgtctctcacaatcagccttatctcctccccaccacatctagaaggccatggaaaaatctggcgcgatggcatcctcgacgaggtcctcgtcggcttcctcgacaagttcaccgttgtcaagaagctcgcggacgaccttgacgtacgcctccagcccacacgcccaggctttgcgatgcctaccaccctccacggcctctatggtgacaacctcttcgacgcactggtggccctgcgactgcctgccgtcgcgccg

SEQ ID NO: 91765 - DNA, 218 bp, Triticum aestivum
  Clone ID: PAT_TA_91765
gttccgttctgggcagcctgctgcagacgggcaggaccatgacctacgacctccaagacggtatgctgacgtttgacacgttcgagacggcagcagctgcgcccgcgccggcgaaggtgcagctcatgataatggccactcttcttctctggtgggtgctcctctagttctactaccgcgctctacgttaataaagtctctgccgtaaaaaaaaaaaa

SEQ ID NO: 91766 - DNA, 236 bp, Triticum aestivum
  unsure (1)..(236): unsure at all n locations
  Clone ID: PAT_TA_91766
tttttttttttttttgtcttgttggaagccttgcnatnatccatgattaacaaaattggnagttatatctttcccaagtncacccggcanagaccatgcatacganacaacactcttttcnttctgacacattctancagcaangcaaaaaggaatccactgaggatctnattcgancncnaccccttcagtaaagtttggcnttanntttcgatncgtttggaccgagggccttg

SEQ ID NO: 91767 - DNA, 571 bp, Triticum aestivum
  unsure (1)..(571): unsure at all n locations
  Clone ID: PAT_TA_91767
ctcaagtttgtcatctttatttataaagtgtctagccttgtatcttactgggaacatctatatacaactgccaactgaaaggtctcgagagctttgtcgatatggcacacacatgaactacataagctctgcaaagatgtaaatgtcgacacaaacttgagggaacagactgttagtaacatgcagcaaggcggcggagcatcaaacagctgaacccgcagcagccaccgtcttgctgagcagctcacggagcgcgccaggagaggtcaccggaggactgcacttgaactcttggcacacatgcgccaccgctggcttccccgatgggctgctccgtgccatctgcgcgatgttcgcgttgttgctctcccagaatgccatctcttccatgttgctgggatctatctggatcacggttctgtttgggtcgtatgacgagaatgcagcancgacatgtcttgaaatctggagatcttaatccccacagcacnactgctcctgacggacatgacatgtcgcgcgcacanacaatggaatgcaagcaagtctcatcagccnaaacgcagggann

SEQ ID NO: 91768 - DNA, 291 bp, Triticum aestivum
  unsure (1)..(291): unsure at all n locations
  Clone ID: PAT_TA_91768
cccagctccggccgccggcgatggccgtctccgacctcctccccctccccttccccgtcccgccgtacgcgctccacgtcgccgcgtcgctggccctcgcggtcgccgcgcacttcctccacgtcacgtccctcctcctctacgccgtccacacttacatccacccggacgctgtgccctccacggggcnccgcgtcgtcgtccgcccgcccggttccgnccctctctcnggcaagcgcggnncggccggtncnccggnctccnacggctcngcgcaggtctaccgcctgg

SEQ ID NO: 91769 - DNA, 639 bp, Triticum aestivum
  unsure (1)..(639): unsure at all n locations
  Clone ID: PAT_TA_91769
gtgcctttaggtcttcttacggtcgagtggctgtcttcatggtcgactgcttgtgcttctggtcgagtgcgtttgtatccgtcgactgggaaggccaggtcgactgaaatgctgatacttcttagaatgtcttttattgtaggagtcatgtccttgattgggtaccttgggtatgataagttaccctaccctaggtatgtatcctcatcattagcccccgaatgggcaagggttaagtgagaatggggctgacctgtgcttccgactcaacctccatgcttccggtgcatctgcctttgggataaatggaanttacggcgggaaccattcctcatttgtccttgattcattcaattccgtccaatggttcaaattacctccatgtgtttttaagacaanccccaaggaacttaagaacgttttttntccganaaaaaacccggnanttcngttttaaggattcaaatttggaancaccggcggnaaaacccccaaccgtggtaagnaagggcncattccggcactttncaatacntcttcccgcgcggattacgggggaagccatgtacaancgtgtgctaaaaaggagntaattttcaggccccgtttntcctcccnantcccccccgnantaacncc

SEQ ID NO: 91770 - DNA, 644 bp, Triticum aestivum
  unsure (1)..(644): unsure at all n locations
  Clone ID: PAT_TA_91770
agaaccacaaacctgacagtccaataccacccttgacattgaaccaagcaggatgtttcacagtttgccacagcaaagcatgggattcaaaaattgttacaagtgcttggtgggtgtatcctcatcaagttagcaaaacagctcccactggcgagtacctcactgttggtagttttatgatccgtggcaagaaaaattccttccacctcaccccttgttatgggctttggtacctcttccgtttgggatgagattgcttggatctcatctaaatgaaaggagattagggtgaanatnaagccttcccagaaccgannaantcccctcctaaatgaaaggagattanggcnaggataacccttccaanaaccgancaagccccaaacacaaataccctnancgttaaactgcacnnaaataatagcaagaccaagatatatcacagntanacggnttcacagatattncacattaacgncaagtgggtacgcggcaatccanatcctaaacaaacatggaaatgaagagctccttcaccacaaaggtngctaaaatctgctggcctcaagggcgnaanccctctncaatcttcatttggaaccggtnttgtgaaaccaggaaaaaccnttttaaccnaaaatnan

SEQ ID NO: 91771 - DNA, 404 bp, Triticum aestivum
  unsure (1)..(404): unsure at all n locations
  Clone ID: PAT_TA_91771
gcgcagggccttgaccgtcgcccaggcaagccaggctggataggcggcggcggcgacgaagccgagccgagaaattccccaccaaaggttagagcttttcgagttttggtttgcgcccgtcttcaggccgccggcgagccgggcgcgcgccgagccgccgcgggccaggagaggcgcggggccggctgattcggcgccgcgtgacgaggcctccaggccggcaacccgggcgcgccaggagccgccatcgcccgtgcaagttangangagctcagatttgcccattcaaggctcccaagaatgangggtactcccgactcctgacgacgatcccggcgctccgttttcgcgccnatctgcgccgagttacaaaggcaagacgacggtggnagcatcangcggct

SEQ ID NO: 91772 - DNA, 624 bp, Triticum aestivum
  unsure (1)..(624): unsure at all n locations
  Clone ID: PAT_TA_91772
ctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcttacctgccaccgctcagcacggaggcctcctcaagcangtcgactacctgatncgctccaagtgggtgccttgcctccagttcaacaaggttgggttcatcttccctnnagcacaaccatctcctgggtactacnatggccgtattggacaatttggaactgcctatgttccgggtgnactgaagccacacaggtatnaacaagtgggaggangtcaagaaggatacctgaccctattccgataaccgttcnanaatctcaagtcattctcactcatcctnaacaacngctcaagatccggaagctaaanataacacanagcatttaatcatganttgtaaccgaatgntggttctccatactttantgtcaaaaaattagtcagtancaatgtcaaaannctatatcacgngattttccg

SEQ ID NO: 91773 - DNA, 360 bp, Triticum aestivum
  unsure (1)..(360): unsure at all n locations
  Clone ID: PAT_TA_91773
ctcaaaccttatataaagtgctactctaagtatggggaagtagttcaaacattgacaagatttttccgggataaagtttgtgtagacccaaaagagatggactctaatgatagcgttacaccgcctgcagacaaatgtctgccgcaggagattctatctgactcgcctgccacagcagtaaattgagcancaagggaactacagttcattgaattcaaccacccagaaaaacnacttatggagtttacccaattanacccngccannccacnaaccttcccaatnaanaaggggttcactttttttaaagncanaacccccaagggnggntttttccagggcncagggngttgttttttt

SEQ ID NO: 91774 - DNA, 394 bp, Triticum aestivum
  unsure (1)..(394): unsure at all n locations
  Clone ID: PAT_TA_91774
gtcccctgcaattggctcgacggcaagcacgtggtcttcggcgaggtcgtcgagggcatggacgtcgtcaagaacatcgagaaggtgggctcccgcagcggcacctgctccaagcaagtcgtcatcgccgactgcggccagctctagatccgtccgcccgccggtcgcctgtcgtcgtcgccccgtgtcccgtgtcgtcgattctaaataagagancgtgtgtcctgtcctgtcttcccctttgtccgtccgatgagatttccgttggttggttaagaaggttttaangtggatctttttggcgctggttntgtttcccgnggcanggtaacttcccggngncggcngcaactaacggtttgaatanatnaccccncnataattaccggggggg

SEQ ID NO: 91775 - DNA, 609 bp, Triticum aestivum
  unsure (1)..(609): unsure at all n locations
  Clone ID: PAT_TA_91775
cctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccaacaggtgatcaacgaggtggaggagtcaagaaggagtacctgacgcgtatgtccgatcatcggatcacaacancgtaggtcantggtaactcatcgcttnagccacgggtgcaagatcggaaggctaacagtaatcacacagcatttantgcatgaatttgcaatcgaatgcttggttcctccattacttctattgtcnanaagttagcantat

SEQ ID NO: 91776 - DNA, 364 bp, Triticum aestivum
  unsure (1)..(364): unsure at all n locations
  Clone ID: PAT_TA_91776
agcagctcccctgcacggtgcactgttccattccccctcttcctcctctttcaatgccgccccgggttcaaacctcccatctaataactgcgccgcacacgtactaggtaggagtaggcttcaagtgctcgcccgccatgccactccactcccacgtccgccgcctccgtgctcttgctgctgggcctttccaccaagggttcccgatctgtctcctcttcttgcgccggcggcgtccgggacnaggcggcaatnttcgcggccgctttcccgtattggcgaattccgggcgaaggctttccggaatanagctttccggagagtgcccncnttttcngggacnaagggcncttggcttgggngg

SEQ ID NO: 91777 - DNA, 552 bp, Triticum aestivum
  unsure (1)..(552): unsure at all n locations
  Clone ID: PAT_TA_91777
ctcgagttttttttttttttttttgtacaccttctcacaactttgtcttcagttgtgatgtgaatattggcgttgatttgtgaaccattgagatgcattagccatggtagtttcatttgtatttgatggaatgttgtaacgagataatcttgaggcaagacacatgaatcctaagttgaaacctttttttcctgcgggaaccaaagttgaaaccttcatagcatcacagtacaatttcatcaaaattatgcgtacatataaacaaatcctgaaggattgatagcaatgccagaaacaattcaactttgttttgccgacatgttggacatccttcatccggctccacctgccatgcagcaacattgagtgcacaacacaacttcanggaaagatcactccggtcgttgcaccgcngtagtaatgactagtgagtagtcaaatcatanagcccaacttcgcacagtaattgctcggacaagcaacatcattctcgtccctgaaccatggactccatatccacgtatanttgtcnagggggccggaccatcgcca

SEQ ID NO: 91778 - DNA, 313 bp, Triticum aestivum
  unsure (1)..(313): unsure at all n locations
  Clone ID: PAT_TA_91778
atgacactaaataaatttttgcaaatgaacaaagataaagtagagacgtaagagagagtgaagacttgaagagtgtaattagtaaacatcaagaaaaagaagttgctacaagaataagaaaatagagaaagagacagagattaatcgagagatacgagaaaagagtaaaagaaaaaagaaaacaagaataaaataagaatcaaaagtaacacatagaataaaaagtagagtagaatagaagaaggnaattgagagantnatgatgataatgntgtgaaaaaagagtacagaaaacgacattaaaaaaaaaaaa

SEQ ID NO: 91779 - DNA, 624 bp, Triticum aestivum
  unsure (1)..(624): unsure at all n locations
  Clone ID: PAT_TA_91779
tttttttttttgaagatctacatatgaggttagtgatgcatcatctggaactagtactaatagaaaaggcactcggtcctccaagcactactccctaacgaccacaattcttctaaccgggcatataatagctgaaggcgttgtggcttcttgagcatctatgtctagggtccagacaacgacattttctagtaataataaagtatggagagtttttgcccgtctacgttttataaaaaagaaaagcctgtgagtttttctttaagcaacccacggtctaacattaagtgccctttctctattgggcttcagcttgaccatggtagccgctagctcgcgcatttgggcgctggttaatataccgcgttcaaatgcagtgtataagccntgttcggnagttaagtccctggctttaataattacagaaatatattaacatgaccatggtataactttgcaaacataactcggattaaataattgtanagtaacttgatcgaaagggggggccggtaccaattcgcctanatgatcntataccncgccacggcctcgtttaaactctgacgggaaacctgngtacaactaacncttnanaaaccccttccacgggtanacaaaagn

SEQ ID NO: 91780 - DNA, 207 bp, Triticum aestivum
  Clone ID: PAT_TA_91780
ttatgagctcctaaaaatattggtttgatttttatctctgtccaatattttcagagagcaacatgaacattttcttggaccattttggaggaatttttatctgggtcatttccagaaatgattctaagggtttcacaaatccccatttcaaatttaaatgaaatttaaacatgatgcacacatgactagctagctcgaagggggggg

SEQ ID NO: 91781 - DNA, 246 bp, Triticum aestivum
  Clone ID: PAT_TA_91781
tttttttttgctataattattacttactttttgaagaattgtcttctcttaggaaattcttggattccaagtttaaatgatcagatgtcaattgttaagtaaagtaacaatctaagtatgcaaaatgttgaacatgctgaaggtagttcggatagatcaagtgtctcagtgatgccacagaatgtttacaattttgcattagatgtgtacaagaaagtcaagtgggtagtacaaagaaattgaaat

SEQ ID NO: 91782 - DNA, 567 bp, Triticum aestivum
  unsure (1)..(567): unsure at all n locations
  Clone ID: PAT_TA_91782
agaccctctagcccattgggacaaccacctagcagcgcaagaccacggctccatccgcacgcctcaactagaggaccacctcactgggacatagaaggtcatcattgccatccatgtacctacagatgggatcgcgactatggatgcctcgccaccagagaccaccccccccataaacaacactaccacagctggacaaccatacctatcctaaagctaccacaagtagaccacaactcttcatcaaaggttgccccgagcagatacctccctaccgctaccttcatcgactagtgccgagacttacccgaccagtggtctctagtaacggcgaggggaangaangaaaagggtgtangggacatgttgtggnaaaaggaagaagcntgtttggtttctccccaaaannaaaattnggancaatcatatagtnataacaaatcaatggccaacaaaaaattcatgaaattagatgattttgtgtaaaaannatggtatcnctaaataancatatcattctatncaatttnnagaacaaagggnattcaattacncggancaatcnat

SEQ ID NO: 91783 - DNA, 635 bp, Triticum aestivum
  unsure (1)..(635): unsure at all n locations
  Clone ID: PAT_TA_91783
ccgcactcgacctagccgcctcctcctctcttccttcctcccgcagccgcctccctccctccctcccgcgcgcctcctctcctcccacccacgtcgccgccgccgccacccacctccccgctgccgccggcctccctcgctcgcgcctccgccccgcgcctcccccgcgcccagctcctcccgcctcgctgccgcctcctctcccctcccgcgcgcctcctctcctcccacccacatcgccgccgccaccacccaccgccacctagatgacagcaccggcgctggngctcgtggtggtcgggtgctgcgctacctgccgccaccgctgcgctcgccctggtgtctccttctcaacacccccttggncctaacaagaggggtgctgctcgccgcctggcctcacgggagtggtcgcaancccgccgtcttcggatcgggcgccgccgcatctctattcttgcgccggggtggatcgtgtatganaggacgcaaatggagncaaggcgtgggctcattaangnaaggcancggaacgagcaangccacttcggtcnattnantgccaaggtgacagtagtcatggctnatncaantgccaataganngctaaaaatatcaagattganggagnaant

SEQ ID NO: 91784 - DNA, 574 bp, Triticum aestivum
  unsure (1)..(574): unsure at all n locations
  Clone ID: PAT_TA_91784
ccccactcctggtctctctcccgctcctatcctctcctcccctcctcgcgccgccgccggcgcccacgccgcggcttccgctcccccccccccccnccagccaagatgaatgttnnnaagctcaataagatggcangtgcngtgngcaacgnagggaagggtatcatgcgcaggaagaacaaggctgtncacaagacnacanctacagntgacaaaaggctctanagtacnctgaaaagantaggagtgaacaccatccctggtatcgaagaggtcaacatctttaaagatgatgtggttattcagtttctcaatcctaaagtgcangcttcgattggtgctaanacatgggtggtcagtggaatccacanacaacnaanctgcaagatcngcngcnatcaattatcaatcaanttggtctgacaaattggacaactgcggaggctncaaagcaattcaaaagcangccccggtggggctgctggatcaggtggtgcaatnaaggggngccaaggtgacanacataagttccgantttcctgnaaaaaatttatagccctaaaaaaaaggaatt

SEQ ID NO: 91785 - DNA, 592 bp, Triticum aestivum
  unsure (1)..(592): unsure at all n locations
  Clone ID: PAT_TA_91785
gttcttctcaccttgaatacatgtaacaagacctttctcaagttgatccttcaacttggcattctcctccacaagatgcacatgctcaaaacacgggttagtggcatatgcattatcaattaataccatatgaggaaggtggcttttcccttggttagcttaacttggagttgagcatgagactccttgaggttagcgtgagcacccttcaagacattgtgggccttgtcaagtacatcaaactcctccttgagtctagcatgatcaaccccaagtttagccttctcggaagttagcacacgagacacaacaagagcatgatcaagatctttctttaacttagcatggtcgtcgttgtgtgactcctcaagagccaaacgatgcccacgctattcctcaagagcattagagagatctgatatctcatcgacatagcacgactatgaccttccatcttanagatggttccttgtgaacctcgatgattcatggcttgacaattgttcaaagagagnaacaaagtgctctggattgccttgactaccataatgccaatcatcaanctataaaccccaagtcacatgacacaagg

SEQ ID NO: 91786 - DNA, 585 bp, Triticum aestivum
  unsure (1)..(585): unsure at all n locations
  Clone ID: PAT_TA_91786
caccgatccacctcaccatcctctcccccccttctccatctccacccctctcctcgccgcctcttcatgcgccattcccgtctagcagcaccgggcatccacggcgcgcacaggtagaacgagggatcgagatcgaccggcgatgccgtcgctctcctgccacaacctgctggacctggcggaggagctgcccccatccccgctccggctcccgcgggtcatggccggcgcctccccctcctcgccggcctcgccgtccccggccgggccacctcgccgggtcatcgtctcgcaccggctccccctccgcgcgtcccccgaccccgcggcgccgttcgggctgcgcttcaccgtcgacgcgggcaacgtcgcctaacagctccgctcgggcctgcccgcctccgcccccgtgctgcagtcngnacgctgcccccgccgccgccgaggccgcctcgaanaactcgcagtactgctggngacttccctgctccgtcttctcccgcgactcacgnagtttacaaggtttgaagataattggcgtctcacactgtcgtaacctcagtggggtgcttacgggttaaactt

SEQ ID NO: 91787 - DNA, 473 bp, Triticum aestivum
  unsure (1)..(473): unsure at all n locations
  Clone ID: PAT_TA_91787
agtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaaccgctcaacaacggaggccctcctcaagcaggtcgaactacctgatccgctccaagtgggtgccttgcctccaagttcaacaaggttgggttcatcttccgtgagcacaacgcatctccttgggtactacnatggccgtattggcaatgtggaaactgctaagttcnggtgnatgacgcacaaagnatnaacaaggtgaggagtcaanaaggattnctgacctttttcgcatcatcggttcanaanatctcaggggatgngtcaa

SEQ ID NO: 91788 - DNA, 534 bp, Triticum aestivum
  unsure (1)..(534): unsure at all n locations
  Clone ID: PAT_TA_91788
tctcctctctcctttccccaacccaaaccaggagcgccctccctcccccagccgcccgccccctccccacccaggaaaccagccatgaagggggccaaatccaagggcgccgtcaaggccgacaccaagttggcggtgaagagcaagggggcggagaagccggccgccaaggggaagaagggcaaggccggcaaggaccccaacaagcccaagagggcgccctccgccttcttcgtcttcatgggcgagttccgcgaggagttcaagcagaagaaccccaagaacaagtccgtcgccgccgtcggcaaancggccggtgagaagtggaagancttgagcgaatcnganaaggcccctacntggcaaggcaacaactaagggcantacaacaaggcaatgccgctaaacaaggcaaatgtctgtgctgccaaanaagngnggcaaggaggtanagaggacattaggagatccanaatcaatcgggattaatgtacatacatangtacacaggacaggacatnncataaccgnaat

SEQ ID NO: 91789 - DNA, 607 bp, Triticum aestivum
  unsure (1)..(607): unsure at all n locations
  Clone ID: PAT_TA_91789
acgaactggattcgggtaactccgttgatttctgcaagccaacaaaacatctatcatttcttcacaactatcgggtttttgcataaactcctttgatacgtgtgctaatgaaatcatagcttcttccagcttccttccttcaacaaggttatgtctattcattttcaaatcccgggcctgtgggttatggcccacttcatacttgtacatctttcgtatctttgaagttttacctattccatattccaacattaaactttcttagtattcttagtaccaattgtacttcattgtcacaaccctaaaatatctacttgtaaatatttattttagtgagcattcatgcatcatatttgttctagtgaaattcaactgaggagtattcaaagctcagaaattattttaacaaaagggcaagaacttaaaaattgcattgaatgaacccaagatgccttcaataatgtttgtaantttggaanggtttgatcaaacaaaatatgacattttaggattatttgggccttgaattaatcatagcaattgattgaatnnatcataaataggaatattcaataacttgacaattagtcnttggaaatcanagana

SEQ ID NO: 91790 - DNA, 617 bp, Triticum aestivum
  unsure (1)..(617): unsure at all n locations
  Clone ID: PAT_TA_91790
agtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcagcaaggttgggttcatcttccgtgagcacaacgcatctcctgggtactacgatggncggtattggacaatgtggaagctgcctatgttcgggtgcactgacgccacacaagtgatnaacaagtggaggagtcaagaaaggattaccctgacccntatgtcggatcatcggattcaaaacatgctcaagtgnatgcgtcaacttcatngcctnaancaacnggctgcaagatccggaaaggctaaaaatcatcacacagcatantaatgcatncatttttaaancgnatgcttggttcctccattacttcaatttccaaaaaaaggngtcaagtn

SEQ ID NO: 91791 - DNA, 600 bp, Triticum aestivum
  unsure (1)..(600): unsure at all n locations
  Clone ID: PAT_TA_91791
tatatccaggactctatttcacacacattgcatatgttacattttttgattaacccccccaaactctcaagaacccacacactatatctctctaggtgtatctctctcacacaaccccacgtaggtggtgtacgtatacaagaagagaataggtgcaccatgcacgtactcacgcttcgtgcccagtcacacccgcgcgggtacacggtggagctcatttctttatgaaatggcagcccacatgcttatttgaatgcctgtagcggttgtttacctagggaggtcgtgtacaacgcgtgcatgaaacaaagttcgacatgacgcgttgccgcgttatttttgaataaagttatatcgctcaatggcacgtacacagaatataaaacgagttttatggataaaaaggtagtacgctcactatatacaatggagcctgtctgcctggtttgtcgctcttanagtactcacanaagntggggtggctcctctctcaacgttggcaatgatcaacccatccgtcaacggggaaaggatncgggggctctcccccaacgtggcacgatcggcgacctccccngggaaggaggatgatntttcctt

SEQ ID NO: 91792 - DNA, 421 bp, Triticum aestivum
  unsure (1)..(421): unsure at all n locations
  Clone ID: PAT_TA_91792
ggcacccagagacgaggaagggcgtagcaagcgacgaaatgcttcggggagttgaaaataagcatagatccggagattcccaaataggtcaaccttttaaactgcctgctgaatccatgagcaggcaagagacaacctgggcgaactgaaacatcttaagtagccaagaggaaaagaaagcaaaagcgatcccgtagtagcggcgagcgaaatggggagcagctaaaccgtngaaaacgggttttgggaagaagcaatacaagcgttgtgctgctaaggcnanccggtttagttccgcaccctagatggtnaatccaattaccgaaagnatcactacttacnctccnacccgantacatngggacgnttgaaccnttttgaacaacaagggcaacttgccagggtaaatccctggntaccc

SEQ ID NO: 91793 - DNA, 377 bp, Triticum aestivum
  unsure (1)..(377): unsure at all n locations
  Clone ID: PAT_TA_91793
cttggacgctgagtgaacatatatgtttgtgataacgttttttattttgctattttgagcaaatattactgatacatatggggaatgtgtccattagttccaagaaaatgtgtacttgggttgtaactcgctgttgtgtaaccatgtattccgtgttagcaattgtacgtcttccatatacaaaggagcaatcatccgtcacattaagcgtataatttagcaaattccccatgtgcttgggatgcaccagccgtataatccttggttgaagctggttccnggctgattgtgacggttnaagatgcaacttacaatccaacagttgtnggagttttataaccanaaagaaaagaaaactactaatccgcaaaaaaaaa

SEQ ID NO: 91794 - DNA, 173 bp, Triticum aestivum
  Clone ID: PAT_TA_91794
ggcacgtccacctcggcaacgcgctgcccaagctccgcaccatcgtctgcgacttcgccagcggcggtgccgcgaagcccagcgtctgcatccactccaccgacctgggcttcctccacgcgtccaagttcctccgcgtcatcgacatccatggctcgagggggggcccggta

SEQ ID NO: 91795 - DNA, 338 bp, Triticum aestivum
  unsure (1)..(338): unsure at all n locations
  Clone ID: PAT_TA_91795
gtcttcctcgcctcgccttcttctcctctcaaatctcgacncaatcatcactctagctacactanggtttttgcccctaaaccaanactctctcanctctcgcgcccgctcgaccagcgcggatggggaangacgggtaaggggaaggaggccaaggggaagggcaagcaagcngccngctcctccgncgacncnggtggcagcaanggangcaanggcactggnaaaggaggtnnaggaaggcgatgactccagcacctgcaccttcgtnaaagntaagcacgtgttgtgncaganncaggggaagatnaatgatgcctacatnaanctgatagtca

SEQ ID NO: 91796 - DNA, 576 bp, Triticum aestivum
  unsure (1)..(576): unsure at all n locations
  Clone ID: PAT_TA_91796
tgggagggagagaagaagccagataatgcatggcatgtgtatgagagcaagggatgagtgtggagggctgcccctccacctctatttataggaaatcccaagggggtagggtagtttcacaaaaaacccaaaatgcacatgattgaagtccttccacaaggacctaggagtgaaaccaaggaacaagagggtccccaaggggggataccccatgtggccggccacacccccatggaggggccaaaaaaatggttcctancaaccaattcaacccaaaattcttttggggcaaaccccaaaaggtggtttccataaataaccataaagctgatttcactattcacgacgacattttcaagcgtctgatcgaactggaaaatattatgttgggctaagaaattccaataccactaaaagatttcaacgcttcccgaaaattccgtttaattcaaccgcgaaaccactgaatgggtccnggactccggaattccgtttactcaanaatccaaaaactccaaaagatccgggaccncaagatnacaggattgcgaacaattnctaagggtaccgaaaaat

SEQ ID NO: 91797 - DNA, 595 bp, Triticum aestivum
  unsure (1)..(595): unsure at all n locations
  Clone ID: PAT_TA_91797
ttgaaatggaaaaaaatttctaatgcttcaaacattttttgaaagtgcgaacattttttatataggtgaacatttttcggctgcgtaaactgaacatgatttgaaaaactaagaacattttttgaaaaatttgaaaaacaagaacatttttcatacatgaacaaaaatttgaaaataagaanattttttgaaatttgtgaacaatttttttggaattggtgaacaaaattttaaaatggggacaactttttaaattcagaacaattttttttaactgagaacaattttgaaaaggagaacattttttatatacatgaccaaacagttgaaacggaaacttttttctagtgcttcgaacattttttgaaagtgcgaacattttttatataggtgaacatttttcagctgcgtaaactgaacatgatttgaaaaataagacatttttgaaaaattgaaaaacaagacattttaatacatgacaaaattganatagacattttgaatttgacatttttgaaaangatttttaancagcataattcaantccaaanacaaatattganatttnaaaacagganattcgaaatcganaaa

SEQ ID NO: 91798 - DNA, 611 bp, Triticum aestivum
  unsure (1)..(611): unsure at all n locations
  Clone ID: PAT_TA_91798
gcgggggcacgctgagtgcacccgctgggtgtagtccccaaggctaaggtcgactgctggcagtcggccttaggctttatgatgtcaatttttctgtcagtcgactatgtcgactggatttcgtaaaccggtgggggcacgctgagtgcacccactgggtgtagtccccgagattgtggtcgactgcttgcagttgattacagtcttaaagaatacatctctctctctctctcttttttttgaggtcgactggtcgactttatcttcaacaggattagtgggggaacgctgagtgcacccactgggtgtagtccccgagactacggtcgaatgcttgtattcggctgtagtcttagaaacgtgtgatttttcctttttcactcggaagtgaattatatttgacatttaatcnattggntcntccagaactcctgtgatcttgtggctcgctactcnaactggaaaacaagcacatcaactccaactancttgaaactggtcaagagaactgacaagnaaaggaggagacnaagtattttgtanacctacacgctttccctgctgttaaaaccgattgttgtactnnctaaggaaggaggcataaaaaaaac

SEQ ID NO: 91799 - DNA, 313 bp, Triticum aestivum
  unsure (1)..(313): unsure at all n locations
  Clone ID: PAT_TA_91799
ntctttcgagaagcaattgaaaaaactaccactttcccncggtggcactccantgcatgtgttgattgattctgnagagttggntanaacatggncgaggattacaancgttcanatggctgtcacttcctcttggaccgtgtgtgatgtncctgtaanangggtaatcgaccagtggttatgaacncaaaancatatgtggggacgtttttagacatgantanaatnacngtcaaaaccaaagtatccncaanctaancaaccattgcaaaattgancatggccganaaaagggaaagtggngatctgccct

SEQ ID NO: 91800 - DNA, 607 bp, Triticum aestivum
  unsure (1)..(607): unsure at all n locations
  Clone ID: PAT_TA_91800
gcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactggacaatgtggaagctgcctatgttcgggtgcaccgacgccacacaagtgatcaacaagtggaggagtcaagaaggagtacctgacgcgtatttcgcatcatcggattcacaacatcgcaagtgnatgcgtcagntnacgcttnagcaacgggctcaagatccggaaggctaacagtaacacacagcatttaaggcatncatttgcaaancgaatgcttggttcctccaatacttctattgn

SEQ ID NO: 91801 - DNA, 576 bp, Triticum aestivum
  unsure (1)..(576): unsure at all n locations
  Clone ID: PAT_TA_91801
ctcacactgattctccattttgccggtatatccatggggataacagtccgtgcgatgctccagcgcggttgctgaggtcaatatattgagctgtcatgggttcggacttgacaaactcgggcattcaatcctgacagttttgagcatactgtggactgagctggttgccttgctatgaggtccttaccaagaatgggagtaagacctcttaggcgtatcttccacctgggtaattgggtatgaaacatcaagactatcttggggcatccataccacattttcaacataataaccggcatacctggtattattggccttgctcccttcattattatttcctcaaccnggttctttaactaaaagaatggggccttaaataccctttgacnattttcccggccctgaatatggcatgtgcanattttggtatcatcttngtntccnaagggggggcccggtaccatncccccaaaatgancctntacccctcanggcgccttanactctacgggaaaccgcgtaccaataaccctgcacaaccccttccaacggtatacaaangcccacgtncctcaa

SEQ ID NO: 91802 - DNA, 576 bp, Triticum aestivum
  unsure (1)..(576): unsure at all n locations
  Clone ID: PAT_TA_91802
gaaaattgtacaggaacacgatgaaccattttggaaggggttcttcgaggaggcgatcctcaggggcatcttctagtgacagctccgctcgccggtcatatgttgaaccaagtgaaagttccacatgagatgccaccaccaaaacatgcttatgggtctagctacgagtatatgatgcgtgtggagcattaaaggaggaatttnnagcaatatattcacaatgccggctccggtccctacatttcaaataagtngtgaacaccgcacattccttactggatcatttgtccaaagganttaattccancctccctgancctaggtgtccntnatgcttttatgatatcatttacancccaactagaattttgcttacaattgcaacttccattccggggattnctttnacaactgccanggtttgatacancttccttnactacctttgctacgtaaacaagggattgcacaaggcanataaaanatcattccgcattatactttcatattaagggaaagttatagcaacaaacgtntaacttagcctaactgncccaaanacgnttcacgtaaagg

SEQ ID NO: 91803 - DNA, 635 bp, Triticum aestivum
  unsure (1)..(635): unsure at all n locations
  Clone ID: PAT_TA_91803
ctggatttagattggaacgggagaggagcggcggtggtttaagaggagaggagcagcgctggtcttggaagtattttttgttttgcatattttgggtcagagtttgaccacgtaccgtatttgacaagcaaagtgtgaatgcttgtcaccaaaaattgtatcatttgggttccgtatctgaatgtactttcaaattatattatttttgcaacgtataacatatattttatttcctaaaaacatggtaattatgacccaagaataaaagggagactagttaatgtggggttgctttcttaattgaagggtaaattgattttgattttgatccagtcacagcgcgccggcctctcgcccaatcataaatcgctgcccatgctcctctccctccttctccattgcaaaacactcctacctccccancatctccattccaaaacaaccgtctcgcctctcctcttctccattgcaaacaccctctcctctcaanactcaatgcaaacacgttcgctctcctcctcccaatgnaagacacactaacctcctctctcaatgaaaacanccccangggggccgtacaatccccaaaggggccntaccncccaggcgcctttaanccgacggaaacctggtcc

SEQ ID NO: 91804 - DNA, 616 bp, Triticum aestivum
  unsure (1)..(616): unsure at all n locations
  Clone ID: PAT_TA_91804
gcagcgcctcatcttcgctggcaagcagctggaggacggcaggacccttgctgactacaacatccagaaggagtccaccctccaccttgtcctccgccttcggggaggcatgcagatctttgtcaagaccctcactggcaagacaattacacttgaggtggagtccgtctgacaccatcgacaatgtcaaggcgaagatccaggacaaggagggcatccccccggaccaagcagcgcctcatctttgctggcaagcagttgaggacggcaggacccttgctgactacaacatccagaaggagtccaccctccacttggtcctccgccttcggggaagcatgcaaatctttgtcaaagacctcactggcaagacacaccttgaggtgggatcctcngacacatcnacaactcaagggaagttcaagacaaggaggcaccccccggacaacaacgctcacttgctggnagcatccaggacggcctaccttgcgatacacncanaaggtcaactcaactgtctcgtctcggggagnatnaaatctntganaccnaatggaagcanncctgngggggtctcggacatcaaactcaggaantcaagnaagnggatccccgc

SEQ ID NO: 91805 - DNA, 629 bp, Triticum aestivum
  unsure (1)..(629): unsure at all n locations
  Clone ID: PAT_TA_91805
atcttgtagcacttagcaacgaagccctatccattagtattccacataagaaatccattctagaaaaaaatacaattagattagctcttcatagacaaacttggggtttgcgagccaaggtaagatcggctcgggatcatgggacccttttctatcagataggaggggctcttgtacaaaatagacttactaagtaataaccccatagaatctatctatataaagataaagaggcaatcgtgtcaggaagcgggtttttctttggccaaaaggtacttcgaacttggaacgagcatgaagagattaacgagacttctttctcttttgagtttttctggcggacctgccgcgcaagatctttgggtcctcccctgggaaccgatgaaaaaaagtggatngcttcctaagtactcgctcaaaatgatcctctcnactatagtcaaggctaatanaantanaagngctctggngnatccttacgacagaaaagatncatcagggtgataatatcnatgacatacttgtcgtccgaactaaggacngttaaaatgtttnaaatggnaagtccccctnataaggatggcattaaaaaagggttttaaaggaaggtgcaacggatgnnggaaatt

SEQ ID NO: 91806 - DNA, 594 bp, Triticum aestivum
  unsure (1)..(594): unsure at all n locations
  Clone ID: PAT_TA_91806
ctcccaccttcggccgccgtcgcggccaggccatcgtggcggcgcgcctccgcgacttcgctgctccaccagccccttcacccaccagcaccacatcatccagccaccactccgtcttcgccgccatcaccttgggcgctccacttcgtcgccgcgcctggcgcgcccgaccagacgggtgtctggttccccgcgccacctgctgctgctctctccctctccgctgctcctcccctcgtctccacttcctctgctctctcttcttctcctaaccctgctgttgctcttcttcttcttctctnaacgctcctgcnctccttctccttgcatccccttgcngttgttgcctcaacctgctgcttcttctccaatccccangctgctcccnatcccctttccttgcngggtcctttaacggaagaaaaaactggtgtgtccttactggttgctgatcctgtattcnctngaacccgaanggtgctncctcaaccttttctgncaaatattgtacnatgccgttaaaatggngatngcaatattaatggttannanatcgttgtnncgatacaattannggttgggaattcttggtgc

SEQ ID NO: 91807 - DNA, 291 bp, Triticum aestivum
  unsure (1)..(291): unsure at all n locations
  Clone ID: PAT_TA_91807
ggcgaatcagcagcggaaccaagccgccgacgccaccatgggtatctcgcgtgactccatgcacaagcgccgggccaccggtgggaagcagaaggcttggaggaagaagcgaaagtatgagctcggccgccagccagccaacactaagctttcaaagcaacaagacagtaagaaggtccgtnttccccggaggtaantaaattggaggnccccccttcntnaaacgggaattncccanggggnaantagggctnttaccccaaaaactntccccgggtggggtttaatttc

SEQ ID NO: 91808 - DNA, 597 bp, Triticum aestivum
  unsure (1)..(597): unsure at all n locations
  Clone ID: PAT_TA_91808
ccacactctccagcaccagcaggccggcggcaagcagcgcaagcacaacaaccaaatggccaccatcagcgccgccgcggcgaccaccgtcgtcgcccgtgccgccatcgccaggccgcaggccctaggtctgccccagctgaggacgaaggagcgagagggtgaggtgcagctactccaaggacgccaagggaggcgacccctgccgccgccgtccgcggggcctggcgcgtccctactcgccgcggcgggcgcggtgaccgcgtccgcggggccggcgctggcgctggtcgacgagcggatgtcgacgggagggcaccgggctnagcctggggcttaacaacaactgctgggtgggttctcctgggctctttcggctcatctggtcgtctanacgtttanactccngctcgacaagacaaagatccngnggctctcctctaaactanaatatttctcgtctctaatttatcgctcgcnaacatcccatatcgtgtatttatcaaaatgtatngttcnaacttcatctaattttcccgggggccgtacaattncctaatgatctatancccncaggccttgttaantctanngaaa

SEQ ID NO: 91809 - DNA, 318 bp, Triticum aestivum
  Clone ID: PAT_TA_91809
gcgaagcacggttggttcaggcagaacctggaagcgccccccgcggaacctcgatctgagcagtgcggacgctgtccctgctggctgctgcagctgtgagtgttgggaggcggaggcgtgcgcgccaggtgttcgacgaggtgtcgcaaccatgttaacgccattgcgcgtgttgctgcggtgccgtcggccgccgatccgcgccgccgccacgttctttaccaagctcaggaagcgcacccctcgcgcctcctcctgcgtctgtggagtccgctgatgagtcggagcaggaggggtcgctggcgcaacggtgccggc

SEQ ID NO: 91810 - DNA, 470 bp, Triticum aestivum
  unsure (1)..(470): unsure at all n locations
  Clone ID: PAT_TA_91810
gattagtctgagagaaaattatctactagatcgaaatttgtttttgtccactatattttccgccactccagtccatccacattgcaccgcgtacctctgccaagtttatgtgatcctcggtatttatacctctgccaagtttacgtgatcctcagtatttatttatcccgcgttgtccgcccttttccgtctttgttcagttccgcacacgcgcctgagtttggtgcacttgtacccacgtcccatccaccttaaaaatgttcatgtgctgccgcgtgcacgccccagccttccgtcacatctccgtttccatgaagttagccatccatcattactgtttaagtgttacaactagtaccacacatctcatcacttggggattggatttcttttgggatggttgctttctcaactctctaagtantacatactttccgtaaaattctctctttgttacnataaccgcttat

SEQ ID NO: 91811 - DNA, 626 bp, Triticum aestivum
  unsure (1)..(626): unsure at all n locations
  Clone ID: PAT_TA_91811
ctcctgcctgctacacccttatccacagccgctcccactccccccctccaatcccacctcccagcgtgcccacctcaaatggcccccctgccaccgccgccgccgccgccatctcctccggcgcgtggccgtctccgcgctcaccttagaggaacagctcgcgccaaccaacccaagaaccgtcaacccccgtaggccgttcgacggaatgcaggagaggaccgtcgcgacttccaacacggcnggacaacctgttcgacgaaatgcctcgcgtgagcggcgaagggcgcgagcgtacgtgacccgacggggagagcgcccccaaggagcggcgagaaagacgcgagtccggcgattctggcgctggcgcacgccaagcangacgccggaggcctcaagtcttctgcaggatgcggcggaacggctgccggtcaacaagttnatgctgccaacgtctcaaacctggcgcgcgctccaagaagcgggatntcccggcangcatcnnttggcataaatgcgcctgtgcaaattntggtgggnacgnctgtaanctantcnttcggctatgatatcgggaaacctccctaaatgcaggaaatgcnctgagctgtatcgggtattcgtnt

SEQ ID NO: 91812 - DNA, 504 bp, Triticum aestivum
  unsure (1)..(504): unsure at all n locations
  Clone ID: PAT_TA_91812
ccaagagccacctcttcggtgcacaacgtgctttgcatcaagagcaaaaagctatgagtgaacacatcgacaacctcgccgccgacttgcgactctccgagcaacgtacaagggactacttcgaccacaagctcgacaatcaagaagcaagagaatgacgcaaggatggacgagattcgcgctttgtttctcaactgctcttcttccacttcggtcctcaacaagaaggagccgttcaagtcgccactccgactttaccctctccggtcaaagtacaccgacatccgaacatcttcaacatgcccgcgcgcatgattgtcaagcaagctcaatcctggtacgcgacaccgatcctcaaagagcaccaacatgtcaaacccaacactttttgcactaacacaaagaacgggaacgacaacgccaacatgaagaggnaaaacgangcgtctacaccaagatgcacaaatgccnagnanaacgccaaganaacanccttgaacttaa

SEQ ID NO: 91813 - DNA, 410 bp, Triticum aestivum
  unsure (1)..(410): unsure at all n locations
  Clone ID: PAT_TA_91813
tttttttttgaccactctatcatagttcccagctgtnagatgtttcatcccantgcagcnanctagagatgtatanccaattgnccantcatcctgcgctnancattatccaatagacacacccctaaagggacctttncangntcaggtcccgtacattcttcaaaggtaaactttnaactaaataggcgttagaaacacanntaatcttcttttacccagcgtgaagnaccanttagtcaatcgtggacntnancacaatgatttnttcgcagccncaangtaannttctgggtcgcnttcgggggnatntttaccgngcaaggcatcaactttngacgccnagcaactctncntanggaanggnttccagttggcgcctacnngatggntgngccccattaagccaa

SEQ ID NO: 91814 - DNA, 480 bp, Triticum aestivum
  unsure (1)..(480): unsure at all n locations
  Clone ID: PAT_TA_91814
gaaaaataaaacaaataggaaaatacgtaaaaatgagaaaactaaagatgaccgataaacttgaaaggaacacagaaaagaaaaacccagatcggaaccgtcctaaaactccccaaaccgctagtgacagcacgactggaaatgtgttatgcggccatcccagtaagtacatggcagctaaaatgcttgaggagacggggtgctctttctangagaggcctattgtatattangtatcgccgtataactgggggacctttttccgatgccaaacaagggacctttgttcaaaggccaacgcatgtttaccgttatgtttgggaataaatttngcgtnntaaaaaaatgttcaancatatattatgattttttcaaccatatttgnaataaatgtcaacgttatactgaacaataaaattttagaatgttaaaaacnaaaaaaagaaggaaacgaaattctttaaaaggaaangngaaaac

SEQ ID NO: 91815 - DNA, 611 bp, Triticum aestivum
  unsure (1)..(611): unsure at all n locations
  Clone ID: PAT_TA_91815
ggtaccaaaaatggatttcggtttgcagtataggctggacaccgcatttccccaagaaacatcgagatgacaatccatgtacttttcacattcaggtgatggcccagacaccacttgcgctacgaaataggaattgttgagcaggaacaggtacctgaggcgtggatcnaagaacagttccgattttctcagaagtagatccttcagataatccatcgtgtcatctatcaacccatcaagatacacggggtcatggctcagtgcagtgttatgtgtggatgcgcgtgctttcttcatcgacacgatgtaatccaccatgcaccgggtattccggtgaacatcgcctcctcctctcgggagctcaatagcccacgagtcgtcgtcctccatgagtgtcctcacctcctccattgtgctggatatggctcgctaacagttcctcgtatctcaacaagccgtcatctcgttgaaaagcgtgtgcttctggtgagccacancgtctaaatatatgatcacgggagacnagnataattcaaaangcntacttcccctnanaacggatanggtcanaanaaacatcccaangccctncaacttnactcgaatctgag

SEQ ID NO: 91816 - DNA, 614 bp, Triticum aestivum
  unsure (1)..(614): unsure at all n locations
  Clone ID: PAT_TA_91816
gcaagctatatacctacatagtacagccatggcccccaccgtgatggcctcgtcggccacctccgtcgctcctttccagtggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcaagcacggaggccctccttaagcaggtcgactacctgattcgctccaagtgggtgccttgcctcgagttcaacaaggttgggttcatcttccgtgagcacaacgcatcccctgggtactacgatggcggtactggacaatgttgnaactgcctatgttcggatgcaccgacgccaccaagtgatnaacaagtggaggagtcaaagaaagatacctgaccctatttcgatcatcggttcacaacatcgtcagtgnatgctcactcatcgcctnaagcacgggtgcaagatcgnaaggctaaanacnatcacacagcatttaaatgcatganttntaatcnaatgcttggttctccattactctatgtcaaanattggcagtca

SEQ ID NO: 91817 - DNA, 166 bp, Triticum aestivum
  Clone ID: PAT_TA_91817
gagtttttttttttttttttggagcatctgtgctctttggttgatgacaaagagaggcgaggggatagagatgcgacctagaagacacgggggcatatggcagacggccaagacagttaacgcttacgtataatcagacacccaattttaatcgaaaaaaaaaaaa

SEQ ID NO: 91818 - DNA, 314 bp, Triticum aestivum
  Clone ID: PAT_TA_91818
aattctacttgccccttgtcatgcacaaaatcgaataaacattgcaaattactttacgcgaatctgatcctgagatgaagtttgtctctagaatatataatggactgaaaacaaaacccaaaatgtggcaattcaaacacccaataaattacttgcataccttattgagatgatttttttgaagtttatgcgtttaccagcttggtgaatgaatcacttgagctcatggtacttgtctcacttctcactccaactgacttcttactccttgccaagttgggagaagaaaacatcgtcaaataatttgaccttcc

SEQ ID NO: 91819 - DNA, 389 bp, Triticum aestivum
  Clone ID: PAT_TA_91819
actttgcatgaaaaatgccttacccgctgctattttcttcactgcctcaatctcctggagggccttgtaggcttcggccttagcggctttggcaccctcaagagccgttgcaagctcagactctcgagtcttcgagtcacgctccaggctctcatgttttttcacgagatcctggagctcttgctgtacctccgcaacccgcgcctcctgcttctctcgctcggtgcgctccgcggccgcattgcgttcggccgcggccaccgcctctttcagggtcgccacctcgttagtggcccctgcaatacccacgttatccttgtcattctttttgcaaccaaaatcgttttctgtaaggtacaattttaataagggttactcaacttcctttt

SEQ ID NO: 91820 - DNA, 291 bp, Triticum aestivum
  unsure (1)..(291): unsure at all n locations
  Clone ID: PAT_TA_91820
aattggttcttaattaaaaataaccaaatcctggacggtcaagacgccganggccttagtggnatttaaacatagcgccccgcgacgaaaggctcgcccgacaccttatccaggaaaagccgaagaccatggcatctcttactgcacttatggcccgcttatgtgcgggcgaagatagctggttggctcgtagaagcaatagttccaagtgaccccggcacttctaaggccaaggattgcaatggtaagccatgacgcaacaaaaacaaacaaaaaaactccaaggggggg

SEQ ID NO: 91821 - DNA, 346 bp, Triticum aestivum
  unsure (1)..(346): unsure at all n locations
  Clone ID: PAT_TA_91821
tttgtacctaaaacaaaattgttcanaaagaaactctaaatacacaanaaaaacaacacaaaaataaataaattaaaaaaataaaaaaaagccctaacagaaagtttgtaattttttgtacctaaaacaaaaatgttcacaaagaaactctaaatacacaaaaaaaaacaacacaaaaataaataaagcaaaaaataaaataaaaaaagcccgcctactaggccagagcggcctgcatacgactagaaacccaacctgtcgttggtcaggatgcaggcccgcaaaggccaagtgggcccacagggctgcaaagaacacgtangcccagtaagcctgctttggagag

SEQ ID NO: 91822 - DNA, 620 bp, Triticum aestivum
  unsure (1)..(620): unsure at all n locations
  Clone ID: PAT_TA_91822
tggacagcgccgccgccgccgcctcccatcttctcgtcgttctcggaggacgagggcaggaagaatcgcctctggtggctgcaccgtcgtgccctccacccgcgccgccgtatcaacgggaccttgcgcggctccctattatttcagctccacccgcgccaccatcgacggcgcggctcctcgcgtggctgcagcggcgctcctggccggtagaggaggagtgagaggccgctgcttcctcagcatggtcctgctcgccgacgacgaagccctgcgaggagacggctccactgctccgagctcctccgatctaatgctgccgccgccatggagcaatgaaaggcacgggtcaaagtgttancgtatccgggagaatgaaactgaggagatgttgtancaatattctctacagatgaagtgttgataaattggaaaatatgcantngaagatcaattttnagganaaaaacngaattctnaaatccggaagaactacaagggantaattccacaatttaaaatggcggtttaataactgaaatcaacananatgcctaantaaacaaatggcgactcggaaacnaaagatgggagtncacctcttaaatttgctggcaaan

SEQ ID NO: 91823 - DNA, 611 bp, Triticum aestivum
  unsure (1)..(611): unsure at all n locations
  Clone ID: PAT_TA_91823
gtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggncggtactgggacaatgtggaagctgcctatgttcgggtgcancgacgccacacaagtgatcaacaagtggaggangtcaagaaggagtacctgacgcgtattccgcatcatcggattcacaacatgcgcaagtgnatgcgtcagctcancgccttnaaancaccggctcaagatccggaaggctaaacagtaatcacacagcatttaatgcatgcattttaacncgaatgcttggntcctccaatactcatttccaaaaatnngcagtnagtn

SEQ ID NO: 91824 - DNA, 573 bp, Triticum aestivum
  unsure (1)..(573): unsure at all n locations
  Clone ID: PAT_TA_91824
tttttttttttttttttaaaaaaactgcagtcaaggctcatcacattagtgaaacaagtgattcgaacgccaacaaccaagcagcagcaaagcaccaatcactcaaacagggaacgaacaggggaaagaggagctcgcgacagagtgggggtccttgctcggcggtgagctcgtcgccaccaaccaagctctcgtcantccaatcatcnacccantnaatcanctctgntttcgnagcccagatntcggccccttcccttcctcggaccaagcaccagcaatggccaccacggcaagccgacgccacggccgcggggcccaaaggacaanccgccaacggttccgancaagtcaagcgccaatccgaggtcggcanaaaaacctgctcaaaangangcctctacaagtaatcctgganacaacgtttaccccgnaacaacaattattaagggnccncaaattacgcaaccnccanggactgttaaantttggggcanggcaattccaaaagnggcaantcatgggcaaaaacagggattggttaacgggaaccncccnaanggtcgcatccca

SEQ ID NO: 91825 - DNA, 556 bp, Triticum aestivum
  unsure (1)..(556): unsure at all n locations
  Clone ID: PAT_TA_91825
gtttaatgtacttttcggtaacaacacgcctaataatcaccctctctagttgcattttgttgcataatatgccattgtaaccacttgtacctgccattcaatggcatttgtcgtggttgttcaatcaacatcagcagccatcgaatcaaacactttcttataatgccacgttcctaattatacccttttgttgggaaatccacacgtgcaccgatattagcaacaatatgatttgttggacttccccttaacgccatgcacaatattatacactccggttgtgtttaagtgactttcccctaatgtcangcttgacggattgacgaaataaacttcctggtacaaaccgaactccnggnaattcctttgggcgtccaaaccnaaattngaacaanggcgtcaaaaaccactagacnatccaaatgccaaanccttctaaacccaaatanacctttgcncnataatgcanccaatcancngggcaatcctaaaanggaataacggttgagtacttcaaaacnaangggaaaaacaaancccanttgattttcnccaa

SEQ ID NO: 91826 - DNA, 631 bp, Triticum aestivum
  unsure (1)..(631): unsure at all n locations
  Clone ID: PAT_TA_91826
cncattnctnccaggggaccnagaaattcanccaaggccacacangtgattttncaaccnacttnggggcaccggagnangtgcangcaattcatatttagattatgcacattaaaagtccaaaanctcaattaatgtataaaaaggcaaaatgaacccgaaataattccaaaatttaacagggcactcatatagttctatgttgcctctgtaaataaaatcaggggggaggcaacgtatatcgtttcacgcacaaaggtgacacgttccctctcggaaccacgaggcttgttgagagaatctccggttttgcaagaggcttatacaaaaacttgtcccaattcagccaaaaattatacgtatgaaaatangggttaagattatgccaaacatctcgctacctagaacaataatgtactatganttgaattcaacataaaagggtacaatatttgaatgganacntatggnacaagtagtcanagngaatatgattacggcanacaagttttgtaacaagatatattaattatggnnaacttgcaacatctatcaatanggaatgatcaaattatcananganacggatnttagtcaatgggggtaaagtcaantgaggagttaagtcacc

SEQ ID NO: 91827 - DNA, 614 bp, Triticum aestivum
  unsure (1)..(614): unsure at all n locations
  Clone ID: PAT_TA_91827
accacgcacctgctcagcgccaggaaggtgcactcgctccgccgcggccgcgaggaggaggcgcgcctggtgatggccaagatccagggcgcggcggccgccggcgccctcgtggacatgacgaagctgctcggcgccttcaccaacgacatagcgtgccgtgccgtgtccgggaagttcttccgggaggaaggccggaacgagctgttcagggaggcgatcgacgggaacgtggccgcgttcggcgggttcaacctgctggactacttcccgggcctggccaaagtgggcgtgctcgcgcgactgctgtttgccaagaccaatccgttgaagaggaaatgggacaactgctcgatangatcatcgacgacatgtcagcaaagcatcnccacaaggagcaacacacgagcacgattaanaagaagatgaanagnaaacttctccatgtgcncctannctcaggagggtananctcacaaacagatanaaggcanatggatgggnatttttgcagnanagtaatcataatattccangggggcccgttccaattccccaaaggancnttacccnccncggcgtctttaaatctangggaaaccgggttcantttn

SEQ ID NO: 91828 - DNA, 536 bp, Triticum aestivum
  unsure (1)..(536): unsure at all n locations
  Clone ID: PAT_TA_91828
ctcctcctcagcccctgccccgagcaggtacttgaaggttggcgatgacctattcgtcagcatcctaggagcggcaggcaccagaacgccaatcgagggggaggtatttgatgaggagatcctcaccgctgccgggctccaggtagttgatgaaccgagcatcagcaacgacatctccaaggaggaccaactccttcaggctataggcgctaacttccacaagctccaagctctccgtcgggcttgcaaggagaaggtggactccagaatggcggccatcgacaaggctgaggtagacttctaggacgtgttgcctaaatgaaaactggtttgacgaantccggangatctgagggctcccaaatccanctgaacnattgcggtgggactcctctgaaacaagccatttnacaaggataggaggttaaaaggcaaggntgcaaggataattcacaaatntacgccgcatccncncattcaagaggaggantggccccaaaaanacgtcctgcaactnaccaagncaggantaaagg

SEQ ID NO: 91829 - DNA, 631 bp, Triticum aestivum
  unsure (1)..(631): unsure at all n locations
  Clone ID: PAT_TA_91829
caaatattacaacttcacacaagctagatatcttttcacaaatcatcgtttcttgcctatcagggcctcgtctgcaatcggaaaaatcattcaagtcaatcaccatgggccttgtagctcacatggttgatcggtttctaccgcatcaccatgtcagctgttgctgcaccatggtccaggagtggctcttgtgatggcaccgtcggctgccagctcagagccaaagtcctccgtcgatctcctctagtcatttgaaatacctctcgcagtttacccaggatgcagtaacaccggggaactggagtatgtcacccataaaatttacaaacgctctgctgcatgtgacagaatcatttccattttttcctgggcttcttgtcaatgggacatatacaagatttcaacggataattccctgtaatttttccngaatgtccgtgggcacactagacacactcgagaatgttggtaatgaacatgggcatacacatatcctaaggacaacaagaagataaatgngaaggaaacccaagcatgtcagattganaaacccaatggaantnnatgtggcccnggnnataactgttagcttccggccccnaaccggggttangaaaactaccatgnccgg

SEQ ID NO: 91830 - DNA, 565 bp, Triticum aestivum
  unsure (1)..(565): unsure at all n locations
  Clone ID: PAT_TA_91830
tagtcgttctcgcggccatagtggaagtagtggttcacggacgtcgtggaagtagtcgttcacggcgacggtagaggtactcgcgattttggcgacggtagtggtacacggtcgcgttttggaagtagtggttcacgtttatttttggagaggtacttgatgaatccaacgtcttcggggcgacggtagtggtacacacaacgtcggggtacttgtcggtccggtcttggtgtagatgtacatggcaaacgtagtggtactaaacgccggtcgtcgagggacttgccaaaatccacagagccggtgtgcttgttcaagcgtcggtcttgttggaggggtacttggtgaatccgcatagtcgcacacgagtcatagtgatacttgggaaaatcacgggggtggtcttggcgtgcaacgaacaacagtacangaaggcaaagacatggcgaagtgaggtgcantggctgggcgtgaactcaacaacgtacatgggaacgcaaactggggtggagaagagtcaggatggtctcaagntgaacaagtggagccaaaaggccccaggggg

SEQ ID NO: 91831 - DNA, 605 bp, Triticum aestivum
  unsure (1)..(605): unsure at all n locations
  Clone ID: PAT_TA_91831
ccnaaaccctaccccgccgccgccgtcgccgccgcagcgcgcggaggcgacctcccaccgccgccaagatgcagatcttcgtgaagaccctgacgggcaagaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccaagaaggagtccaccctccacctgggtgctccgcctccgcggcggcgccaagaagcgcaagaagaagacctacaccaagcccaagaagcaaaagcacaagcacaagaaggtgaagctcgccgtcctccaattctacaaggtcgacgacccacggcaaggtgacaagctcaggaaggatgcccaacgccgacgcgngcnggnactcatggcaacactcgacgcatacgcgnaatgngctcactacttaaacagaggntaagttgtncatgtcgncttactactacagatcaatataatttcttncntaacgaactnatctagttctatatacncnngcgtacatctgtattgtc

SEQ ID NO: 91832 - DNA, 301 bp, Triticum aestivum
  unsure (1)..(301): unsure at all n locations
  Clone ID: PAT_TA_91832
tgcaaggccacggtgagggagacctggattcgggggtcctcangtgtccggctcactcaatatgggctgggctgatgggccgtgaagataaactgggggatcattccctgtgttcgggtaggactcctggatgcgtggacggcaagattggagttgggatgtgctgtttccttaccttgtaaacggactgtgtgcccctctagtgtatatataaactgngagggtttagactgtanggatcatcaagaattcatataggctagacatctanggtttagccattacgattccnagggggggg

SEQ ID NO: 91833 - DNA, 494 bp, Triticum aestivum
  unsure (1)..(494): unsure at all n locations
  Clone ID: PAT_TA_91833
cactaatggcgcacctgtgatgtggtgcgccattactatattctaatggcgcgccatgtctcgatgcgccattactaanatnttacnaatggtgcacctgntgtgtggtgcgccattagtagttttganaanaaacatannanaatttgttactaatggcgcaccgttgcatagtgcgccattactaattgacatagtaatggcgcaccacatctatgngtgcgccattagtagttttgaaaaaatagtaananaaanatacnagtcattttgttactnatggtgcaccatgtctcggtgcnccattacnaggntttanctncgtaatggngcacttccactgnagccccattacnanntttttttcanantgctatcagttnttcnacttnttccctgtaattaagcacaacatggntgtggtgcccaatactgctaactagtnatgcgnacacccangggcgcaataanacntgcccagnncggngaacccc

SEQ ID NO: 91834 - DNA, 603 bp, Triticum aestivum
  unsure (1)..(603): unsure at all n locations
  Clone ID: PAT_TA_91834
gccggtgctgaatgttgcaccgagatcatgtgaatccggacgtctctgcaatagcaggcgtggcaacagccaaggtacgcccccgacagccacactctgaggaaggtgtactttgagtgccgccacgccgagaaactcgcgtccatgaacgtcgctgaaccccgcgggtgccacaactccgagggacggcatcaatggtggggcgtccccgggcgcactctcgaagccgtcctcgaccacatcgaggctggcaactcgccgcgggatggagtacccggcggccccctccttctctctccgccgcggcagttcctagatgccgangcgaatggagacgactctctctcgtcgggtccgttctccggtctccgttctccccataaaccggagtcccgganaggccctccggcgganaccgcggngggcctataataacaaggcggtctgtcctctcttctcctcgttcgnaaaccgaanacganagacctcntccgtaaaagggcacaggcatgccggcgtggtcctcaagatactcgaaagaatgatgcaacccttcctgagaattccctgccccgcccaaaagaggtctatctnnaaaaanaa

SEQ ID NO: 91835 - DNA, 615 bp, Triticum aestivum
  unsure (1)..(615): unsure at all n locations
  Clone ID: PAT_TA_91835
aataccatggcccccgccgtgatggcttcgtcggctaccaccgtcgcacccttccaggggctcaagtccacagccggtctgcccgtcagccgccgctccagcggcagcctcggccgcgtcagcaatggcggaaggatcaggtgcatgcaggtgtggccgattgagggtatcaagaagttcgagaccctgtcttacttgccacccctctccacagaggccctcctaaagcaggtagactacctgattcgctccaagtggggtgccctgcctcnagtttaacaaggttggtttctccttccgttgagcacaacagctctccccgggtactacgacgtccatactggacaatgtgggaactgctatgttcnggtgcaccgacgcaccaagtgtcaaanaagtggaggaggtcaaanaaggatacctgatcctaangtcctttcaaccgntctaaaactgcgcaagtgcatggtanctnaacncctaaggcacaagttcaagntcggaaggcnaatanattaacaaggctanttaggcatgtaattaanttgcaaancggtttcacaacaanttnctcaatattggttgcanaaagtntgnatccgtanttaaacattt

SEQ ID NO: 91836 - DNA, 426 bp, Triticum aestivum
  unsure (1)..(426): unsure at all n locations
  Clone ID: PAT_TA_91836
gagaaagaatgcttaggttcagataagcctggacatacgacaccgatggtcaggaaggactggatgaagaagagggctatgttcatgatggctttggcccattaatgccggtacaagaagagggctatgttcatgatggctccggtgacacaatggaggaacaagaaggagaccgtgctgactgctccagtgaccgaaccgagtccggacaggtatatatatattagttaagcccgtgctgactagttaattgatgcatccattgttttggtatatgtacaaatattaatactctcgtcttcctccttttaattttagcctcccgnttgagcnaaactttggaattgngtcctttttatttccaataaaaggcnanagccaccccaaaganttcttaaaaattcttaatactcaagtcaatcagta

SEQ ID NO: 91837 - DNA, 622 bp, Triticum aestivum
  unsure (1)..(622): unsure at all n locations
  Clone ID: PAT_TA_91837
gtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcangtcgactacctgatccgctccaagtgggtgccttgcctcgagttcagcaaggttgggttatcttccgtgagcacaacgcatcccctgggtactatgatggccggtactggacaatgtggaantgcctatgttcggggtgcaccgacgccacacaagtgattaanangtggaggangtcaagaaggantacctgacccttatgtccgatcatcggattcaaaacatcgccangtcaatgctcagttnatccttnaacaacgggctgcaagantccggaaggctaaaaactactcacacaggcattanaangcatgaatttgcacccgaatgcttggttcctccattacttcaatttccaaaaagttgtcattattacanaggcnana

SEQ ID NO: 91838 - DNA, 613 bp, Triticum aestivum
  unsure (1)..(613): unsure at all n locations
  Clone ID: PAT_TA_91838
ttttttttttttttttagggaaaacatagagagaccatggggaggaggagtcctgtacgtgggataaaagccctggtctcctatttcatcctacgattatacatgaaccatatattaattgtacggtcaaaatttcttaattctaaggattaacgtggtgtctcgtatggtgcttccaattaagtatatatatatatatatatatatatatatatatatatatatatactagtcaagccgtgcatccgcacgggctatcatcatacataaccttaagtaaaantcatgggaaaacattgattatacttgcctcttttgagaacatgcaatatgtttaaaaaacaattttactaaaaagtatgcaatatatacatgttataaataatatcccttcaaccttcaaaacatgtggataaaatcatgtngaaactttcaacaatatcgtttcatttaagctagttgtgttgtgatgtgggtatttaaaaccgtggtgaaaaaatacacaaagtnnagagaggtgtcaaaatttcaaaaaccaaatntntgggtaacggntatgnatcanatcaaggggnaanccgtggctaaaaacggngggttnncccgtancaaa

SEQ ID NO: 91839 - DNA, 664 bp, Triticum aestivum
  unsure (1)..(664): unsure at all n locations
  Clone ID: PAT_TA_91839
tttttttttacatacaaaaggcatacaatgccacacgaatacaacaacatattacaagagatcaacatccgactaaggatgaaccacaaacagaagctcaaacgacatccaccctgctagcccaggctgccgacctggaacctatcccctgatcgaagaagaatcagaagaagaactccataacaagcaaacatcgctctcacgtcatgatcatcgcataacctgtacctgcaactttggtgtaagtaatctgtggagccacgaagactcaagcatccccattaccatggggtatcaaagactagcaaacttaatgggaaaaggnaagggtaaagtggtgagggttgcaacaancgggtaancaantatggtggctaacatacncaaatganaacnaagaagagaacaaaggacgtccttgaantancatgatcaagaatgttcctnanccctacttacnttaacataaccaaagacgtgtcactcccggatcgccgagaanagacatcacggtacacacacggtgatgtgtttaatcggtcngggnaatatcanaatggcattacaantccatcgcaataacgcggnagggtccaanttaacctgagggntccnnttaccagaaaccccnnttacagnattcctcccaaanccttttccganc

SEQ ID NO: 91840 - DNA, 485 bp, Triticum aestivum
  unsure (1)..(485): unsure at all n locations
  Clone ID: PAT_TA_91840
tctgaattcactaaggtctctctctttgtcaggagagccctggccggactatggccaacaggattgggatgcggacgacgaagaaattcgatgcccacccaccatccaccttgtagccactgtcgatgatttaaccgacatgctcgacttcgactccgaatacatcgatggtatggacgacgatgtaggagacgaacatgaaccagcgcctatagggcactgggaaancactcctcattatgacatatacatggtggatacacccaacaaangtaatggcgacaagatacggaggataccctcccaaagaaacaacccaagcgccgacgttcagcngngccgtcctnattcccgccaaaacaaaantggtgttaccgnacaaggagattatnaacncccgattattccgnaagacaacaanatccctcccaacaagnttntttcaggaggttnaagggcaanntccctantaaaannaacggaag

SEQ ID NO: 91841 - DNA, 499 bp, Triticum aestivum
  unsure (1)..(499): unsure at all n locations
  Clone ID: PAT_TA_91841
acgtcacacacgacgccatacatcgatcttttgttttctatacaagccacagcgaagtgtgagactaattgtacgttgcgctaataacagagtacgtactactactgtttattctagaagcgcagtgacccggccaccactgcaagtgagcctagtggccgcggtaacctttgcatttctaaccgcccggggaaccagccggaggccactccggccgaaaacgtcgatcaccagcactggtcggtctcccaggtgcggcggcagcacccggggaacgacggcgagcgggcgagttnggggcgctgcggcggccgacggcggaggggatcatgatcatgcggcggtcgtatcggcgccttgctgggncngaaancttctgtnaggcggcgtgacccgtatnaatcntcggnnggcnccgcnggtccgggaacgtccgggttggncggnctcccaagcggtggtnccngcttgtntnccctngctccnccggggtcangcc

SEQ ID NO: 91842 - DNA, 651 bp, Triticum aestivum
  unsure (1)..(651): unsure at all n locations
  Clone ID: PAT_TA_91842
ctagcacctacactcatacctctcggagtggttatgcttccaccgcttctcaggctgtcctatttgctacattcaaggtccttgtcgagcttcgttgcaacgaggtccggatgtagaaccacccaggtttctactactatccttctctgcacgacaatggttgtgtccgtttcactatcattgatccggagtctgatagtgttgctagccaccttgctcggtatatcactgctagctatcttatgatccacgagctggctcgagagctgactcgtgctcgtactctttaacctctactaggtctgtcattgctccatcctccctggggatttactccttatattccaagccattctagttcccctatttcgccggttactcctccgagtagctcgggcactcgactgtgaacctctcaatgctcctactgatgggtttcactctcactaccctgtagcccgatgctcacctacactacnccgagggagacctcnaggggggccggtaccaatcgcctataggatctatacgccgccacggcgtcgtttaaaagtctgacgggaaaactgngtacactaacgctganaatcccttccagngggtatacaaaagccnacgtngcctcanattcnaccnaagnaatgancccgn

SEQ ID NO: 91843 - DNA, 630 bp, Triticum aestivum
  unsure (1)..(630): unsure at all n locations
  Clone ID: PAT_TA_91843
cacaaaacacttacctctcgcatgccgcttattcagttgcagcttgcaagtcctacaatgaagcatacatccttccttcaacaatttgtcttcctgtttggtcttatcgtcacaaccttggtctctggtgatgatcaatttctcttctccggcttcagccaacccagcctaaccctgggacggatgtgccatggtcacagatggtggcttcttggatctgtccaatgggcacgacgttctcaagggcatgcctctatcccaccctctgcacttcccgcaancacccggtgggaaantcaatccttcgcatccatgtatcctcaacacttcactccttacgcagactttagcgctgatggcaggtttcttcatgcacccacaaaattctctgatgcacgggaacaaanacttgcccctcaaacgagaagaacaggngacacaaanaacacactcaagatcgaatttacactacagaatctgagtccaaagacatgatgaaanacatggganaatanaacatgaatctcatnaatcatgatcggnttcacaannaaggtgggcntaganatacctaangaacagtatcacccggaanaaanaggggnccaattagtacttgccntaggaana

SEQ ID NO: 91844 - DNA, 298 bp, Triticum aestivum
  unsure (1)..(298): unsure at all n locations
  Clone ID: PAT_TA_91844
cacagctgcattcaaataatgagagcctcttgaatgtacatgcaactgatgatatactgtatgtatctgatgacatgatacattctatgatccaactaacgcccgatgtggtcagctcgtgctagagataacaccggcagcggtgggggtcttctgttgcgtggtcttctcagcgagcagctccctgcttcttctccaccaacaacttgtgtaggttgaacanggacaagaantggttgtgttcntccctaanaccncaacttcaatttcaaaatttcctncaanggatntttcccgt

SEQ ID NO: 91845 - DNA, 626 bp, Triticum aestivum
  unsure (1)..(626): unsure at all n locations
  Clone ID: PAT_TA_91845
gcggcctgggatctggccgcggtggtccgggcggtctggtgcccggcggtggtggcgtgtcaacgtgggggcggcgcggagttgtgctggtggacgcgcggtggcggctcgggccggccagatctggctcgttcgggccgcaacgttgaggggcccggtctgggcactctgtgtccggacgctgggttctcggatggtgcagcggcgtcgccattcatgctccggccaagatggaangagcggcaggtccaaattcggtggtgggttgcgccccgggcgaagtccctggcgttagnccaaattttcccggacgaaatcctggaattaacccgttgatngaaaactgttgatntctccttgtttaaagatcaacaaggagtttttganccaacctanccaattcgncncccgggtgaaaccaaatccctttccgttngggaataagggccctggntccttctccatgggaacacnttggganatntactctnggnaagaacactgccgtggttaatgttgncgganctcaagctcattccttgtgggacagtttgcactcttgtgcgtgttcccttggaanctaatatacganaattagtgctccccgatgggaatccnttctcgat

SEQ ID NO: 91846 - DNA, 492 bp, Triticum aestivum
  unsure (1)..(492): unsure at all n locations
  Clone ID: PAT_TA_91846
tgaagttttgtgtggatgaagtgtctaatcgaggatgtctcgatatgaggaaaaggaagataggcaagagctcaagcttggggatgcccgaggcaccccaagtaaatattcaaggagactgaagtgtctaagcttggggatgccctggaaggcatcctctctttcttcaacaagtatcggtatgttttccggattccgtttccgttcatgcgatctgtgcaagtcttgggagcgtcttttgcatttaattttcatttttcttttaatgcaccatgatggtatgagatatacttgggttgatttatagaatgctcatacacttcaacttaaaccttttgagtaatggtttaatanaatgctcaatgtgctcacttaatacatttgaatttttgatgctggttccctccatannnaaaaccccattgttgatccctttgctcnctaaattgttnaacatgggnaacttnttnaaanataaanccctgctcacta

SEQ ID NO: 91847 - DNA, 625 bp, Triticum aestivum
  unsure (1)..(625): unsure at all n locations
  Clone ID: PAT_TA_91847
catattgaggaccaagtatgttcgggtccccgaatcccctgagccggatacttccccttcggaagggactttactaccgccggactccggttcagatgtaggattgcaagagccttcgcgcttaaccggacccgaaccggttacttcggaagccataccggctccaaacacagatgtgggacaagatctaaaattaatccacccacccaccacaatctatactctccaagcaactcagctcctccaagatatatacgacctgatgtatgtgcggcagcagcccaaggaaacgtccacacttttgggcaaatcctgcttgttaaaaacaaatcaagncgttccggacaagactatttcgncttcaacataatgtncaaacgaaggaatgatcctcnacgtcacaatacaanttcanggattaccatgtntacaaatcattcgatggaacatatggagggcaaaaanaatggaccgcaacttgaccaattgcggncgggtaaagaatatacccggnggtcancgacaacggctatggcaggananaagccntatggacaaggccntcttngactatgnaanccgncgnttaacatgcggcantttgaanagccncgcccatccaacn

SEQ ID NO: 91848 - DNA, 629 bp, Triticum aestivum
  unsure (1)..(629): unsure at all n locations
  Clone ID: PAT_TA_91848
tttgcatacatactccagccatacgggccacagaatgatatacgagatctagttgattaatccatccaagatatctaaagtatttacaaagtatatatatacggatgatgaatatctatgtttggttggatggtaatggatatatagtctaagagtctgatatgtgtgtgtgtgtgtttgtcaactaacttgggttgggtggtggtggtagtttgatnccgggcgccggccggctagcgggagatgtccggcttntggcggcgagcaagcatggtgtccaaggacgaccccagctgagcttcaccctccgccgttcgtggtgcccnngagagtatcctccaacgccggcaacaactcgccgggcgtttggcgcggcaccatgatcgccttgccgcccgngacacaaccctcgtcaacgcctgtcgatnaatccaacagnancntatacctccacgttcannangccacggctntctgggtgccaactgcccaagtgatgactcaacaantctcanctgcanaacnccgggaggcccancagtcgggcgcggcaactcgcttcctgtcatccgcacgcttactctccccgggntcccatatcccgagcacggacanccntaccccnccnn

SEQ ID NO: 91849 - DNA, 619 bp, Triticum aestivum
  unsure (1)..(619): unsure at all n locations
  Clone ID: PAT_TA_91849
aagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcaccaatgcaagtgcggaccaactgcggtgctcctgctgcaactgctagatcattgatcatcgattaatgcatgcaccgcgcctgcanatcnatnataccattttactactaacataccatgttaccgctactgattcaaggcttancnatcacctgacctgatcaacatcaagtgcatccatcttgttgtaacaagcccctaaataaacncccgggggggccgtaccaatctcctatatgatctataccccgtaatggcgtgnttaaactctgaatggaaaacctgcgtancaantatccctgagaatccctttccantggtaanacaaagcccacgttccttcaaattgcactatggatggaccccttcggatna

SEQ ID NO: 91850 - DNA, 635 bp, Triticum aestivum
  unsure (1)..(635): unsure at all n locations
  Clone ID: PAT_TA_91850
aaacatgcaaccttccccctccgattcatctatccgaaaacacgaaacaccggggatgccttcccggatgttttcccccttcgccggtattacctatccctgcgttagatcacctctagcaccgtgtattgccatgttatgctttgtgattctttgattgctctattatttatggtgttcccctccgttactctttccggtagacccccgagaccgctaccgggtaccctgtgattgactacatttgacgatgaaccttcttgacaagagcaaccaagcaagccccccccctttgatnaccaaatatcgcctaatcttccccaanattgcctggaatgagaanatgtancaagttacnnattcngttaaccnaatccggcngananccgtnatggttgcnaaattgttaccttaactgctacctangcttaataaagatgcantgtccacaatggccnaacctgtccgtgtgcnaagcaaacnaccggctgatacaaggagngataacggtataacaaatactnaatcatgcacagtgggacnaatcggtanctcttagtacccaagggattcnatagggntnaagnaggggtcaacccgaaggggcctggtctaggccaagtantttggggaan

SEQ ID NO: 91851 - DNA, 620 bp, Triticum aestivum
  unsure (1)..(620): unsure at all n locations
  Clone ID: PAT_TA_91851
cctcctcctttccccaacccagaccaggagcgccctctctcccccgccccctccccccaggaaaccagccatgaagggggccaaatccaagggcgccgccaaggccgacgccaagttggcggtgaagagcaagggggcggagaagccggccgccaaggggaagaagggcaaggccggcaaggaccccaacaagcccaagagggcgccatccgccttcttcgtcttcatgggcgagttccgcgaggagttcaagcagaagaaccccaagaacaagtccgtcgccgccgtcggcaaagcggccggtgagaagtggaagagcttgagcgaatcggaaaaggcccctatgtgggcaaaggcaacaagctcaagggcgaatacaacaaggcattgctgctanacaagggcgaaaacgctgctgctgctgcccaaaagaagntgcggcaaggagtanaggaggaagataagaggaactgacaagtcaaatccgngattatgacacatnacataaggaacatnangacaggcatacantganaaaccatcttaagtntcggngcaatcgactgttcaaacgctacnttcgggntatagnctacancatnatacaantnttatcgagt

SEQ ID NO: 91852 - DNA, 638 bp, Triticum aestivum
  unsure (1)..(638): unsure at all n locations
  Clone ID: PAT_TA_91852
gtctcgagtttttttttttttttttttcaatgagaaacaaactgatagcacacacacatatcagtaagcaataagccccaaatgtacaatctttcgagcaagacagcccaatggtcacaacagaaggttagcataataactgaagcctctgggtaaacttacatcagccacataattaagtcactcggtttccataacgtgtacctttgttcaagatgcacggtgtcagcacaacaatgttaatgatgccaatggaaagcaaatcactacctcatcatgatcaatccaaaataacttccatctcgtatacactgggctaaaaaatggagccggattcccttccccatgagcatgtccttgggctccgtttatccttgggaacaatgtnatggctgccaacaccatcaaggggggntggntacattacctcttgtgggcccctttacctgtccaatgcaacacgttctcttacgcaaggataatgcggctccntcngccatctcctccaaatccgcaagatagaattaccacactggatcccgccggattcaaaggctgcatgccgaacatgaacngctccatcnacacagtacgcagccaatacaanggtgcatgncaacgggnaacacacagngcgg

SEQ ID NO: 91853 - DNA, 272 bp, Triticum aestivum
  unsure (1)..(272): unsure at all n locations
  Clone ID: PAT_TA_91853
aggtaaagattgatatattagatgatagtatttggacaccgcaagtgttccggaatgtatccggtacatatcagagtaccggggaggttaccggaaccacccgggggaagatatgggccatatgggccataggagggaaggcacaccagcctacaaggggtggcgcgcccccacccaagggaaagggaggccgatgtaagaaagagggggggnnaaangccctcctttcctttctcccccctctctctctttcccccttttccccatcgaag

SEQ ID NO: 91854 - DNA, 616 bp, Triticum aestivum
  unsure (1)..(616): unsure at all n locations
  Clone ID: PAT_TA_91854
atccattgaacggattctccatgaataaccctcagagctgggtaagcggacgtttatctacccgatccatacttccaaagtcaagtattttactttgtgatttcgacgcaggagctgcgccgggacgtggagggcataggaagcctaactccacagcctgaggatccggaacgatcccttgatccgacctccgaagaggatccggacataaaggtggagctgattgacggggtgttccaccaacttaacatgggacaatgccctagtccccattacggctgactacccggttgtttcccggctcccaagtgactacgaccgangccttgacaccatcatttgatccatgctcaatctggacatcctatactggatggtgcatcccaagaagtgcctttaaagnnggaaaccgaactgcggnggctgacaacaaaggtcatttcggccaacaagcggaaaagatncnatcgaacnaaactcccgcaacgtacgncacttgttttaaggaaggtcctaataanccanaatttcaaganaaanacctcccggaaatntccgaaggtgcaacaacctcncancatgtcatcnatgnccgaatgngnaaaaaggaanaccg

SEQ ID NO: 91855 - DNA, 602 bp, Triticum aestivum
  unsure (1)..(602): unsure at all n locations
  Clone ID: PAT_TA_91855
gtgcgccgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaattctgcctgggagcccacctccttcaccgtcaaaggccgagggcatccagaaagaacgagccgccggcttccanaaagaccaactcaatgacccgtctcaactacaccttngacgaaatggaaggccgctcnaagtccgngccgacggacctcaattccaaggagaaggacggatccactatgcggcgtcaacgtgcantcccccggaggngaacgcgtccttctctttaacgtcaaanaccctcncaacnggaagccnaaantnaaagggccttcttgtgccaactaaagggtcncttctccaacaaanggcnggnggtcannggtacaaanncttgggctaccccggggaaagaaacagagattgcagggaactaaaa

SEQ ID NO: 91856 - DNA, 493 bp, Triticum aestivum
  unsure (1)..(493): unsure at all n locations
  Clone ID: PAT_TA_91856
ctctctctctctctctctctctctctctctctctctctctctctctctctctctctctctctctctctctctctctctctctctctntcactctctctntctctctctntctttttttaaacntcttnaaaatctatctcaaaggaacaacataatattgnatatgnatttttcagaattaacnanaggcatagctcatagttttcaaacaaaggnacacaatccgaaagtgcataatngattccaaaataactcaacacacagngncagatantcagacangaaaaagacaacttangtgttccttgngaaatatcctantaatacatctcaagatacttcatcnaattttcattttcnattttcagtagaaaaagctanaanttgtnaagaacattcttacaacttgttcatatggncatgatccagcaangntttcangaaaatgttactaaacnnacaaaaagaaggannttgcaatccancnttaatc

SEQ ID NO: 91857 - DNA, 866 bp, Triticum aestivum
  unsure (1)..(866): unsure at all n locations
  Clone ID: PAT_TA_91857
ggccgcctcctagaaactagtngggaattcccccggggcctngcnaggttttttttttgtngaaacaattcatgggggggattcaaataatcaattgaaagtttgggcggaanggaaagaaaaacaaattaataaacaaggaaangcctanaaataataaaaacccgacaaccccttggggttttaagaattaacctaggaataacaacaacaacaaaacaacaatttngtttgccctccgaattggtttccctctccaaccggaatnaaacccacgttacgcatggcacaacaaagatgagtaatcttcaacttctngctctggctcctaagttaagactccgangctggcggccgtaccaaaacaaccctggggatncttggaacatcccttnggggccgcccttgggcgcccgaangtccngtgtctggaccggctgcaacggctctccgaaagaacaccggattaactcgccgggtctnccgggcttngctccttgggtcaacgccngancngtgaatgttngcccnctgggaccaaaggacgccgttctttaannttctcccttaanccaactcctcctcngtctcctccnncctcccgggnggtancgccaacgggcgttgtcctnaccantatnaagccaacaacggncctttgggtnnnagggaaagacnaaccccggtanctggggnaccaaggaagggcccgctgaanctctcgggcttnccggtnacgaacaactgcttnacggtnaaaaggaaaggnanccctcgccccngngaactcacggttacggcncttatcnaaancggtcntcccccacttaggngcctcgggccaacncanngggcttaatcntang

SEQ ID NO: 91858 - DNA, 597 bp, Triticum aestivum
  unsure (1)..(597): unsure at all n locations
  Clone ID: PAT_TA_91858
atcaagatcccactcatcttgggtatctggggaggcaagggtcaaggaaaatccttccagtgtgagcttgtcttcgccaagatgggcatcaacccaatcatgatgagtgccggagagccagccaagctcatcaggcagcggtaccgtgaggctgcagacatgatcaaagaagggtaaagatgtgctgcctcttcatcaacgatcttgacgccggtgcgggccngatgggccgggaccacacaattacaccgtccaacaaccaagatggtgaacgccaccctcaatgaacatcgcccgatgcccccaacaaacgtgcaactccccaaagcatgttcaacaagganggagaacctccctgttgccancctcntcactgggtaacattttcaaagtttgtacgccctctcaanccctgaatggcctatggagaantttaccggggtcccaaccgcnaagacctttcgtgtctgcaaggganctccaaaacngacaattnaaggacaatcctcntcaaaatcntcgaaacttccaagacaatcatcgacttttcgtgcctcctgncggtgtcacaacaagtgccaaatggtgaccccacgg

SEQ ID NO: 91859 - DNA, 593 bp, Triticum aestivum
  unsure (1)..(593): unsure at all n locations
  Clone ID: PAT_TA_91859
gtggacacggttatgcgagctcttcctcgacaatcaactccaacgccatgtcttcctccaaggggagttcttcacgctgcaacaaaacgatctctcgatcgatgagtactgcacgcggccgaaggtcctcgccgacgagcggcgcgacgtcggcatgaccatcgacgactccgtcctcctcatcaacctccttcgaggtctccaccccgacctcggcagtccgccgccaacctctccctcgtcacgctgacgtacgccaaggcctcacgtacttctcatggaggagaagcgccttcgccattctgctcggcaagcgaaccacacgtctccanatcggctcgccgccggcaaggggcgctccaaacccgnccgcgctcgtcctcctgcttttacccggcaaccgcgccggccatttgggggcccaaacaaaagnccggagncngcccgnaatccaaatggngccggcctccgttaacctgcggatcctatcaactggtgagggtaaacctggangggtctgatctaacaagccgtcctcccccnatcggganantgtgacgcggcttacagggtatacggcccccgttccgaaa

SEQ ID NO: 91860 - DNA, 373 bp, Triticum aestivum
  Clone ID: PAT_TA_91860
gttttttttttttttttttttttcaaatttatgaacatttttaaactcatattttcttcattttttgaacttttttcaaatccgtgaacctttttatattcacgttcttttaagtcaatggtcaatagagcgagcgagcacggatgctcgtgtttggtgggtcgggtgccagttacctagcttagcactttgggcagattgtaactaggcccaaaattttgcatgggtctaaaagcgggtccgtggtagactcaggttattatctgaaccatactggagcggtaaattcaaggcgaataggtgctaatcctgaaggtgagtggataagcgtccgtgcgtccgctgaaattcccggtcggtctactaccaacct

SEQ ID NO: 91861 - DNA, 614 bp, Triticum aestivum
  unsure (1)..(614): unsure at all n locations
  Clone ID: PAT_TA_91861
cctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcttacctgccaccgctcaacacggaggcctcctcaagcaagtggactacctgattccgctccaagtgggtgccttgccttgagttcaacaagtcgggtcatcttcccgtngagcacaatgctctcccgggtataacaacggccgctactgggacaatgtggaaactgcctaagttccgggtgcaccgacccaacaagtgattaacaaggtggaggagncaaanaaggatacctgacncgtactccgcataatcgggttcnaaacatcgcaagtgcatncgtcagtnatgccttaacaacgggtgcaaggatccggaaggctaaaagtanacacggcacattaatgcattaatttnaanncgaaatcnttggttcctccaatgcctttact

SEQ ID NO: 91862 - DNA, 462 bp, Triticum aestivum
  unsure (1)..(462): unsure at all n locations
  Clone ID: PAT_TA_91862
gtaggtcatagggcaaggccttttgaagagcttatgtgaatatggcaagagccacagagccatcccctgcaatttccacgactgctctaagatcgctcaacatctgcccgtggattctctgcagaagcatggtgtcataacccaccagcacacacatcccctctagtggcctctcgcgaaagtaaactccgtgcctctcgcggaagcaaaaccgtgcctctcaaggaagaaaaagaaaaaagaaaaaacatatatattttttcatttcccgagaggcacggtccgtgcatctccgcggaagcaaaacatccctctcaacaagaattaaaaaaagaagagaaacaatttttttccatttcccgagangtagaagaaaaaaagtaaacaatttttcacttctgaagagnacattngtgctctctctaaagcaaatcatactctcaagggaagaaaaaaaaaaaa

SEQ ID NO: 91863 - DNA, 494 bp, Triticum aestivum
  unsure (1)..(494): unsure at all n locations
  Clone ID: PAT_TA_91863
gggattcccccggggcctgccaggcctgccagtaattttncttttgggggttttcaatttagtngttttgangcccaaggtaaggaacctttgggaatnactttgggttttatccgtttgattttngtttttgccttgaaaaacaaaaaacttttgcgtccaggttaaaaagaattggtttaaaattcaactgggagcaatgggaaaataattttggatttttttaacnacaaaggatttaataatacaaatttccctcctgttgtccctaaattttccaagaatttttgggaggttaaaagaaagtaataatgaaagtttaacaagattaactaacaagactggttccccgttttttggacacattcccngtttaactaatgtgttggtttggcttaattttaaaggaacccaatggggtaagtaacccggggggtaattgaaccaatggaagaaatttnggagtacaagtnagataattaacacccaataat

SEQ ID NO: 91864 - DNA, 470 bp, Triticum aestivum
  unsure (1)..(470): unsure at all n locations
  Clone ID: PAT_TA_91864
gtccattccgtcgctccccggtccccgccatccctgctttccccttgaatgcccacctctgcttccagcctccacatcaagctccagttcgtccgcggctaaagcctccgcgccggaagttctgcgatcgagcgagtttccggggcccataccgatggccctgcttccttcgggctcaagcagcacgccggtgatcgccgaggtgggagatgaacggcggcgcccgaccaagagcgccaacaccgtacgagccaccgttcgtgcaagcatccacancttctangacacccccggcantctcgattaagcaanagagactgatacaaagntgctggtatgtcananttngcctgttccaanacttttgttggnggtaccccnggntcacttttgnttgggattaaaattagangacaancaaaagcaaggaaaggggntccaaaattaagcaacgcanaattncctgatca

SEQ ID NO: 91865 - DNA, 649 bp, Triticum aestivum
  unsure (1)..(649): unsure at all n locations
  Clone ID: PAT_TA_91865
atcaatagtaaacaggagattgctttgcgtatcacggatcgagcacacaatagaatgctcgaactacactctcctagcaaaaggcagggcaagtgagttctacacgatattcgataatgaaacgagccttcctccttccgaaaccccctctcctcggcccgggatagcgatagacgtacgaattcaatcaatggcgataatgtcatcccctttccttagatataaaagaatcattctgagcgagtccataagaagcgacccgctttttcatcggttccgggggaagaccaaagatcttgcgcgaccagaaaaactcaaaagagaaagagaggtatgcactgtgaaggaagccctctgaccactcttccttccccctactaccataaggtaagtaggggcctcggatctctattcctgagaaactactaaaactacttcgagaaactacaattcgagaaacatacaaactacaaaaaaattataacctccctttgggtggctcaatgctgggcaatgacaatatattcggtaccngggtcnaatnccagggggccngtacaattccctanatatcttaanccgtaaggcgtcnttaaatctgacggaaaccgggtacaantacnctgnaaacccttccannggnaaacaa

SEQ ID NO: 91866 - DNA, 612 bp, Triticum aestivum
  unsure (1)..(612): unsure at all n locations
  Clone ID: PAT_TA_91866
gtcatccaagggtagccggtactgcgtgtaccacgacctccacacccacaacaccaatgaatgccaagagctcagagccgtgcgagaagtacgtgccggccgacgccccgatcgcatcgatcggggctatggcaaggnaggaggaagaggtggaggacgatgggaagaccgtggcccacgccaagggtggcgaccgacctcgcgaggaccgctggtaggaccagcctcatgangatggttggcgcgacccacctcgcgaggggggttggagagatcagcctcgcnaggatcacccacaaggcaatgcgggcctcccaactctgccaacacagccgangangaacgaaagaccatcaccangatgaggggctgggggcttccaanagccgcgcgcgatcgcttgcatcttgggcggcgctcaagcccnggctctcaaggcatctcaaacaattgccccnaagtaatgaatccttccaancttangcaaagcctctcaagtggtcatcgtgcctatcnntnaactaacgatcaatcaatnccggcaaannggatctcccaatgcttgccccatcacacaantgaagtcacagacctaacatgngtgcggtattc

SEQ ID NO: 91867 - DNA, 628 bp, Triticum aestivum
  unsure (1)..(628): unsure at all n locations
  Clone ID: PAT_TA_91867
gcagccgcagcgcgaccccgcgagaaaccctaccgccgccgccgcagaagcagccatgggtatcgacctcgttgccggcgggaggaacaagaggaccaagcgcgtcgcgcccaagtccgacgatgtctacctcaagctcctcgtcaagctctaccgtttcctggtgaggaggaccaagagcaagttcaacgccgtcatcctcaagaggctcttcatgagcaagaccaaccgcccgccgctctccatgcgccgcctctccaatagaagggaaaanggggggggnaagaacattgctgttggttgnttggnacaatcacagatgacatgcgggttcaatagtcccagcaatgaaggttacgctctgaggtcanananacagcnanggcaagattgtcaatgctggtggggaatgctcactttgacaacttgcatccgtgctcaaanggggaaaacacattctgttnaggggaccaaaaatccgttaggcgtnaggactcngaangccctgtgttcgaancaacaancctatttcctcaaggtagaattnaaaggnctgtagaggaaacctggtnaagttaatccccttcggancctttgcggacacggntcgttncatnaatattnaatt

SEQ ID NO: 91868 - DNA, 562 bp, Triticum aestivum
  unsure (1)..(562): unsure at all n locations
  Clone ID: PAT_TA_91868
acatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcagcaagttgggttcatcttcccgtnaagcacaacgcatcccctgggtactacgatggncggtactgggacaatgtggaaactgcctatttcgggtgcaccgacccacacaagtgatnaacaagtggaagagtcaagaaggattacctgacgcttactccgcatcatcngatcgacaacatcgcaagtgcatgcgnagctcatcgcctnaaacaacgggctgcaagatccggaaggctaaacagtcntcacaacggcaaattaaatgcatgcggttg

SEQ ID NO: 91869 - DNA, 647 bp, Triticum aestivum
  unsure (1)..(647): unsure at all n locations
  Clone ID: PAT_TA_91869
ccactctctacctctgttgtttcttctgcggcgctcggtccccgaaaagtaccccgccgactcccaggcctcagatccgttttggtcctcagcaaagcaggccaaagactaatccgagcacctgcctaatcctcaagtttcgtttcatcatgagattgctagagagtcttcggttctgtatgcacatgcaatcaaaggcttgggctgctcactgttcttggatgcacgctacatttataccttctgacagcctctgggctatctcctggaaaccatcctcatggaattgggttgagctgtccaccacatatttgggctggaagaatgtttggagaacttgggtccctaaacaatctacaagtgcattgactttaacaaggtgatgttnagcaagaattgattccattggtacgaaaaacttccatgcttcaacagccnggtaaacggaatcctgtttgccaggatnaggaacacaagactgcaaccnttgggcatggaatacagggaaaaaagagaaaatatggtgatacaatatacaacggnnaaataaaagaattgcagatncagcaactcngaaataaggttnaacaagagaaaaatcacgtactaggnatgactagtgntatgggcgacanaancatgctang

SEQ ID NO: 91870 - DNA, 454 bp, Triticum aestivum
  unsure (1)..(454): unsure at all n locations
  Clone ID: PAT_TA_91870
gcgacgcctcctctgccaagctcctctccttccaatcccccgactcgccatcgtaggtccaccgccctgcgctcgccgggcgccagcagcagccccggggacgctgtcctccaggcggcgccccagccccagtacgcccgtcctccaaggcggcggtcagccccagtacgcccgtcctccaaggcgacggccagcatcaggaacacggtgattttggaggcacganggattctgcgattngagcgcacaaggctggcactggttctttaacaatactttggcanttatctatatatgtccctaacttcatatggttacatgacatctaccaaactanttgacttctgcatgcagtttanctccaatgagaaaattcnaagttcggttttntangganaaccactaagntnactntaacncanagaaacaagggtattntccatttcaacatgtt

SEQ ID NO: 91871 - DNA, 469 bp, Triticum aestivum
  unsure (1)..(469): unsure at all n locations
  Clone ID: PAT_TA_91871
aaaatcctaccgagtggtgagcaaccctcccactcgggggcttagctgcagtctagtactcgcctaagtttgaaaaatcccaccgagtggtgagcaaccctcccactcgggggcttagctgcagtccaagtactcgcctaagtttgaaacacatccctatcagcaaggacgacgaggtgcaggtcgactacaaccttctcctccggagctacgccacaagtagacctacgctccatcctcatccgcaaaggatgacgaagtgcaggtccgaactgcaacttctcctcaaaagctgngccacaattttaaatgcntccatcctcaatncgcaaggncnacgaagggcaggtcgatanacttnttcctctggggcaanacacaantncaagnacctcancctcatccgcaaggngacaaagngcaggcaactggactcctcctcaaaagtgcnctcaagtncaaaatttcc

SEQ ID NO: 91872 - DNA, 308 bp, Triticum aestivum
  unsure (1)..(308): unsure at all n locations
  Clone ID: PAT_TA_91872
ctccttcttgcaccagcattgggtcatgggagccatcataatcatagcccgctgcttcttcaccctctccttccagaccatcggtgtcgttgagaaacatcaacgagcagacggtatcacttcctgctgcgattatgtccctcaacaacgcttcttgtgcttcgtctcggggcggggtgtccatagtttctacaantatttacaacatggcaattattattcaaacatganaangcttcacttgctatgtaattagggtttcctcgtancgttcggcgaccctngaagaactcgttcccgaatgaaaa

SEQ ID NO: 91873 - DNA, 646 bp, Triticum aestivum
  unsure (1)..(646): unsure at all n locations
  Clone ID: PAT_TA_91873
ttcagtttttcctcagttatttcaaccggtgaattctcgtctcgttcgtcattcttcatctcttttcttctctggtggattcaattccaattttcgatgttgattatattctttccctcggctcaagtgttttccctgctcgttcgcctctcgccagtttatccttccggagtgctcaagacatctcaggagattcgtctgtgttctaattaattcnaggttgtcacctcatccaaatatttcaactattccggtgcatcatttatctgttcaacaacctttccaatggtgtttttctcttcaagtggggcctaaccacangtctttcccaggatcttacctgactcttctgatcccccgggagtatcccaatcntttcaaagggggacgttagaatgaattcaacaatcaaangccttctccaagattgttatcaaacattcatggtggtcnacccttggtttcaatccaacggggtaccaataatttgggggngttcncgngtcttggagacgaagaanantctctaaactgnccgtcctcaagttcgggtcagctaaacatctccantattagtgcanatnncctacancganagtagantgttccgttcttacggnacatcataatctacancgggtcnnag

SEQ ID NO: 91874 - DNA, 642 bp, Triticum aestivum
  unsure (1)..(642): unsure at all n locations
  Clone ID: PAT_TA_91874
cggcggtgttggtgaagatcgcggtgatgatgatggcccccggcagcgctccagcgccaccggaagcaagggggagagagccccccttcttcttcttcttccttgacctcctccctagatggtagaagggtttcccctctgttcgttggctcccatggatggaggggcgaanagcccctctggagattgggatctatctctctatttctgcgttcttttttctaccccctcaccgtttcctttatatcctggagatccgtaactccgattggggtgaatctttcgcccaaatctttctcaataaaatanctttctttgcgccaaaaaagaaagcgtcaaccgccttacgggtgggacaacaaggtaaggggcatnctggggggggtaaacgcgncccctactccntgacaacttcggaaactctcnnttgatttacttcccgaaaatcataatattccaaaaancccctccattttaaccnattggancgttggaaatgggtttctgcaaanaaaaatcaacaancaggaanggaatgggacggtaanattatccaaaatanntaaaattcaaannttaaatnataaattgatganatcaaatttgttcatancttaatncccagttaantncgnccccccc

SEQ ID NO: 91875 - DNA, 608 bp, Triticum aestivum
  unsure (1)..(608): unsure at all n locations
  Clone ID: PAT_TA_91875
cagagcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttgggacttggaggcggcttgacagtcgacatcgacgccaacggcaggaaggtgggcaagaaggggtgtacaattcgttgacaatacgggcaaaggtcnacggggtacagccnnttaaacccaaanggaagggctaatcngggaaccnnacccgggggganaaacgggtttatatngggctgacnctcnnggtctntggggggggtctcccccgttaaaanaaaatctcccccgggnaaaagactcccggttanaagggcnggtctgntttannaattccggaaccaaaaanancccnggaagtttgnatcaacatcaaanatnttcnaanaaggttagtgagnactaaccgtacaaaaggggccgtacaattgccnaaaggtcttacccgnaaggcgtcnttaantccnanggaaccngtacantaccctgaaaaaccnttcnagggnaaanaaggnc

SEQ ID NO: 91876 - DNA, 627 bp, Triticum aestivum
  unsure (1)..(627): unsure at all n locations
  Clone ID: PAT_TA_91876
gcgaaataaatgtagggcaaacctcatttccttcagcacccttgctctgagaacaaagaacccggcaaatataatctccggtaaggtccctcggtaggagttcaaagtaatttctgagaaatgcggatctaggcatttgacgtgattgttatattgtatcacattatccaccactggggcctaatcttatctgcaaaagaagaaaacgtgttaagtgcctacatgcattttggaacattactacatgcctattgggttgcaagattgtgaaatgcactaacatgccacctccattttggacatgataacatgggccttttgattacattccaagaaaaatgtaccttccttcanaaaaaggttgagtngatgaaaagttccctaaagaaactaatacaagatgatccaaaggngaatgattattgatggtaccatatgatttaagcaacaatatggngggganattttgtncngaanctccaaaaagacctcaaaaactnntacatgtcatgtaactggaaaacttacaatgacccctaggtacatnnagaaaggaacactcattaactttcagaaaagcntcagaancaattncagtggcaaattnncanctccgnccatttggaa

SEQ ID NO: 91877 - DNA, 645 bp, Triticum aestivum
  unsure (1)..(645): unsure at all n locations
  Clone ID: PAT_TA_91877
catccatccgcccctcgctgccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtgggacacatcgtcatcaaggcccgtccctgcaaggttgtttgaggctccacctccaaagactggggaagcatggtcacgcaaagtgtcactttgttgccattgacatcttttaatgggaaagaactttgaggnatcttccttcatccccacaactgtgactccccatgtttgaccgcaaagattatcaactggatttgacataactggatgatggtatttcaccttcctaactgagaatgggaacacgaaaggatacctgaacttccactgatgagttctgcttgggcaattnaaactggtttnctnatggaagactgntctgtcgtaattccccagggngaananatttgcncntgaaggaacgtggggaataacaacgtcctgttctactgcaaattgaacaaggntcngggttgaaaaaatggacaaantcgtggtaaaattntcatttnggttttacagccaggngaant

SEQ ID NO: 91878 - DNA, 243 bp, Triticum aestivum
  unsure (1)..(243): unsure at all n locations
  Clone ID: PAT_TA_91878
ttagaagcctgtgtacaagctcgtaacgaagggcgcgatcttgctcgcgaaggtaatgaaattatccgagcagcttgcaaatggagtcctgaactagccgcagcttgtgaagtatggaaggcgatcaaattcgagttcgagccggtagatactattgataagtagataaaactaaagataaagaagagaaggtataaataaaaaagaaacgaaataaaaaaaanaancccccaaggggggggg

SEQ ID NO: 91879 - DNA, 519 bp, Triticum aestivum
  unsure (1)..(519): unsure at all n locations
  Clone ID: PAT_TA_91879
cttggttgaaggctattctctttggtgggatgggaagagcaaaagctctgggaagagtgtggtagccaagaaatacgactgaatttaataaaacagacaaatgccacatcaactcgaccacagcgatggagtgctacagangcgcgaacaccgccttggcaaggacttcctctcttcttgcnaaaaccgaacccaacaantggttgcttaaaggccctnntttaaccgtncccnanaaaccaatcccggntacacgggcccnanatactgtcccntaacctcgnggtctcccaatcgtcngactctcnacancctgctccggatgccggcaaacggcaacttcntcngcgatttaactccaaacctcnccgctccttgagcgtgcccgcacctgacaanctcaanggccccgtcttggggtcaacttgaanagtccccgcaaaagtnttgacacaagagtaaccttgggtggnaacatcctttaggcgataagtntcaacttcccggccctgcttaagg

SEQ ID NO: 91880 - DNA, 418 bp, Triticum aestivum
  unsure (1)..(418): unsure at all n locations
  Clone ID: PAT_TA_91880
gtgattgtctgcttctataatcgtgaactgtttgtgatgggtcgtgcatcgtaaacgtagcaccatagaataccgactgtgatggcaatgcgagcacaaacgagttgcaaggatgaagcgtttcaagatattccgagatatcagaaacattttatagggacaattgtatgcatcaaggctccctatccccgacanttctaagccgtngtgggaangatccctatcgcatcaccacttnggcgatggttcaaaacaccgtccccnaaaaggggttaaaaaaccgtttggtatannacctccctccaactggggggaacgnctcaaaacannaatcattcctnctgaatggaatttcanccttacntgcaantggtaaaaccaaagnggaattttaaccaaaatgnaaaacccccaacaa

SEQ ID NO: 91881 - DNA, 564 bp, Triticum aestivum
  unsure (1)..(564): unsure at all n locations
  Clone ID: PAT_TA_91881
cgcctgcggccttggtcaatgcgtggcgcttgattggacgtgggcgcctccacttccccacacaaccttaataactgccaggccgggcggccgcccattgttagcgtagaacttccctcattgctcgtcgtgcttgcccttgtctccacctctcttccgcgaacccgcaactcttcccctagattcgacgctggcaccaacctctcttgtcgccatggcccctcggtcgaagaaggggaaagctgcactccagcccgaactcaaccggcttggagctgtcctgaacggtccatggtgatnaacaagaaggttttngcaaggccgtccaacccttgccgccgatcccaaatgaatgggaaggaacgacgtctgnggccgcttccccgggcaatgatngactggnaaccacgaaattccanccactttaantctcccgggtggctgatncctttcccggatttaacaaaggtataactcccattacaancaagnatgnanctaaaacccaatcancaaccccggggtgtcntgcttccttgtaaggcatgnggaatgcccttcgta

SEQ ID NO: 91882 - DNA, 360 bp, Triticum aestivum
  unsure (1)..(360): unsure at all n locations
  Clone ID: PAT_TA_91882
gacaagcgacgtggagagctacttcgaattgcatggagatgaacaaaagggaccagtgagaaaagatgaagacaagtgtttcagttcagcgaaaaaagatcatatatgctggctcgtttttcttgttctcattttggctctgtaaacaaagctggatatgtattaggatctacctgngtgggtgagagaactctgcttccttcatgttggctgtaggaggtagttaagccttctccgatgtgttgtcctctgaactggtgtactggccgtttttctgcttcattanataaatnggccaggggggnaaccctttcctttttttaaaaaaanggggaaattctaccccannaggggaaaaaa

SEQ ID NO: 91883 - DNA, 161 bp, Triticum aestivum
  Clone ID: PAT_TA_91883
tgcgaagtagctttttccggtttgcaccttcagatccgccatggcatggtcactatactcataaagcttatggtttcccccctttatattcactaccatcatcctaggtgcttcactgcttcgtgtcgtgctagcactgctcccgagggggggcccggtac

SEQ ID NO: 91884 - DNA, 444 bp, Triticum aestivum
  unsure (1)..(444): unsure at all n locations
  Clone ID: PAT_TA_91884
atatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgttggcccatccgagggcatcaagaattccgagaccctgtcctacttgccaccgctcaacaanggagcctcctttancaaggtcaacactgattcgtccaattggtgcttcctccanttcacaaggttnggttancttcccttgancanaacgaacccctgggtactacantggcgtaatgggnatntggaactgctanttcngatgcaaccaaccaaccaggtatnacnaggttggaggangtcaagaaggatacctgacnctaantcgcata

SEQ ID NO: 91885 - DNA, 568 bp, Triticum aestivum
  unsure (1)..(568): unsure at all n locations
  Clone ID: PAT_TA_91885
agttactgagtagaaacttaccaggaagtaaacacactctggatgctgtcgcatgctctgttcagcacgtgctcgctgccccggctgccgcaccttgccaaaccgcgccaccattgccatcgcgacccacttaactccgccctgggcgctcgccgatgccggagttccgccgcaagcgagcacgggtgcgacccagcaatccgaacgggtgcaccgcgccactatgctccgtccgcacccccgttcaatgtgctccgtctgncncctcccaacagtgcccgcatgancgcgtcgcttntccccctctcactgacgccgtttcgtcgccgggcgccgttttccaagaancctcccggcgggccgttncttttcctccgctcgccctatnaatacagcctcttcaagcctccatganatcacaattcaacacacaactcccacacgcaatttnaagccgcacccggccgggnagctccggcggcatcctgantnagtccgntnattccaaaatttgcccaacatccaaccctccaagncaggggggccgtacaatccctaatgatctata

SEQ ID NO: 91886 - DNA, 201 bp, Triticum aestivum
  unsure (1)..(201): unsure at all n locations
  Clone ID: PAT_TA_91886
ctatcatatatactcgcctcaagatttgtataccttacacttttcatancantacacggatganccctaccaaccancactatanatccacaagtatatattaatgtcaaatggaaaagaaatangtngtatcgcccatactcccancccacaantctacctgtcagctaatcatgcacatgcngccatggccgaccanca

SEQ ID NO: 91887 - DNA, 270 bp, Triticum aestivum
  unsure (1)..(270): unsure at all n locations
  Clone ID: PAT_TA_91887
accagcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtggaactaccatggcaagagtccaaggccaacaggttcacagtcatggcagcggaaaacatcgacgaagaagaggaacacagacanttggaaggncttgcctacanatctnccacgaacaa

SEQ ID NO: 91888 - DNA, 596 bp, Triticum aestivum
  unsure (1)..(596): unsure at all n locations
  Clone ID: PAT_TA_91888
ttttttttaaagagagatttacactgctgcagactatgcagacatacacccattaattggagctactatgttcgcatcacccattaatgaaggatgcatacgcacaaacagtacagcaaaatgcaacagtaaatagcaaagggataactgaatcatacaggaaaggctggggttaccggttcgaaccagctgaatcccatcccgtgtatcattccctaacgtcacaaaccatagaatagaatagaaaacaaaccanaggaaacaaacgggttcgtttcagtttcaccatgccgccaacctttgcctctcaaaccatggccgtccctccgctgtcctccctctgcagaggaactggccactgctacccatcnggaagactgctgccacaacgccttccctattanccggcccctcanaccctctcngacgaacttcantccacnggaatctcaagccatcaattgggaaaccaccatacttattgggacnccttaactcnccaaatttgtaccgccagtaatcccccacaaccaagtttcaannaacggcaatttggaataactcncgaanaaatcccccattgggataattnttnc

SEQ ID NO: 91889 - DNA, 566 bp, Triticum aestivum
  unsure (1)..(566): unsure at all n locations
  Clone ID: PAT_TA_91889
agaccatcacgctggaggtggagtcctcggacaccatcgacaacgtcaaggccaagatccaggacaaggagggcatcccgccggaccagcagcgcctcatcttcgccggtaagcagctcgaggacggccgcaccctcgccgactacaacatccagaaggagtccaccctccacctgggtgctccgcctccgcggcggcgccaagaagcgcaagaagaagacctacaccaagccaaagaagcaaaagcacaagcacaagaaggtgaactccgccncctccantctacaagtccgacgacgccaccggcaaggtgaccagctcaggaagggatgccccaacgccgactgcgggccgggacttccatggcaacacttcgaccncactactgcggcaanncggctcactactctacaaccagaggttaaaggtgctttcgattctctgtctttaactactatcnaganccatcacttaaatttcccnttgtcctttaaangaactggatctaagttcctgnatatcanccctangcgtnaccatctgctaaattgggtaaaaaaaaaaaa

SEQ ID NO: 91890 - DNA, 644 bp, Triticum aestivum
  unsure (1)..(644): unsure at all n locations
  Clone ID: PAT_TA_91890
acaagaggtctttcaagtacgcgtgggtgcttgacaagctcaaggccgagcgtgagagaggtatcaccatcgatattgctctctggaagtttgagaccaccaagtactactgcaccgtcattgatgcccctggtcaccgtgacttcatcaagaacatgatcaccggtacctcccaggctgactgtgctgttctcatcatcgactccaccactgngtggttttgaggctggtatctccaangacggncagacacgtgagcatgccctccttgctttcactcttgggagtgangcanatgatctgctgctgcaacaagatggncgccaccactcccangtnctcgaaggcgcgttctgangaaattntcaangagtccttcctacctgaagaaggtcnctcaacccgaaangttnccttcgtcccatctctgggtttgaggtgcaacatgattnacaggccacancttgatgnacaaggccaacctcntntgcgcctgncagtttacgatccannagcctcnacagccctngctcccccagncttaaanatggtgnttcacgtccnttgnctgtnaacgngtctcanctgnaggtntncctggccaggncgaacnagtagtcttgcancaaancctccncggtctt

SEQ ID NO: 91891 - DNA, 648 bp, Triticum aestivum
  unsure (1)..(648): unsure at all n locations
  Clone ID: PAT_TA_91891
atacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatccgagggcatcaagaattccgagaccctgtcttacctgccaccgctcaacacggaggcctcctccaagcaggtccgactacctggattccgctccaaagtggntccttgcctccgantcaacaagttggntcatcttcccttganacaacgcatctccctggggtactaacgatggccngtattgggcatgtnggaantgcctatttccggngcactgacccacacagtgatnaacgaaggtggaggagtccaagaagganacctgaccctatntccgnatcatccgttccacaaatcctcangtgcatgctcanttcatcgcttaaacaaccggntccaagatccggnaaggctaacagnaancacacangcntttaatgcatgcatttgnaacncgaatgcttggttcctccattacttctattgtcanaaattagtcagttcagtcaaatgncaaaaatnccnttatc

SEQ ID NO: 91892 - DNA, 638 bp, Triticum aestivum
  unsure (1)..(638): unsure at all n locations
  Clone ID: PAT_TA_91892
gttaaactatgaaaaaagctgaacgtcctgtaaaaggtgaaaatagcttacctcgctagcgtgacgctgcgagctgtatccgcggtcctcagaagcggatgagggagcctcggcgcctttggttagcaccttccagacgtcttcatacgtcgtgtcgaagagcctgttaagggtttggtgctgcgccgggacgaactcccacagattaaaatcccgttgttggcacgggaggatccgtcggacgagcataacctgggattacattaacaagccagattgggcttgttcaccagggactgggatgcatctttgcaatccggtcacctattttccgtcaccccacgatagnccgtctctttcnaggacataagcgcgtggggggtcagattggaactcgggggctgcggtcatttcggatcccntggtccgtgattaaaacaaccngattccacccttaaggncccacaaagacctccagggggggccgggtaccaatcnnccaaagngatcgtatactncctcatggcgtcnttanaatctgacgggaaacccggngtaccaactaacccttgagacaccccttnncaactgngtatacaaangccaccntncttcaaantgcnccgagggaaggaccc

SEQ ID NO: 91893 - DNA, 635 bp, Triticum aestivum
  unsure (1)..(635): unsure at all n locations
  Clone ID: PAT_TA_91893
agttcacaaagtggccagaggtggaagtagtgaggaaggtgacaacacagtcagccgtcaagttcttcaaggggctagtgtgtcattttggtgtgccaaacagagtcatcaccgataacgacacgcagttcacaagccacaccttcatgcaatatattcaagacctcggcatcagggtctgtttcgcctccagggcacctcacggagcaatggccaggcggagagggcaaatgctgaatgttgtgaggcctgaggacaaagactttgacaggctgcacaagagcggaaancctggattgatgattnccgacgttctttggnccatttaagaacgacgcaaatcgagcaaccggcaaanaccttaacctaagtatacgggtaaaacattctccccaacggngctcaaatatgnancnccaagggggggcccngtaccattcnccctanatgancntattaccncgtcaatggcgtcgtttanaactcctgacgggaaacctggnttaccaattnacccctncaacaaaccccttcgcaacggggtatacaaaaagcccacgatgccttcaaaatnccactaatgcaatggacccctntacggcataaccggggttntggtaccantaccnacttca

SEQ ID NO: 91894 - DNA, 243 bp, Triticum aestivum
  Clone ID: PAT_TA_91894
gtcgtctttgccggtggccgacagcaaggcatagtgtttcacggtgacggtacaaaccatgtaccaggacgtgtccagacttcgcatggccgtagtgtttggtcataggattttaatagcttttattacaaaagtgctgcactttggaaggtttattaaagagaaagataacctatcagtactgtattgtagtagctgtcgtgagtattgacctcgtgccgaattcggcacgagggggggggg

SEQ ID NO: 91895 - DNA, 324 bp, Triticum aestivum
  unsure (1)..(324): unsure at all n locations
  Clone ID: PAT_TA_91895
gcgggaccttgagcggtccgaggaagagctcggccttaccaagaggcagctcgaagagaacaaaggtaagtgataccccgtttgtatattgagaaaaaagaagatgattgttagatcataggatcgtcatgaatttgctaggggccacgatcnaagtggcggccctgaagaaggcgatgtccgaggccgaagacaaagcggccaagggagcgcacccgagcacgaagaaacaagaggccgggtccggcgaagttcaagcaagactcccggttttctcnaagaatacganccttggaccgtgactcccaaaccaaggtccagtac

SEQ ID NO: 91896 - DNA, 620 bp, Triticum aestivum
  unsure (1)..(620): unsure at all n locations
  Clone ID: PAT_TA_91896
gggcttaatttacagtagattaattaaagaagactggatttagagctaacttgtgtatgagaagaagaggaaaaaaaaggcaaacacttggaccgatcaagagctctaagctactaacatggaaatttggaggcaagcaaagcaaccatggaggaaaaacgctagctggctaggtcagcgcgaagtctatgcaccgcttcttccagaccgcgtgcgccggagtggccgctgcgttggcgtccatggatctcttgcttgtcttgggcaccatgctgcagtcctcgtgctcgggcgcgtgactcggcgccggcgccgtgagaagtcgacgccgaagatcgcacggtcctcatcacgggtgccggcgacggggcggccgccgcgttgacnaaatcgtcgtcatcgtctggtcctggaccggagcttgcagtcatgaagactggttgctcctgagnnaaacggtanaaccgacgggtcccggcttcaggccttcncctgaaaacggtcancctggggacactactcggtgcgtcattcatacggactcaaacttcggccgatctcaattaaantcctncacccggnacgggccgcgaagactgaagaaanntccgntctntctn

SEQ ID NO: 91897 - DNA, 241 bp, Triticum aestivum
  unsure (1)..(241): unsure at all n locations
  Clone ID: PAT_TA_91897
tccctttcgggtaacggcgccagaaattggcaaacggacgtgaataaattgtagtagattgacagatcgaacgccaaataaaataaataagaataaattgtggcaaggtatttttgtatttttgggtttaatagatctgaaaataaaaggcaaataaaatagatcacaaagttaaataatatgagaaagagaccagggggtccgtatgtttcactaagtggcttctctccnaagggggggc

SEQ ID NO: 91898 - DNA, 638 bp, Triticum aestivum
  unsure (1)..(638): unsure at all n locations
  Clone ID: PAT_TA_91898
ggcagcagtacactccaagcaacgcccccgccccgccccccctcccgtcgtcatcatcccaaccccgcgcgcctccctcgcgacgcacgagcagtaggagcccggcaagaaccgaaccatttcttttctcccctccgagcccacctaacctcgctctctccctaccaaacgccccctcggccaattcccccactctctcgacagccgcggcgcggaaatgggcggcggcggcggcgcgaggccgttcttggccgtcgtcatggcggtggccgtgttggcggcgatggtggcgccggcgcgggggcggttcgtggtggagaagagcagcgtgagggtgctggcgccggagcacatccgggggcaacacgaagccgccatcggcaacttcggggtgcccgactacggcggcacgctcacggcgtcgtgctctaccggccaagaaggcacggatgcgcgagttcccgccaagtcaatcaatccggcgcccgtctctcctgtcgacgcgaaatgcaattccgctaagnctgaaccgannaggggcccgcgggtctattcggacgtgacanaatgtacatggaaccgagggtcccaaangnctcaagcaaatcgtcgctggaacccctcggatctaacntgct

SEQ ID NO: 91899 - DNA, 489 bp, Triticum aestivum
  unsure (1)..(489): unsure at all n locations
  Clone ID: PAT_TA_91899
acacaagaagctcatagccaatcaaagcctctccatctccgaagctccaaccgaaccgaggatgtcttgctgcggaggaaactgcggctgcggcaccgcctgcaagtgcggcaacggctgcggcggctgcaacatgtacccggaggccgaggccgccggcgccaccctcctcgtctccgccaccgccacccacaaggcgagctccggcggcatggagatggcggccgagaacggcggctgcggctgcacccagtgcaagtgcggcaccaagctgcggctgctcctgctgcagctgcnagatcattgatcatcgatcatgcatgcaangcgcgtgcagcatcgatcatatcgatntactactaacataccatgttancgctactgatcgaagggcntatctatgcacctgacctgatcacaatcaagtgccatgccatgctggtgtaacaggcccctaaataaatctcctggttaactaaaaaaaaaaaa

SEQ ID NO: 91900 - DNA, 240 bp, Triticum aestivum
  unsure (1)..(240): unsure at all n locations
  Clone ID: PAT_TA_91900
gggattgtgcccccttattacgggattctcatcaacacgggcgtgggtaacccgaccgtgccgtttacacatcccttgggagcaggcgaattttaaggcaattgcgggggaggggggagtncgatattcactgnncttatcatngaanataatattccnctttcttctcncanacnttcttcctgccttcccgttcttgagctctancncccaattcatcattcnttctcattcanacat

SEQ ID NO: 91901 - DNA, 599 bp, Triticum aestivum
  unsure (1)..(599): unsure at all n locations
  Clone ID: PAT_TA_91901
gttaattctcatataggtgggactagccacatgcataataataatcaagtgtcccataaaaacacaatctaaataatttgttgtaggagaacgcacagtctatgcttatttgaacagtgctgaagattaattaccttttgccttgcagatgttttctgatagcatcaataaggtccggtacatcaggaaagccaatgagcagtggtgcctttacctgtgagagcatgctagtgagaaacctcctcatatctgggttccgtgagacgattacgaaagcccgacactgaaatttccctccatgcctgtgatacatgcctctggcagctgttgtctttccaacacctgcacatccgtttataggtatcaccttgagacctgtcctgttgtcgtcgtctaaagccagcagctcgagaagcttgttggcagctccacagcacaactgtgcacggcaatgccgtgtcaacatcgacacacatggaactggnactctgggaanttggagtagcngtgacccgactcccacngcanntcacngtcatgacttngaggaacactgaagtcaagcntcctcgacctcacnagcantatcgaaaacaata

SEQ ID NO: 91902 - DNA, 357 bp, Triticum aestivum
  Clone ID: PAT_TA_91902
cactcttcttcttcttcttcttcttcttcttgctcccacgcatgcagcgttgctctcctgctggctctcctcgtatgttgttccttggcgtgctcggtggcggcagtccaagttgctccggacggacgccgtaagccaaggttttctcccccgccgccgatgagcagggtgccgattgggccaagttccgccgccccaggagacgccaaacgcaagaccctgcagcaagctagtattgcaaatcccccttatgcatgaaataccaccggcgatcgcgcgctcttatgcttacatacgtatgaatgatcggtcatattaaggtgttgtgttacttgtttcatcagatcaaaggggggg

SEQ ID NO: 91903 - DNA, 447 bp, Triticum aestivum
  unsure (1)..(447): unsure at all n locations
  Clone ID: PAT_TA_91903
acaacgcatcccctgggtactacgatggccggtactggacaatgtggaagctgcctatgttcgggtgcaccgacgccacgcaggtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagtcactcaccacgggccacatataaatgccattgcggtttgtcaactctgacatgctttgggtttccttttccatttatcttccttgtttgttcctaaagataaaatatgtgtattccatgttcccgacatgacccgagaaacatctccgtaatgtnnaatgctaccgaggtangtatatgcacatgcacataatattataantcaaccgtccgact

SEQ ID NO: 91904 - DNA, 452 bp, Triticum aestivum
  unsure (1)..(452): unsure at all n locations
  Clone ID: PAT_TA_91904
ggttccttctggtccataaaaaatctccaaaaagttacgcggtgttttttggacctggctgaagagcaccgcctgaagctggagctgatcgaagccgagctcgagggccggaccgcttccctgaaggtgaagctggaatctgtggcccattgagtctgccttgggcttctgcctgcgccaattatcctcccttcaagcagcaancaaaggataccgcatcccttgcaaagaggactgcgaatgaagtgaaccatcccctgacactgcaatgcaagcacggtcgatcccaagatntccgagtcaagactaacctncattgggcacatctgcaatgaattctcctcatcgcacaaantgactangccagcactcattcttcaatcaattttgacccctggangattnggcaacaaggtccatggngnnataaagnacncgggttcttctccggg

SEQ ID NO: 91905 - DNA, 592 bp, Triticum aestivum
  unsure (1)..(592): unsure at all n locations
  Clone ID: PAT_TA_91905
ggaccaccttgcaaggctaaatactcctgggtgaccgatagcgaagtagtaccgtgagggaaaggtgaaaagaacccccagtgggtagtgaaatagaacgtgaaaccgtgctgagctcccaacagttgggaggggaaagttgatctctgaccgcgtgcctgttgaaagaatgagccggcgactcataggcagtggttgggttaaagggaacggaacccaccggaccgttagcgaaagcgatccttaataaggcnattgtcactgcttatggacccgacctggtgatctatccaatgaccaagatnanctttggttaaactancaaaaggcccnaccactatntttaaaatcaccgttaattttgtaaggggtaaatgcacccnaacccaactactgtttcccccaatcctttaggaacatttacggcactagggtaacnttttcggncggctcccaacgtacaatcaggaanctatcaattaccaaatacagtaagccgcatnacatgggaaactcactcaaggaaaccgttcactaggccnatccccattaagggngggtcaaaaccaggnttcaacaccccttantgttt

SEQ ID NO: 91906 - DNA, 501 bp, Triticum aestivum
  unsure (1)..(501): unsure at all n locations
  Clone ID: PAT_TA_91906
gttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactggacaatgtggaagctgcctatgttcgggtgcaccgacgccacacaggtgatcaacgaggtggaggaggtcaagaaggagtaccctgacgcgtacgtccgcatcatcggattcgacaacatgcgccaggtgcagtgcgtcagcttcattgccttcaagccaacgggctgcgaagagtccggcaaggctaaacagctcactcaacacgggcacatataaagtgccantgcaattttgtcaactctgacattgcnttgggtttccntcncaattgncttctacttgtccaaaaatangtgtagtcaagtcaagtacacatggtccagaaaaaaaaaaaa

SEQ ID NO: 91907 - DNA, 580 bp, Triticum aestivum
  unsure (1)..(580): unsure at all n locations
  Clone ID: PAT_TA_91907
ttaagattactatatatgatacacaagtgcttgactagaaagattacttacagaaacttgccaataatgctagcaaagatttactagtagattatgaacctatttactcaatcaagcaatttaatttgatggcaatgtgataaaatataatataagaaacaaggactccttaaatattagagcatctccgagtgcaatgctccggaccaaatctcgtccacaccatcctccacttcagccttaggtcagtctcctcanccgacgatgtcagcttttgaactttgagaatccccacacgccgctgaacatgttcacccatgcacagccagaaagcgacattnttccccgctcaaacattttaatggggatatgagaaggaggggcaccacaacaacatctggatgggagcaacctgcaaatcctgcggccgtgggctcatccaagggaacaaagaaggnggatgccnccaggagatgcacaggctggtaaaggagccacgggggtgggcccactgaacccanacactacttaacaatggaaaacgggcaaangcactgntgagnacgnanggcaccccagg

SEQ ID NO: 91908 - DNA, 484 bp, Triticum aestivum
  unsure (1)..(484): unsure at all n locations
  Clone ID: PAT_TA_91908
cactcttggcgcgccatagaagcctgtgaagcgccatatatcagatggagtatcaactctccgcaccacacaatctatgtggccggtactgtaattcttaagctcaacggacacgtcctttgaccagaataatccaaggcctccgctcancccaacactgtccactgcgaaacaaccagagaaacccaaagaaaatttcagattctctaccctgtcagccctaatcttcgtttccatcacaaagagaagggcgggaccttcttgcttcaccacattgcgaagctcacgaactgcctcggggttcccaagcccccggcagttccagcttaagcaaatcattgggctgggcaaggctgtccagcagccactgccgagtcttcaaagtttgttggggtcgnttcntccttttgggtccgttcngnccttccccccaaacttcctttaanaaatgtgtctgnctgatagnaaaatccctgtcaacgca

SEQ ID NO: 91909 - DNA, 650 bp, Triticum aestivum
  unsure (1)..(650): unsure at all n locations
  Clone ID: PAT_TA_91909
ggaaagggatacataaacttggatctggggtagtcttcaagtcctcatgttgcttctgcttccgtgtagtgctccattgagcttgaagtacttgatggtgtggcttcgtgtatgacactcttcttgatccaggttgctaatgggtagtcacggtaggttagattgggctaggggtcgatggatcggtggtcaatgccctcatagagatcgggcaagttaggaagttggaaacacttccggggttgtgatgcatggaaagccttgtgcacatcaggtaactccggtggcaactccagctgggtaactatcttctcttcgtctcatagtgatctcagangggggttgttaaattttgggagttgatctccaaagggggccgatgaagcttggtgtgggtatccttgtcatggaaatgcttggntccttaaaaaaaaagggctccanatagacttggnctcaacgagaaantcactctaacatggggtgggtgtattctcctcttggaangggtctcaaatgtccctgacanctaaggtctctcaactcnggtaaaataggcacaatgatatanactactgtcaacacccanaagctttcacggtaanaatagcgggaatangngtttnttatcggcaggtcaataagtaagc

SEQ ID NO: 91910 - DNA, 561 bp, Triticum aestivum
  unsure (1)..(561): unsure at all n locations
  Clone ID: PAT_TA_91910
gttgcacaccatcattttccttttgttgcacaccatccttttccttttgctgttagctgatggcctgatgtgctgcaggcggccggaatcgagcgttcttggtcagtggagcagggagcttggtccaggcggcgacggcgctccatgaccataggtgctgttggtggtggcccttccatggcttcgccccacagatccatggctgcgtggtcgcctcctcctgcctgatgcccacgggctagggttcgggatccatggctcctcctccaccgttgcggctgcgtggtcgtggaggangacggcgtcgtggatctgggccgccggggatatgggtgaggaagcangctcatgganaggccgggggcggccgatgggaaaagcggaaggagcccgtatccacnacggtaancgcgctcccctgctaacaacnaaaggcgntacgtaccgtcacaaantaaagggctatggaaaanacgttggnccactttatnggaantattgcctcaacnaanaaaacccnatatatgtcaattgcctgaaggactttnaaaataaattggg

SEQ ID NO: 91911 - DNA, 632 bp, Triticum aestivum
  unsure (1)..(632): unsure at all n locations
  Clone ID: PAT_TA_91911
gtttatcgaatctcgatcgtagtgatacacatattcataatattgatgccaaaagatgcaaagttggtaatgctagtgcaacatatttgtggcactgccgtttaggtcatgttgatgtaaaccgcatcaagaaactccgtgctgatgggattttgggaatcacttggatgcttgcgaaccatgcctcatgggcaggatgactaagattccntctccgggaacaatgggagcgagcaactggaattattgggaaataaacataccgatgatgccggccaatgatgtttganacccacggnaaggaacaatgttttccnaacttcaacaganatttnangcaaatagtgtaaaaccacttgatggaacacaatcctgaacacttgaaanttccaaaatttccaatatggaagttnanaccatcctaacaagaaataatttccacaatttggtcccaaagnaatattganttaccatttggcttcaattaaacatatggatattcacaaanaancaactggnaacacgcataatgcgtgggatgnacgcanatgtccaatgtnggactatctaggcaccatctttatactnaanggttgcngatcaagacaccagcaggntttaaactcggcccg

SEQ ID NO: 91912 - DNA, 618 bp, Triticum aestivum
  unsure (1)..(618): unsure at all n locations
  Clone ID: PAT_TA_91912
ctaactcgttgcacaagaattcctcccaccctcgccgtctcgccgccgtcaccaccgcagctagataagagaaaaaaagagagagaagaactcgtcgggagggctcgagatctgtgttcggagaggggaattcttgaggtcggaatcggaacaagcgggcgcgctcgggatcggggttaccatacaattttcccaaggaactttaagtgaatgtgctaatggagtcaaagggtggcaaaaagtctagcagtatattccctgatgtacgaagntcccctccngctacagattgaagacttcgacctgctggaggcgccaagaattctcctgctgcatactccaactgcgcgaagancaacctgaaacgtttttggaacccttcccgtatttaagtttttaatgcatttnatcccganctttctcccacaactcccnggttgctgttcacgatancgacattcccaatcttctcctcggtctctcngtcggcttcgacncaaacgcacaatggtgcccgactcgcgatggattgaggcacaaaaagcctgaatacctcccgagnataancttgtacctangcctgctggcnctccaggccaattancngtctatttgngg

SEQ ID NO: 91913 - DNA, 599 bp, Triticum aestivum
  unsure (1)..(599): unsure at all n locations
  Clone ID: PAT_TA_91913
cggagcagttgaccccgacgaacgatcagtcatcagcaggctggcgaatgtgacgttggtccgaaccggatctccggaacgctcgaccaccgcctcaagcaccggagtcgattaagggacttgaacttcaagccttctcctgcttggagcccccgcttctcctcctcctctcatgttagaggcacttcttcttcatcatcatcaggaagcacgacgatgtctcgccggaactgcagcgaaagaaaaacatcggatttccggccgactggacactcaatcgactaaatgaggcctgggncgaatggcttacaaccccggaaggtgcccgtccnttngtcccttntcccccanttttgtcaatacanttcatttgnanaaaagttaaggcaanaaaacaaggcaatttggcaaganaactttattcaccnaataaagcaagaaataccaccctnaggaaaggactcactgntctcaacaatctcnanctggaggacaacttncgctgggacnttcgtggtcgatcacccaatgttcgcttgtattggcgatcttcggccgcccngtaaagttctggtggtcanatgggatcacnttcttnn

SEQ ID NO: 91914 - DNA, 636 bp, Triticum aestivum
  unsure (1)..(636): unsure at all n locations
  Clone ID: PAT_TA_91914
acacacctctccccatattcgcatgtgtatctcacacactcactctctgattatgtctatgtgtctccacgttacacaacacaaattcccatgcacatgtctctttatatcctccacacagagacacaaagaatcttatcattgccccagtctctacacatatcacacacgcacgctatctctctctcgcacacacgttcaacaaatattttcccgtgaataactcactgtctattcatcaactgtccgtggtagtacggcgaacacgggacatgaaaaagaataaatctacatgtgcatagaccacgttagtatgaataatangactaagagcaagccgaaagcngccgcntcacccctccttcaagggcgatgagaaacttttgttcaacacatcnagaggcatcaagctacngccaacanctcaaccgttggaatagaagtagttcaagtgtttggngatacaatgtataacgatactggttcataaactggtntacatcatatactctctctaaaaaaaacgattgtgatgatggacccgcatctgcaatatanacttntnatacgacagtngaatnactaaggtacgaatcccaaattgagnaaggctncttgtcgctaccaaactatgng

SEQ ID NO: 91915 - DNA, 588 bp, Triticum aestivum
  unsure (1)..(588): unsure at all n locations
  Clone ID: PAT_TA_91915
cactcgaccccacctcaccccccgccctcgccgccgacgacgcgcccctcctctgccgtagcggcgacccgagatccgcccttccccgacgaccatgccggtggcgcaggcgggagggcaacccgtggccgcggacagcgcctcgtcccgcaggaaccgccgccgccagaagaancctccaacgccaacgccgcgccgtggtcgctgttccggcgccggtgccgccacgccgatgcagcgctcttcgacaccagcgcgagtcttcgccggtccgccctggttcctcccccgcacgangccgttcgcccgcttcgccgcatcctcaatgagatccctccaacgcgttctgctanttggggtcaccggtctggtacgtggactgcaatgaacacgatgcggacttcaacctgcntcatgnctcaantatcgggggcggaaactcatcaccntgtatgcncatgacatgaaagcgtgccggcttnatgaccntcgacacatgtcacgncaccctgcgnatgaangcggcacatctcatanagtcctcgatgagatccgncacgggcncataaaatcctgtnatggnnctat

SEQ ID NO: 91916 - DNA, 634 bp, Triticum aestivum
  unsure (1)..(634): unsure at all n locations
  Clone ID: PAT_TA_91916
ctggtgcctgctcctggcgtgttaaaaagattccttgcctcaaagaccggcggaaggtgcgaccggtatcttttcctcatgaagccatgtgacgcactctgatccagcatgagccggtaagcccgagcctccaactcggcccgctctatagccatcctgggtgttctctgctgccaggtccgctttatcttgagttatctgatcttcacctttgcaatctctgcgttgtgctgatcccggtttgccgcgtccacctctgccgccagcaatgttgctaaagcgtccgaacaaatcaagacaaaacctgagccgggaggcgggcgctgagcccctgtcctgctggtgttgctgctgctgaaccggagattatcgccgcggcagtagaagatgtttgtgctgattgtgtaccntccatgaaagacgcaaccgatcccgcggttnaaggggtccggatacgtcgcatcgggactttaataaccngcatcctgaactgaacatgatcnnctcccngttgaaaccctcacagatannaacggtnccgcaaatccattacccaaatcgcnnatgntgcactacaaggaccttaggngctaactgcgatttncctancctncataatcggnattcggtnagc

SEQ ID NO: 91917 - DNA, 633 bp, Triticum aestivum
  unsure (1)..(633): unsure at all n locations
  Clone ID: PAT_TA_91917
atactctgccattatttgccaaattttcgtttctcctgagagctgagacgaaggctgttcattttttcagcctcggccctcttagacgatacacatacatatgacatgcccaaattgaaggacaaaatcgtcatacccacctaataacaatccaataatcctaaccacattatacacacatctctatagtgacaggcgcggtttcaatcctgccctccgccgccgcgccctcggcgacgccaccgccgcggtgacctcgccgtcccacagccttacaacggtgccgtcaagcaccgccgtgtcaaagtgngcggtaccaagcccaaatctccccgcctcctcaaggccatctccctcttctcccagcanggcaccgccgtcnaggctgccgacctgattctcatcgacgccgtccgtctcgctgtgtcccgctctggtcgtcgacgacgggangcctcctctctctccctgtcgcgattcctgacgcgtcataccatcgtcagcncngcccgcgtatatcctgaacggactnggcgcnaccggtcgctatcgggaggaggtcacggacgcattcggcgtggtccnggggananataacggctcggcncngatgcncaaangtctcgcggccgg

SEQ ID NO: 91918 - DNA, 621 bp, Triticum aestivum
  unsure (1)..(621): unsure at all n locations
  Clone ID: PAT_TA_91918
agaaatcaggaagagctaacacatgagctaacactagagcttatttcagcaacacaaaggcttgttgctttgtatctgtccagtgatatggcacacctatcttcagaagattggacagtggtttgctcaacattccataatgagaaatgaactcctgtaagtacccagctagccccaaaaacctcttacaccttaagcaagaaactgggaactgggcatccttaatagaaggatatttttgcagnttctgtggcacccctgaagganccctgggctnagggcctccggccttccggctgttacccatnggcccgactgatggctgtntaaaacatgaagntggaaactaactgtncccgattngcccccctttgngttggaaagnaactttggaaccgactagnaaatcctcctaatnatccgacccaatgtaaccctnaaccccctggtctaaaanaaccggagggtatccggnaaggcagcatcatnacatatcatcagtaanctcaaggttaacnatacatncatgnaataanctgtacaccanatcacagtnatcacaggctnggatacccaaaagtccactgnanattgtcctcccgtaatgtntatcaatcgacc

SEQ ID NO: 91919 - DNA, 461 bp, Triticum aestivum
  unsure (1)..(461): unsure at all n locations
  Clone ID: PAT_TA_91919
aaggtagggtttccagttgcaagccgcgccgccgccgccgccgccatgggacactcgaacgtctggaactcgcaccccaagaactacggccccggatccagggtttgccgtgtctgcggcaactcgcatggcctgatccgcaagtacgggctgatgtgctgcaggcagtgcttccgcagcaacgccaaggacattgggctcatcaagtaccgttaagaatgggaaacctcaaaggaagcaaggactaagaaattatcaaacgaactgtggtgctcaaccgaggctgatcttatcctaataagtatgttatgaactactataagtttgatccctgggtgacaaaacctnaaacatgttaacgactgctgtttgacatttgaaaccgatattctgttacggcttccattatggtaaaaggtgccccncatccctaaattttataacctgccaaaaaaaaaaaa

SEQ ID NO: 91920 - DNA, 253 bp, Triticum aestivum
  unsure (1)..(253): unsure at all n locations
  Clone ID: PAT_TA_91920
cttcatcatacaaaatacataatcttgagagtctttggaaatttggatcaaaatacagaatctttatctagtcgagtctgaactctgaagaatctgagatttcagctcaaattctacaagatagaactagaaacacggaagcaaacaataatccaaccggggtctctgacagtcgtcttgacagcgtaccttctccgaaggggggggcccggtacccaattcgccctatagtgantccttattacgcgcgtca

SEQ ID NO: 91921 - DNA, 578 bp, Triticum aestivum
  unsure (1)..(578): unsure at all n locations
  Clone ID: PAT_TA_91921
ttcaggtagacggcctcgcacacacgcacattatatcgcagttcccctccttccctttcatccatctccaatctttgctgccagagtctgctccaccatctgctccaagaacgccaatcacttgcctggatctatactggtgactaactgaccggtgagtagatcgggctgtgcaagctatctttcagttcggttaccttgctgaagcaccgattgatcaagcgaatgatgatggccgacagcggaaagggatagcagtttccatatcactggcacccaagatcgataggagaccaaagaaattgacatccagactccaactctataagcataccccgggcaattgggnccattaatgggctcaatgaatggttcaatttgtttcaatgggcggttctccaattcnaaatctgcgnnccgggggncctgcaacacangaggaagtntcaatcatgaatatgcactttcagatggtaagttaacgnatatgntactaattggtaactgtgtactgtctgtaccncnggactatatanatggatacncaccccangggtcacaatgccaaaaaaaaaaaa

SEQ ID NO: 91922 - DNA, 330 bp, Triticum aestivum
  unsure (1)..(330): unsure at all n locations
  Clone ID: PAT_TA_91922
tttttttttatttataccttctcttctttatctttagttttatctacttatcaatagtatctaccggctcgaactcgaatttgatcgccttccatacttcacaagctgcggctagttcaggactccatttgcaagctgctcggataatttcattaccttcgcgagcaagatcgcgcccttcgttacgagcttgtacacaggcttctaaagccactccgattagctgctgcaccaaggtgcatttccccaaaggatgtcctaaagtcctccaccaaatgtaatacagaccnccccaaagattccggtcagagtgggatatccaaggggggg

SEQ ID NO: 91923 - DNA, 644 bp, Triticum aestivum
  unsure (1)..(644): unsure at all n locations
  Clone ID: PAT_TA_91923
gataatacattaccatggcccccgccgtgatggcttcctcggctaccaccgtcgcacccttccaggggctcaagtccacagccggtctccccgtcggccgccgctccagcggcagcctcagcagcgtcagcaatggcggaaggatcaggtgcatgcaggtgtggccaattgagggcatcaagaattccgagaccctgtcttacctgccacccctatccacgggaggcctccctggaaacaggtccgactacctggattccgctcaaaagtggntccctgcctccganttaacaagtttgggttcctcttccctttanacaacantccccccgggtactacgacgggccgatactgggacatgttgnagctgcctatttccggngcactggacccacacaagtgctgaacaagtggaggagtccaagaagganacctgaccctantcctgtcatcngttcnacaactgcgcaaangcatgcgtcaattcaacnctttangcacggttcaaagatccggnaaggctaaatacaatttaacaaggctnccntataagnctttgtaactcatttgtcaaaatcgcgtcaancgctttacgngaaacttttcaagatttggagtgtcanaagttttacanaantattcc

SEQ ID NO: 91924 - DNA, 633 bp, Triticum aestivum
  unsure (1)..(633): unsure at all n locations
  Clone ID: PAT_TA_91924
gcgacctgtcctgtcgtactcctgagttgtctgcggtgacttcaatatgatatatagcaatgagcacgagatcaatgaaaacctccatgaccgcatgatcgggagattccaccgcttcctaaatgattgtgagctcaaagagtgtactttcatggtcggtgatacacatggtcctgtgaacatgggtgctccctggntgggccaagctttgacagagttggtcctgcatggntggactggggaagcagctgcatcctaactgctccatgttatatctcccccaccattatctcctggaccactaccatcctacancttctccctaanacggcatgccgttgaccaccaatggatgagaaaacatcattatcatccccaaaaatcaagtntaaaaccaacagcattaggttattaggttnccaagattgtcnaataatgcgaaacaactcaacacacaaccaaacacatggnatgaacacncaaacangnttataaggcagatacacagcttcaacgggcaactctcaacttcnccctaaagnacnaattaaccaacagcaattccannaacggcaacagccaccattgancanacnacggcggcaaaggttaacanaacntcttgagcaatta

SEQ ID NO: 91925 - DNA, 618 bp, Triticum aestivum
  unsure (1)..(618): unsure at all n locations
  Clone ID: PAT_TA_91925
gtccaatccagtcccccatccgatctcgccgggaaacctccgatccaagcgaagccaaggctttctcgtcctcctcctcaagatgcagatctttgtgaagaccctgaccggcaagaccatcaccctcgaggttgagtcctcggacaccatcgacaacgtcaaggctaagatccaaggacaaggagggcatccctccggattaagcagcgtctcatcttccgctggcaagcagtccgaggatgggcgcacctggcttgactacaacatccagaaggantcacatccacttttgtcaagtcccgttgtggatgcaatttttcctcaaaaccctgaccgggaaaccatcancttgaggnccancctncttacacatcnaaactttaaggcaaattcaagacaaggagattcccccngacaacactctcactttgctgggaacatcnaggatngcgaccttgcggatacaaatcaaaaggncaatccactgtgccaagtcntggggatcantttctcagactacggaaacatactcagttatctcgncattaaagtaggcaantcagnaggggattcccgcaaantcaanttggaanccagngccaccctaaaaacnaaagg

SEQ ID NO: 91926 - DNA, 559 bp, Triticum aestivum
  unsure (1)..(559): unsure at all n locations
  Clone ID: PAT_TA_91926
ccacgagccgccgcactcaggccgccgccctagccgccgcgccgtccgtccccgccggattccagtggcagccagcctccggtatccccttcttccaccctcctttgccgacagtcactgaagcatctccttgcgatggctgcagcggcgatttctggcggtcacctcgcctctccnacccctacctccacccggcgcccacagtcgctccccctccatccgcctcaagtccgaccaatccgccgcatcccccgcctccgcanccgcgcgggtcgccggccgcgcagtgtccaancctgcgcggcccctccactggggaaaagatgcaaacanttcctaagtttcttcaatatcaatgattttggacaaagatacaatcatgaaattcttaaaccgacaatttaggttaaggcaatgataaancangancagggttcaaccttcaaaggaatcnaggnaatatctcgccaaccncaatgagaccanttcattgaacagatctctgctggtgggatcgttataagtccgacattcanatggaanntaganacgtagttcc

SEQ ID NO: 91927 - DNA, 633 bp, Triticum aestivum
  unsure (1)..(633): unsure at all n locations
  Clone ID: PAT_TA_91927
gatacctaggcacccagagacgaggaagggcgtagcaagcgacgaaatgcttcggggagttgaaaataagcatagatccggagattcccaaataggtcaaccttttaaactgcctgctgaatccatgagcaggcaagagacaacctgggcgaactgaaacatcttaagtaccaagaggaaaagaaagcaaaagcatccccntagtaaccggcgagccaaattnggagcaaccttaaccgtttaaacggggtttttgggaaaaacaattcaaannttntcctgccnagcaaacggtttaatngcccacccctaaatgntnaagtcccaattacccgaacaacactactttagcccctgaacccnagttacatngnaacnttgaancccctntttaaccannaaggcaccttntcaaggtaaaacccctgggngcccgtacnaattaaccntttaggaaaggngaaaanaccccatgggnattgaattaaacnttaacttcttaaccccaacattggaagggaaattnttcngacgctgctttnanaagancgggaancaaggattgnttgtaggaangacccccgacccttcaaccatctaaagggatttcccntntgcccaccnggttttcca

SEQ ID NO: 91928 - DNA, 616 bp, Triticum aestivum
  unsure (1)..(616): unsure at all n locations
  Clone ID: PAT_TA_91928
gatttgatttcatgtagtacgtgcagataccctgtgagcccatgcatgtatatctagctatagtatttacataggaggaaaccaaattcagtaaaaccccccaaaactgtctgtctcgtatctattgggttttctgaagtgtcctacaggaattgcgattacactttacgtccaagtgtgaataccgtcctatcattttcccgatcgcatcatcatttcattggactcctatctcaactcttctgcaagcccggaactgttcaaaccagccgttaataaatatccaatatgtatcctcttcaatacnaccgggttggtaatcatagttccaaaagactaactttggctgtccgcaanatttcacttcccatggccactaaggacaagccaagaangttcacgttttggtgacngaatctacacgggatttgggtttgccaccaaagggactttctccaaccanataaattttaggcaatatgcccatttcaacggtcggaancggctggggcccgccaaattcggggtgtaaaggntgttcgnagnaatccttcngccgaactaacgnagaactanggcncatgtccccacgttgttggtacaagatancangggc

SEQ ID NO: 91929 - DNA, 662 bp, Triticum aestivum
  unsure (1)..(662): unsure at all n locations
  Clone ID: PAT_TA_91929
gaccggcctgtcgcagggcgtgcgtctcccaggcccgaccggcaggcgcgccagcangttcaccgtgagggcgtcgtctgcggaggcggaggccgccggccgccgcgcggtccttggtctcatggccagcggagtcgtcggcagcgcgttcgctcaggtggtgcacgccggcaccgtncgcggccatcaaggtttgnccaacgccgccgctntnccgttgactncccggcaaggacaactncgaagaagnaaaggaattcacctnccccttaaaaancngtntaacttcaaccgctngcaacggccgaagggcggtnccggccaaanntttcgnccaaganatattctaacttnanccctcntatcacaaaaaaaatgggnttttatttattaaacnctgctntaaggngtccctatatatacntgactctaaacanttnctccnctaaaaangggggggggnaaaaagncttaaggctcaccgggaantcttncacctctangggttnacaatcaaccaattaanacccacnaggcnaaatttnaggganacaaaagtnncgggantcnccaagctgntaatgtnaatatggctncggttaagctttagttgtaattgaaccgatntattcccgttaaaantanacctattatcaaaaaaa

SEQ ID NO: 91930 - DNA, 686 bp, Triticum aestivum
  unsure (1)..(686): unsure at all n locations
  Clone ID: PAT_TA_91930
ccagtttttgccacatgagtccactatacctacctatatgcggtatttccgtgcctttctaagaaaatgtttttatctctaagtctttcactttgagcactggcacctctataaatccctacttccctctgcgaagggcctttcttctacttcatgcaattattatttttgaatttgagtctccatcttatcttataaagcaccaatttagaggcactatgatcgtacttgagcattggggtagctaatatgcgagtgtgtttcatgaaatgggtcaatgtttgagcatgatgggctagggataacttactttatcattgatattttgggaagacatagttgcttgttgatatgattgagtatttaaattgtcatgccaaaactaaactaatgctttggaaccatatataatccaaatgtccatgctataaagaaaagattatgatatgacatgataggaacatccacatcaaaaattgttctacattactaccnaaggggggccggtaccaatcgcctatatgagcgtataccgcgccannggcgtcgtttaaactcntgacnggaaacctgggtaccaataaccctgagaaacccttccancngntatacaaaggccnacgttgcctcaaattgcaccnaaggaaggnccccnncggatnaccgngggtnggaccaggcncact

SEQ ID NO: 91931 - DNA, 667 bp, Triticum aestivum
  unsure (1)..(667): unsure at all n locations
  Clone ID: PAT_TA_91931
gagagagagagaactagtctcgagtttttttttttcgagttgggtagtttacctctacccaccagccatgggtaaggagaagactcacatcaacatcgtggtcattggccatgtcgactctggcaagtcgacgaccactggccacctgatctacaagcttggaggcattgacaagcgtgtcatcgagaggttcgagaaggaagccgctgagatgaacaagaggtctttcaagtacgcgtgggtgcttgacaagctcaaggccgagcgtgagagaggtatcaccatcgatattgctctctgggaattcgagacaacaatactactgcaccgtcattgatgcccctgggtcaccgtgacttcatcaaagaacatgatcaccggtactccaagctgacgtgctgtctcatcatcgatcaacacggggggtttnaagctggatcccaaaggatggcaaacactnaacagcctccttgcttcatcctgggtgaacaaatatcgcgctgcaacaaatggagcacancccaagtntcaaaggncgtataaaaatgnaaggaggcnctccactaaaaagccgtaaacctgnagtcctngcccaaccgggtttggggnaaattttaagccaactttcggaaggcaacctttggcttnattaaccangccaaacccc

SEQ ID NO: 91932 - DNA, 644 bp, Triticum aestivum
  unsure (1)..(644): unsure at all n locations
  Clone ID: PAT_TA_91932
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcttacctgccaccgctcagcacggaggcctcctcaagcaggtggactactgatncgctccaagtgggtgccttgccttgattcaacaaggtcggttcatcttccgtnaacacatgctctcccgggtactacnacggccgctactgggacaatgtggaactgcctaagttccgggtgcaacgacncanacaggtgtttaacaggttgangangtcaanaaggatacctgaagctacttcgcatnatcgttcnacaaatcgcaagngcatgctnaactaatgcttaaacaacngctcaagatcggcaaggctaacagtatacacggcacataaagncatgagtttgaatctaatgcttggtttctccattgcttctatttcaaanatgtatcagtcagtnaangtcaaactgnctntataacgggattatccatca

SEQ ID NO: 91933 - DNA, 542 bp, Triticum aestivum
  unsure (1)..(542): unsure at all n locations
  Clone ID: PAT_TA_91933
caagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcctacttgccaccgctcagcacggaggcctccttaagcagtcgactacctgatccgctccaagtgggtgccttgcctcnagttcaacaaaggttgggttcatcttccgtgagcacaaccatcccctgggtactacnatggccggtatgggcatgtggaactgcctagttcngatgcaccgacccaccaggtgtnaacaagtggaggagncaagaaggatacctgaccctatntcgcataacggttcnaaaatctcagtgcatgctaactatccctnaacaacgggtcaagatcggaaggctaaagtatcacacaggcatttaagtcatt

SEQ ID NO: 91934 - DNA, 479 bp, Triticum aestivum
  unsure (1)..(479): unsure at all n locations
  Clone ID: PAT_TA_91934
gtaaaaacagacgatcactaaaagttacagagactaggctagtagtagcaagtcaagctcctgcagtaattaatcagctccttcctcccgttgaccaaagttcaccgagtcaactaagaacccgctccgctcccatggatgatggatggacggatacgaacgctactcactactcccgttgaccgcgcttgactcggcctgcttccgtggctcgccgtcggcgggggcggcgtccctgaaattggngtaaaatntccctgcggaanaattgcgggtgccccaaaacaacaaggaccaaaacaaccnccccgggnaacgntaacgncttattnttagggaaaggaacttnaacnnttgaacccaacaanctnttttcccggggcttnaaagttcccccttttgcntgggngggccaattcntaaaggtaccccaacccatttacccctaggcccatnggntgggaacggccnattttaac

SEQ ID NO: 91935 - DNA, 679 bp, Triticum aestivum
  unsure (1)..(679): unsure at all n locations
  Clone ID: PAT_TA_91935
ctgaactttgcgtataactgatgttccctgagtttctcaagaaccaagtgcaaatgttccttgtgttcttcttcattcttcaagtaaatcaatatgtcatcaatgaataccacaacaaacttatccaagaactccatgaataccttattcatcatactcataaaataggcaggggcattagtcaaaccaaaagacatgaccgtgtactcataaagtccatatctcgtggtaaaagttgtcttgggtatatcctattctcgaatcttcagctggtgatatcctgatcgaatatcgatcttgggagaaaactttgctccttgtagctggtcaaacaaacattgatcattgggcagagggacttgttcttaacgtcactcatttagcgcatgataatctacaacatctcaaggtcatccttctctcaactaagaacactanggtcccaaggtgatgaatcngtcgaatataacttccncaataatcctaatcgctctaattcctcagataattgcggcatcaatangttaaanggtgagaatnnaatagataaggctatngagaanacacctatgctagatacaagaaactatagcattaacaataacaacagcaaactaagtagnnttcaagaatagttctaaaacgatcatcatgcgaattgangggcaaaantcaanan

SEQ ID NO: 91936 - DNA, 655 bp, Triticum aestivum
  unsure (1)..(655): unsure at all n locations
  Clone ID: PAT_TA_91936
tagtacaccgacagtaaatggatagcacataagcatgagcgtttcaggagttctgggtgacacaatacttaaggagataaataaaggtcacagtttatagacatctagtgccaccattcttaaatggcgagtgctaggcgtcggtgcgccggcccaaatttaggccggtcagaccagcaccgtacgatcaaacaaatcaggaaccgtatgattcctttcttcctccctcgaacatcttcttcttttagaaaaagtttcagacgcgccgccatggacgaagcgtcgtagcacctccccgcgcgtctcctctgtcgctgtcctcgcgccgggtcgtcgtcgtccgtcaccgggtcccgccgtcgccgtcgcctcctccctttcctgccaacaacgtatgccccccggcgacgattgtagctctgtggcgccgctcacggggagctcancgctcgcangcatacacacgtggcgctcgcaactcatangggaatcgcgtggccgctncctgtctggttgcgcgccccggctcggtcgcggnggttttttttgaatcgacaaacatgntanacctgtanttaaacataggtgaatnatcgnnaatnaacactagcaaggaataagtcnaggnaaaancaacaggagggatcaagtncat

SEQ ID NO: 91937 - DNA, 595 bp, Triticum aestivum
  unsure (1)..(595): unsure at all n locations
  Clone ID: PAT_TA_91937
ggaaggccggagaattgatctttcanaacaagattcagcanagcagcattgctttcacaagacacaacatcattaacgaggagcaatcggngtactaaggaaatcattattattggtattggagaaatcacacaatttggtattatcttgcgccattgcgacaagtaatccaacacacaagcaaacancaaggcaagccaaagngagagganattgggaaagagagggcgaataaancggcaagggtgaagtgggggagtanaaaacannaggcaaatggcaaatantgtaaatgcnangggagatgantttgtgatgggtacttgggcagtcttgncttnaccgaaanatctcccatgcaaacngcgccagaaatccttcttgctacgtcttgagcttgcgttggtttnccttgnacncgaaagggtgatgcaccantagtacntacgtacttccctcaattttgagaacacggtatcatccagtaggagactcctccantcccacgcaactacacanccatcnaggactcacaaccatncattcnggggtgtcancccttcnagtcattgcacagtgagatngntnacctata

SEQ ID NO: 91938 - DNA, 687 bp, Triticum aestivum
  unsure (1)..(687): unsure at all n locations
  Clone ID: PAT_TA_91938
ctctaattactacagtaattactagcacctgcaacacgaatgtggaccaagaatgttgtccatgaatctgcagagggactgtcacagtccagcttcacctgccatccggatgcatgatctgcgagaaaacggcgctgggcgtcagcccgtgcgagtccacgctcgcgatgctccgtcccgtcatgctcatcgtggtcgtggtcgtcgtggtgggtgcttgcgtccgtcgacggctcgtccgactgcagtctgggtcatgacgagaggcgacgcgcccgacgacgacagcgtcccctccgtngaggctgccggtgtcctcctcgctctcctgcagctgggagcgcgaatcnaggtccaagangactcgcccatgggacggctgtcnacgctncggtcgggcaccattctccgcngttccgttaactttaggaacatgggggcgntntcccctgganacggtcgataactggccaacaccctgctccggaacgaacgccaatcgngaggtgatcgctcctggcaacangggtanccggggcgccgaaagaactcaaaagacacccaaggataactcgnttcccaaactgtgcnccgaatanccggtcagtaccaactgccttacacgncnactgtggncatttggccctctgnaccatcgaccttgancaattcncanagatttggctt

SEQ ID NO: 91939 - DNA, 445 bp, Triticum aestivum
  unsure (1)..(445): unsure at all n locations
  Clone ID: PAT_TA_91939
gcgacctccgccatgaacattggattggcttcctcctccttgtagcttggccccagagaactcggggattggcctgccgcaaagcgagcttgggaatggaggtctgtggcgccgaccgccgctgcgatttctgcgcggcgctccggcgtcagcatcttgtagtaagtgatcttgcggtgcaccatggctttctggcgaactaggggatgcttgatgtgggctaggggatcaaaaggtgggggaaggttgggagatttggngggngatttaanggcatggcctggcgtangccgagcatcganggttctggtgtgaatagtggttccgctgacgancggtcaatcgtttngactgtacatcactcttgtcgcattcntgttgcagccngcacctggatnctcaantcgctcactgaantggaanccttcgtcttgcatttcgctcc

SEQ ID NO: 91940 - DNA, 707 bp, Triticum aestivum
  unsure (1)..(707): unsure at all n locations
  Clone ID: PAT_TA_91940
ctccaaaggaacaatcttcaacatcctgactagcacaggatccgtcctggtctcaggaaggggagccggacacctgatcaactttgccttcgctatccactcctgtttaaaaggacagctcttttagggcgaatttatgacaattttacggatagcgagtctgggcacaaggttacttacttgagtatccgggcgattgcagcttaaacctgcgtcctcggtcaattccggacacattgcttgtgatccgaagatcattttatacatctccacgggagtttctcccataaaatgctggagagctccgtgggtccctccggattaaactcccacagacgaagggagcgacgtttgccgggcagtgttcggcgaacagcatgacctgcatcaccttggacaagttgaggctctttctaagagatccctaaatgcggcctgcaacaaggcactcnttgggataaccccaatctaaccttgttgaccatgatgctagcntggtggggggccaagcgaaagcggaagcgcaaccacttggngctccgggancggtgatatagaacacccgttgcanaaccgaactctctnaaaggancctggcatgngcacagaatctactagaaaagctccgatcggtgcgtncccatactcgtcatcaaggctagcaaaccgatagtaccgggacctcnanacatatggaantggtgccg

SEQ ID NO: 91941 - DNA, 600 bp, Triticum aestivum
  unsure (1)..(600): unsure at all n locations
  Clone ID: PAT_TA_91941
ccgcctcctcctctccgctccttctccttccttcgagtttcagccatgggtaaggagaagactcacatcaacatcgtggtcattggccatgtcgactctggcaagtcgaccaccactggccatctgatctacaagcttggaggtattgacaaagcgtgtgatcgagaggttcgagaaggaagccgctgagatgaacaagaggtctttcaagtacgcctgggtgcttgacaagctgaaggccgagcgtgagaggggtatcaccattgatattgccctgtgggaagttcgagaccaccaagtactactgcaccgtcattgatgcccctgggtcaccgtgactcatcaagaacatgattactgggtactcccaagctgactgtgctgtgctcatcaatgactccacacgggtgggttttgangctggtatctccaaggatgggcagaccgtnaacacccctccctgcttcaaccctgggagtgnagcaaatgtctgctgctgcaacaagatggatgcaacaaccccaantaccnaaggccgttatgaggaaatgcaaggaatccctccacctgaaaagncggtaaacctganagggtccnttg

SEQ ID NO: 91942 - DNA, 665 bp, Triticum aestivum
  unsure (1)..(665): unsure at all n locations
  Clone ID: PAT_TA_91942
ggtaaatgaaaacgattagtcccacacgaggtttgggaataagtgattgtctgataatgagcaaggaatatacgtctttctgctaaagaggatctattaaactcataattcattagatccttgttatcaatgccaactaggtatcataagtaaatggatcccggttgttcaatcctttgataaccaaggtcattctttgctaaagagaaatgatcactatgagtcagactcaatagaattggatccattccaaatagcgagaattaggattcttgatccctctcaatctctctttcaattccgaggatccaagagaggtgttttcataagcatctccgaatatttgccatctcggaatatttcgattcattttccaatgatatgtcttctatatgaaaatgggtattacgatgtacgatgatcctgttaagcaccatggctgaatggtaaagcgccaaccataatggtaaattgcgggtcaatcctgctggtgcacacgaacggaacatcataagcnatggaacggncccatcanggatccatcacatcatctacgaatgnatggatatctcatacatagacataagancnaatctacatcggancancaatgnggaatcatngggngancatcccttttanaaaatccttntggaaacatactt

SEQ ID NO: 91943 - DNA, 687 bp, Triticum aestivum
  unsure (1)..(687): unsure at all n locations
  Clone ID: PAT_TA_91943
atgagtcctcacttgtttaggaaccaagtgaagactgatattgcggccacaaattctacagatggagttcaatgaagacgaagtgcttgtgaaagtttgagaagtaacatatttaaggtggtagaaactctcttcatggagcgaggtgggactaaatttttgtagtaaacttagcagtagtggttattgtgaaaatgcgctactgctatgatccgtagcagtagcgctcttccgtattaacgcgctgctgttataactagccttccggcggtggcgtgggcaattatagcaagtaagcgcgtcttaagagcgggcgcgctactgctacatttatttcaagcagcgantttgtgtgcccgcgctactacgttagcaacagcgccttatattaaagcgcacaactagtaagataantgtaaaagctttccctatatgtncccggttggcttccngcccgggagaaaggggananacccccccccntctctctctctcctngncttcanctnangggaaaaggttcccnccgggcaaggccncaangnaacgagggcanagcccncaanataaattccccccggtcctcgtttcgggccccgatcggccttcncnttctaatnccgnatctancnatggcgaatttgccantttacgaatggtnctcgaaaaggacacnctaggngccnn

SEQ ID NO: 91944 - DNA, 655 bp, Triticum aestivum
  unsure (1)..(655): unsure at all n locations
  Clone ID: PAT_TA_91944
ggcggatggtttcatagggcgtttctacttgggctgttggtccatcatcaagctcgatcttgtgtggtatcttttcacgctttggctcccaaagacttccatggatttagtgccatggaaaaacagtgatggagccaggatttgcacatatagggagaccaaatcaagttgataaaataaatatccagtgtgaaaaaatataatatactaatattacaacaaggttttgcttgggcgctataaaaatatcattacatttgaattagttcaaatttgcctctatgcttccaatgatcatgttttctattaatttcatcagaaggtattttagttgctaattatctttcagtgtatattatcatgcaattgtgaagcaattgtctcaaattttattgcaaagactgtcttggaattttaatagttgaaaaaaaattgctttgcgctnccatngagacccggagaatataccaatcncaacaacagcttaacatgaataatctaatgggttggctgcgctttcccncataagttgaacgcncncaaatagtantgcaaatcaaacncgctcatgtatgattatantgaaatgcacaaatatccaaacagtnagtgacctcaacatataacnnagtagtcgnatacattaaaccgctta

SEQ ID NO: 91945 - DNA, 706 bp, Triticum aestivum
  unsure (1)..(706): unsure at all n locations
  Clone ID: PAT_TA_91945
gaaccggaaatgtagagaacaagacaaaaaagtggaactatgcacaacgggttatctatccgagttggtaactatggcaggaaataaccctggagatgttgagtttgaatctcaagtggtgcaatattttttttgaagctaaaaaaaggaaaaagaatgtaattggccgagcccagaacaaagcctataaccagcgccaaataagatttgacatgatagacactactatacggtgtatacatacaaaaatggctatgatttataaaaggtctatattacactttgtacgtttagttgtggggtttaatcgaatgaaatgtcctttatcaaaaaataattattatataattagtgatctctatctaataataaaggggctattgcttctggtggtacgtcaccgatttgcccccaaagttgcaaaatattaccaccaatatcactaagtgattaaaaacgttcacacangggaaccctgcctgggctggccatgcagtaggaacctctatactgcgcacgcatgctgggagacgcacaacgcgcctgttcnggcgatcagtccgcanctggttttaaattagttccnttccgttttggtttttaaanttaanaattggactcnaaaantcgaagtaaagatagaatggaatcnangtaaaatttaaaattgggtcaaaagtcgatttgaaattccatttganacncg

SEQ ID NO: 91946 - DNA, 160 bp, Triticum aestivum
  unsure (1)..(160): unsure at all n locations
  Clone ID: PAT_TA_91946
agttcaccancgatgctaccggtcaagcagccacgcacgctatagctactacntcgtgcaccagccccagcccccagccgagccgagcgatcgtgatcgtgatcgatggagcccagccgncaccgtgtgncggcggcggcggtgctgctcgtgctcgtgg

SEQ ID NO: 91947 - DNA, 304 bp, Triticum aestivum
  Clone ID: PAT_TA_91947
ctcgtggtaggtcaaacaaagatgtctgtggagccgtctctgctagtcgacatccccatctaccacacattatgttcctgttatcgccacaaaaacatagcacaacaagactaaagtgctagtcgtccacctcctcgagcacctcgttgcttcctctttgctttttgagaaatctacacgaaccctatattgtgccatacttctactaaatttattgtccatcgtgttcctgcagcctctcactcatattccgtgtatctcatttcatagcttgggattttgtaacttggttaaaaaaaaaaaa

SEQ ID NO: 91948 - DNA, 675 bp, Triticum aestivum
  unsure (1)..(675): unsure at all n locations
  Clone ID: PAT_TA_91948
cgacgccgccaagatggccggcttcgccctcgccacctctgccctcctcgtctccggcgcgagcgcggagggggcgcccaagaggctgaccttcgacgagatccagagcaagacctacatggaggtgaagggtaccggcaccgcgaaccagtgcccgaccatcgacggcggcgtcgactccttccccttcaaggccggcaagtacgagatgaagaattctgcctgggagccactccttcaccgtcaagccgagggcatccagaagaacgagccgccggcttccaagaagaccaactcatgacccgtctcactaacccttgacnaatggaaggccntcaaggtccgggcccaacggacctcaattccaaggagaaggacggatcnactatcggcnnacctgcactccccggaggcaacgctgccttctcttaacgttaacagtctcncnacnggaanccgaaactnaaacggcctccttttncaaacanagggtcgtcttctcaaccaaaggcntgggggtcacnggtacanacccgtgnctaccgccgaggnaaggaacaagagatttgcaagaaactnaaaccgtctctcaagaaatcagtnantacaaacaaccggaacgnaagtattggctcaactaacgtaaacactcgcaggncagnnttaatcaggntn

SEQ ID NO: 91949 - DNA, 677 bp, Triticum aestivum
  unsure (1)..(677): unsure at all n locations
  Clone ID: PAT_TA_91949
cttgcatctccggggatcaccggcacagcaccgacgaggtctccttcccaagaggagacgacgacgatagcgcccccatggggtccctgcggcggagaatggggagtgcgtccacggccacgcgtgagcgcaggtggcgaggccatgtcgcgagcggtggctgggcgaagcggacgggctggcacgaccatgtgacgacctggcgctgccagccacgggcggccacggcctggcgctgtcggtcacggcgcgagccaggccacccggaggttggagggttnngaggtcggagaccccggggggcggagcaagcgcgactgcggcaccatgcgttgcaagagcgcttngggcccggcaacaaccaagggtcaaacccaccggcgtatggcaacnggcacaaggacaccgcngtgaaccatccggcggcgccggcggcgctcaaagcttgtgactccaancgcccctccnaagcatcntggcngcnccaacnaatccgtccaaacggggntgcnctccggaaaggnaacccgggtcaaccatcaatgggggaanatgtagcgtaccttacgcccacggtaagnaagaaaggaacaggcggattnccgggggagnccctttctcaattccggttctttccaaccgagaatgnnaaaattattaanccaaaaancaaattt

SEQ ID NO: 91950 - DNA, 420 bp, Triticum aestivum
  unsure (1)..(420): unsure at all n locations
  Clone ID: PAT_TA_91950
gatcaacattgtctttgtaaaacttcaactcctctgttgcacaaaccgactcagcataggacgcattaccttcttcacattccaaagcaatcttccggctcccatgcactatgatggtgagggggagtccttgattaggggatccccggacagccggactatatcctttgggctggactgttgggactatgaagatacaagattgaagacttcgtcccgtgtccgggagggactctccttgggcgttggaaggcaacttgacattccgnatatgtaaatnncccttgtanntaacctgtgtaaccctaaccccccggngtcnatataaaccggnggtttantccgtanggacaagaaaataaaancgtaggnacttcaaggttttgcccnaatccnnggaaaatnaacctgnaanccata

SEQ ID NO: 91951 - DNA, 671 bp, Triticum aestivum
  unsure (1)..(671): unsure at all n locations
  Clone ID: PAT_TA_91951
actgccgagctcacttgggggcttcttgatcgtattcgaatcatagcttaaccccatttgggaaccgactttgatcgtattcgaatcagagtcgttaaaaaactctcagggtcattagggggcttcctgttcaaacataggtcgtattccgaaccatagagaacacatctgttgggtaccctcttgatcggcgcaatgccaaagccattggggggctacatgatcgtattccgaacctantttcaaccactcctggggacattcactgatcgtattccgatcaattaccttgccaatataantcccttttttgggttaattcctttttggggaaccccacaatttnnttnaaatttttttccccnaggttanaactataatatgatttttgtacccggttnaattancattgannatccaccggccanaacacntttgatttcccgggtaccaaatatggttnttaanccttacggccggttatataaccgtngggcaattgtgaaatttacaaantgggttttataacannaancatgatatttgaaaccttttgcctactacatttattnagncatttttaaaatgtaacnggtgcttataaaaagggnttaaaantttacacaanatcccangatggccaaaaattttnccaccattaggccatagna

SEQ ID NO: 91952 - DNA, 417 bp, Triticum aestivum
  unsure (1)..(417): unsure at all n locations
  Clone ID: PAT_TA_91952
ttagggttttctcttttttcgggggagaaatctcaagaggcggcaccatgctcgtgtaccaggacaagctttccggcgacgagcttctgtcggattcgttcccttacagggagctggagaacggcgtgctctgggaagtcgatggccattgggtccgttcaaggagcagttgatgtggacattgggagccaaccctctgctgagggtggtggtgatgatagtgnttttnatgaccaagccgttaagtggtttgacattgttgaacctccgtcttcaaggacaactgctttttgacaaagancatttactctcaacatgaaacgctacatcaaaaactctctgccaactttnaagggatgacctagatctttcnaaanaaaagttgaatccgcaanaaatacttccttaacaantcaa

SEQ ID NO: 91953 - DNA, 673 bp, Triticum aestivum
  unsure (1)..(673): unsure at all n locations
  Clone ID: PAT_TA_91953
agaccgtcacacttgaggtggagtcgtctgacaccattgacaatgtcaaggccaagatccaggacaaggagggcattcccccggaccagcagcgccttatctttgctggcaagcagctggaggatggccgtacccttgctgactacaacatccaagaaggagtccacccttcaccttgtcctccgccttcggggaggcatgcagttttccgtcaagaccctcaccggcaagaccatcaccttgagtggatcctctgacaccatccgacaacgtcaaggcaagatccaagacaaggagggattccccccggaccaacaacgccttacttccgcaaggcaanaactgggaggatggccgcacctcgcggactacaacatccaagaagganccacctccaacttttcctgcctcgccnttgtggcatcattttcntgaagacctcaacgggnaagacatcacactntaggtggatcctctgacacatntacaattcaaggcaagtcaagacaaggnggatccccgacaaaaaancctatttccccggaaaaactgngggtggncanccttggntaaaaatnaagggtcnccccacttggccccccccngggnaaattccccgttgccccggttaaangggccnnggggccattannggnattttgcaaccccagtt

SEQ ID NO: 91954 - DNA, 662 bp, Triticum aestivum
  unsure (1)..(662): unsure at all n locations
  Clone ID: PAT_TA_91954
aagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcgagttcaagcaaggttgggttcatcttccgtgagcacaacgcatctcctggggtactacgatggccggtattgggacaatgtggaagctgcctatgttcgggtgcactgacgccacacaagtgatcaacgaagtggaggaagtcaagaaggagtacctgacgcgtattccgcatatcggattcgacaacatgctcaggtgcantgcgtcagcttaacgcctnaaancaacgggctgcaagatcggnaggctaaacagnnatcacacaggcatattaagtgcaatgngttttgaacncganatgctttggtttcctccattacttctattgtccagaaaagtgagncatgttagtcacatgcncaaanat

SEQ ID NO: 91955 - DNA, 410 bp, Triticum aestivum
  Clone ID: PAT_TA_91955
ccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctccgagaaagcatgctccgtatgtgaatgctatccggtgggctatgtatatgcacggacgcataatattatacaatatgtcaaactatatacgttttaatggtaaaaaaaaaaaa

SEQ ID NO: 91956 - DNA, 669 bp, Triticum aestivum
  unsure (1)..(669): unsure at all n locations
  Clone ID: PAT_TA_91956
aacacacctaataccactgtaccatcagaccaaaaatggaccaaagtcaccaacaaaaagaccaggctacctctcactaaaccagcccaacaacctccaccaagctccacagctgccactaccccgaaaactgtcaataatgctcctgatgctgacacacttcttgttcttgtcctgacaaagggtgcatctattcctgcctacaatgctatcagtgtcagggataacatcaacagacttctaggcaagaaagctgtggcaagagtccacacctcccctcggaataaccttgttctcacctgctttgactccacccctgatgagcttctttcttcacaggacaagtggataatgctctttggaaaatggctattgacaccattcaaaaagtgaataactttccgaaactggtagcctatggggtgccaactagcttaccaatcacttcgtttcaagaggaatacaagacttaacctgggtgtggaactgantggaatccaagatggtaacaaacatctaatggncaacttgtcctgtatctnagcatcactcngaggaagagaaaataaattcaaacangggatatagttgagaacgcttctaagtactaacttagcaactaaaacgnctcatgaaaatgctaatangcacntttctactnaaanggan

SEQ ID NO: 91957 - DNA, 639 bp, Triticum aestivum
  unsure (1)..(639): unsure at all n locations
  Clone ID: PAT_TA_91957
gcacagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggaaggncttgcctacgatatctccgacgaccaagcaggcataccaaganggaaagggatccgtggatcctcttccaaagcgcccacgggcgacggaccaacgaggcctcctcaactcctacantactcagccanggatcaaagaantcaattccacaacacatggaggttctanatgtcccngtttaanggcaacttgtgnncactctccaaanattnatacctgccaaatcaagttcantcactgggtactggggagnaagtaaggaaacctcatgggactgtctccaananggataacaatatataatccgaaactgaatgaacccgnaacacaagntatagangtnctagtgaaattcaaaggaaatgngccctacantttacggcgncgtggacnaaaactn

SEQ ID NO: 91958 - DNA, 655 bp, Triticum aestivum
  unsure (1)..(655): unsure at all n locations
  Clone ID: PAT_TA_91958
gccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtggactacctgatccgctccaagtgggtgccttgccttgagttcagcaaggtcgggttcatcttccgtgagcacaatgcgtctcccgggtactacgacggccgctactgggacaatgtggaagctgcctatgttcgggtgcaccgacgccacacangtgatcaacgaagtggaggangtcaagaaggagtacctgacgcgtactccgcatcatcggattcgacaacatgcgccaagtgcaatgcgtcagctcaatgcctnaagcaacgggctgcaagatccgnaaggctaaacagtactaacacgggcaattaagtgcantgagtttgcactcgacattctttggtttctccaattgcttctactgtccaagaatagttagtcatgttatgtacacatgcncanaactgnctagtaatcatcg

SEQ ID NO: 91959 - DNA, 629 bp, Triticum aestivum
  unsure (1)..(629): unsure at all n locations
  Clone ID: PAT_TA_91959
aaaaaaggcgtgtaacccgtagacctgttaggagtagtattgatgctccataacacggagggtaactcctccacccaacaacccggcgtccgttgcaaagggaccaaaagacggggcttgatgcccttcaagatctcctgattagctctctcagcttgaccattgaattgagggtgagccactgatgaaacatcaagtcaaatatgctctcgttgacaaaactcctccatggcgcctttagatagattgggtaccattgtcagttataatgctgtgtgggaaaaccaaaacgaaatatcacccttttcatgaactgaactgctgtggctgcgtcacacttactaactgggctctgcttcaacccactttgtgaacttgtcgaccgccacaaagagtgantcttcttaacctgggtctttaaaaaggccaacatatcaagccccaaaccgcaaacggcaattatgggatcacctcaactcctgaaccggacataagccancgcgagaactttgacaacgtcanattactgacaatctccgnacncatgaccgnagcaataaaacatgtgaaaacctggcanaagganttgaccggatatggcaaatccctcggaaccagtaaantctact

SEQ ID NO: 91960 - DNA, 512 bp, Triticum aestivum
  unsure (1)..(512): unsure at all n locations
  Clone ID: PAT_TA_91960
cgtggtctcgttcctgtgcgtgatcgtggggtcgctcgcgttcgccgtgcaggccgtgctcgccgccagaggcctcgccccagccaccggtgctttaagcagcaagaattacacggttgaaccgcctaatcccccttgtgtaataggtgttacttactgttcgagcggcccacccgcacattaagtatccgtgaagatataggcggcctggggaaccacacttgggaggcagattgggagttgggagatccgatacaantactgtccaaagcatggaataaattaagctactggaacactanccttggttgttaagcatagtgatgttgagactatctatcgttggtgtttcccttttcccgaataaacaccaagacagcgcaacgtggattatctaataataccaaggagaagaaaaccacccgtttttaacgcngnaatttctctttctccgtgtgttggtgttgtactcccaacaantanaagtgtttaaatgtctcaaaaaaaaaaaa

SEQ ID NO: 91961 - DNA, 577 bp, Triticum aestivum
  unsure (1)..(577): unsure at all n locations
  Clone ID: PAT_TA_91961
ctcgtgccgaattcggcacgagcttcgccggccaaatcgagctagctagccaggcggcggagagatgagcgaggcggaggcggaggcggcgtcgacgcggcgccggacgctggtgctggtgaacctgacgtcgatgctggagaaggcggacgaggtgctgctgccggcggtgtaccggagttngggcgccgcgctggccgtctcccccacggcgctcggtccctcaccctctgccgcgcgtccgtccaaggcctctccttcccgctcgccgcctacgcctccgcgcgccacgaccgcgcaaaatctcncgttcgggctttctctgggccgccgcacttcttgtcgcatttccgcactactccanatngcattccccggggctgaacgatcgctcccctggcattcngcataatcctgncgccgataaanggcacaacaangggcccgttggctggncaatactgaactngtcatgtgggggtcntgggtgtctccgccttaaattctcggtcccggtggggnccgntcaatnggaanaaantcctngctccnaatgtttnccncnccaaccaattaa

SEQ ID NO: 91962 - DNA, 637 bp, Triticum aestivum
  unsure (1)..(637): unsure at all n locations
  Clone ID: PAT_TA_91962
tttttttttttcaaatttatgcgttgactgctcgactaacacccaagtccatggctctgtatgccccttcccaatccacaatgtaactccctcatccaaatcattgaaaattccatatgtaagctcgaagaccaaagaaatacagtgaaagaaattgaacttaagccgccgtaatgtgccccgcaacgacaagagctcgagaacctcaaatcccccagcactaattcgctgccaaggttgtattttcctgtaaattcgggttcttcaaaaacatttacagtagangaanttttccagatgatttgagttgccaacactgttagactgttaagagtacccgtcaagtagttcnctgggttaataggccaagtaaacgtgaccgtacaaaatgttaaaacaaatacactgtnnggaaaaancggaggcgttaggatgnaaattnaattgtatcggncggccaatggtttcctganaggaaanactgcgcctcgcnctttaacaaagctacatgngtaaccanttgttcccacatcgggaaatgtcaagncaaaggtcaccanaatgntaaccggcatttacacgaanccggaaatgttccgtttnaaagaaantcataccatnggnaaggantacccag

SEQ ID NO: 91963 - DNA, 627 bp, Triticum aestivum
  unsure (1)..(627): unsure at all n locations
  Clone ID: PAT_TA_91963
aacacccaaatatagcaattaaaactggacatatactcactacagtacaaaagggactcgacaaaacaaatcataggttcccccttatgaagaggcacgacaaaacaaatcatgggtttcctcacttgtcacagatgggctcgttcccgtggaaagagcacggaccctgggatacgctccatgttgtcacagatgggtccttccccttcgaaagaggacggtagtagggtgccctccctgatgtcacagacggntctttccccttggnaagagcagatggattcttccccttggnaagaccagagagggtgctcccaaggtnccgtccatgaagcctgatttggaacttggttccaagccanacgcaaaagttcctttcaaaaaatgacaaaagggnacaatgggatgttnaaatggaantctttacaangagcaaaggnacaattggngggcatgtgaatcaattcggttaacccatggtgtggtgggcactnaactgtgaatacccgcctaggcatccttcatgactcattctactatgtcacanataccgatanncanccttattatgctgaacaatanggttnaanttccccgaantggnaaaaccganaaccccntttgcaa

SEQ ID NO: 91964 - DNA, 603 bp, Triticum aestivum
  unsure (1)..(603): unsure at all n locations
  Clone ID: PAT_TA_91964
gagaactagtctccatcaccaagttagtagaacttcgtgatgaactatgacatgcaagggataatggaaacgattcccaagctcttcgtaatgcggaaattgacgaaggtagaaatcgagaaaaacatcaagtgttgatggtagacaagaccactagtttcaagaaaagggcagnnaggaagaaggggaactcaaagaagaacagcaagcaantgctgctcaaagttgaagaagccaatctgtcctaagcctgaactantgtttctactgcaaaaggactggccactgggancggtttaacccaagtgattgggcgntaagaaggatggaaagtgacatagtnaattganaacaagtaatgagngnctttacaangttaacccaancccaatatttggacnatcaattgccaaaataataccccaacggattgcagataacaggatattaggtgaatgatagttgttgaatggtcacanatgnatgatatcgcaaaatcctaacttcgaatatgtnaactaataagtgtatttggttncttacatanataattnntaagtnttgancattatcattannaaaaantgtgtnttnaaaacctaa

SEQ ID NO: 91965 - DNA, 665 bp, Triticum aestivum
  unsure (1)..(665): unsure at all n locations
  Clone ID: PAT_TA_91965
ttttttttttttttttttttttttttttttttttttttttttttttttttttttttttgcctcataccaaaaaagataaagattgcggtattaattacaagtaaagtacattaatcagtatcacataatatcctgttctcganaaaaaagtctcacataatatcctgaacatgtcaattgtcagatatcacgctaccggnggcctgcatcttcatggngtcaagaaagcaacggnggccttgcacgggtagcggcgacgacccctcgtccacgcgcgtctgcgcgagcgatagcgagtatccggcgcatccccgcggcggcagtggcgcaagggggttgtggacnccgtcctaaggtggtgatgacgaacgctcgtcatcgcgatccgctcaaccgcttcttaangcgggaccctccctggagcaacngtagaatccctggggtttgggcgttcttgacaacttctngcgtaattccnccannggtaccgtcncaaaaactcaaccccggacccgnctgaaccaanttgcgccttgcccnccngtcctgnggcaacccgnttanttgncagccttgnaacaacaaaaaattgcgtttcccngtggggtttcnccggttgggcgcncccnttctcaaggnaaggnntttccncccaggaaaaaacc

SEQ ID NO: 91966 - DNA, 630 bp, Triticum aestivum
  unsure (1)..(630): unsure at all n locations
  Clone ID: PAT_TA_91966
tttgaagattgaaggttgagcaacaccatatttcttaacaagcagtcgtccatcctctcccagcactccatatttacagatgaagaaagcacaagctatcacaaaacctgattaagaagtagcaatcgcttattaccctagctagctagcttaccaccggcgcatgcctgggtattacctagaaacatttatcacaaaactcaagtctagtgtggtggtaagaaatagtagtagagcagggccataatcatatacagtaataactctctgtgggtgtgggtaattttgggttctgtcctaagtgacgatgatgatgatgaagaagatgattataagcggtaagaaaagctgggacttttcagctgtgcttccatccatccactcctttcttgcctgcctgctttctcccctggaaaactaatggggggaccacatccnagaacacaaccgaaggaatggnggnacgaagtggtgggccgcttctcgctccatcaatctgcaacgggcgtcggtccaattgtcaatggcggcggtgccgcgcctataacnatgatgaggtnccgaacgggccggtgcggatgccttcgcgcttgcnctggggcgngggngcgctgcgggtaactctccgcg

SEQ ID NO: 91967 - DNA, 608 bp, Triticum aestivum
  unsure (1)..(608): unsure at all n locations
  Clone ID: PAT_TA_91967
agggaaacatcggggcagctccttcactagtagaaaaggggcctattgtcccggttggtgagggcctttagtcccggttcatgaaccgggactaaagggtcggtactaatgccctggccctttagtctcgattcaatccagaaccgggactaaaggccgcggccacgtggagctccacctttagtcccgcttgggtaacaccaaccgggactaaaggaaattttatgattttttttgattttttttttgaatttttttttgattttcaaatttctgaattaatttaacctctatctgtaatcaccaaccctcatcacttctcaatttatcctctaatcaccctcatcattccaaatcatctaacttcccgaacggtcaccatcctcccactcccccagcctggagcacgcttaactcgctcgccaacgccgcgttggactttcctcgccggagaaacgccgcgacacanccgcaaccgccgcagcgctccggaggaggaggtanacacaaggaaggagaggcatgcgggagnacacgaaccntcacangatagtaacctccggagagngactcggttaatccgtgacntcnanaccgggntcaaagtt

SEQ ID NO: 91968 - DNA, 668 bp, Triticum aestivum
  unsure (1)..(668): unsure at all n locations
  Clone ID: PAT_TA_91968
ctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactgggacaatgtggaagctgcctaagttcggggtgcaccgacgccacacaagtgatcaacgaagtggaggangtcaaagaaggagtacctgacgcgtattccgcatatcggntcnacaacatcgcaagtgcantgcgtaagctnaacgccttaaagcaacgggctgcaagatcggnaaggctaaacagtnatcacacaggcatttaagtgcaatgagttttgaacncganattctttggtttnctccattacttctatttccaaaanggtagncangtagtcaaangncaaaaatc

SEQ ID NO: 91969 - DNA, 646 bp, Triticum aestivum
  unsure (1)..(646): unsure at all n locations
  Clone ID: PAT_TA_91969
ctgctctgaagtctgctattgctcaatacggtacctcctttaccaagttggtggcaggtatttctgtaggcagtgaagatctgtatcgtatatcccctcaaggtgttgaatcaaaatcaaacgttggtgccgagccctcagcaattgccaattacatgagccaggttcgatcagctcttgcgggaacagccctcagtggaacaacaataagggacaatgtcgacacatggacagcttgggttaatggctctaatcaagaagttgttgacgcaagtgattggattggcgtggatgcgtacccatattttgaaagcacccaagctaatggcgttgagaatggagctactctgtttaacaaaagcaatgggacgctaccagaaatgctgctaaaggcaagcactttggattactggagacaagtnggccgttggtggtccgaaatcgggcgctgccgaaacgggatcacaaatgccaagagctattgggataaattggatgtcaaaacttggnacgtaacacttggnggtatacctgatgacactgatggtacanacactgggaacaattgngcncaaagngtacccaacttncttacggtcaaaaaantcnattnatcgggcnnaacgccctccaaatttagggctat

SEQ ID NO: 91970 - DNA, 234 bp, Triticum aestivum
  Clone ID: PAT_TA_91970
aaccaatggacttgcgacactgcaaagaaaaactcaagcaagcacgcaacatttcacctgcgtgactgcacagacatggcagcactgacattacttataaaatgctttctcattcaaaaaatgaggaaggcagtggttttgttggtttgattaaactgggtgaagaggcaggtgtgtggtttgaggcaccccaactgcattattttttactgcttcgtttataaaaaaaaaaaa

SEQ ID NO: 91971 - DNA, 607 bp, Triticum aestivum
  unsure (1)..(607): unsure at all n locations
  Clone ID: PAT_TA_91971
ttgaacttcatgattagtcaatgctagttcaatagatgtgctagtgtgttgagcttgaagatgagtccatgcacagtatgcattgtccttgttcagtagtcatgatgctaaccattgcgggacatgaccaccaataccgaagaccttagtcaggccattgttctgtccgagaacctgttttgtccctcctatgtgaggactcccaaacgcttttcgagcagatgcctcctgatacatatctattcaagggggctattgtgcaaccatctttagtgggtggcggtgcttgatacgtctccaacgtatctataatttttatggtccaagccaataatataaccggtttgggatgtttaanatcattaatagcaattaaatatcctggggacaactattaactaaagccatgcaattcnggttttccnggttanattcccaaaaaaggatacaaacgagccaaacggataaaactcgcgacaatttctggncanaagacaacaagagacttgngatnatcgaaagcacagtggcanaggacgaggtcncaaggggggaaggggccaacctgggncctangancccgacaantcttgcaantncaatccca

SEQ ID NO: 91972 - DNA, 200 bp, Triticum aestivum
  unsure (1)..(200): unsure at all n locations
  Clone ID: PAT_TA_91972
attgtgtcaatatgagaatntccttccnaaattanttatccacaccnattgctcantancttanattttcccaagattttggatgcnantccnaattactctattattccnaagccaatgaaaagtgcataaaacctacaaaaatggggntttctaattgangccntgatnaacatanancntatctatanacaacaact

SEQ ID NO: 91973 - DNA, 470 bp, Triticum aestivum
  unsure (1)..(470): unsure at all n locations
  Clone ID: PAT_TA_91973
gttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggatccggcaaggcctaaacagtcactcacgacaggccatatataaagtgccattgcattttgtcaactctggacattgcttgggtttccttctccattacttcctaatttgttcctaaagatatgtgtatgtccatgttcaagtnccaacatngtccnagaaacatcccgtatgtgaatgctaccgtggntagtatatcacggacgcataatatatacatattcaactatataaaaaaaaaaaa

SEQ ID NO: 91974 - DNA, 605 bp, Triticum aestivum
  unsure (1)..(605): unsure at all n locations
  Clone ID: PAT_TA_91974
gtacagaggcaaaataataatgctctatgagttgaactgaagttactttcagctcccacaccaaagaaagtttcacaaactgacgatgcaaagaaaagaagacagattttcattactaatactacttgagagcagagtcatcttttaattttttttgggcgaaaagatagcagaggcagcttgggtggtcatctgatctgggtcgcgattgggtgctgagcttacgtgcgggacaccgtcacttcattctgtctcttggagcccatgtccagtgaagcgaagaatgatggcaagaaggaagtggacaagaaatgggacaatcaagaactggacacatatatagatagagacgcaattgtgtttgggtccaactaactcctctgcattgctcccctttctaaatccngaatactgcatgtggcaacctatgatttactctgtttcccaactatactaagctcctcnaacccctggttgctccgttccaacccgaatantgctgtgaaaaaaagagtttttttttttttgaaactgcgngggtttatcantnggtaataaactagccancatctggaaccncgcacgttcaccaaacggcnggtaat

SEQ ID NO: 91975 - DNA, 606 bp, Triticum aestivum
  unsure (1)..(606): unsure at all n locations
  Clone ID: PAT_TA_91975
atttgcatatagtatttgttatcgacgatgcccggcccgcatcctcgccgtcgactcgttcgcgacgacgtcctgcttcagaggacccacgtccgagactgggctccgccgggctggcactgggaggtgctaccttcaggtgcgcgacgcttggtgaggaacccggccccgggtcccgtcgtcgaccctcatctcctttccgtggcattcgcgtgggcactttcggtgcggagggagccggcccgccggagtggtactcgcnngnccagggaggaggacganactccatcgctacatggctgctatggacgcagttctccaatactggcaagttcttgggaaatcaccgactatatcaatgatggtccttcacttgggtgtcaaccgcccaaatacncncaatatcaactttataactactactactaactacggngtatcnatatnaatattgagatgattatccagatanatatataattgagacaagtatcagatantcatatcagacactatcagataatcatattngacanttcaataaacatatccancagtntcaattaccatncggttncaatnttaatcntgaataaaanttgggaa

SEQ ID NO: 91976 - DNA, 235 bp, Triticum aestivum
  Clone ID: PAT_TA_91976
ctagtggcttttgagagtgtgcacacaatgagaagaaaaaagaagggcaaaaactacacgtgtgcggtgaagctcgatatgatgaaagcgtatgatcgtgtggaatggcattacttggaagcagtgatgcagcgacttgggttcagtcacaattttattgaattgatcatgacgtgtgtgacttcggtcagattcacggtgaaggtgaatggggagctcctcccggtcttccacc

SEQ ID NO: 91977 - DNA, 561 bp, Triticum aestivum
  unsure (1)..(561): unsure at all n locations
  Clone ID: PAT_TA_91977
gtgatgatttatccttcacaatgtcggactcttgttcggcttgccgagatgattatccgaagagttgagctcggctcaacaaagtgacgatatgtctagcgcaggtcggcagccttggagcaatattgccgaactagtttcacacctgcatgatgatgaagatgacctcaggggacacttaaaaatttacgggcacgtgtttaaaaacaacgcacaatactctagaagagaatcctctaaaaaggttgtcatcacgttcataaagagacatgaatcgggccggtccgtatttgcgcacaaaacggttccgaaaatgggccaccatcgaaaggtcctgggagttgaacctcggttcnagtcaaatttggaggtggtaagatatggaaatccacagtagatgaacggtgggttttcaaagtactccgaactgggnctgggagacangncctaaatcgtccggatccgtcaanattgcaaggctcggaaacanaaattgccgagatccccatcggnaccgacaaatttnatgctgtgaaactaattcgacattcacganaatct

SEQ ID NO: 91978 - DNA, 366 bp, Triticum aestivum
  unsure (1)..(366): unsure at all n locations
  Clone ID: PAT_TA_91978
gctatatncctacatagtacagccatggcccccaccgtgatggnctcgtcgggnacctccgtcgctcctttccaggggctcangnccaccgccggcctccccgtcanccgccgctccaacggcgctagcctcngcagcgtcagcaacggtggaaggatcaggtgcatgcangtgtggcccantgagggcatcacgnagttcganaccctgtccnacttgccancgctcaagcacggangccctcctcaagcangtcgactagctgntccgctccaaggtgggtnccntgcctcgagttcagcaangttgggttcatcttccgtgngcacanngcatcccctgtngtactannatggccggtactgg

SEQ ID NO: 91979 - DNA, 572 bp, Triticum aestivum
  unsure (1)..(572): unsure at all n locations
  Clone ID: PAT_TA_91979
gctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaattcgagaccctgtcctacttgccaccgctcaacacggaggcctcctcaagcagtcgactactgattcgtccaatgggtgccttgcctcnaattcaacaaggttgggttcatcttccgtngagcacaacgcatcccctgggtaatataatggcngtantggncaangtggaantgctaagttccgggngaaccgacncaaacaatgttcaacnaggtgganggaggcaaagaaggantacctgaacctatgtcgcanaacgggttnanaanatgccaagtgcaatgctcagttatcccttaancaacgggctgcaagattcggaaggcanaanactcaccacanngcattaaaagccatngattttgcacccaaaa

SEQ ID NO: 91980 - DNA, 587 bp, Triticum aestivum
  unsure (1)..(587): unsure at all n locations
  Clone ID: PAT_TA_91980
gagacgtatcacaattccagcttgtaagcaacttctcccatatgttccaaaactttgtatggtcccataaaatgtggtgctaactttcccttaactccaaaacgcttaactcctcgaagtggggacacacgaagatatactctgtctccgacttcgtaaactgtctccttgcgtttagaatccgcataactcttctgcctagactgggctactttgagtctctcgcgaatcaacttaaccttctctttagactccttaattaaatctggtctgaacaactgacgatctcctactcatcccataatagcggtgtcctacactccttccgtacaagctttgaaaggggcatcntcaactcgcttggataacggtgttgtacaaaatccggcatatggtctcaaattcctccaagatctgatggatctccaatcntcanctgccgtggataaaggtgtactgaatccanccaaggccaaagttaagcaacgatcaaaacttgggggaaagggtccccaaggaaaaagggcctaaaancatgaaaanaatctgcantaatcttcaantcactgaaagngcctacagagaat

SEQ ID NO: 91981 - DNA, 607 bp, Triticum aestivum
  unsure (1)..(607): unsure at all n locations
  Clone ID: PAT_TA_91981
gaagacccaggtaccatgagcggcaagttcgtatatcgccgatgtgtaccactatgaaacgtgaaccactacttccactaccgtcgccgtggatcgattgtacaactacttcccctacaccgcatcgaactcgtcccgcccgaaaacgcacgcttcaaaggtataaccccgagatgactgcccgtgaaagaatgcatgagtgatgtatgagatgcccgtgtttgcaccgtgtcctagttgtcgcttgcacgttcctcctcgtttgccatgccgtcgaaccatgggaacccggttgccgggatcaccccaccatcttttacacgttccataaatccacacttttgcatcgatatctcaatgagttatcggatcatcagaatgttgccgtggcacatttccgttgtcgttgccgtggcacccttttgttccgccacgctgacaaagctcataacagctcaagctttcaaaaaatgcataaatggntantatccgcatcagatacacaataaaatgttaanngttncataaatgcaaaagatatgggagtcgaatgtgttgtgttcggccnctaatgcnanaagnagtaatagtcacctcaagttaaaaa

SEQ ID NO: 91982 - DNA, 633 bp, Triticum aestivum
  unsure (1)..(633): unsure at all n locations
  Clone ID: PAT_TA_91982
gtgtagtttgaaggtcttgcaaactctgaggtcagttcgagctagtgatgttttcatcgcaaagctatcaaatttatgtcagctgaggctccttagcattaatggggtaaggagcatccactgtgcacaactttgtgactctctgtcaaagatgcaccagctttcaacattagaaatagtagcaagcaatgaagatgaggtgctccagcttgaaactttgacactaccaaacctcttcgaaagtcattttgctgggcgatttccggaangaacttngaaactccattttctccaaaccaagggagacnccttcacacgatatacctatacnggcccaactccntgggtaaccanttncangcctcnccgatttttgagtttggacccaaatatgcttacaagggcgtatactggncaagactaacttcaaccaaggngggttcccnaagtgaaatatcccttganggattgccacacgtcaacaaatncacatacatgagggaacttgggcctcctgaanaactgtgataaaaacctgttaactcaggaatccanagcgtggaaatcgaaatcccaanaagcgttgttctnaagatcnaattcaaggatttcacacaantaancagttananc

SEQ ID NO: 91983 - DNA, 443 bp, Triticum aestivum
  unsure (1)..(443): unsure at all n locations
  Clone ID: PAT_TA_91983
agcagccgccgccctactactacccgccgccgccgccgcacggtggccatcaccaccacggccaccaccaccatgaccaccacgccgaggaccaccaccaccaccatggccaccatcaccaccaccaccacaacgatgatgactgctgccttgggcttcctcaaaggatggttgngccgctctatgctgctgctgctgtctgggaggagtgctgctgctgtttctggtgatgtgcgtgcttggaagctacccgtgtcttgcatcttcnacattgggcgtgccgcaatatctaagtgaacctcctggcttgttaataatgtgtaactgttatgaactatccgttactgggtcaaataactgtgtttaattgnttgctgaatgtttgggccantgatggacgggttntcaaatttcatattcaaacttacgtttttaaaaaaaaa

SEQ ID NO: 91984 - DNA, 567 bp, Triticum aestivum
  unsure (1)..(567): unsure at all n locations
  Clone ID: PAT_TA_91984
tccactcctacttcgccgtttccgggagattcttggattggtttttcggcaaagatggtttcgcccgtcgtgatcgcgtcggcggggctcgggatgctggcgggcgtggcgatggcgagccggggatcgggcgacgggctgccggcggcgtccaggtgggacgcgcggccccgttgctccacgtgcagcggcaaccgggccgggaaggagtgctctgcaaccgtttggtcccaacgngaacttcggttgccggaacttctccnggtcccgggcgcaagcgctgcgcaacttgcggagntctggnaaccggccggcgttcccggcccattantcttccaagagcaaaactaccaacgnnccaangggaacccgagantanaantatttcaacggtttccccnaagaancttatnttattaacncacattgaaccanttatnaactntcncccgggnaantaaaccnttcctnnctncaacaattattnccccgttaanaaatnnattnaagatancctnaacttaatgatttaaggaaacaactcananttaggtnaaaaaaaaaaaa

SEQ ID NO: 91985 - DNA, 586 bp, Triticum aestivum
  unsure (1)..(586): unsure at all n locations
  Clone ID: PAT_TA_91985
atactccctgtcttatattttgatacagatcaggagtagatagataaggacatatggttaggggctcagagcgcgccgcagtctgcggtctggaacgaaagctcccccttgcctatgtcatacagcaggtgcaagtcttgctgctgggaagttgccgatgatgctctcatcccctccttcctccatnaacaatgcacgccgtnggactttccaacgggcgcccaattactccctggcggnaacgccatatccgcaacgccgctgaagttggacaacatcaaccgnaacaactntcaaatccnttccgtnccaaanacaagtccaattccgcttctgccngcggtgcattaagtgccgttaatttccggcaattctttctcaaaagcctttcccgnatcngnaaggacttaatggtccgttcnatataccccccgacaaaaccgtacatttcctnaancaaacccatcggatggaatggctccacgtatccacaaaggaggataactcntnggaacttgggctaaangaagattacggccccgtantcccccaaaaggtganccttttaaaggaagatgaatttgcn

SEQ ID NO: 91986 - DNA, 364 bp, Triticum aestivum
  unsure (1)..(364): unsure at all n locations
  Clone ID: PAT_TA_91986
ctccacctctctcaaccaagccaaggccaagagctgagtgaagcacccgcggccatggagggcaaggaggaggacgtgcggctgggcgcgaaccgctactcggagcaccagcccatcggcacggcggcgcagggcggcggcgcggacgagaaggactacaaggagccgcccccggcccccttcttcgaggccggggagctcacctcctgggtccttctaccgggccggcatcgccgattcctggccacttcctcttcctctacatctcggtgctcaccgtnatggcgttgtggggcaacccttccgggtccaaanttccgnacgtcggatcaaaggatcncctggacttcnggggatatttttc

SEQ ID NO: 91987 - DNA, 422 bp, Triticum aestivum
  unsure (1)..(422): unsure at all n locations
  Clone ID: PAT_TA_91987
ataagatccaactataatagcaaagctcgcgatacatcaagatcgtgcagtatcaagaacacagagagagagagagagagagagagagagatcaaacacatagctactggtacatancctcagccccgagggtgaactactcactcctcatcatggagagtactgggatgacgaagatggccacctgtgatggataccccctccggcagggtgctggaacagggtcccgattggtttttgggtggctacaaaggcttgcggcggtggaactcccgatctatggtgctcctggatgttttcggggtatatgggtatatatangaggaagaagtangtcngtggagctgcaangggccacnanggtggngggcnacccgggggggcangccccttcctgccttgtggctcccttgtttcttctt

SEQ ID NO: 91988 - DNA, 605 bp, Triticum aestivum
  unsure (1)..(605): unsure at all n locations
  Clone ID: PAT_TA_91988
ctcgcactcccgttcgtctgttcgaggcttcctgagccgtatccgccatggccatcgtcatcggcgcggccaccggcctccccaagccctgagaccgcgtccgggagaaccgccgccatagacttcgttcatcccgagcatctaatcgagtggagccgcccgataggctcgccatcgagctcatcttcaccacgtacttcaccggccgccatcgtcgattgcctcgtcttcagcccgtccccgaccacctcgacctcaccttcggcatcgcgacactgagactgatgtcgctgctacccagtacgactacggtgttgacgattcctctctctttccaagagcaatcagacgttggatccaaggagcagacccaccgtcgacgacgatcctactacctggaagtgcctgctactaccgtagncgctgacgacacatgantatttaggaggtccangcaggagccaacctctcnttngtaccattgtgtacctctaaggaantgttaactagttgaccanaatgttcttcctnanctcagatnactcttatcaccccaggcctgntgaaaatcnttaggggccgtacaattcctaanntcttanccc

SEQ ID NO: 91989 - DNA, 287 bp, Triticum aestivum
  Clone ID: PAT_TA_91989
aagcctccctcacccaacccccaccgcgcgtcggcgacggccgtgccgccgccaccgcctgactagctaggaccaaggtcaggggcgggagtagtaaatgctttgctgatacgtgtatgcaatggtgcctgcgatcgcctagctaggcaactagctatgttcttcctgggtcggtatcaagagaagaaacaactagcagctgtgcacaatacttgttttgcttcccgataaatcatggaacaggaaacatgtggggatatacaccaactgataaccttggataaatt

SEQ ID NO: 91990 - DNA, 608 bp, Triticum aestivum
  unsure (1)..(608): unsure at all n locations
  Clone ID: PAT_TA_91990
agaatactggctccaagttgccaaaattttctcaaagccagtctaaacaactaatcaattctatggactttcttggcatcaattactacacatttttgtacgtgaaggatgacccgcatcatgctcctagcaacaaaaggaatttcagggctgatatggctgctaaatcaatattttcaagcaattctaccagtggattctatgtgccaggttatgggatacagcaagtgcttgaacatttgaagcaattttatggtaatcctccaatctatatccatgagaatgggatatccaatgcatcaagatgttagtatttgatgatggcctagggtggaatcctgaagtgaacatcttaagaacttctcactgcgtcaagaatggtcnaatactagggctacttgcctgtccctgatggttanatgaacactngtgtcaggacactntggccnattactggatttgcgatgagtccaaagnacaaggacctcattgganagattccaagggagnaacgaaacggaatcccgtacaccgtaacgccaggttcgagtaacgtctnccagttcaaaataatgcatcggtnannacaattncagtnacgtaattcn

SEQ ID NO: 91991 - DNA, 375 bp, Triticum aestivum
  unsure (1)..(375): unsure at all n locations
  Clone ID: PAT_TA_91991
aatcctctcaaactattgctctgcaaatacttgtctgcttgcattatggatactttccatatgtctggcaatattcagtagtatcctttatcatctttatttttaacatttgattcgatatgcttgtgaatgcttgaaatcatcaatcatagttagaattattcccttaggctcggacgtcaccccggacatgagccggtgttcggcaaatcaaaccttgattgattgtcaatctagtcaatccacttacttgncttgattaatngctccncttccgattncccaattttgggaaaccataacccttgccttttagccaagaattccccattgnttcaaaaattgtttccctgaaatcccccttcctcggggtga

SEQ ID NO: 91992 - DNA, 567 bp, Triticum aestivum
  unsure (1)..(567): unsure at all n locations
  Clone ID: PAT_TA_91992
gtgacaaacacgtatcatcacggaagtgtatttttttgtagtgatgttgtaggggatccatatccgacacttctgcgatgacgggaccgaagatgaaccaccgtcacggttgcgcctgaggaatccctggtgtccctgcagacctgtctcaacctgcatggccttgttcaccaaggtggccaagtcagcaaagtgatgaacaaggagcgtgagcttgatacagcttgatgtccttcactgaacttttcatgtctatgtgcgtcagtagcaatatattcttcggcatagcaagacaagtcaaggaatcccgctgataagtatccatatcctgttgcctgaatgangttnccggactctcgcttctcctgtccataattccctggaggaatgaagcaagcatagaagntacttgggactctggcaaattaatgattgttccaacaagtagtgaancctgtggatacccacattagcancgggacctttangaaatagattgaaagtgcataatggtagggcacactacagatcatccanagtgattatggagcatcanagnacaaaggc

SEQ ID NO: 91993 - DNA, 328 bp, Triticum aestivum
  unsure (1)..(328): unsure at all n locations
  Clone ID: PAT_TA_91993
ctccacttccatcgcctcccaagatcgcagatctgctccggtgagaatccgtcgccatgtcttccagcgaggtcgcctgcacccttgccgccctcatcctccacgatgacgggatccccatcacttctgagaagatcgcgacggtggtgaaggctgccggaatcaaggttgaggcctactggcccgcgctcttcgccaagctcctgggagaagaagagcgtcnatgactcatcctttcctncgattntggtggaagggggtgctcccanctgctggctgctgctgcccccggctgccggtggtgctgctgcccnnaaanaaaaaaaaa

SEQ ID NO: 91994 - DNA, 622 bp, Triticum aestivum
  unsure (1)..(622): unsure at all n locations
  Clone ID: PAT_TA_91994
tttttttttttttttttttagtcgacagattgtataatatattatgtgcatgtgcatatacatagccaccgattgcattcacatacgagcacgctttctcgagccatgttgttacatgaacatggacatacacatattcttaggaacaagtaagaaagacaaatggagaaggaaaacccaaagcaatgtcagagttgacaaaactgcaatggcactttatatgtggccgtggtgagtgagctgtttaggccttgccggactcctcgcagccggtggcttnaaangcaatgaagctgacgcactgcacctggcgcagttgtccgaatcccgatgatgcngacgtacgcctcanggtatccttccttgactcctccaactcgttgataactgtgtggcgtngggcanccgaacataggaanttcanattgtcaacaacatccaatttatccaattgaagtactanatatcncaagatggacactgtataaggcctcatgnggtaaanaactntgaagatacttncatacattcataggagaatcatgatncccatatatanatcntcaaggcccgttcgtaaaaaacgatgatctncattgttttgaanaggctccacggttng

SEQ ID NO: 91995 - DNA, 352 bp, Triticum aestivum
  unsure (1)..(352): unsure at all n locations
  Clone ID: PAT_TA_91995
cccacccgtcccctcccctccccctcctctcttccctttcccctacntcccacatcntctcactctcactcttcttcttccttaacacttctccctcattactcttcctcttctacctacctttctctctctgcattactccnacctaactacacaatctccattaatgcatctccnttctctttttccttccgcctccactatgttgaanttgtctcctccnaanttangtatntaggtanatgtntcanttagttnagtgacctanttgccccctaactagatctatctttgtcanagaagagctttgggacacttttggtctccctacatcatcatctcatcancgtgc

SEQ ID NO: 91996 - DNA, 610 bp, Triticum aestivum
  unsure (1)..(610): unsure at all n locations
  Clone ID: PAT_TA_91996
atatctctcctccctctcccatcccctctctctcctccacccgacgtcgcngtcgncgtccaatctccggngagatcccctcccccgccggcagccatggnctccaccttcagnggcgannagaccgcccccttcttcngcttccttggngccgccgcngccctcgtcttctcctgcatgggggcggcgtacgggacggcgaagagcggggtgggggtggcgtcgatgggggtgatgcggncggagctggtgatgaagtccatcntgcccgtggtcatggcggaggtgctcgggatctacggttcatcatcgccgtcatcatctccatcgggatcaaccccaaggccaagccctacttcctcttcgacggctacgcgcacctctcctccgggctcncctgcggntccggggctcgccgccggatggcatcggatcntcggcgacccggggtcagggcaaagcgcaacagccaagtgttctcggaggtctcatcttacttngcnaancctgcctgtacggctaatgtcgancactcctcctgcggcatccgncnacataaaagactnaacaggnanagtgtcacaatgatcgttgaggtatctctaaactt

SEQ ID NO: 91997 - DNA, 214 bp, Triticum aestivum
  unsure (1)..(214): unsure at all n locations
  Clone ID: PAT_TA_91997
nccacaancctancaggccngcctcgaccaggnccncagctccgaggcaggtaaacgtcntgcgcggcgcgcnatagcctncangagcatcaaggtcgacgnncactcnatgctctggatggcncagatcttntatctcaacnatagatcatcgcacatctatgtgcgccaatcntatcttcccattttnggatcatgcacatnacataatttg

SEQ ID NO: 91998 - DNA, 606 bp, Triticum aestivum
  unsure (1)..(606): unsure at all n locations
  Clone ID: PAT_TA_91998
ccccctccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctggctgactacaacatccagaaggaatccacactccacctggtgctcaagactccgtggtggcatgcagatcttcgtcaagaccctgaccggcaagaccatcaccctggaggttgagtcctctgacacatcgacaacgtcaaggcaagatcaagacaaggagggaatccccggacagcagcgtctcaattttgctggcaagcagtcnangatgggcgcacgctcgctgactacaacatcaagaagggatccaactcaactggtgtcaggtccgttgnggatgaantntctcaagacctgaccgnaagacatcacctggagncatctctganacatcanantcaggcaagtcaagcaagnggatcacggcaaaagttancttgtggaacaat

SEQ ID NO: 91999 - DNA, 547 bp, Triticum aestivum
  unsure (1)..(547): unsure at all n locations
  Clone ID: PAT_TA_91999
ttctgacatcanctagcctgattagaaatgatggtgctgaaaacaatattgttgaaaacttgaggtttgaagtatttcttccaaacgaacaagtcanaacagggaccttgaagcattacagtctacattacaatgttgctctactcggtgtcgaanatanccgtgttgtccgaccaccaaaaattcagcttgantgtancaagtctcgagtancanccatagggcgttgcttcanatcaggcacattaatggccgcangtggtcagctggtttcctggtcaggcacacttgattgcaaagttcgttgtacgctcgtcatgtaaaatcgctaaggctggaattgnangaccccttgttaanatggacgganacttattggnatgaattctatcangganaatggaaccctttctgttanggaatantanggnacatttggnanattttanggnaanagcntctgattaatngcaagganatggtccncttcnggaaatgaatgggaccaggttcgtaanagtgctggccatccatntgctcaccgana

SEQ ID NO: 92000 - DNA, 621 bp, Triticum aestivum
  unsure (1)..(621): unsure at all n locations
  Clone ID: PAT_TA_92000
ggtgaaataaacgcaaacatcagccatgagaggatggtggtgagggtgagggtgcccgtgcagttcagtaaaaaagtgacatatatagtggggactggaggtatttataagggaaattttggaattaatatactttttcaggcggaaatggcatagtacttgattatgataatatgtattttcacaggtcttgggaaatccgagcattgaggaagacgaccgtggacgcggactcagctgcctgccgcctctcaacaacacgtcacttcattgtttttgtcatcacctcaacaagaacatgaaggaaacaagatcagtgtccacacaatattcntacaggaaactanccagacatctcgatctgttacctgtctgctgctggctacatgctcacaattggttttaaccggcnactaacaggatctancaanttaaaggttaagggtttcggtttcctccgaaaacattcacangacatnttntagatattanttctacactacactcaaggncatanggtcctgcccaanaaagncattnnactttanttggaattcaanaatncanttggatgggtaagnantgggtaatttaacttaanaccgttcatccaacacgatt

SEQ ID NO: 92001 - DNA, 639 bp, Triticum aestivum
  unsure (1)..(639): unsure at all n locations
  Clone ID: PAT_TA_92001
ttttttttttcagctcacaaaggtcctttattgttacgtaacttgtcattacacatacaagcacaacagctccgttattctgcagcgtagatagcgagagacgcatgcatgtttttatccaggacagaccacaactccacatcgtttcttcagtagatacgtacgcacgcatgggtaggtatgggtatgtgtatgtcgatctgcacgcgtacgtgcacgagccatgcatgatgcatgcacggcgcgcgctggctggctcagtagtacggctggagcttccancgttggttgtcgncctcgcaacacttncaagagcacgacctcngtgccgtcgcgcangccgccgtggtactgtcgccgtttganggcgtcnaagttnangtanatgttgttcaacatgcgcanaaactgaagcgttgcccaagtcctgctctccgtcaanagaacgactcgtcaagtantctgggttgtacggacaagaccacaggtgggactggccgaggaatgctgatggctgccngtggcttgtcacaangcnaagngggtaacctcctctcctgatcngngtcactcaagtctgatcatgctggaacnncttgggttgcgggcanaaaactnccttccnggcatgctattngg

SEQ ID NO: 92002 - DNA, 550 bp, Triticum aestivum
  unsure (1)..(550): unsure at all n locations
  Clone ID: PAT_TA_92002
gcgaaggataaatcatcaccaacatcgccgccccacggattacacggagcgggcataccggcatcgccgcacggtcgcttcatcaagccggcatcgaccacatcacgacctgcatcgatagggccgcactattgcttcttcaagctggtgtccatcacgccgacctaattcgactcatcggctgacatcgaggcttcgacatctcggctggaccgggggcttcgccatctcttcatcaacctactccggacacttcggcgtcactanccgaccagctccgtcacgttagctgggccgagggctttgcctcggcgagtcaactttaccagcattgccatgccgtcgttttatcgcccatcangcaatgggtgtgcggagcgggtccaattttaggaatcactttcntcggattgctacancaaataaacaggtgctattaacccagtatttttgcttgtttgagtcaattttccaaggaattatacccgggttgtcgtatatgtcacnattataatgggggtgattaanaaatccatggngtcgtanttcg

SEQ ID NO: 92003 - DNA, 616 bp, Triticum aestivum
  unsure (1)..(616): unsure at all n locations
  Clone ID: PAT_TA_92003
gctggatgagtacggcgatgtcgtccgcgagcttcttgaggacggtgaacttgttgccggtggcaaggatcatctggtccaactaagagtcgtagttggcatcgatggcggccatccaccagccggtctccaacaccgtctggagacgatcctcggtgccatgccgcaggccggcatcatggaccatctagcacagccgctggccgctcgcgtgcatcaccgccattggtctggagtgagctcttttgcacttagtgtaggtgcttaggcaaatgcttaggtgcgtacgatgtggtagatgcattggaatggaggggcacctttatatgagggcaaactgcgttgcattcacatcgtgcggcctctttcccggtcctcctcccattacttccctcaagcattaattgaangaggatgcattggccgttcaacatttcgggaacttctactccctcccttgtctgcattaaagactaccngagctgcgccgccgctgtcaaatcaatagtangcccctacaaaaccgntgaaaagctcctactcatcaaaccctccttaacccangaaacnagaactntcggcaaatcgtcatacngatgattatgaaatcggcact

SEQ ID NO: 92004 - DNA, 618 bp, Triticum aestivum
  unsure (1)..(618): unsure at all n locations
  Clone ID: PAT_TA_92004
gtacatgtccgagaaacccaactttcttgagccaaaattcacacttactgaacttggcgtatagctgatggtcgcggagccgttgtagtgctgctcggaggtgatccttgtgttcttattcacccttggagtaaatgaggatatcatcgatgaagactaccacgaatttgtcgaggaagtccataaatactttgttcatcatatgcatgaagaaagcagggcattggtgagaccaaaggacatcatggtatattcataaagaccgtaccgagtagtgaatgcggtgttaggaatatcttcctttttaatcttgagctgatgatatccggtccgtaaatagattttagagaataccttagcccactgagctgatcaaacaaatcatcaatccttggcaacgggtattaattttgatggtgacctcaatcagccggcggtaatctatgcacatacggagactacatctttttgccaagaaaatgcangtgatcccacgtgaaanctgggaaggataacctttggataatctcaactgttcttactcacaaatcngatanggatcggtatactctgnnaaaagcggtccacanagncaangaaatcantccgttggggann

SEQ ID NO: 92005 - DNA, 381 bp, Triticum aestivum
  unsure (1)..(381): unsure at all n locations
  Clone ID: PAT_TA_92005
naacatnaactaaatgncangttcnccanntgtgaattctggctaccggnagtaacctanctnggacatgtcanctcaaaggatngtattgcagtcacaccnnacacgagttcangctagtcttnagttggaatcctcnnacagaacgttaaacaagtcanaagttttctcggtcttnccanttattgccgtcggatttgncgagaacttctctaanatcgacaggcctcngactaaccngttgcataagggtgtcaagttccagntgnacatnacacatntcagganaatttccaaggcantcattgacaagttgacttctgctcnagttctagcnccacntgatactaagaaggnctttgtcatttactgcgacncttc

SEQ ID NO: 92006 - DNA, 297 bp, Triticum aestivum
  Clone ID: PAT_TA_92006
aaaacttcggacgaaatctctatcatatgtttgttctggcttattttgcaagccaatactttgttttgttttgagttgtgggattcgagtcgcttcgaagtcaaatgttgattccataccttttcctaagcggtgttctcatgtgaatactaatccttcatgataatcgagtttttcatgtcaatcctttttaaccagtgtgcttctcttcaagtggatccgatcatttcaacttccgcaagatcaattatcacatcttctcaacggtgtttgtttcatccatcccaaattgtcttg

SEQ ID NO: 92007 - DNA, 610 bp, Triticum aestivum
  unsure (1)..(610): unsure at all n locations
  Clone ID: PAT_TA_92007
acaatgccaaccttatactatctcacacttgaccaagaattcaacctcatcatctagatcttgccaggcggtagccacctctcacaggcttttgatacgtcatactccacaggtttaactcaaactgtcttgtccaaccgtttgctagcaactgctttgtcccgacactaccaaccacttcctactctcaaaaacaactactaccaatgacctagtgctcagaataacggcagctcaaacagcagccagcactcaccttatgcaatgaacaaccaaagtcacaaacagtacaaccaactaacccccgtccacaatgcccactacccccaacacaatgatgctcaagaataacagcactgcacggtgccagcaacgccaacctcaagagcagaaccatcagcaaccacggacaagcgagtcntgtgggcaaagttcagtgccntgcaacaacagtcaacaacatgcagtattccggaatcctctgnatanttcaacagtatccttgagctnacggtgatccacgtaagacatncaatgcnatcacncaacanaggctatntcaangacacatttatngttntctgaactanangcaataanccgggttnnt

SEQ ID NO: 92008 - DNA, 612 bp, Triticum aestivum
  unsure (1)..(612): unsure at all n locations
  Clone ID: PAT_TA_92008
cagccgcgcatccaccgttgctagcaaggtcgaccaagcagcaccgagatggctgctgccttctcctccaccgtcggtgccccggcttctacgccgaccaacttcctcgggaagaagctcaagaagcaggtgacctcggccgtgaactaccatggcaagagctccaaggccaacaggttcacagtcatggcagcggaaaacatcgacgagaagaggaacacagacaagtggaagggtcttgcctacgatatctccgacgaccagcaggacatcaccaagagggaagggcatcgtggactccctcttccaggcgcccacgggcgacggcaccacgangccgtcctcaagctcctacgaagtacgtcagcaaggactcaagaagtacgacttcgacaacaccatgggaagcttctacatcgctcctgcttcatggacaagctgtttcatctctccaagaactcatgacctgccaaatcaagatccatcatcttgggtactggggagnaaggtcaaaggaatccttcaatgtgactntcttcccaagtgggataaccatcatatatgccgaaactgaaattgaanccgnaacaacaagnatagnaantactaggt

SEQ ID NO: 92009 - DNA, 635 bp, Triticum aestivum
  unsure (1)..(635): unsure at all n locations
  Clone ID: PAT_TA_92009
ctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggccggtactgggacaatgtggaagctgcctatgttcgggtgcancgacgccacacaagtgatnaacaagtggaggagtcaagaaggantacctgacgcgtatgtccgcatcatcggatcnaaacatcgcaagtgcatgcgtaacttcacncctnaaacaacgggctgcaagatccggaaggctaaanatcatcacnaaggcatattaatgcatganttttnatcnaatgcttggttcctccaatactctatngtccaaaaatntttcaatnaatcaaatggcaaaacagctt

SEQ ID NO: 92010 - DNA, 280 bp, Triticum aestivum
  unsure (1)..(280): unsure at all n locations
  Clone ID: PAT_TA_92010
ttttttttttttttttttttttttttttttttttttggggggcaaatttgcagttttattcccantaataaacgggagttantcntacnaccggatattacacncccggttcaataaggntgttgcaacaacttgtactgctatgancatggtcntccaatccctccantgtacggnggaggggctccanngccgggctgcggacggtaanggtacggccnaggacngccgccntacngtangccaaggctgtccgcacggcctgcctctgaataagggg

SEQ ID NO: 92011 - DNA, 241 bp, Triticum aestivum
  Clone ID: PAT_TA_92011
gcgaagcctaaacggcgccttgactcacgcccgtcggccttctcgctcgatccgtcgctcgccgtcgccgccacagcagtccggcaggcaagcggtagcccggccaatcagccatccggcatccggcaccgatcggaagtcaagaagtcaagaagtcaagaagtacggcaagaagtaccgagacattagcctgccatattaccaaagaagaagcaaaagtcgggtgctgaaaaaaaaaaaa

SEQ ID NO: 92012 - DNA, 645 bp, Triticum aestivum
  unsure (1)..(645): unsure at all n locations
  Clone ID: PAT_TA_92012
ccgaataggtagccatcatcacgtgtcgaggaacgtcctcgcgatctataaatcgatcgggtatatcctgctctactatccagggtctgccagaggttgtatttgtcaccccaagctgtattgtttctgtttttacgtggcggcggggcgggttgttgttctgcttgaattatcgctttatctcggccaagttgtggtcgacctgccgcattgtcccgaccgcgctgtgatctgtcggccgtgttgcgcgagtgaggtatgagctctagcgcctcctcatcaaactggggtagcagtttgcgcttcaggtaactcctgggctgggagcttgaggccgtattcttcggctgccaggacattagtccatctgtcgttgagcaaatcttggtcaacttgaagttgctgttgtttcctttttangctccctgcagtggctataacctgcgcttgaagcctcctgctcnaaggggggcccgtaccaattcgcctaaaatgatcntataccgcgctcacgggcgtcgtttaaactcctactggaaaacctgggtaccaactaacccttgagaanccccttccanngntatacaaaggcnacgttcctcaaaatccacnaagnaaggacccctncggataccgnggggngtn

SEQ ID NO: 92013 - DNA, 641 bp, Triticum aestivum
  unsure (1)..(641): unsure at all n locations
  Clone ID: PAT_TA_92013
gctacgtgggccggtcgtgtcagtgagaatggttgatgtaaaaattcagagaagctgtctgaattagtgcactggttagtcgcaacaacaaaaatcaaaagaatcagtgcagacgtaaaacgctaagaaccaaaaaaaattcgtctaggcctgctcctcgacctgttctgatggaagggatgggagagaccggcggctttccctccctgtctcgccgggtgctcttaggcgggctgaggacctacgccgagaaaccaagttgtgttagaagctcgttcagcaggacctcccggctcaagtcaatcgaatgactcgcgtggcagcganggtggcgatgcctaacactangactacttggttggggcttgtgaacancgacgcgttcccgggttgacatgatgggtctcgtgcggaccatgcatggagtctggtctctggctcccgggtaaattccggaactgccgccgctcaaangaggctcatattggcggagggnagntaacccccaacccaaccgtaannatccctccttgacttcnnatctgggaattgccttccaagggggcccgtacaatccctaaatatcttaccccnaaggctctttaactcnacggaaaccgggtacaantaccttanaaccc

SEQ ID NO: 92014 - DNA, 632 bp, Triticum aestivum
  unsure (1)..(632): unsure at all n locations
  Clone ID: PAT_TA_92014
tgcggggccggaccggctcgccagaggtggcccgccgtaggactcgccctcttcccgtgaccggaggctcgacagcctcggcctcctcctccgacgactcgtcgaccacatcttcgacgagatgggccctggtgccggcactgctggcctccccagcggcctccgcccactgggcgagctccttctcctccgcctctgccgcggccttgtcatccacgccactggcgctgctggcctcctcggcgagcttcgcctccatcgccctggcggcgatataatccagctccgcctgggtggtgtcctggacaagtcgtggctcggcgctgacatactctcctccaaggtgtcgaaaaacacatgcagctgattctccggcggctcaacccaantggggacaaggcntncgcgttgaacttcggatcatggcaatatgtccntcnacgcaattttgctcacaagacaccccgccggnaactnaacaagggccctnatggcttccggctttcgnggctngnacctgccggacgtcactccatggggtangtcantggaaaccctggaaaatgggtgccaaacgnaatttggcaaccgggggacnanatgngggctctaaaaatccgcnccttttaaag

SEQ ID NO: 92015 - DNA, 626 bp, Triticum aestivum
  unsure (1)..(626): unsure at all n locations
  Clone ID: PAT_TA_92015
gtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgagttcagcaaggttgggttcatcttccgtgagcacaacgcatcccctgggtactacgatggccggtactggacaatgtggaagctgcctatgttcggatgcaccgacgccaccangtgataacaaggtggaggaagtcaagaaggagtacctgaccctatgtccgcatatcggatcgacacatgctcaagtgcatgcgtcacttancgcctcaagcaacngctgcaagatccggaaggctaaacactantcacgaaggcatttaatgcatgcanttnaacccgaatgcttggttcctccattacttctatttccaaaaaantagtcantagtcaaatgtcanaacagccc

SEQ ID NO: 92016 - DNA, 548 bp, Triticum aestivum
  unsure (1)..(548): unsure at all n locations
  Clone ID: PAT_TA_92016
aggaggtaccacatggacatggttcttctacttgttgtactagagatcattctgctaattgcgaccacgtctggagggaatatcacgcgaaatcactcttgtctactgggatgcggcaaaggacatacttttaccaggccctggtgtcccccatgtgcttgttacataagacattgttcttgtacatgtggtcgtgggcgcatgtaaaatgcatatcgacgtttggttcgtgttcggcgttgtcaagaatgggacgtatgacatttttgccttagcaagtagaggcggaggcataggatgacttatatctggccgtgcaccatgagtactgtaggtccaatctttaatggttgcagttggcaatgatggtgcatacatggtgtttccccgtcgaagacacccttggactgttctgccgggtgaaaatttaggattaacataaataaatgtgtccctcaagaaagngttcaattcggagaacttccgatnaatctcagtgttacacggtgatgttagnntcgtcncaatgatacttgcgttaaaaaaaa

SEQ ID NO: 92017 - DNA, 496 bp, Triticum aestivum
  unsure (1)..(496): unsure at all n locations
  Clone ID: PAT_TA_92017
tgctgatttttttcctcctaaaggaacatcctagagagttgacgatttagatttagcccactccaataatttggtcaatattccttcatgtggctaagaacgttttggtgttctattttgtatggtatgaccactattcagaggttttatttatttatagcgagaaaagagatctggatcgtaccaatactattttaatagtatgagtacggctcacagctttacttggaagcaaaagaaagctagcaagtcggcaccttatagtaatangattagtacgcagtttgccatttggtttgaaaacccaaaattggtttgccattccttttcttaaattatcctctcanattcctcaactactaaacttcaagagtatcttcacatgtgtcattttcttaattaattttcctgnaaagcaagttcagctggacatatctactcaccttaagtcgatnaaagcgataggattagacaattgtcaancaaaaaaaaaaaa

SEQ ID NO: 92018 - DNA, 566 bp, Triticum aestivum
  unsure (1)..(566): unsure at all n locations
  Clone ID: PAT_TA_92018
cgaggctcccgcatccgctaccgaagatcgcggattcagctcgcagcgtccagctgacgaggtaagtgatattgtcttttacgggacacttgttattcatagtttgactctatgtgggatctaaactccctttcctttgacaggactggctgaagaaggccgcacaggctatctgtccggccccattgccagaggacccagctgacgtccgcctaacggggctgctggctccggcaccccacgtggtgctggagaagaaggccaagaagaaggccacggggactcggaagagttcccgttttctggtgctatcggatgatgaatccgangccgactcctcccaacaaggcgangaggagaagaagaaagcctctcccanccggggggaaggaagaaagnnaagggctcccaanaanggaaggccgaaggtccaanagggaaaaatcttccccggatgtccgcaatcaatgacacacagganggctcaanggcaanctctggcaaatntatnccggnnccaanaattaaggttcntttcncaaatagtcttcaatcncanaaaccta

SEQ ID NO: 92019 - DNA, 629 bp, Triticum aestivum
  unsure (1)..(629): unsure at all n locations
  Clone ID: PAT_TA_92019
acgaaactaaacagaatcctaaaatttggtttctacataggtagacaggaatataaccacttgagttaaaagctcaaatttggttatattcctaaaatttggtttctacataagcagacaggaatataaccattaccagtattctccgctaaacaaacatacttgcatccaccattacaccaacttggaagaactttactgacgccataagaaaaccctttactcaaatttgctggaagaagaaatgcatgtgcaggaaattaagctgacaggtgatcagtgcttgagatgcgccatggcggcttccttgaccccaacctcggcaaggtacacaccaagaaattcgccgtaggagtggggcttatatggaggccctcgcctgcgggcaacacagctccggcgccggcgcgacatncaacccgntcnggcacacgaacgtggcancgagtccgccccggccgcncncggtgacacccgtgctcgganncgcagngcccttgctcacactcanctgatccaaattnagacangccccgggcggntcgggtcaccaatanccggcgccaantacgtncgtgacanacgngcncccaanttcatacagnanagcgggccgtgggccggccagg

SEQ ID NO: 92020 - DNA, 518 bp, Triticum aestivum
  unsure (1)..(518): unsure at all n locations
  Clone ID: PAT_TA_92020
gcacgacgagggcctcctcctcgtcaaggtctacttcaagcgcgccggggagcccctcgacctcaaggaccatgagcggaggctggagcggatccggagggcgttccaggggctcgagggctcccacgtctggcccttccaggtttggtttcagacggacaaggcagcatatctcctgaggcagtactcctacagcaatctgcatgatagacttagtacacgccctttcctcagtcaaattgagaagaaatggcttgcttttcagttaatccatgctgtggagcagagccatagtaagggagtttgccatggtgacataaaatgtgagaatgtactggtgacctcatggaactgggtatactcacggactttgcgtcttttaaccaacttacatcccggatgatgatcgtcngattttcgtcctccttcnanactggaggaagcaaaatgcatcttgacctaaagatcancaaanatggggcganccaaattcctcanatnaactctaaacaactagg

SEQ ID NO: 92021 - DNA, 638 bp, Triticum aestivum
  unsure (1)..(638): unsure at all n locations
  Clone ID: PAT_TA_92021
gagctgccttgtcattgatagaggaagtgtgagagcatgctaattgtgcagggaagagaaataaaatgaaagcgaaaatgagaaacaaaagagaagaatgttatgatctcatgataatgtcggccaccagccagcgcccacaggagtatacctataggcggtccaaaggtactagcatgcttgccaatgaatgtcacatgctctgcctaatatgtaatgcttggttcccaaaggtactagcatgcttgccaatgaatgtcacatgctctgcctaatatgtaatgcttggttcttttttttgcttgtagttcatgcttcttttcaattatgcaatttagaaagaaaaaaagtatgttattatgtcattatgccatgtcagtttatgtcatggaggcggtaaagtgattattagttaaaaagtatagtcaagcttgatatgttcaatcggtgttactaactttctcaaagtatcatgcattagtgattacaagctcaattgactgatgcttcaatgataatccaagttacaaggtggnaaaacaagcgcccatagttaggaaatagttaccaagagaaantatagatgaancanggggccggnccaatcccaaanatcttanccccangctcttaaagtg

SEQ ID NO: 92022 - DNA, 638 bp, Triticum aestivum
  unsure (1)..(638): unsure at all n locations
  Clone ID: PAT_TA_92022
ggttggtaaaggaagggacgttgggctcaatcagatttccatgtttgaagccaaggttgctggtggcaacggggagcaaactctaagcagagatgtctacagactaggccacggattggatttcttccggatgctctcattcttttatacaaccattggattttatctcaacaccatgatggttgtgctaactgtctatgcatttgtgtgggggcgcttttatcttgcactcagtgggctcgaggactacatcacaaacaacactagctctactgataatgcagccctgtgggctgtcctgaaccagcaatttttcatacagtttggcctcttcacagcattgcccatgattattgagaactccctagagcatggtttcctcattgcggtgtgggatttcatagtaatgcaattgcaatgtgcatctgttttctaaccttctcatggggacaagacacactattatgggcggcacccttcatggaggggcaaagtacgtccancggccgtggctcctggtggagcaaagaantnctgagaacatagntgtagccgtacaattacnancatanactgggtaatggctatcactaacaaancaggganaatgngtaaccgcgaactcaatggccagatgc

SEQ ID NO: 92023 - DNA, 627 bp, Triticum aestivum
  unsure (1)..(627): unsure at all n locations
  Clone ID: PAT_TA_92023
cttgatcgccatggctccttcctcccagctactgactttagtcctcgtcctgctggcctcgtcggcggccgtgccgcgcggtgcccccctccacggcaccaacctaaagcgcattcgcgcgtacatgcaccaagaccctcacgggtccgaacgcgacggaggtgacgtcggtgcagtcccccctagggggcgacgcgacgtttgggcagatcaccgtgctggacaacgagctgcgggacggcccagaccggtggtgctcatcaccccttggccgtttccagggcttggtcgccgagggcggggctggagggcacgccgggcctgctgtcagcggccaacgtggtgttcacggccgggcggcaacgcgggagcacactggccatgctgggcacgtacagaacttacgggcaacgtcagcgcaacgtctccgggggacggcnanttcggatggccgcggtaaactcatggttaatggcggggcanaactcaaaacattcanatatcnctcttgtnagtcaagnttgntgatatttgataccacnggtgtaagaaanngctncactccatacaatncataagggtattacnnangaatttttnaaaanaaaagcgttntttaagggggcg

SEQ ID NO: 92024 - DNA, 476 bp, Triticum aestivum
  unsure (1)..(476): unsure at all n locations
  Clone ID: PAT_TA_92024
gttgagtctagaaatgctttagttatatgtaggggaattgattgtgggatggaacgtaaggctctttttactcctttacctcatgcctttctgatctgggtcatcttatccttcctacgaggttaaggaactaggctttattttctttctatcaggatcacgtgttactaatccctagacttataggattgttggatttaagccattcagtttcaactacttccgtgtgttgacagttgacctcagaaccttgttatgatgttgttgagtggttatgccaccattttgcaggatgtctcaaacctttgagcatttacagccgttatgctgtccgagtcatcctaagtttcctaaataatctgaagcattgcaaaacccttcctcctcaatttgatgttccttggggcaagattaacacactaatccttgattgangnacccgttactcgttggnaaagttggngtataataagacc

SEQ ID NO: 92025 - DNA, 486 bp, Triticum aestivum
  unsure (1)..(486): unsure at all n locations
  Clone ID: PAT_TA_92025
cggacccctatttaatattacgctcatcggcttctgcatcttttaacagtctcagccgccacgcgtcgagcggatacaagaagttggggcatttttacattttccaccttgatcatgtaaacaaattgcctaataagatacggggatccttagatccaatccacaccatcttccccaagcgaggaatcattagagcgtgcccgaaaaaaccacttcaacatggccggcgctcgcagtcttcctcccgctctcgggagcaccaagctggggcgattggggagaagtgtaccatatcccacggccgattagtgaagttgcacacccaagggtacctactccttcatatctatccccgttcgaaccggattggttccttaaatggcggggagcaacgggagaatctcccaaccaatccaaggggattgaataagcctcgttcctacttactgagggtgttnggnttccaatcaaccgttccccgcnggn

SEQ ID NO: 92026 - DNA, 473 bp, Triticum aestivum
  unsure (1)..(473): unsure at all n locations
  Clone ID: PAT_TA_92026
ataaactcgagttcgatcatcaccaaccatgtcgtgctgcggaggcaactgcgggtgcggatccggctgcaagtgcggcaacggctgcggagggtgcaagatgtaccctgagatggacgagggagtgaacaccgcctcccagaccctcatcatgggcgttgccccctccaaagggcaccccgtcgttcgaggccgccgccgagaacggagggtgcaagtgcggcccaactgcacctgcaacccgtgcacctgcaagtgatccatgaaggcctcaatcaaatcaagtncangggagatggcatggatggacctgatgaaggagcaataataattaatgcatgancccaagcgtgttttccttttaaattgccaccaacaataagacgaaatntatcgtaccgtaccaactaattaatggatanccgtgcccttgnggcttgtacntntgctgtgtaaggctctngtccgtnatn

SEQ ID NO: 92027 - DNA, 418 bp, Triticum aestivum
  unsure (1)..(418): unsure at all n locations
  Clone ID: PAT_TA_92027
ccctcttcttctcctttcttcctcttcttatttccattttcctctcattctttttcttcttcttccttcttaaaaatacatgaagtagtattgcctaattcattgttcatatgaatatacaaacatttgcatatttacaataattaatatcaccaaaaaaatctatgaacagaaaaaaatcctattttttctaaaaaactattgcatatatacatgaacatatatatacacaagagaacatatatataaaaaacaagcatatataagaaaaaaagcctatatatgaaaaaaatgctagctagggaagggcaccggccggaccaggaggaccacggggtcngcggcgaggatgcnacgggcagtgggcgctcgctcgggttaaggggcgcgggcgacgcgaacggcgggcaanggcgtc

SEQ ID NO: 92028 - DNA, 494 bp, Triticum aestivum
  unsure (1)..(494): unsure at all n locations
  Clone ID: PAT_TA_92028
ctgattccttcagagatcgcaccagtctgggtttgatgccgctcataataagatcgtttgctcgttccacttgatcgtttgtttggggtgatagacggaggcgtaatcgagcttaatgcccatgttgccgcaccaagtttttacctcgtcggctgtgaagttgggagccattatcggtgatgatgctgtgggggacaccataatggtgcacgacccctgatatgaagtctatcactgggtcccggattccggccgttttaactggnttgggctcctaccattgggtgaatttaaccaacaatgaccaacaggtancttttcctaatggtccctcccttttaangggncccgacaatatcgagcccccaanacccaaaagggcaaattatggggattgtttggaaagcgttggccgnaaaatntttggttggngaaaaaactgggaacccaccaagtttgacaagnccgtgnaccgcccnggcntcggcataaaa

SEQ ID NO: 92029 - DNA, 474 bp, Triticum aestivum
  unsure (1)..(474): unsure at all n locations
  Clone ID: PAT_TA_92029
aatggcgtccacctcctgcttcctccaccagtccaccgcgcgcctggccgcctcggcgcgccctgcgcccgccgtcgggcgcacccagctgttcgtctgcaaggcgcagaagaacgacgaggctgcacctgacgctgccgtccgtcaccagccggcgcgccgcgctgtccctcctccgccggtgccgccgccgtcgccgtcaaggtctcccccgccgcttccgcctacgggagaagcagcgaacgtgttccggcaaggcgaagaaagaacacganttccgtggaaaagccgggaaggggtttcaaactgatgattcccggcaagtttgaacccaagcaagggcgttanttcccttggcaagtgtcccgctacgaagacaactttcgacgccaacaacactctcccgttttatcaacccgacaaccaagaaacataaccgatagtcccctaaggttcnctccaagtcgttctccn

SEQ ID NO: 92030 - DNA, 204 bp, Triticum aestivum
  unsure (1)..(204): unsure at all n locations
  Clone ID: PAT_TA_92030
cctacccacctgtgtcggtttcgggtacaggtacccttttgttgaaggtcgttcgagcttttcctgggagtatggcatcagttacatacttcagcgccgtagcgcctgggtatgagctcgtggagaagcaatcgctatccacggggctcatacttcaagcgcttgcagcgcttggtaccgcgcgncccaaggggggggggggcc

SEQ ID NO: 92031 - DNA, 337 bp, Triticum aestivum
  unsure (1)..(337): unsure at all n locations
  Clone ID: PAT_TA_92031
cctcctcctagcaagctatatacctacatagtacagccatggcccccaccgtgatggcctcgtcggccacctccgtcgctcctttccaggggctcaagtccaccgccggcctccccgtcnagccgccgctccaacggcgctagcctcggcagcgtcaagcaacggtggaaggtnnaggtgcatgcaggtgtttggccatccgaagggcatcaagaattccgagaccctgtcttacctgccaccgctcaacacggangcctcctccaagcaagttcnatacctgattcgctccaaagtgggtgcttgcctccanttnaacaaggttggttnaacttcc

SEQ ID NO: 92032 - DNA, 468 bp, Triticum aestivum
  unsure (1)..(468): unsure at all n locations
  Clone ID: PAT_TA_92032
tagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgttggcccatcgagggcatcaagaattcgagaccctgtcttacctgccaccgctcagcacggaggccctcctcaagcangtcgactacctgatccgctccaagtgggtgccttgcctccaantcaacaaggttggttcatcttccgtgagcanaacgcatctcctgggtaatacaatggccgtattggcatgtggaaactgctaatgttcggggtgcactgacgcaaacaggtattaacaagtggaggagncaanaaggattcccngaccctatttcgcatcaaccggt

SEQ ID NO: 92033 - DNA, 492 bp, Triticum aestivum
  unsure (1)..(492): unsure at all n locations
  Clone ID: PAT_TA_92033
cttgagatggcgcaaaccatggcgtccatgaccggcctgtcgcagggcgtgcgtctcccaggcccgaccggcaggcgcgccagcaggttcaccgtgagggcgtcgtcggcggaggcggaaggccgccggccgccgcgcggtccttggtctcatggccagcggagtccgtccggcagcgcgttcgctcaggtnggtgcacgcccggcaccgtcgcggcatcaaggttttggccaccgccgccgtctccggttggactccccccggaacggacaatccgaacgaagcaaggacttccacctgcccctggaaaaaccggtctacctggcagccgctgccaccggcgggaggcggncggtcccnggccaaaggagtccggcccaagaatccttcaacctnnaagccgtcnatccnacaagaacaatngcnttacttcatnaacactccgcttcaaggctcctaactacgctatnactcaagacgtcactcctccca

SEQ ID NO: 92034 - DNA, 334 bp, Triticum aestivum
  unsure (1)..(334): unsure at all n locations
  Clone ID: PAT_TA_92034
cggtctaatccgattcaaacgcaccgcttcctcgtgtccgaactaagccccaatcccgtcaccaccgccgctggtgctcggcgcgatggcgcagaaggacgccgccaatggcaacggcgccaccacgcgcccgccgcccactccctcccccatccgcttctccaattcttccaaggccaacatgcggttcctggtcaccggcggagctggtttcatnggttcgaacttcgttcgacaagttcatgggagaaacgagaanacgaagngcaatttttgccnaaaatttttcancngggtcaaaagaaaacttanaaaatgggtttgnaaaccnaaa

SEQ ID NO: 92035 - DNA, 279 bp, Triticum aestivum
  unsure (1)..(279): unsure at all n locations
  Clone ID: PAT_TA_92035
cggccgcacccctccccaccccgccgagcgctccgcggccgccatggcgtctcctccgggcccggggtctgccaaccgcgcgctctcctcctcgtcgaggggggccgctctcgcccttccccggcgcggccctgtcacgaatggggagaatgggttgaggcaagatacaagaggggcaagcaatggcagctgttacaaccacggaaccgagcaacacggtgcgttcctctccgagggatgaaagacctgntctntcccaggagatagtggagtgatgtg

SEQ ID NO: 92036 - DNA, 479 bp, Triticum aestivum
  unsure (1)..(479): unsure at all n locations
  Clone ID: PAT_TA_92036
actgcattatatttgaacagaatacaagagtgaacagtacattgtagttttcccgataaattaacaatactatatgaatatccaacaatgataattacatatgacatgtaaaatatttttaaagcgtaacgataaaatgaattgtggaggtcaggccatgttactgaaattgggaattggaggtcaaaccattgcagaaatttgagctccaagtcatgccaagtttgacccaaccgaaaactgagcttcaaggaaggcattttgctataaaaatagtaagaatgaagaaaaaagctaccagagagcaaatcaagaatgggccaaccaattggatacntggcgccaggaccgtgtacaatcaanttgaaaaagccgtaactgttgccaantntgcaaacaagtgagctcctaagttcaaagatgtacaggttgtgatttacacctccaatttccaagnggcattaanggaanacaatgca

SEQ ID NO: 92037 - DNA, 440 bp, Triticum aestivum
  unsure (1)..(440): unsure at all n locations
  Clone ID: PAT_TA_92037
gagaaatgttttttctgcaaacatgcaagttttttttgcgagaaacttccaatctattcatcaattggtagtacaaagaacaccagaagtaaaaattacatccatgttcgtagaccacctagcgacgactatcagcactggagcgagccgacgtgcgcctccgtcatcgcccctccatcatcaagagcgaggcaaaccttgttgtagtaagacaatcaagaaagtccgtccgcgctaaggccccattaagaccaagcacaccaagaacaacaaccaccattaatttaagataagcgtgggttcgaaaagaatcccaacctggcagcaccgtttaatttaagataagcgtggattcnaaagatccaacctgcaancatgcngccnttnacaaatgacacngatccaaacggttcaacggannaaaatccaaccggatccct

SEQ ID NO: 92038 - DNA, 464 bp, Triticum aestivum
  unsure (1)..(464): unsure at all n locations
  Clone ID: PAT_TA_92038
agtccaataagagatatgttgacattaattaccaaaaccacctagggagcacttgtgctttcaatatctcccttttaagtaattgatgacagcatacatcaaagctttagataaggatataaagaatagcaagtaaagtttgggaaagacatgtaacaagcataggtccccctacatgttatgcaacatgttgaaatatccgaatatagaagcatgttaagagcataaccatgacagagttaagaatgtgttacatgtacctgggcatatgcatttagagcaaagaatattnnaagaaatactttcatgctcaatganccttcctttgcaaacatatggtcatcaagcaagattcctccaaacacatgattatgagcaatgtgctaacttggtagccctgagtttggttaaggatggaatgaacctgcacaaacaaggtttataanccaggtnatcccctaacc

SEQ ID NO: 92039 - DNA, 403 bp, Triticum aestivum
  unsure (1)..(403): unsure at all n locations
  Clone ID: PAT_TA_92039
gagagctcctctccaaacctctcccttctccccgccaggagtctagggttagagaagagagagagagagagagtgagacaagagcaaaaataatctctcgccccactgttataccaaggttgcatccatctcatatccctctatatatctttgtatcacgatggctgggcctatccctaagagcacccttggggcattccgccttccggctccctaagcaacatcatctctttcnacaagctccctgggccccataccaacattctaccgggtttttcaaagagcaaatcccacggaggggtccancnggtncctacgttcgtggcctgttnaaacgcgagctgtggtnttcctacgcacgggncaaaccggtnaaggctccctcatcaanatcaacgctgtt

SEQ ID NO: 92040 - DNA, 474 bp, Triticum aestivum
  unsure (1)..(474): unsure at all n locations
  Clone ID: PAT_TA_92040
cgcgattcctctcccctcgcctcctcgtcctccccctcctaggggatcgccggagaggaatcgcgacgagggcttcctcctatcagttaaatcaaagccatggagcacaaggagaccggctgccagtctcgggagggccccatcctttgcgtcaataattgtggcttcttcggcagcgcggcgaccatgaacatgtgctccaagtgccacaaggagatggcgattaaagcangagcaagcaaagctggccgctctctttcgacagatcgtcaacggtgggaatgccgcaaaagaaatcttgctgctggnancacggcgttgaatttcccacttttagggaaaaancttattacgcaaacctgctatatcctggccaancnanggggcattggnaacccaaaggccaaccgttnaaaactgcaaaanaggccnggctaacggtnaaatccgtttggaactgnttggcaaacactt

SEQ ID NO: 92041 - DNA, 467 bp, Triticum aestivum
  unsure (1)..(467): unsure at all n locations
  Clone ID: PAT_TA_92041
tgcgattgacgcgcttccactcctgttcttggagccgctgattcggagctgggtcgtttgatcggctttagagttncccgggagaaagggaaggagttgctctgtttcttggctaatttcggcgggcggcgatgccggactccgacaacgactccggcgggccgagcaagccggacttctccgtcgcccaaggagcangacaggttcctgccgatttccgaacgtgagccggttatgaagaaaggcgctgcccggcaacgccaaattctcgaaaggacgcccaaggagacgtgcaagagtncntgtcccgagttcatctccttnatcaaccggngaagctcccgacaaantnccaacgccaagaacncaagacatcaacgggnacaacttcttttggcaatacanctccgtttnnangacaaatganccctnaagtctactgcaaattccnccactggagnaaaaag

SEQ ID NO: 92042 - DNA, 240 bp, Triticum aestivum
  Clone ID: PAT_TA_92042
ttttgtgtgtaagttgcttcaagcattaataaagataaatattttagcagtttggtttatttcttgacaaagggtgttctttattactccccttgttcatttatataagacattgggacgggtctagctggcggccgggtactagctagcgttcactagcggccggccaaataaattaagtgcctgtaccttggtcccatggactagacaaccgcgtattaaaaaggcaaaaaaaaaaaa

SEQ ID NO: 92043 - DNA, 490 bp, Triticum aestivum
  unsure (1)..(490): unsure at all n locations
  Clone ID: PAT_TA_92043
taaaagtacaacagaccgagcacccccgcccgggaatagtgcacatggtaaccagcatctacacgcgctggtttcttttcacacaacacaatgtgaagttcgttctcgagcaagacgcctttcagccccttccaagcactagaaaagcacatgggacaaaatcaatacagcaagggctaacaaaattccccctaagaaacaggcttggaataanacctcatttcaattccatattgggaagcatttaaagcaanttttatttttacanggctgttacatgttttactatacacgattttacataatttacattcccgaaacacgcatatttccgtgtccttcccnggaaccggttttngccgaagccaanagaggcaaagctttaagcccntccnggatccgtgggattcnatatnccgttntcccnaacctacngcccagttatacgnttcttccttggcanaacctccacactttngtttttaagttc

SEQ ID NO: 92044 - DNA, 454 bp, Triticum aestivum
  unsure (1)..(454): unsure at all n locations
  Clone ID: PAT_TA_92044
gaggcggggtgggccggccaggtagcggcctcccttatccaccgacacacccactccccccccccacgatcccctctcctccctctgtctccccccgattcagatcgggggaaatgtccccgtcgccgctccatcgcgcctccctccccctccgcgacgccacctcgccagcgccgcacctcctggcctccttcctccccctccgtgcaccgcgtcgtcttccccgagctccgcgtgcactgcatctgtggccgccccgaccccgtttgccagaacacgtcgcctcgccggaggcacctcnccggaccgcaacgcgttcgtcctcccctgcatcgccttcgtccctgaccctttcccgcatcttcgcttcnggctctgtnncgttcccgtcngggctcccttttcgccaancaanancacaacnacngctccaggggggggcccggttnccatt

SEQ ID NO: 92045 - DNA, 433 bp, Triticum aestivum
  unsure (1)..(433): unsure at all n locations
  Clone ID: PAT_TA_92045
tcatggacatctatgcggtagagccagtcgccccaaagttcaatcaatggccgtcatttccgatcaccttcgaccgacgagatcatccgactagtatccgccacggcggtttggccgcactgggtccttgacccaatcatcgacagatccacctaacacgatcctgatggatggtggaagcagctcaacctgctgttaccaaggatacagtacgnnagatgggattatccctcaacgaatccaaaccaacaaagacactttttaagggntcaaanccggntgtanaaaggcccccttgtacggctcaatcancctggggggggttttcggttcncccggnaaatttcccnanccnaaagtttaaccttccnaaacgncccntttcnnaaanggtttacangcacgggctcaaaganccgttttgcaaatttca

SEQ ID NO: 92046 - DNA, 462 bp, Triticum aestivum
  unsure (1)..(462): unsure at all n locations
  Clone ID: PAT_TA_92046
gcgatattcttcttcatccctgtccacccaaaacgttcttttaaatccaaatacatcttggtgtttctggggtgtatcaagtatggtgagtcgtgtgcctcctgaagtattaacttccttatctttgtgttattggggcacataaacacggtcctccgaaccatatggtgtccgtgctcatcctcacgaaaacctttgggttttccttccgctcattttctcctttatctccggcaactctttgtcatccttcctggggctcctcaaactttcccaacaatgttagactccacctccattggttgcaacaaaacctcctaaggaacatcctacatccgaagttccctgagattctcctggctactcctngtcaagcaatccccaatgcttaataagggtattaacatactccttcccgggtcnaaacatccggtacacattggccttgcctgggatgatant

SEQ ID NO: 92047 - DNA, 418 bp, Triticum aestivum
  unsure (1)..(418): unsure at all n locations
  Clone ID: PAT_TA_92047
tttttttttttttttttatccagcaagtacatggtaagacaaaagggcaggtaaaatcacattacattatttaaaaaaataatgtattcgacaaaaaattgcggcagaagagccacatcatgagtgggattctttacaattttgcaaaacatagggctatccattcattatagtttgcaaatgacagaactgcgacagcatacaccgttcanggttaacaaatgaatccttggattcccaaggagacctaagaagtcaagattgcagttcctagccaaaccatactgctgtatcaagcggtttgcaccaacgaccatgatgctcaatgcctcantccaccaanatgtccngggaanactgccccnggcnancttccaaanggaangcattccccaaagntcccttgggattntcctgg

SEQ ID NO: 92048 - DNA, 172 bp, Triticum aestivum
  unsure (1)..(172): unsure at all n locations
  Clone ID: PAT_TA_92048
ctcctcgcctccgccatgtctggcctcctccgtggaaggcgcctcgccgccgcagccacgcgcgccgcctcaaccctgaccgcagccgaatgctcccctgccatcgcggcggtcccgccaccgcaccgcctcctccaggatcggcgcaatggaaanggggnccctcgtcctc

SEQ ID NO: 92049 - DNA, 188 bp, Triticum aestivum
  Clone ID: PAT_TA_92049
cttcctgaagacattgcgatgtcgaagagctgttctttgtctgttttattagtgtgtggtttttggtcatttgtacgggttgtaaaagagtagcagtaccgtcatgcctcaaagtggcgtttgctgtcattttgtaagctgacttgagcatcaaatatcttgataatcgctttgataaaaaaaaaaaa

SEQ ID NO: 92050 - DNA, 244 bp, Triticum aestivum
  Clone ID: PAT_TA_92050
cgccgctccatgtttcgagacacggttgccattggcatgtcttgttaaagaagagatcgtgtccccttattacgggattctcatcaatacgggcgtgggtaacccaaccgtgccgtttacacaacccttgggaataggcgagttttaaggcgaatggggaggcgcttgacattcacggcctttataaggggataaggattcgtcctcattcactcacaccttctccttcctctgtccatccatt

SEQ ID NO: 92051 - DNA, 363 bp, Triticum aestivum
  unsure (1)..(363): unsure at all n locations
  Clone ID: PAT_TA_92051
ctagcttatttgcattattaacaatctcatcattggaaaaatgcagaatagaattagaagtattgacagacatacccgtagtgacctccacatcacgaagcttggccgccctcatagcgcaccgctgctgaatgtcgtccacctccggatggtcctggagacggctgctcaaccgtcgcccctcagacaccggattcaggataccaccaaacgcaatcacctcctcccgatatgctctactagggtgcaccatgccgggggatggagaagccatggcctcctgcccgggctcccccacaaccccggccaaagggcaaactgacggcaccggcgccgccgtcacacaagnctccaagggggggg

SEQ ID NO: 92052 - DNA, 510 bp, Triticum aestivum
  unsure (1)..(510): unsure at all n locations
  Clone ID: PAT_TA_92052
tttgactcctcccaccaccaaaaccgccggccgcatcccgcgccgcccaccggcggcagagccaccgccgctgaataaacccccgcgacccgaagcgcaagcgaccggcgcacaccaacccccacccagccatggcgtcctctctcctcaccaccccgtcccagaccctcgccctcacgcccgccgcagctcgcgcccgcaggtcctcgcctgcggcggaccaggtgtccttctcctctccccgcctcccgagccgccgggcgctgcgcgtgcgcgcgtcgggtagcgattcgagaaggangtgccggagaacgaagcgccgacgacttcctgcnggaagacggtcccgggccggtccggtccgtncgcgagcgttcgaaggcatgattcggcgggttcagggaaatttgcnccgcctcnaggaagccaangcatnggaaccgtcttgaagactttgnccccccnggggcggggggataacggtgncaagacgaacttncaaaagcgggt

SEQ ID NO: 92053 - DNA, 183 bp, Triticum aestivum
  Clone ID: PAT_TA_92053
gggttgtcaatccctctcgggtaaaagattggtagatgcaaataaaatccagtgaggtatttttgggtttttggtaatatagatctggaaataaaagatgtaaataaataaaaaaggcaaatagcaatatagatctgaaaatatgtgatgagaaaatagacccgggggtcgtagattccacta

SEQ ID NO: 92054 - DNA, 251 bp, Triticum aestivum
  unsure (1)..(251): unsure at all n locations
  Clone ID: PAT_TA_92054
aggaaatgggaatgaatttcaaacaccatggcaccgttgattgctggcaaaatattgagatgcctcgtttttaaattctagtaaatccaaaattatgttaaccattcacgtgacgccacgtgtcttggttttaatggctgtaggaggtgccgtgcagatagctgcttgaccttgactgaatgggaggcgtgcaagtgccgtcaggtgcgcangctgaccgagaggcgtgcaagctnctccaaagggggggg

SEQ ID NO: 92055 - DNA, 517 bp, Triticum aestivum
  unsure (1)..(517): unsure at all n locations
  Clone ID: PAT_TA_92055
ctgtctggctccgtgaaggagaaaatgcgaagtcattgcaatataacgccttgagtgaaacacttcaaacaagaaaagttggtggtggcgttacccaccgtataggaagtattaggcccagacacggcgcacaattatcgtggcgctccgaagtcaaattccatgttaatatattcacactcagagtgtaaatcttcattgattgaagatatacattactttgtgtgttgcacatctaagtcatcaacatgcataagtgttaggatgtgtgcctgatcacaggacattagaggatctaagatatttagctcacaccgtaacttgcaaaacttttctcatccaanggctttgtgaanatatctgccaattgcnctcaatgttgacgtgaatgatatcggtncttcctcaataacatgatctctgagaaatggtgacaattcaagtgctttgtctccaatgttngcaagattgttgctatttgatggaacncntntccaaaaaaaagnatnttcagttg

SEQ ID NO: 92056 - DNA, 517 bp, Triticum aestivum
  unsure (1)..(517): unsure at all n locations
  Clone ID: PAT_TA_92056
gagcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtcgacatcgacgccaacggcaggaaggtgggcaagaagggcgtgtaccagttcgttgacaagtacggcgccaacgtccacggctacagcccaatctacacgccagaggaatggtctgaatctggtgaccgctacccngcggaacgaacgggcttcttanctggggcgtcaacctcgcccggctcctcnggcgggggcgtctcctcgtctanaacacaacgctctcgcccggtaaganacatctacttntaaanaaggccggtctctgcttcatnaagtcctgtatcnanatactactcctgtgaattntcatcaacgatcaaattatnattcgaacaaatggtttn

SEQ ID NO: 92057 - DNA, 461 bp, Triticum aestivum
  unsure (1)..(461): unsure at all n locations
  Clone ID: PAT_TA_92057
ccgcgtccgagcgccgtgcgccgtggagtgtcgtccgcgacctctgcctgcttctccgcccgcctccgcccgtgtacgctcatccccatcggtttcaggacaccgagcggctccatggtccgtgcggctgccgacgggtgctaccccatgccaggagaaccgcgcccggtgcggtcttgcagcagggctctggagttcctccccggtgcacccgagccctctctctgtaaaattatctgtaaagaatgttgtagcagagttttgtaaatcaattatgggaaacattgatgttaagtttgtaaatttgttgtgtaaatcgatcataaacaatgttgtancagtnaaaaccattcaaaatggatggtgagctatctcaaaaacaatgttgtanctgggaaaaaaatatttcaagtgtcctaagaattgataatggtaaattgttgtgtaatccaactataana

SEQ ID NO: 92058 - DNA, 444 bp, Triticum aestivum
  unsure (1)..(444): unsure at all n locations
  Clone ID: PAT_TA_92058
aaactgtcttgtatccgttgtatgtgaacgtagagcctatcacacccgataatcatgtggtgtctcagcacgatgaactatcgcaaccgtgcatactcggggagaacacttataccttggaattttagtgagggatcatcttataatgctaccgccgtactaagaaaaatacgatgcataaaagataaacatcacattcaatcataatatatgacatgatatggcattatcatattgtgcctttgatttccatctccaaagcaccgtcatgatctccatcataactggttgacacttgatctccatcgtacacatggcgtctcgccaactatgcttctacactattggctacgcatatgataagtaaacattacatgcgtttnattcatacataaaggacaacataagtcctgcatnggcattacgntncaaaatatgtccatc

SEQ ID NO: 92059 - DNA, 419 bp, Triticum aestivum
  unsure (1)..(419): unsure at all n locations
  Clone ID: PAT_TA_92059
gagttcttgagaatgtaggagttaaagtcataactgacaagtaagagctcgtgatcgttccgacttccgcactggttgtccttgccatagaagccaccctcataatcgctcaagtctgtgttgttgacactgacggcgatggagacgacaacagggccaaccgtgactggcgaaagcagttggtaccaagtggcggagcttgacaagaatctatggggaggccaaagacacaaaaaaatgtaaccaactacaacatcaataaccacacatgcacacctttaaaaaacctccatatgagaaaaacaacagatttctcatcgcaaagagcaaagagaaanggaaaaagatantttttttccccccccgttgcaaccacatttccttttgcnagtagattacaataccnagtaanaattggg

SEQ ID NO: 92060 - DNA, 556 bp, Triticum aestivum
  unsure (1)..(556): unsure at all n locations
  Clone ID: PAT_TA_92060
gcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcangtgtggcccattnngggcatcaanaagttcgagacctgtcctanttnncaccgctcaacacgggaggcctcctcaagcaggcnactacctggattcgtcccaagtgggtgccttgcctccagttaacaaagttgggtcacntccgtgagcacaacgatcccttggtacnatgatgccgtatgggacaagttgaanctgctaatgtccggggcaccgangcacaaaatnatnaacaagtggagnaggcaanaagggtacctgancgtnttccgataacnggntntaaaaatgggcaagngaatgngcaattancgctttaacaccgggttnaagatccgnaaggctaaaagtatcacgcagcattttaatgcattgaatttt

SEQ ID NO: 92061 - DNA, 636 bp, Triticum aestivum
  Clone ID: PAT_TA_92061
aaaaggcaaaggtaaaatttattaaaatgtaggatgtacatgtagttgtgtcttcatttgaagtaatttccccctctcaaattctgtgcaagtgcacaccacttattccatcatcaccttgttggttgtgctcttgatgagcccccaagcactcctcacatgcctctcctcctgcagcgatgaccccaccgcaaaccggagcacgatcctatgaccaaccactgtgtgcgcaatgtatgccttaccggtcttatttaggttcttcatcagcacacggttggcctcatcagcatgctcctcggtcatggctccactggccttgatcctgaagcataccatggcaaagttcctaggcacaacgatctcaaaccggtggtctgcgcggacaagaccttcaaacattttggccatggcgatatcactccggatgtgctcctggagcttggcggtgccataggtgcgcatgaccatccacaacttgagcccgcgaaagcggcggcccacgccgacctgcatatctttgagatcggtgacctcgccagagtcggtggcatcgttctttaggtactctgggttggtctccatggagtcgctcaggcggcgagcgtcgcggacatagaggcgggtgccggaaca

SEQ ID NO: 92062 - DNA, 513 bp, Triticum aestivum
  unsure (1)..(513): unsure at all n locations
  Clone ID: PAT_TA_92062
gagaaacacagagcaagaagataagagagaagcaaagcttgagatggcgcaaaccatggcgtccatgaccggcctgtcgcagggcgtgcgtctcccaggcccggccggcaggcgcgccagcaggttcaccgtgagggcgtcgtccggcggaggccgaggccgccggccgccgcgcggtcctttggctcatggccagcggatcctccgggagcgcttcgctcaangtgggtgcacgcccggcaccgtctcggcatcaaggttggccccccgccgccgtctcccggtggatccccccggaacngacaactccngaccaagcaaggacttcgacttcccccctgaagaccgttctacctgcagccgctgcaaccggcnggaggcggcggtccggccaangatccggccaagaatccttaacctcaancgtcnaccnacaagacatggccttcttcatgacactccgctcaagctcctactgcgtanactcaaacttttcctccaaanaaggaggaa

SEQ ID NO: 92063 - DNA, 431 bp, Triticum aestivum
  unsure (1)..(431): unsure at all n locations
  Clone ID: PAT_TA_92063
tttttttttttttttttttttttttttacgaaacgaaattggagacccgattccttgcgtgacacctggcaatacaaatcttaaagcagcccacccgtttcccacgttccacgccctgccctttcagcttctaatctgaatcatcttcctaacagaagctcatcttcgtccagctgaaccccagtgcacagacgcatcagtgtaacacaacgacggngagatgcttaaccatgcagcatgcgtagtgcgtcngtgngtgccgcgagtggcggcgtcnaggagcatcgttgttgccggcancggggacgtgggtcacgagcagcggagtagcgcccgttcgtccaacgagatgcatccccattgctgccaaaatggggctgacgaatccgccntggccggtgagaacaacanctgggctngatgcaagactc

SEQ ID NO: 92064 - DNA, 340 bp, Triticum aestivum
  unsure (1)..(340): unsure at all n locations
  Clone ID: PAT_TA_92064
acgacgccggccacagctccccgccaacctccccggtgaaccaagcgctctctctctctccgtcgatcgtatggtgcccatggtcaccgaggcgtggacgctcgccgggtgcggcggggccgcgtccaagcccttgccggcgcaggaggccccacgctgctgcatcctactgccaaagaaacccacgttcgttnnagagcggtggcctccgccgaagtagcacaanccagacgccgcgggcgcgaaaaacccgnccgttcgtccggtaagcgccgggnggatcnccttcttgcctggctggccgcgcttcgcgctggcngtcctcctccttctggggggc

SEQ ID NO: 92065 - DNA, 589 bp, Triticum aestivum
  unsure (1)..(589): unsure at all n locations
  Clone ID: PAT_TA_92065
gcagagtgcattgatcctgactgtagctgggtggagcaatgggtgcatcgtgcagggcctcgtaaggatatatactatgagccaaatgaagtaaaagctgctatagttacttgtggaggtctctgccctggtttgaatgatgtcatcagacaggtagtattcaccctaagagacatatggggttaagaatattgttggaattccatttggtttcntggatttttgaaaaaggtctaaaagaaatccccttcacgtaaccaatgggagaatattaaccttgctggtggaantttccnagatcctcccgtggangagctaaaactaatgaaattgtngataatatacaagccagaagattnatanctttttgtacttggggggaatgggacccatgccaggacaaatncacccatgatgatgccgttaaaaaccaagttnngtntacattccaagacntngcaagnatcctttatggcaaaatttgttttaacncnntgaaaacncaaaggcntatnncccaaaaagactttntacaaggacgttgcaattanggaaacatggtnatgatnagtcctaaggaagtagtcgn

SEQ ID NO: 92066 - DNA, 594 bp, Triticum aestivum
  unsure (1)..(594): unsure at all n locations
  Clone ID: PAT_TA_92066
cccaaataaagtatcaactacacttaacaaccgatcttccaataaaatggtttcaacacaacccttccgcagttcatttctgcaaagctctcaacacaggagtaaacggacgaaatcaaatacaaatcaacttccaaattcaccattattaccattacactttcatctaccactacaatccgaggaagaagaggcgaagaatccaaggtgaaagagaaatgggaactaagcataccacaccaatccaaccccgaactttactccccaacctttaaaccgagatacacaaatgggtnacaagaaggcccaccggnagaaaagaaaaccgggatccctcctaccttaagttagcaagnaaanatttcattcnnncaaacactggcgaaaagacngtgacccatttcctttgggataaattattaaaagtatacggttccacttcnttccnaaaantaccnttaaanncaatgtcaacnatttcngcanccggattnantgccncactgggannaaagnccanaaccngngccnttgttaccnaaccttatggaagacctnaaccccccatnnttacggntcnggcacnaaattggg

SEQ ID NO: 92067 - DNA, 340 bp, Triticum aestivum
  unsure (1)..(340): unsure at all n locations
  Clone ID: PAT_TA_92067
agccctttagcggagggaaagcagagcaacgcacaagaagcacacgcgatcgcgcgagtcgttggtgcgccggccaaagcctaacccgctaacgatggcggcgggtgaatngtggtgctgggctcctgncggggttggtnggctncngggccggcttgnttcttgnccttaaacttcttcttggcngcaatcttnccctgttnttccnttttgaaacggaancggantnccttgccgcgccctttccggancnggtttaacncaagggtcttttggggtgtttaaacattcgngattnaaaatttccttttncgttccnngtnttaaaaanccgggacaa

SEQ ID NO: 92068 - DNA, 537 bp, Triticum aestivum
  unsure (1)..(537): unsure at all n locations
  Clone ID: PAT_TA_92068
ctgctcccggcctgtaaatatcaaggatctagacacctagatattcccagagagccattaggataataagcatcaggtaaagcctgacagggtctgctggttttagaatcatcaatacccctcccatctaggataggagagaagcatgttgggtattcacctaagtatgcgtagagaaagaaaagacatgcagggagatagagaggtgttgtgctacttgagtcctgtaactatcctggcacgtttgtgctcctcctctgactccaagccacatcttgtacagtgccccttgcctccttttgttaacctggaaaatcatttgatacattgcccctntatgggtacccgctcnactcaatgttttacccaagggattaaccacattttccaaanggaccttcaaacctnaaattaaattaaanggtacatnggaacgcctncccngaaaatctcaaaaaaccggatcttncaagnaggctnanccgggccattggggncaatcaaccaaccctctttttnaaancnggcncttttaac

SEQ ID NO: 92069 - DNA, 375 bp, Triticum aestivum
  unsure (1)..(375): unsure at all n locations
  Clone ID: PAT_TA_92069
ctcgtgccgaattcggcacgagatcgatcctcccgcgtaccaagccaccgaccaacatggcagcgtctctccaagccgcggccacgctgatgccggccaagatcggcggccgggcctcctccgcgcggccgtccgtccgcacgtcgcccgggcgttcggcgtttgacgctggcgccaaggatnacctggctccctgcaatcccgacatcaaggaagtccccaagcaattcgccgacgcccgcccaagatngccggtttngccctcgccactttgcctcctncgtttcccggggcaaccccggaggggggcgcccnaaaagctaccttccacnaattttnaaagcaaacctaatgaggttaaagggtaccgaaccg

SEQ ID NO: 92070 - DNA, 579 bp, Triticum aestivum
  unsure (1)..(579): unsure at all n locations
  Clone ID: PAT_TA_92070
ctcgtgccgaattcggcacgaggagagaactagtctcgagtttttttttttttttttttttttttttttttttgaagaagacagatatatattgtagatctgctatattgatgattattgaaaataagagtggaaaaggttaatcatgtacagaggtcttgcagcgagtatttatacacaaagacaatgcataaaatataccatcaatagcaataactgccaaccattcagccattcaacgactatgtcattaagatatacctgcatcacattaatatatatcatgtatggttgaaaaacnggnatgtcactgctgtgtgccgatgacttcattgacacagntcgcttgtcctgccggtacacttgcctaatacnggcattcnaagngcgtattcanaangggcctgatnaaaanacttcatttgtnccntnggttgttgcctcatggattggnatccccaatggcatccctttttccnccttgcaanactttccaccggattcccattagcntgtaanagnatggncataggaggggcccagtaagttacgaaaangtctccaaattagnntggantc

SEQ ID NO: 92071 - DNA, 615 bp, Triticum aestivum
  unsure (1)..(615): unsure at all n locations
  Clone ID: PAT_TA_92071
ctcgtgccgaattcggcacgagcatcgttggcctatcttcaggcctgttctgcacacacagcagaccgatctggatgcacttcagcacctggtcaacgtgagagggatggtcgctaagggatggatcgatcaactcgatgacctttcccctggtccagtactcccatacaaggtttacgagatagacatattgctccgagttgcaggagccattgtttcttcttcctgtgacaatctccaaaaccaaaacaccgaagctgaatgcgtccgacttcgctgaatattgaccatgcatgggcatactccgggcgacatgtatcccgtatgtcccagcgatgcgcctaatgacatcttcctgattgntccctccnaaatacttagctaagccaaaatcagaancttagggtgtatcnaagccaatagntattgctcgctttaangcacgggtgaanacctcnaattgaatcctcaatggcatacttacccctacaacccactgatacctgacncttcccatcnngcnctgattctcaanccaaagangggncaaggtcgtgggaaaatcntaaaatattcctgtctcaanaaacatgagcaaanatctngnaactacan

SEQ ID NO: 92072 - DNA, 310 bp, Triticum aestivum
  unsure (1)..(310): unsure at all n locations
  Clone ID: PAT_TA_92072
ggcttcccctccccttccggttcgggttctggttcggtttcggntccgaggggtancnagcctactcnatgggtttccgtagttcggagaggagagaaagggagagatccatggngganacngantaccgctgcttcgtgggcngcctcncctgagccancgacgaccacaacctcnagcaggncttcanccagtacggcgagatcctcgacgccaagatcatcaacnaccgcgangacgggcangtcccntggcttcgagcttcnncacggttcgggagcgaaggagtcngatgcgncaaggccatcga

SEQ ID NO: 92073 - DNA, 575 bp, Triticum aestivum
  unsure (1)..(575): unsure at all n locations
  Clone ID: PAT_TA_92073
tgaaggctgtggctgtgcttaccggcagtgagggtgtcaagggcaccatcttcttcacccaggagggagatggcccgaccaccgtgacgggaagcgtcactggactcaaggaagggctccacggcttccacgtgcacgctcttggtgacaccaccaacggctgcatgtcaactgggaccacacttcaaccctgctggcatgtgcatggggcaccagaagatgaaatccgccatgctggtgattcttgggaaatgttacagctggagcggatggtgttgctaacatcaatttactgactgccatacccccttaactgggaccaattcaattgttggccttctgtttcctcccacngtgacgctgatattcttggcaagggtgggcatgacttaacaagacacttggaacctggtcccctgttcttnccggacanccgctccaagctaagntcatctccaccggcaactctaanttttgggacttttcaagatcaattncacncatccaaatacaatntctnntaatnttanttcacatcgttgatccantcaccnaantacctnaaaaaaaaaaaa

SEQ ID NO: 92074 - DNA, 621 bp, Triticum aestivum
  unsure (1)..(621): unsure at all n locations
  Clone ID: PAT_TA_92074
tttgtgacctcgactcacgcgtctctgatatatttctttgtcatctcttatccctaccacaggtatgccgccagcaactcgaaatcagtacactcgagtgcgcaacaatatcgcgcaagctcacaaaccaatccattttggcggctcaaaaatcaccaaaccacgcgctctcgttcaaaaaaacgaaaagcctgccttgcttgtccggtctatcacgcaacaagagaggaaaatagcctcctgcaaaccgacaaatgcgcaacaaaacgtatccaaatctctgaaagcattcacacccattngagttcgcgctccgcagtattactgattcaacaaatcaaaggcatattggaagttcaaggaacagacgcgcatccgcgccatccgcacaccaancggaatggggaactggacctaaaacttgaggtatcnacacgactcccaatatgggcctgcatagtattcgcgctcccgccaatggtaaaggnaaatagnnggtctactccacctatcnaggattggcgtctccggaanggactntacaaggggacgattngaggaatacnangacnatgatccanattggacgngtaaaacaacnacaaagtttagtnganttng

SEQ ID NO: 92075 - DNA, 509 bp, Triticum aestivum
  unsure (1)..(509): unsure at all n locations
  Clone ID: PAT_TA_92075
cttgcctcgagttcagcaaggttgggttcatcttccgtgagcacaacgcatcccctgggtactatgatggccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggatccggcaaggcctaaacagctcactcacgacaggcatatataaagngccattgcattttgtcaactcnggacattgcttgggtttccttctccattaccttcctatttgttccctaagaatatgtgtatgtccatgtcatgttccaacaggctccnanaaacatgctcnntangagaatctaccgtggtnagtatataacggaccaataatattatcatantnnactaaaacttttaanggaacaatggaaataan

SEQ ID NO: 92076 - DNA, 425 bp, Triticum aestivum
  unsure (1)..(425): unsure at all n locations
  Clone ID: PAT_TA_92076
ctcgtgccgaattcggcacgaggtcntctcaaatatgtcgagtcttcttgctcagcttggcctcggcctcgtcatctacgtggttcttacactctttctctatacgctctcgctcctcatcccantcgctggnttcggggcgcncctgctcgcagcgtatgcctctctcttantatgcgcctcggncggtgtgagtttcctccgcctgccttcacattgtcggttaccccgcgcatctcgcantgtgtcgtcgcgcgctgcttttaagcatcntatncggtacacgacagcctgacctttaatcgtcgatgattccgcaagactacctgaatcagacacgggcaancatatncatcggtaacnaccagacggacttgacgnatgatgctccctgatctttcccantgggctccggtgacgggaac

SEQ ID NO: 92077 - DNA, 157 bp, Triticum aestivum
  unsure (1)..(157): unsure at all n locations
  Clone ID: PAT_TA_92077
aggccgccgccggcgcctcatgggctcacnaggtcaagcangccctccgtgacaagctccggtgggcacccgccgcnggcaccacgggcaccggcggccaccgcgccnctaggccgccgacggnctccncggctgtgaccnccgagccngcggctga

SEQ ID NO: 92078 - DNA, 473 bp, Triticum aestivum
  unsure (1)..(473): unsure at all n locations
  Clone ID: PAT_TA_92078
ctcgtgccgaattcggcacgagaaaagcttgtatacggaaatagtgttgactaagcacgccacgtggtgtggggcccgctatcatctactgaacggtatagtacgacgtgtggccgattattttttgaaaaccccttggaattatttttcctaacgagaagttcgtagacacgtgtcaggtccatccgtgagcgagcaaattatatgcaaaaatggcggctgatgtgattttgaacccatgatctggggcatgaaggggtatgcgcccaaccaatgcaccaagaatgttttcactttttgccgaagatacccatcatatatgttccttacaccttaaagcggaccggccatttgctcctgacattccttttaaaaattggtaattatatgtnanttatatgtgtgttaaaaattattattggtngaataaaaataatatttatataataatatttttggttaaaaaaaaaaaa

SEQ ID NO: 92079 - DNA, 614 bp, Triticum aestivum
  unsure (1)..(614): unsure at all n locations
  Clone ID: PAT_TA_92079
ctcgtgccgaattcggcacgagaaaatgcgacgctcattgcggaagctatccgcagctcagcctagccgctacctagaatctggtgcgcctacaggaattaccggcctgcttacacacgcttctcctcgcgcgacacttatgtacacctatgcaagcacactcgatgcgctcgcacagttacccgaaagctcactctatcgacagagtaccgaggctatcactaaacatcgcatgtccattgtatctgcagtccgagccagccggcttagcggaatacgtgggaaagatcaagaaatcttggccgcaaacctagcattttngacaactacaatggccatacacaccatgtttgaaaaagcaggaaaaaatttattgtcatcaagccaaaccggaacgggatgaattgacagaggattggatggatgatggatgacttcgtccaaagcaaaaccgaacgggagtgaantnctgattnacgcccgaagataaatggcatgatacgacaaaaatnatatgacctgacaaattacggctcccaatccatgagttgaataatngtgnggcttatgannatctcagttcaaggananaaactttaattttgtnaggcang

SEQ ID NO: 92080 - DNA, 237 bp, Triticum aestivum
  Clone ID: PAT_TA_92080
gtgttatttgcgatttgtgttgaaacattgttagcacgactacatggttgaaacaatgtattatggtgatttaggtggagacaaaacaaaacatgatgtaagaaatgcagagaaatccattttctacagctgccggtgacgacctttttctgctgccacagtgttttgtaagtcagaacttttgtagtaagtatgaaacatttatcccactgttgggtaaatggtaaaaaaaaaaaa

SEQ ID NO: 92081 - DNA, 180 bp, Triticum aestivum
  Clone ID: PAT_TA_92081
ttgaccttgaatacagctctttatttacgaaaatataaagaaattgtgttgtacagatgctgctgcataactgaaagttgtgaatgtatatcccgtctcagttgaaatggagcgtaactgaacaaaaagaagctcaagaaacgtacacataagtaaaaaaactcgagggggggcccggta

SEQ ID NO: 92082 - DNA, 214 bp, Triticum aestivum
  unsure (1)..(214): unsure at all n locations
  Clone ID: PAT_TA_92082
caaacatctatcatttctcgttaataatctacaattcctcatcgtctcaaaaagcctatcacctcttcgatctgggacgcatatccaaggatcttttgggctaaagctctccagggctgctcaagctatgcgcaagaantctttnntcccctcnnatcattaataaccggnnaacaagtccaaacttccntcccaaatttcgacncttgggatt

SEQ ID NO: 92083 - DNA, 333 bp, Triticum aestivum
  unsure (1)..(333): unsure at all n locations
  Clone ID: PAT_TA_92083
gaaacaaagtaagaccaagggtcgccggcattgcttctcacagttaattgtgccaaaccaattctccataacctatcantatagcaattaaaatcatcattcaattacaagtctgtgcacgtggggttataacctttttaagaattgacgcgttagagaagtcgaggaagaaatcgataatatggtgatganatttgggacaccgtttcttgantcnatgctggtcaanaacgcactcganngtttctatggaattggnaagctgcattcgacccgtatcctgggcaaatacnttatatttccacaggcgcnacttggatnactttncaanca

SEQ ID NO: 92084 - DNA, 194 bp, Triticum aestivum
  Clone ID: PAT_TA_92084
ctcgtgccgaattcggcacgagctcgtgccgaattcggcacgagggaagattgcagtaccgagctatgcatgacgaggattctgtgcctcaacttgtattttttgatgctttgaactcggatgtaaccaagtatgattaaataaagcggcaaagcttccaatttaaaaataaataaatccagaaaaaaaaaaaa

SEQ ID NO: 92085 - DNA, 582 bp, Triticum aestivum
  unsure (1)..(582): unsure at all n locations
  Clone ID: PAT_TA_92085
ctcgtgccgaattcggcacnagctgcaactgtctacttattaaaatgtaaacactactttacaagtattcttgctgtatatagtgttgatttctagtagatcaaaggattgatataacaatggctaccggggctccattaacagcagaaaccccctgcaacaaaattatcggcataacgcagcagcaacgagataaactccccaaactagagcctcgaaaacgagttcaacaagactcctctccaattcccgaaactccatgcttacctgctccacctaaattacaaagcttagatttcaagaancatccaagacggtcttatcggctaatgaccatgcccttttcctggatcaacagcctacaantgttactactttaatttgggcctaacngatangtactgaacccattctcaatcaagtacagatattatcctacactcaggattatatngaaatcctgataanccaaggatacgtnnaacntccacccnaaattaggaatcagcttggaacagtccccaattcangatcttgaacaaaanatccnctggncnacattgtagcnctgcgcatacgaat

SEQ ID NO: 92086 - DNA, 607 bp, Triticum aestivum
  unsure (1)..(607): unsure at all n locations
  Clone ID: PAT_TA_92086
ctcgtgccgaattcggcacgagggatccactgtcacttcttggaatagtgtccctggtttgccaatatcttcccatggtggtgaacttcaacagaagaatgaggaagctgctgtcattgagtccaagattagtcagataagggaccttcttcctcattatgggaaaggtttccttgccgcttgcttggaagcctacaaccagaaccctgaggaagttatccaaaggatactagatggaacacttcatcaggatcttcctagctttagatacttccgttacaagagatgccacaacaaaaatctgcacctaagtgttgcgaaagataaaggcaaaggcgtactaagtgggaaactatcctaaatattgcaaataaacccaataaatttgaacccancttctcaatctcnacaacatccaaggtcccnactcatattacctcatttcaacaacatcaaagnccnnctcatcgttcacattccacaaggtanattncaaggaagccaagatgnntgcccaattngcattctagaccgcaaaagccaagagcgttaatcactgtcctgatccatntgatacaggtnatanatancntgaattggtcacggg

SEQ ID NO: 92087 - DNA, 471 bp, Triticum aestivum
  unsure (1)..(471): unsure at all n locations
  Clone ID: PAT_TA_92087
ctcgtgccgaattcggcacgagatttcgagtcgtgatctgaagtgaagaggcacaattgggctaaggaaagcattttgagggactaacaccttttgagaatgattttgtgctgttcgaaacgactaaaaggattggagtctggacttagaaggaatatcgtctctcacaaagaaaattatcactacggagcgggcggcctgggattgaaagatctcagtgggtattcttgggcatgatttgggcatgtgcgaaaggatctccgggaatcgtgtggtggtctatttacaaattttatctgggtgtggcgtcaataacaagcatgatccttcataaagaattcaagcctgtgcttaaaactgatggatacggaangcccatccattcaagctgggctaagcattncctagaataacatgacgancctacgtgtggtaagaaaccngggataagaaaccaataatcattactca

SEQ ID NO: 92088 - DNA, 241 bp, Triticum aestivum
  unsure (1)..(241): unsure at all n locations
  Clone ID: PAT_TA_92088
ctcgtgccgaattcggcacgaggttttatcctcttatccccttcgtatattgtactcctcctcctcctgctgctgccattgtttttatctttttctccgcntttgtcgccgcaaagcgccaagctttatcgctcgcgcgctcccggctcnacagcgcggcgcngccgcgtcggatgcgncacgtgctgccggttggccgcgccgtcntccaacgcggnncgcgggcngcggcgatggggtc

SEQ ID NO: 92089 - DNA, 382 bp, Triticum aestivum
  unsure (1)..(382): unsure at all n locations
  Clone ID: PAT_TA_92089
ttttttttttttttttttagaaacggngggagtactttatttcaaggttcacaacaacctaaatcttattttacacttcacataagttcagaatttaatatttatcttggcgccatgttatcacacatcatcnatttcctccaggnaaagttgnaaaanaatanagtagatgccccagaatacacggccaaaaagaangatacaagtctgcagcanagcaggttcacancnaancatgccgnaatcnacatacacaatgtctgaatnaanatcaactanaacgagngtncagggaaatgcatacagtcataccgtacanaagnattttacnantgcancatacccactantttcacagcaantttgggtccccacnagtaca

SEQ ID NO: 92090 - DNA, 643 bp, Triticum aestivum
  unsure (1)..(643): unsure at all n locations
  Clone ID: PAT_TA_92090
ctcgtgccgaattcggcacgagattcaggcgatcagcgggatgagggtccagccgaggcgcatgacgggatccagacggagcgaggcgcccgaggggatcgagcggacgcgcgggagcggatgaatccggggcggtcgatccagcccacgcgggcaatccgcctacgagctcttgctgattgatgcagctctgctcccgccgatgcaggctccgcagactgcagccgatctgattgccgccttntagcggcaaanccaccgcaacttgccantctcccggcggcggtggtatataaccagcctaagatcacgacttcttatgcctccttccnatgcatccntccccccaacagnatacaatccaagaaagatgttcacaacgaatttacccgggtatgcaagagagatttcacaagttgaccactataatttnanccantctgganattacatcnagtcttggtnctggggaatatcagcatatgacactatccttacattcaagtncanactgtgtagagnatcggnaataggacatattgatataaggttttgaannaggataatagatccactgtgcaatattagtatcaactacagcatttttcananaaccgnanaccacataanttttatgnagtgg

SEQ ID NO: 92091 - DNA, 425 bp, Triticum aestivum
  unsure (1)..(425): unsure at all n locations
  Clone ID: PAT_TA_92091
agaacagccaccatcanatgtanaagaccaaaatcattctcgtgcaagcactcacgaattagtgtctggagtcagtgaacanatgcaangagtagagacggctccgcggccaaatgggtcctgggcccctataaacgcatcatccccgccgctcgatgatgagcganctaaatacacaccgcatggtcaacatccttatggnattccatgcctatctgcccccgtcactgcacctgcatcacccatatcacgtgagtcgcatcgcctaattagcggtanaatcgcccttgcaagtggcactcatttggccaaanctctacnaaatccctcaattntcngcaaaagtatcagagcttctgtttgggaatnntgtggganaacnnaggctgantatangnttttccaaaaggntgaaaccnaagatt

SEQ ID NO: 92092 - DNA, 543 bp, Triticum aestivum
  unsure (1)..(543): unsure at all n locations
  Clone ID: PAT_TA_92092
cccatcccccaagtcataaacccaagtcggactcgccttcctcctcccccaactactcctcctcgcctccgcgcatcgcaccgcaccgggggtcacctgagatcacatacacaatggtgaaggctgtggctgtgcttaccggcagtgagggtgtcaagggcaccatcttcttcacccaggagggagatggcccgaccaccgtgacgggaagtgtcactggactcaaggaagggctccacggcttccatgtgcacgctcttgggtgacaccaccaatggctgcatgtcaactggaccacacttcaacccccgctggcatgtncatggggaaccnaaagattaatccgccatgctgggtgatcctggggaatgtgaaaactnggagcngatngtgtttcctanacatgttactgatgcatacccccttagnggacaaatnnantgtggcctgctgtgtcctccanggtgancngatattttggaagggtggcatgagcttacaaggattgaaancngtccgtttgctncngaacancggnccagg

SEQ ID NO: 92093 - DNA, 368 bp, Triticum aestivum
  unsure (1)..(368): unsure at all n locations
  Clone ID: PAT_TA_92093
ctcgtgccgaattcggcacgaggatcagcaagaagaanaagtttgtgagcgatggcgttttctacgccgagctgaacgagatgctgacccgggagcttgccgaggacggctactccggcgtggangtgcgcgtgacgccgatgcgcacggagatcatcatcagggccacgcggacgcanaacgtgcttggtganaagggccgcaggatcanggagctcaactccgtcctccagaagcgcttcancnttcccggangaanggcgtngagnnttacccnagaagggtcnncaaacgttggctcnggggcatcctnccaangctgagtcaatccgcnnaaganttctcggggnctttnccntccnaaggga

SEQ ID NO: 92094 - DNA, 523 bp, Triticum aestivum
  unsure (1)..(523): unsure at all n locations
  Clone ID: PAT_TA_92094
ctcgtgccgaattcggcacgagcgagtttttttttttttttttttcatgtcaaactgcagataaatttaggcctattgaatctagtgatgagaagcattgggtatgggatgaaaattccaccccttgtaattgtctcgagctttaccatttcaccaaaaatagtgcccaggaggatcaaagctccaacttcaagatattttgatcttctacatctgttattttgggggcgaggcgaagatatctctccctaagaaactgttttaacctatatatatagcatcaaagccgggaaagaattagagatctcatccattacctttttacatttaaccgactggaaccaaggctcccnanttaagatccnantacgncttaattcatncaacggaccttantgccnaagnaccacnatcccaaatacccaatcnnnatttttcnaangaatcggggcttaacataagtttcgntnttangccacattcatggccngngtngaaanaacaaccagngacnggccnctgc

SEQ ID NO: 92095 - DNA, 396 bp, Triticum aestivum
  unsure (1)..(396): unsure at all n locations
  Clone ID: PAT_TA_92095
ctcgtgccgaattcggcacgagctcgtgccgaattcggcacgancgcaaccccgcggcccggcggnggagccgctgctcaccccgncgcngtacctcggnccccactcaccatcncacctcnacnacnccgacgccgactcctacgtcctcctcgtccccgtgcggctcnggngcngcctgcgccggggctgcggatgccnnccgngtcgccgacggncctcgccgccctccgcgntcctccgcgntcgccttcctcntctggcctccgacccggcgtcagcgtcgcccgctccgctngcgcactctccgtcgtcgnccgcnngccgtcgnctcaagtctccgccgcgctcaangccgcgtcgnaagcccaactcttnagctnggtacagnnctcg

SEQ ID NO: 92096 - DNA, 626 bp, Triticum aestivum
  unsure (1)..(626): unsure at all n locations
  Clone ID: PAT_TA_92096
cccagctagggttttgctgcctccgccgccgcctcccgccagcgtcgtccccccatggcgctgccgaaccagaacaccgtcgattaccccagcttcaagctcgtcatcgtcggcgatggcgggactgggcaaaaccacttttgtgaagaggcatctcactgggaganttngagaaagaaatatgacccactatgggtgtttgaantcacccatttggtttccaccactaactggtggaagntccnttcctactggctggggacactggctggggcaagaaattttgggtggcctttaaggatggtactatatccaangtccagtgttcgatatcatgttttgatncactttnaaagctgacatacagaatgtccctaaccttgaacangacttntcaggtgttttnaacaccccattgcccntnntccggacagttntatntttaaaacagcagtttaggcaacaagaattcccacnggaananacngatanatatccctgccaaacatacattnngactccttacttcaggactgcggggtccaaataatctcaacgtgccctaccccgatactcactgcatanaaaacagtacttngtaaggaacncncctnacaanttttttt

SEQ ID NO: 92097 - DNA, 352 bp, Triticum aestivum
  unsure (1)..(352): unsure at all n locations
  Clone ID: PAT_TA_92097
gcnagtcgagtcncctcnagtccccaancccctcntcntcctcctcctcgccgtcgcngccgcgctcggatccggcgccgcccanggctcccccgcccngatcccgccggtccatgccgccgccgcagctcgccgcctgatnccgggaggcggganngaggaagggcngccgcncgctcttccggtcggggaggcgttctcccgcacgttctggggnncggatngggagattcgaccgattcgctgctccngggcagtctgcttttggngntcgtcggacgggnnatagattccntntcttcggcnatggngcntgggaagcnanatgaagcccttcacaacatcgtccaca

SEQ ID NO: 92098 - DNA, 223 bp, Triticum aestivum
  Clone ID: PAT_TA_92098
ctagtctccagaagcttgagacaatgcaggcgacgagataatcgttcggagctgaaattgatatatgcatttttcctatttagcggtcatagctgggaggagttggggtaaatggctgctttgggagttggaaatattttgcactaacaatgcgctggaattctctgcaaaacacatagagcatatcattttattttattagttctaccccaaaaaaaaaaaa

SEQ ID NO: 92099 - DNA, 542 bp, Triticum aestivum
  unsure (1)..(542): unsure at all n locations
  Clone ID: PAT_TA_92099
ttcaaattaataagccattaaaatgtcgatctgggacaaactctcaggaaggaagtcttcatcctcaaataaaggcacgactgcggctacctctttctcggaccctccaccagattcgttccaaacttctttcgatccacaagatactcaagatgtatcctcactactcactgcctcttcattttccggaccctgctcagcttcatcctctcgccggctaagaccaacaaacacttgagtatatacacttngaaagatcccttatctccggttctccccggtcaanatcggttttgccaaccaacnaaggatgggacaagacgacctaagtttatgggaccngtgttacttacctacacctngacgttnggtggggctttggggattnccaagaagntttaggaataatccccgnnggcaccaccaaactantttaacccngnctttacgcccttactaggaangcattttnaggancaacggggtnaacatcctntnaacggttatccattaatgggnaaatnccngggaanagtcattaa

SEQ ID NO: 92100 - DNA, 239 bp, Triticum aestivum
  Clone ID: PAT_TA_92100
ctcgtgccgaattcggcacgaggtgaccaccaccggcaacggcaccggccggggccagctcgcttgcgcagaaagggtacagtggaggagtggtagcagcagatctattctattcgttgtaagaaaaataaaagtttgcatttcttctcaccttgaataaagctccgtgccgaatcggagaaagggggggggggcccggtacccaattccgccctataagtgatccgtattacgcgcgc

SEQ ID NO: 92101 - DNA, 183 bp, Triticum aestivum
  Clone ID: PAT_TA_92101
ctcgtgccgaattcggcacgagtttttttttgcgcatagatcttctttatggttctatcgtattagctattgctgtggcttattatcagccagtcattggtatgtaatattgtaggctgctttggtacaatagatatgtttacctgggattgttgaaataattcatttaccaaaaaaaaaaaa

SEQ ID NO: 92102 - DNA, 307 bp, Triticum aestivum
  unsure (1)..(307): unsure at all n locations
  Clone ID: PAT_TA_92102
ctcgtgccgaattcggcacgagccgttgtcctgtaccctggcgtcggcgtcggccacctggtgccgatggtggaggtcgccaagctgttcctcaagcacggcctggccgtcaccgtggtgctcattgatccgcaaggccgatccacggacttctcctccgccgtcgcccgcgcgaggcctccaaccctccgtcgccttccactcctgccgccgccgcccgcgnttccaactccgacaccgngcccacaaacccgttanccaaatttcccnggtccctgaatccatgaagcccccttccngaattcct

SEQ ID NO: 92103 - DNA, 400 bp, Triticum aestivum
  unsure (1)..(400): unsure at all n locations
  Clone ID: PAT_TA_92103
aaaatgaggccattgtaaggagaggcatgggtatgggtttaccccttggtagttccttttcacctgttactttaatgacaaacgacaaaaagcgagtaagaattaaagacccaacaacagtctatgtcgaccaagcttgggtgtaacaaaggtttatacgaaaaactcctgaatatagagccgtgggaaaagtaaatattcctacgacaccgtactacatcctatgacaattgtactcaaaagaagaantaactccggataagacttggatcaaagaacgtccaaaaaaaaagcaagattaagcgaaaantttgggntgcacttccccnaacagcctattccttcccccaagagacatattatccnangggaagagaaagaaggtatggctcccctaacg

SEQ ID NO: 92104 - DNA, 568 bp, Triticum aestivum
  unsure (1)..(568): unsure at all n locations
  Clone ID: PAT_TA_92104
ctcgtgccgaattcggcacgagctcgtgccgaattcggcacgagcgaatacgacttcctcttcaaagtgctaattggagactctggagttggtaaatcaaatcttcttagtcggtttacccgcaatgagttcaaccttgactcaaagtctacgatcggtgttgagtttgcaactccgatctatccaagttagacgcaaagacaatcaaaggctcaagatctggggatactgctgggcaaggagagatatccggggtattacatcctgcctattatccgaggggctgttgggtgcactacttgtccnacgatatcaancaaacaccaaaccttacgnagaacgtttacaaagatggctgaaagacttagaattcacgctgaccccnacatccttatcnagncngggttgggaacaaaangatttnaaatcttcgagcctgcctacggatnaagccaanattngccaangaaanactacttncattgaactctgccttaaatgcaanatgccattctttttananaactttcanattnccgatgttcccaaaanttaaaaggggtcagca

SEQ ID NO: 92105 - DNA, 461 bp, Triticum aestivum
  unsure (1)..(461): unsure at all n locations
  Clone ID: PAT_TA_92105
ttttttttttttttagaacgattcaaccatattcgttcattatttgttttccagagtctaacttatatcccaatcacacaaacaccctttcacacagtgtgattcgaagacgacaaggaaaatcatgaaataaccgagagatcgacatggcgcggcaagaaaaagagaccctgtcctcatggcattagtgggtgcttccgtacattaaggggcacgttaggcagctgctcgctgcaggttctttgccggtgccggcgctaagtgtactgggtagcgttagtgtccaaggtgggcgacatcccatgggaagcaactaatggatgtcccggggccgccggcgatggagaccatcccctgggcggaacctcctggatgaactttgggttgccgttcnanaagggcaggaantgcatnanataaaataccacgatgccaaatttgtcaatgggggaagaaaaaaa

SEQ ID NO: 92106 - DNA, 601 bp, Triticum aestivum
  unsure (1)..(601): unsure at all n locations
  Clone ID: PAT_TA_92106
tgataacgagtgtgctctgctgctccatccatccccaccaagatccggccaggtttcttgtccatccccggcggcggcgggcctgtcttggccaccggagagcgagcgagcgagcgaggcgttgccgtcgctgcagcgcggccgagtgcgagcagggggacgcgcgccggccggtgctggccgcaaacagagaacgttgtgctcctaaacaactagtactatcttcaagcaaagctagccaaccaaggacctaagaatctccatcactccatcacctccganctcaaagcaatgggcaattaactggtcccaacaacggttgcaccaaccaagcgganatcccttggatcctgtccaacgaccactaccaccacttaccgcccgggnaacggacatcacaacatnacacacanatntctccgctggcnnatggnagactacactacaacaataccgccngggacgacacaacnagaccgcacacatcacacacaattcctcgcgcnccgatggacattcanacacanaacacacaagacacanagacacananactcnagcanacatnaccatggatagatnntttaggttccacgtagaa

SEQ ID NO: 92107 - DNA, 662 bp, Triticum aestivum
  unsure (1)..(662): unsure at all n locations
  Clone ID: PAT_TA_92107
ctaatctgggagctccggtaccgtatagcatttgggattgcaagaggcttggcttatctacacgaggaatgcgaggactgcattatacactgcgacatgaagccggacaatgtgctccttgatgcacatttctgtcctaagattgcagacttcggtatggcgaagcttcttggtcgagatttcaacagggccctgacaacaatgcggggaaccatcggataccttgcaccggagtggatctcggggcttcccatcacacacaaatctgatgtttacagctacggaatgacacttcttgagattatatcagggcgaaggaatgcagagaaaattaaggaagggaggttcacttactttcccatctttgctgcagtcaaggtgggccgaaagagatgtcatgtgcctgctggataattggctggatgggctataccaatgtcgagcanctgagctgagctncaagatccatgctggtgcatccaagatgatgaggtnacaggcaatgatgggcaatcgtccatctaaaggtgtcatggatgtnnagtgcctcggtcnagncatacaganttgtagaaggagattctanaccccaaacgactacatccttcttcccatangacangnctccatanatgnacactttaatacgnnngagaaggngg

SEQ ID NO: 92108 - DNA, 620 bp, Triticum aestivum
  unsure (1)..(620): unsure at all n locations
  Clone ID: PAT_TA_92108
ctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcaagcacggaggcctcctcaagcaggtcgactacctgatccgtccaagtgggtgccttgcctccgattcagcaagttggnttatcttccgtgagacaacgcacccctgggtactacgatggcggtactgggacatgtggaantgcctagttcggtgcaccgaccnaccaggtgtnaacgaggtggaggagtcaagaaggatacctgaccctattccgcatcaacnggttcnaaacatcnnangtgcatgcttaagttnangcttnaancacgggctgnangatccggangctaaaaantaatcacaagggcaattaagngcattgggttntnactcgaatgcttggttcctttcattacttctgtttcaanaanattggtagcant

SEQ ID NO: 92109 - DNA, 665 bp, Triticum aestivum
  unsure (1)..(665): unsure at all n locations
  Clone ID: PAT_TA_92109
ttgattccaaataaaatcaaactgcatgggaaaagtaggaaacaggaaatgaaaagactgccagacttttaaaaaacctaatcttagcatctaccaaatgctaggagaaacaaagtcagataagaagtgacaagctatcaaaagttagcaaaatttgaaaacagaccagaattcctccgaggtacactgatcagggtgtaagacacatgatgacatgaacagccgcatgcagggcatacaagatgcaacttccancccaaaaattgctactgcctccgtccgcataatataagatgttattcaaaccaatacatggagtaaatggttgtcataacaccttatattataaagacgaagcagttatccacaaataagcagttttaacttccatcaacctggacgancctgaaactatgtaccggtaccgccggtgatggcctttactaacaacgatccaaattatgttacacaggtagaaaagcanaacaatggagacatttatactangaaatacaggttaacagctatatagggctggccttgaaacatttgcaaaccagacaaggtncaatatacaaganaactatncagaacgttcaggcaggagggcctaaggaatggtctcgatcncanactgcaatgngtacatcgggcctancncangg

SEQ ID NO: 92110 - DNA, 488 bp, Triticum aestivum
  unsure (1)..(488): unsure at all n locations
  Clone ID: PAT_TA_92110
ctcgtgccgaattcggcacgagcacacaccacctcacttcgacgaccgatagaagcgctgttccaactgcaaacaggagcttgcctcatttattaccgaccattatcgactttgagattacgacgctacgtatacccgcaaggagtaaatatattggggaggaaaaggtggcgcaggagtggaaagagatatggaagagacctcttgtcggaatgatgaaaccgatatttgcgagctttttcgaccttgggaacgtttgtaggcaccaagaccgggattacggcaaattaggccggtggatttctattgtcaatgagtcaacggcaatcaccaagaccactgaacgccgccagagaagttgagctaagcttcctatgcataaacctactgtatcataacttttctgacatttcggcatgaacattgatgaagggtgggacgggagctagaaagatgtgtgcgcggactcctgttaaaaaaaanaaaag

SEQ ID NO: 92111 - DNA, 363 bp, Triticum aestivum
  unsure (1)..(363): unsure at all n locations
  Clone ID: PAT_TA_92111
ctcgtgccgaattcggcacgaggccatcttttcgtttcacgtccgcgcaagcacgcgcgactttcaaaccaggggcattcaagaagcagtttggacgacaggaacaaagatggcagagttcagcttctttcgagagccccccacctaactggtttaagaggatgtgggagagccctattggcgtcaagactgttcatttctgggcaccagttatgaagtggtctttagtcttggcgggcattagcgatctctatcgtccagctgagaagctttccctcacgcaaaacctggcctcaccgctactgggtctaantttggcncnttggtgctttgtgattcaaaccaagnaatatactactaact

SEQ ID NO: 92112 - DNA, 622 bp, Triticum aestivum
  unsure (1)..(622): unsure at all n locations
  Clone ID: PAT_TA_92112
ctcgtgccgaattcggcacgaggagagaactagtctcgagttttttttttttttttttttaccaaataggtatactcaatatctttatatattaacaaaacatgcccagcaatcgcttggatgcgatgcggtacttaggtacaaaggataaaaatatcagatattaaattggcatgcttaaaaggtgtaaaggcagctgccgtccgtcactcctccgccgttggggtcgaagtcttggcatctggtcggtgcatcctgccggcacaggcaaagtacctttgctgtgcccctttactcctccctatgcaagcaagaatgtgggtgtgtatggagaatttcctaaccgttnnaaggacatcttcancgcatcctgggntacacacccaaagtgcctgntcaagtangtgtcaacaactcacacctttaatttcctgctccttgacacattcccgtatccaacantccnacgcacttgggtgccaaaggaangcctcccncantaaaacttctgcaaagtcccaaacggtaagnaccanttgnactntcnctaaccgngancangcacnaaaatcatggntnccggaanggnacatttnacaagganctccnaatgcgccgaaaa

SEQ ID NO: 92113 - DNA, 210 bp, Triticum aestivum
  Clone ID: PAT_TA_92113
ttttttttttttttttttcggacggacggagggtacattctctcacaaacgaaatggaaccgctgacccggtcaaaaagaaaaatggaaccgctgcttctttcggtgtgattatgtcccttcatccatgattccgtcgaaatcgagccgcaggaatgccacctactgcagttaccgggctttcagttcctttcaccccaaaaaaaaaaaa

SEQ ID NO: 92114 - DNA, 534 bp, Triticum aestivum
  unsure (1)..(534): unsure at all n locations
  Clone ID: PAT_TA_92114
ctcgtgccgaattcggcacgaggtttgacgtcacaaaaggaaggtcacattatggccctggaggaggctatcatcacttttcgggcagggacgcatcacgagcttttgtttctggaaattttacaggtgatgggctgacagattctttgcagggtttatctagcatggaggtaaatagcattgttgactggaggaaattttacgttgagagatacatatttgctggtaaaattgttggacgctactacgacagcgagggcaatcctacacaatatctgaagggtgtggagatgaangcaaaaaggggtgctcagcttcttgnagaagcagaacganggaggaagatanaatacccagctgttattcaaaaatggagcgangcagagggtgaagaanttggtgcgagacaggtacccaanggtaatgaggaagccgggcgacatancnctgacnggcagtgancaaccgngccctgttcaagaagggaaccnngccgcnggggctantgngtanaaggtgtnttacatccaatcg

SEQ ID NO: 92115 - DNA, 437 bp, Triticum aestivum
  unsure (1)..(437): unsure at all n locations
  Clone ID: PAT_TA_92115
ctcgtgccnaattcggcacgaggtttttttttttttnttttcgcattgttatancgttagcanttcactagttctattcccattggtcnccttcttcttgaccaccttgcccctcaccctaacanttggtatcagaaaacccctcatacttctttcccaagtcgttacacacctgcnccaacatgtgctcctccatagcaaacagttgacgaaaatcccaccatatctgnaagattgcttcgggnggaagccggggatcccggaaggcagtggatatatnatantcaggggntttggaatttancggacttattggagatggtggtgcttcatttgcncctncggncaagagnaccantataagtcttccaatccnggaaactacngntggaaagagncttgtggnancttcccanggtcgcttatncgggngttaa

SEQ ID NO: 92116 - DNA, 633 bp, Triticum aestivum
  unsure (1)..(633): unsure at all n locations
  Clone ID: PAT_TA_92116
ctcgtgccgaattcggcacgagatctttttanagctctcatttataaattcatgccaaatgggaacttggatacatggntgcatcaccaagggggagggaaagctccgangcgtctgggtttgantcagaggataaacatangtgttaacatanctgatgcattagattacttgcacaatgacatcggaagcagcacaattatccattgtgatgtaaagcccagtaatatcctccttgatgatgatatgaatgctcacttgggagactttgngtattgcgagcttctatcagggtgctagttcgacaccaactggcgattcanatacagtttccgttcggcgtcaagggaacagttgggtacattggtccaaggtatatatactagttcctangtcttacagcaatccggattgcagaaaccaggttgatatattttgcgttaaccctctnttnatccttcctcaaaataagcgggaggtggcagcatcactgcgggactttaagtttgggatgtaatcggagagctgacngganaagcancantgatnattagaaggactacatgcantcgaaaggggtttcagncagtatgaagcacgagcgnctcagaganggancccaanacaanntag

SEQ ID NO: 92117 - DNA, 394 bp, Triticum aestivum
  unsure (1)..(394): unsure at all n locations
  Clone ID: PAT_TA_92117
aaaatagtggtgagaactgctgcataatttcatcagcgtctaaaaagcgagaaacacttatattcgagaatttacttaccctagaagatgactcaactccctttccaagtgctgcacgtctagtccgctttacaacacggaattgatcagcatcctaaggaaaaaataaaaaaacatgagcatgggaaaaaaataaaaaaatgttatatgacccaaacaaaaccgaaaaatgggcttgtgtcatcagcttgccacttacctcaacatcctctccctgctcaaacactccgcgcaggtccgtgggctggcgattagcangacacttccgattccggcgaagcgactgacttccaagaacgctggattaagcaacccaaaaaagaaaagaaacatg

SEQ ID NO: 92118 - DNA, 164 bp, Triticum aestivum
  Clone ID: PAT_TA_92118
ctcgtgccgttttttttttttttttgctgtgatattagaggagggaagtttatcgtatattgactctgacataaaacttgcttcataattttctttgtccacatctcccgtacttccaacttttgacggctcgctgagttgctcattatcgtcgatgagatgtt

SEQ ID NO: 92119 - DNA, 644 bp, Triticum aestivum
  unsure (1)..(644): unsure at all n locations
  Clone ID: PAT_TA_92119
ctcgtgccgaattcggcacgagcaaatccacacccaatctcgtctccgatcgactcgagagctcgtcgaatcctcctcccccatcgtctcaagatgcagatcttcgtgaagaccctcactggcaagaccatcactctggaggttgagagctctgacaccattgacaatgttaaggctaagatccaggacaaggagggcattcccccggaccagcagcgcctgatctttgctgggcaagcagctgggaggacggccgcaccctgggccgactacaacatccaagaaaganccacccttcacctgggtgctccgcctcccgtggtgggtatgcagnttttggtgaaaccctccaccggcaagaccatcaccctgggagtttgagantcctgacacatttgacaatgttaangctaagntccaagacaaggaggnatcccccggacaacacgctgatctttgctggnaacaactggaggacggcgcacctggccgatacaacancaagaaagancaccttaactgggntcccctcgtggtggatgaaatttgtgaaacctcacggnagacatatcngagtganactcgacacatgaaagttaggcaanntcaganagaggnatcccgacacanctattttntganag

SEQ ID NO: 92120 - DNA, 612 bp, Triticum aestivum
  unsure (1)..(612): unsure at all n locations
  Clone ID: PAT_TA_92120
gctgctcgtatactacagcgtgaccatggcatcaatgtaaatttgactctcatgttctctcaagtacaagctattgctgccgcggaagctggcactttcttaatctctccttttgtaggccgtatactggattggtacaaagccaaaactggaaagacatacagcaaggaagaagacccgggagttgagctgttaagaaaatattccgattattataaaaagttgggttacaagactatccgtcatgggtgcctcattcaagaaatattgggtgagatcacagaattggctgggctgtgattacttaacatctctcccaaacctattggaagaattttagcgtctggatgctccccgtaccgaaaaantcngatgcatcngggtgcagcaanctcaaatattgagaaagaagataccttggattgcganctctttcccgattgattcaacgaggatcaagtggccgtagaaantactgaaggacaanaattgctgctgagcacacattgaagntatcctaggangaagatgaggttactantaccaagaaataaaacattagtananaagaaaaacccagggggccgtncaatccctaanggcttagcccnn

SEQ ID NO: 92121 - DNA, 613 bp, Triticum aestivum
  unsure (1)..(613): unsure at all n locations
  Clone ID: PAT_TA_92121
cgagtttttttttttttttttttgggcggtgtgtacaaagggcagggacgtaatcagcgcaagctgatgacttgcgcttactaggaattcctcgttgaagagcaataattgcaatgctctatccccagcacgacagagtttaacaagattacccaggtctttcgaccaaggaggaaactccgttggctctgtcagtgtagcgcgcgtgcggcccagaacatctaagggcatcacagacctgttattgcctcaaacttccatcggcttgaagccgatanccctccaaagaagctagcaaccagccaaagctagtcnagtatttagnaggttaaggccccgtnccgttatcgcaattaagcaagacaatcatcnaccaactaagaaggcatgcacnaccacccacaaatcaangaaaatccaacggtaacctnaatggtgtcnggccngggattccccgtgntgagcaaataaacccangtnaccctggggggcctccgtnattcttaatttaaccttgcgacatccccccaanaccaaanattgattccnnaagggcnaggagcaaaaanaaacnccgntctatcgnaattangtanaaacaagtactntctcn

SEQ ID NO: 92122 - DNA, 324 bp, Triticum aestivum
  unsure (1)..(324): unsure at all n locations
  Clone ID: PAT_TA_92122
ctcgtgccgaattcggcacgaggcaagcaggacgccgcagtggctggggccagctcggaaccatctggcaccgagagccacaagaaggcgggagcagagaaggaggtgggcgctgatgtagcagaccaatcctaagctattagtgttaggcaaacataacgccatgtattatgtatactataagaaagaaagaaagctcgtcttacctgtcgttctgtccgggattgtcatctcactcactctaaattgttgtaggcttgtactagcaattgtggaataactcgcaagcctttgtccaaaaaaaaannaaanaaaaaaaaaaaa

SEQ ID NO: 92123 - DNA, 667 bp, Triticum aestivum
  unsure (1)..(667): unsure at all n locations
  Clone ID: PAT_TA_92123
tttttttttttttttttttttggaaaaagaaagtcagccaactgatgtttaggcgatcccttattttaccaagtctctgctctcaagtacagtaaccaacagacctccctcaacctcaagacaaataatcatcagtagaactagagacactcacaccactcgcgccactttgtgctccgtttgtcatgactcggcgggtaggttcgaagcaacctcgctcttgtcctttttgggatttggatggacttctccgtttcccacttggtcctccttgttggcgtatccttcacgtcgtcttcctccggcggctttgatccttgtcttccgcggcgctttccttccttggagctggtcgatnnaggcgagcgagcaagcgtcggcgtcgcgcgcgctgcgcttgggacggatcaggactcggcacgtccgccggcgtcactccagtcgcgcaacancctccgacgnaccgaacncgggtgccgtcactcgaggaattccggcaactctgaangctcnaacccatagaactcaatggcagtcaagcnccgcccggntancccggtcaactttcaagtggntggtgggaagnaagatcnccncgcgtcgcgccaaacctcataattncagcggnaananccaggggccgncatnccnaaggccttanccgnng

SEQ ID NO: 92124 - DNA, 484 bp, Triticum aestivum
  unsure (1)..(484): unsure at all n locations
  Clone ID: PAT_TA_92124
tcatttacagctttatcgacccatagcccataggccatagccaattagccatatggcaaccaaatcgactcaaagcacgggaccttcattcttcaacttcctaaaggaaggcctcctgctcccgacccgcaaccggaggctcttcttggcggtctacgccatcatcatcgcctccaccgcgctgctcctcctccggcggcgacctccgccgtcncanccctccgccgacgagattccantccgacgccnaagcgcctgaacanaaccgaccccggcagcccggacttttgccaantcccttgcaggaatttcaaggatgacaccaagnntcctgtccnnntggcgccggggtactccctgtcnctgttgtccttaantccggcntccggttgtctcctctttgcggccttttcaaantatccgggnaaggacacacgtacttggctttgggcccccctggggaaaccaaggcagttaanggctc

SEQ ID NO: 92125 - DNA, 566 bp, Triticum aestivum
  unsure (1)..(566): unsure at all n locations
  Clone ID: PAT_TA_92125
catcattgttataagccgaaaaagtcggttttattccacaacgtttgatagttatttcttctataactatctgcattaatgttgttaatgcgttttgcattcccaaaccatgtcctctattggcatgatatgtattgccatcgagttcaaacatccaattatcgaaaaaataaattgatgaaaaagttctgagttaggaaatcgctcatgaagacagctaacattactctagatagancctgttttccgttaggcttcttttttgaancccggacaataaccccaacgttccgctacatccttcngttccganttttggtgatcccatccgagtacttcctccggatggcgtcaattaactggatttaacataatgttaggccaagttccaaccttacccccggtnttggagagnaaccttccnggtcnctgtcaaccaacganccttaaagcaatcccggtgttcaaccgcactgtctttccnctacccctggganaagnnaacaaattgcccctaaaacaagtgtcgggcattccattagactttgggtcnctgtatgcaaata

SEQ ID NO: 92126 - DNA, 518 bp, Triticum aestivum
  unsure (1)..(518): unsure at all n locations
  Clone ID: PAT_TA_92126
ctcgtgccgaattcggcacgagtatgaatgaagccgatgaatgcgtaaacaagctcgaaactttcaagagcttcaaaattctcggcttcattccaactgatcagcacaagaaatatctagcaatgggtgaaagctgtataacagtcgctcaacctgtcaatgataggtctcagttggcaatatcatcgctcgttcatgctctccttgaactagagtcctatgctattgccagaattgtacttaaaaatggagcagagcctggaattgttcttctagcaccatatgttgaacaaggantactnggaggctcttgtcatgtacccttccctttttcggaagactcatatctatcaatttcacaatttgaaaaggaantacaggctcaaggngctgagttcaagaataggnaatntggaatnaaccacttaatangggcaatnagggataagtgntcnanggaaanccaatttngaaaaattanaaggcacctcgggtttncncgtttaanaanattcaaa

SEQ ID NO: 92127 - DNA, 350 bp, Triticum aestivum
  unsure (1)..(350): unsure at all n locations
  Clone ID: PAT_TA_92127
cgaattcggnacgaggtaaatacgcacggtgttcacacctaattctttaaacttggcaatgtcgcgcttacaacttgtctcatcagctatgggatcaactagcttagatgatccaccaggctggtagtcaattccacggatatagaatcggntgtctccctgaaaaaatgcgnttcctttgactgttattgncgttatcggtttggnatcgcganannacaaggaacctgaagatggtgatatcagagctcncgtcaccacggaaatgngccgcaattgcgtgtgatttcattttgatgttaatttcantcgtgatcagtatgnttctacnaacttaagttgtcanactg

SEQ ID NO: 92128 - DNA, 556 bp, Triticum aestivum
  unsure (1)..(556): unsure at all n locations
  Clone ID: PAT_TA_92128
gcacaatcgaaataatgtgtggccgttacgtgttggctcttaagcctcctgaaatccgtgaagtattccggaataatggaatgaatattgaattggccccagaggatacagtaggccacacgcctgaaataacctacaaccttgctccaggaaatcatggactagttttagttccatggaagcactacagtagcaaagatgatccttcgtccaaaaaaaacctattcgtgcaaggggacgcatcgatgaataaagaagtttcagaatccaacaaggtcaactatcacctacagacaatgaaatggggtttccgtcccaatgtggtcatcaaagaattctgtaactgggtgcgagtcctacactcaattaactgccgttgacgactcccttancagaaacaaaatatatgggatcacttaaaaatanaatccgtgtgtggnantgctcaggggtctacnagtgggttanaaaagcaaggttaaatccttccatattatnnaagggacaaaactatancatgnaggttatcaaaatattcatnacggaacatgtaaaa

SEQ ID NO: 92129 - DNA, 601 bp, Triticum aestivum
  unsure (1)..(601): unsure at all n locations
  Clone ID: PAT_TA_92129
ctcgtgccgaattcggcacgagcatgcttacatcagaagatgatctcgcccctgcacggagaaattacccggcaggtcactgtgtgttagctgtcaaccaaatttgtgctcctgaacagagggctaaaggcttgaataattcaaaatatggcatggaaaaaatctgggcatggtctagcaatcacacgaaggcgtcgtaaacgacatgcccaaatgacccgtcttgacactatttttggaacatcttgctagtcgggccacaagttgcaagaatctatcgacgacgaccatgagaatatgatctttaatcgcgacagaagagtcgattcataggagtgcagaattctgaaatctagacatgccagaccgaactgtacccaatgcggagtagacaaagactccaatcttcgatcgctaccagcttttgtgaggctcngttggtaatgatcccgtggtggaaatgttatccatcacgaaattagaacaaatgtttctactaaacgagtaagactnnatatcagttaagatgacacctacacngaaaataattaattaccagtattcncgatctcaatcccatattacatccaaaaaaaaaaaa

SEQ ID NO: 92130 - DNA, 523 bp, Triticum aestivum
  unsure (1)..(523): unsure at all n locations
  Clone ID: PAT_TA_92130
tttcaaaagaatcccatccaaggtgtcgttggacgaaatggagaggtctcagagctatattggtgtcggcgaaacggaattgaagaatcctacatcgtacgcgctaaatacgactagaactttaagtagtgactccggtagggaagtagcagctctctgtgcagtgggtgctgccgttcttttcgccgctgcgcttgtctgttagaagtaaagggaaagggagatattaatggttcatgggtaattagaaatactgatgataatggttctgtccaggcttgggcctaacctccactcaagattggagaaaaaataaatccgtggatttgggctagaatgactggggaacttcccaaaaaagattggtttngaatgttagtanagattaanaggcttgcatgatgggagncatacaacgaatgatgcaaggcttaacccaaggcgaaacaaaaatccaaattatccttaacctttgcaaaaaaaaggggggcccgtaccaatncncccaanaggatcctatacc

SEQ ID NO: 92131 - DNA, 348 bp, Triticum aestivum
  unsure (1)..(348): unsure at all n locations
  Clone ID: PAT_TA_92131
gagagaactagcttacaagaccgtgatccgcatcagacaatgagtggaaggataattcccatcagaagaacatcgcagtcaggccnccaggactttattattgatggnaatcctacaagtantccagggagtccgcanataataactcatacagccagtataaactccaaaaatgnttcaaatatgaatagnacaatgtccanancctcnacantgancacaactgagcaaattgncactgganaacaccgaattacaaaatctttcancagtggcaccggtacangtcccacaaagaaacctccaaaacccanttggccaaacctggaataactttncnantttggg

SEQ ID NO: 92132 - DNA, 400 bp, Triticum aestivum
  unsure (1)..(400): unsure at all n locations
  Clone ID: PAT_TA_92132
gtttttttttttttttttttttttttttataataaaatcattaaattatttctgaaaatcatggatttttcagttagttaattaaggtttgagtgacaactaaatcacatacccttttgatctttgacgccccacgcctagatgccaacaaaaactcatatctagtcgagtattttacaactcgtcgcttcatacgtacatattttatgtgagaagatcagcaacattcaataggcatctcatcaatttgtgtcgaataatacaatccgatgtccccttaaaaccctgacacctcaactgggtgacaaaagttgattggnaacaccctaacgtccaaacctacacttccttcccaatccgggtggatataatccccaagatactngggnaattcaaaagt

SEQ ID NO: 92133 - DNA, 634 bp, Triticum aestivum
  unsure (1)..(634): unsure at all n locations
  Clone ID: PAT_TA_92133
ctcgtgccgaattcggcacgaggttccgcgaggagttcaagcagaagaaccccaagaacaagtccgtcgccgccgtcggcaaagcggccggtgagaggtggaagagcttgagcgaatcggaaaaggccccctatgtggccaaggccaacaagctcaagggcgagtacaacaaggccattgctgcctacaacaagggcgagagcgctgctgctgctgccccaaagaaggctgcggccaaggaggtagaggaggaagatgaggaggaatctgacaagtccaagtcggagatcaatgacgacgatgacgatganggcagcgatnaggacnaggacgatgacgagtgaagaagaccatcttgtcaaggctgctccggcggacaatcggganctgctgtgcaaaaacggcctgancttgtgngtggtgtataaggagcctatcatctccactagaattacccaatttnacttanatcgtanttgnttacttttcctgtcattgncngctataacgggtacgtcctgttgnccccgcggggggatnctatgtggaggttttccctccgcggggccgctgtccnaaaggtnccttcctcatngtcggnaattnganaanaatcgggagttantaaaaaaaa

SEQ ID NO: 92134 - DNA, 421 bp, Triticum aestivum
  unsure (1)..(421): unsure at all n locations
  Clone ID: PAT_TA_92134
ctcgtgccgaattcggcacgaggaattccgccatgattatgacatctggcaagcttctagtaggtctaagcctagcattttcagcagtgactgctggaacgttcaacactgctattgaacaaagagtccaaaggaccactatctcgaatcaatggcgtaataatgtagagataagctcccccttatatcctgcaaactatctgtcggtacccattgatcatttccacaatgattctctgtatgagccccacaccgaggagatgtttaatctgagatactggtttgacgctacatactacaaggcaaggtggtcctgttatcgtctacaagcgggtgaaacagatggaagtggacgtttacaatatctaacnaaagggtccttnacaagctgatantggaaccaatggattggngtggtgct

SEQ ID NO: 92135 - DNA, 571 bp, Triticum aestivum
  unsure (1)..(571): unsure at all n locations
  Clone ID: PAT_TA_92135
ctgctgtgacatcctctcatttaaacgatatatacgtggctcatgtcactatcacttcttaatttatcggcgtgcaggccactaattactagcagtggtggcactgctagagccgccacagctacactttccgctgatagagtcctcctttgcccacgtattatctggcgtggtgtcaaggccggatggtatacggggcccaagcgcggtgccaaacctctcaactataacctcggaagtggccttcctcagcttacacagtcgccagatgcagcacttgctcgcctcgaccattctctcccgcgtcgcancggtgttctcgcaatcaaaaaggcatgacagtctccacaatcccgaaacaagtcgacgaacaacctgcacgtgttgcaaatggntcggtcaagtanttgcacacaagacgcgcgagcaacatggatactatgccgtacagtcggnagtggtggaagccgctgacaagtcntcggccctactgggtacttgacatcaggtgtcagcctaagcgtcaccaattgaatttcggtccatcaacggaatccaatatggcaatctg

SEQ ID NO: 92136 - DNA, 628 bp, Triticum aestivum
  unsure (1)..(628): unsure at all n locations
  Clone ID: PAT_TA_92136
ctcgtgccgaattcggcacgagctctgatccgccggggccgcaaagcaatggccgccgcagcggcagcaggcgcggcatcctcccttgtcccctccacttcccagcgccgtctccccttccgtcccacccccacccgccaacccctcctagccgccaacaggaccctgacgctctccccgaagccaccccgcctcctgcatcccctcgccgcgtcctcctcctctccgcctccgcccgaggatgctgagccaaccgaccccgtcaagctcgccttcgcccgcgccgccgcgtacaaganggagaggactaatccgacgcccaagccaccgccaccgccaccgtcgccttcccctccgcggcagccttccgcaaaggagtcaannggaagcaaagaggcattcaacgggcnctggagtaaaggaacggaaacggggaaggactggncggnggttcccggttttaatcgtngcngantttcggcaaagnagttacaataaanaggtgattggaaanngnaaggaananggaggttnctacataaacggttttgggctggttttcaaaaaaacttnaggccaacaaggttnaaggatttctttaataanttctnagggaaaaaatnggccn

SEQ ID NO: 92137 - DNA, 621 bp, Triticum aestivum
  unsure (1)..(621): unsure at all n locations
  Clone ID: PAT_TA_92137
ctcgtgccgaattcggcacgagcatgatgccatattcctccagacctctcccgtcgcacttgcgtcatgtttcaaacacaagcaattttacactgtcaggacaatcaccaaagctacttgcacgtatagaggaaaaaaaacttgagctagcaaatttaaaacaacttcgagatctaagtgccagtttggcccagcagatgcaatcattgggaagagaaacttgctactctcacggatgggcactgaagctgtcgccactgttttgagtaactgggcaatatgtcctcaaagctattaacatggcatccgagtagtctctccgattaataaataaaattaactggagaanccaagatgcngttaataacccanaaaatgagacagaggacaatactttactccctaacgagtantctnncaaaagnaacggttcgaataccaactgaaatnaagaganttaaagttnaanggccttaggaaacnagntaacanaggatannactttcctngnaaactgatatgaggttggggtnacaaaataaccntantctgngtcgacaanggtatgctatgacaaaattatctaatggcanagttgcctgggaaaattcattagtatac

SEQ ID NO: 92138 - DNA, 425 bp, Triticum aestivum
  unsure (1)..(425): unsure at all n locations
  Clone ID: PAT_TA_92138
gcgtatcccatactattacttggccatccggaccctcgacttcttcattaccgcacatcacccacctctcccgggctccgaagcagcctcgcatgcgaaattgatcattcttccagccttcggcccggtagctcttgaggaggccgcctgtttcggcgtccatcagccgaatctgattatcgagactaccgaccagtanacctctcccatcttttgtcttttttaaagaagtgacnggtgacccaattacatctgtcaccacctttcaacatcgcanngtcatacttgcgtacgcgtcaatctacactccccgcccanantgtcgccgtcgcancnaagtacccacctgacactgtctcaagcctcgctgagaacaataattggtttcangttacaactttttacatccnagntgcgganctcgc

SEQ ID NO: 92139 - DNA, 623 bp, Triticum aestivum
  unsure (1)..(623): unsure at all n locations
  Clone ID: PAT_TA_92139
cgacaatccctacgtggccaagctgtagtcttgatgggcaaaaacaccatggtccgtcgtgctattaaaggttttatttctgatgcgccagagtacgaatgccttcttccatacgtcaagggaaatgtagggtttgtctttacaaacagcgaccttaaagaaatccgtgacaagattttggcaaacaaagtcgctgcacccgctagagctggagccgttgctcctgctgacgtgttcgtacctgcaggtaacaccggtatggaaccgggaaaaacatctttcttccaagcactcggagttccaaccaaaattgctcgaggtacaattgaaatcactactgagctaaaacttgtggaagccggaaataaggttggagcctccgaagcaacacttttgaacatgcttaatatctcccctttcacttacggtatggggatctccagattatgataaagnaacacattcccaccgaatgttcttgacatcggagaagtnaatctaaaacctcantgctgcnactcacatngctcatgtacagcgtnactccgaatacactgcatcatcctgtaaggtaaaaatgtacanacacaacatnattgcaaggtagatagncgaccancgnn

SEQ ID NO: 92140 - DNA, 490 bp, Triticum aestivum
  unsure (1)..(490): unsure at all n locations
  Clone ID: PAT_TA_92140
ctggtgccgaattcggcacgaggagcattctaccaccgcaccgcacgagtgaagtgagagctttgcacgaaaacttcatcagaaaccatgaagggcaccaagctcgcggcgatcctgatcctccaggccgtcctggtcatgggactcctctcacacgtgaacgccgattttttccccaagtgctgcaacaactgcaggtccttctcgggggtcgacgtctgcgacgacgcccaccccaagtgtccccagggctgctcggcgtgccgcgtggtgtcgacgagccccgaaatgtggcgctgcgcggatatgaaatccaccgtcgacggcacctgcggtggaccctgcaagaagtactgatcggttaatgccggnatgatatgttccgcctaanantaaataaaagtcaggcnanatgagaangtcatcctgcctangctttgtgtgtggcaaaaatcttatacaanaggtcgtcccttcntcnctgtgtttc

SEQ ID NO: 92141 - DNA, 665 bp, Triticum aestivum
  unsure (1)..(665): unsure at all n locations
  Clone ID: PAT_TA_92141
ttgatcacccaacaacacgagtctgctgcttcacagctgcctcttgtttagataagtgaggtctttcgtgatctgcacagagttacactttcaagttctctattaataaataggaaacctactcgattgcaacatgtgcagtgcgaaaataccacgcaactttaggctgctaaaagagctggagaaaggcgagaaaggcttgggtgtttgaaacttgctcttatggctttgttggatgggagacgagatgctcatgtccaaatgggatgggcactataattgggcctccacgttagtgcacatgagaatccatatatccctngaaaatgtatgtggtgatnnaataccctggataancacctacatcaattccgggganccgantnacctaccttggggttaaccaaaataatggaagtttatccaacaaacacctgtttacaaacgggatacatagacnaggaacgtataacgactaaaancnaggnctcctgaaacaagantactcacaccccaggggggggcgtacattnncctaaggatntatagccccacgcctcnttnactctacngaaacctggtacaactacccctgaaaacccttcaatggtancaaggccncgttcctccaattgaccatganggnccccttggataacggggtg

SEQ ID NO: 92142 - DNA, 520 bp, Triticum aestivum
  unsure (1)..(520): unsure at all n locations
  Clone ID: PAT_TA_92142
ctcgtgccgaattcggcacgagcgcaactctctccatccctcctctctctctctcgagctcgtgctccagagaaggtcgccgacgtcgtcgtttgccgtcctcgtggcaagagaccaccccgagcccagctgacatgtcctgtagatccgcctcgtcgccctcttcgtccctctagaaggaatcgcgccaaggtcgccgactgatctcaagcatggagcttgtgcggcgctcccccaagcatgtggccgcagtcttttgcagctgccgcgagccatccgtgcgagcccgcttcaacgacttaatcgcttccaaaggccgcactggaactcntcccttcccctccctggattttgcaaccgcccctgggctctccggcatggggggttnttaactnggatttggnntaattcggaccncctttgggggannanatggctcgncccaaccctggggtngttaangatggagggggtgctnggtcnaccnggaaggaaccnccactggatttanaagggtagg

SEQ ID NO: 92143 - DNA, 479 bp, Triticum aestivum
  unsure (1)..(479): unsure at all n locations
  Clone ID: PAT_TA_92143
ctcgtgccgaattcggcacgagtgaactctagttataagaaaaataattatgaagagaataatgacccctcagtcaatgacgttgtagagcgcattgattcaggtaactaccaaagtaaatctaagtacaggttttgtagtcacgtatatttaaacaatttgacctaattgttggccccaattactctaactcctgaaagtcanagttatatttagacgacaaaaggtcaaaaacagaataatttatatattcatatttacctatcccaggttaccacctagatattaacttcacccaaatttatttcttatcattcaagtagtaganaatgacattcganatcatcctaggcatnatattacattatcctggtccatgttgagtaaaangggctcaaaggaatccaanttactctaanatgtggattanatcaagtagcganaacttggatgaaattcngactggnttagtangaggc

SEQ ID NO: 92144 - DNA, 216 bp, Triticum aestivum
  Clone ID: PAT_TA_92144
ctcgtgccgaattcggcacgagtagccccgcagattattctactccgaggcatacgtggtaaattctccttctcacagactgagtgagtggctgacagtgattcgatcggcagtcagacagtccactcaggctcagaggtttttttttgaaacactcaggctcagttatgactgacacggtgctaaatatatactgaagtgtacaaaaaaaaaaaa

SEQ ID NO: 92145 - DNA, 625 bp, Triticum aestivum
  unsure (1)..(625): unsure at all n locations
  Clone ID: PAT_TA_92145
cgaagagattatgcgtcttattgatctgtctgctttgtcagtattggtcaacgatcgaccaggaactatctgttggatcgttctctgttttgagggatctcggatctcgattcctggttgcattaccaccaaggagctgggaactgtcatgcgttccctggggcagaatcccactgaggcagagcttcaagacatgatcaatgaggtggatgctgacggcaatggaacaattggatttccccgaattcctcaaccttatggcccgcaagatgaaggacactgatctgaggaagagctcaaggaggcattccgtgtgtttgacaaggatcaaaatggtttatctctgctgctgaactgcgccatgtcatgaccaaccttggtgagaagttgactgatgaggangttgacgagatggtccgtgaggctgatgttgatggtgatggcagatcaactatgacgaattgttaaagcatgatggcaataagttcattacatctgagggaactcagtaacagncaanatatactatcagggcatttgtggatggtatgataaccganacataacgcgtganagtgtagaagatgttgctganattaaatctgccggctcnaaaaaaaaaaaa

SEQ ID NO: 92146 - DNA, 239 bp, Triticum aestivum
  Clone ID: PAT_TA_92146
atgattcgagtaaactacgaagagaaatctagcaaatcatgcgtgagttgagagctgaaaatgtattgttttttcatcctcattccgcccatgtgatttcttggttagaaatagccagctatattgaaagtggagagtcttcaggggctatgtatgtgtatgaagcctcctggatgttcagctctagccaaatacgtaaaattattgaattaaatttaaccactgccaaaaaaaaaaaa

SEQ ID NO: 92147 - DNA, 456 bp, Triticum aestivum
  unsure (1)..(456): unsure at all n locations
  Clone ID: PAT_TA_92147
atgaaacgatatcttcctgtcaaccttacatcggtggaatactgtgggttcgttcaatgcttgaccgagcgaaactgtcaatgcgcttcttggtcacattagcccccccatttttattgtgtccgggcggatcagctacaaatttgcacaacattttctagtttacagatttactttgacatcgactatgattttcaagtggtaggggacgaaatgtggagaaagtaagagttccacctatccgatccgtaaactaatttcccttnaagcacggatgaacctatcgagtgggcttactaactactcctttaatgaacgttggagaatacaggatggacgacatgtccttattatcctaagantttangcaatgtgttcaaagttccgctaatagctgattngagcaaacgggtttggtcataataactcccaatggtgataccttttgcgatacaa

SEQ ID NO: 92148 - DNA, 181 bp, Triticum aestivum
  unsure (1)..(181): unsure at all n locations
  Clone ID: PAT_TA_92148
gcggaatactaccaacgctccgctacggatcgcaaaggcaaaggtcggggcttctaaagatactagagacacaacttctgtctcaaagactggtgaaaaacggnggtgagggtaaattaatcgacacctagctgagggagcaatggcnatgnaatgncnaggnaatttgggnaatttccaa

SEQ ID NO: 92149 - DNA, 297 bp, Triticum aestivum
  unsure (1)..(297): unsure at all n locations
  Clone ID: PAT_TA_92149
ctcgtgccgaattcggcacgagatcggaagcaaaaaaaatcgacagaaggttccactttgtgtgctaacatcagttctgacagtgcccatgaaggtttacagaagccacctataaaaaatatgtacgagggaagtgatcccaagcaaaaaggattcacaggggggcaaagttgcttcaaaggaactgaacaaaggaatgaacccanggaagcagcagtcacgccacaaggattgcaacctcaacatgcaatatgatggnctcanaaagtttattgggaaaaaaatcccagggggggc

SEQ ID NO: 92150 - DNA, 486 bp, Triticum aestivum
  unsure (1)..(486): unsure at all n locations
  Clone ID: PAT_TA_92150
ctcgtgccgaattcggcacgagcctagtgaacatttttctgggcttaaatgcctaaactaaaaacaaacattaccatactaattactcagctaacanataaacaaactagcgaataaaatcaaataaactctccaaaaattcaatattcaatttccaatattttctactgattttgaagaagtcatattatcttctctctttattttaaaatatttggaaaaacaattttgaaaaacaatttgacccaattaccangattttgnataaatcaaaattgaatttttgtgaaacctccaactctctcaaattggnccttgagntgcttaaggcctcttggnatcaaggtcaagtaaaacaaggcanncantggtgcatagnncatgggtgtacaangaatgatctatgattacaatcaaattgaaaattgggatgtacanactacganccttangaggatcccacctccnagggggggnccggaccaa

SEQ ID NO: 92151 - DNA, 664 bp, Triticum aestivum
  unsure (1)..(664): unsure at all n locations
  Clone ID: PAT_TA_92151
ctcgtgccgaattcggcacgagcctcctcctagcaagctatatacctacatagtacagccatggcccccaccgtgatggcctcgtcggncacctccgtcgctcctttccaggggctcaagtccaccgccggnctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcancacggaggccctcctcaagcaggtcgactacctgatccgctccaatgggtgccttgcctcnagttcagnaaggntgggttatcttccgtgagnacancgcatctcctggganacaaagaatggcnggtttggaaaattggaatctgctnttttgggnngaatggcgccaaaaaggnttaacgnggtggaggaggtnaaaagggtacctnacgcgttttccgnacatcggttcanaaatggnaagtnantggtaagttnncgccttagcacgggtgcaagatcnnnagcctaacactatcagaaggcatnntaangcattggtttncacctgaatncttggttcctncaatacttctatttccaacaanggngccntcantcaaangccaaaaatcttt

SEQ ID NO: 92152 - DNA, 574 bp, Triticum aestivum
  unsure (1)..(574): unsure at all n locations
  Clone ID: PAT_TA_92152
ctcgtgccgaattcggcacgagcttctcctcctcggatgccggcccggccaccggcaccggcagcctcgcagcagttggcgccccagaaaagcctgacgctggacttcaccaagccttcgaaggcgccggcagcggcagccgctgcttcggtgacgtcgacgtctttcttctcgtcggtgacggcggggggcgagggcagcgtctccaagggcccgggccagctggtgtcctccggaaagccgccgctcgcggctggtaccaaacgcaagcaacagcagcagcagacgccctgcgcgagcggcgcgcactccgacgtcgccgccgccgccgccggtggccggtgccactgctcgaagaagcgcaagcaccgggtgaaatacacacgcgcgtcccgcggtaagctcgcgcacggnggaatccccggggaagacactcgtgggcaagtacgggaaganccatcaagggtcccttacccgctgnacatagtgannacgnaaaggctgccgtgcgaagaatcaacngcaacgacacccgcatgtcatcgcactngaggtgcacgcncacattgcgcgc

SEQ ID NO: 92153 - DNA, 186 bp, Triticum aestivum
  unsure (1)..(186): unsure at all n locations
  Clone ID: PAT_TA_92153
ctcgtgccgaattcggcacgagctcgtgccgaattcggcacgagcacaaacacaagcacagatcggtcgagattcaaggcaaccgggagcaatggtnggcnanaaggggctggtgctgctggncttcngggtnagcccgttcgggcagnncgtgagcatcncgctggacgagaagggcctgnncta

SEQ ID NO: 92154 - DNA, 577 bp, Triticum aestivum
  unsure (1)..(577): unsure at all n locations
  Clone ID: PAT_TA_92154
ccttgacttacaccagacttatcaaccgaatccactattacgatgtgtccatcctgcgaaccggagacggacatcaatggacatgctcaaaatcaaaattccaatggaatcaacggatcatctgctgtttctcccgataaacaccctgggatatactgccattgagaccaagatgaatccacatcctactagctcaaacccttatcgccctgtcggtgacttcctcagtaatatctctagcttcaaaattattgaaagtacgctacgtgagggcgagcaattcgcgaatgccttttttgataccgagaaaaaattgagattgccaaagtctccgatgacttcggcgttgattatattgagttaacatcgcccgctgatctgagcaatcaagagccgactgtgaagcatatgtaagcttgggttgaaagcaaaaatctacaacatcgctgcanatggatgatgcagatactgtgcaacggagtggtggataaatgttgtatggantctcctactaatnggacatccatgggaaggcannctaatacaatcngcatnaatgtaattgcnagtccaaaat

SEQ ID NO: 92155 - DNA, 369 bp, Triticum aestivum
  unsure (1)..(369): unsure at all n locations
  Clone ID: PAT_TA_92155
attgacnacaaccttgntaagatcaagaacgtgntggcagtgtangaagcgcacctgancaantccaaatnactgnctggagantcccncagtcttgcagaccttaaccatgtgtctgtcaccctgngcttgncggcnacaccctactnatctntgttcgacgcgtanncacatgngnaggcctggtngactgacctgttggcgaggccgtccgtccanaatgtcgctgagctgatgaagacatgatctnanattctggcgctcgatcgtcgcnaantngtcgaggtgtgncccccctgatgtgtgnctgtacgantgtgtgttcttgaangtctcctcgtgtngattnttcaggattgtgcttgcgat

SEQ ID NO: 92156 - DNA, 657 bp, Triticum aestivum
  unsure (1)..(657): unsure at all n locations
  Clone ID: PAT_TA_92156
tttttttttgatgaaaaccattcgattggaattaaattgaccgagacaactatctcctgcaaccattttcttcacagatagtaaattacatcctaattctggtacaaaaagtgtatttgccaacaagatatattttccatcttgtaatttcagcattgctgtcccaattccaactgaataaataaagcctccaccaacttgaatcttccttcggcagggtcttaatgctgaatgcgtttttcccataagagaccgccaaattcttcgtcattggactgggactcgtcataggagtcattctccgcaaattttgcctgctcgttgcggcgaaaaggtgatgatacgcgagctttgggtgatgaattatgtctcaagttagctgangagctaggnttgttgctgcnccgggtgaagcaaggtacnaacatgcgaagtttaccttgccgttatntnacaangggggaagtaggattgggacntaatcnnccctcncctcccccngananagctttcctgnggttnaaccnattcacaatngcaagaaanctggnngcgatnagccantnaaaacccagggggcggtacaatnncnaaaggaccattaccgccaaggcgtgttaagtcgncnggaaacnngtacaataccttggaaacctt

SEQ ID NO: 92157 - DNA, 363 bp, Triticum aestivum
  unsure (1)..(363): unsure at all n locations
  Clone ID: PAT_TA_92157
gcctggttttgaacatttantcgttaaaccaattcattttcatcacataatatacacgcatctgagatatanagatggtcgttaacacagttacaagtcttgatgaataccgaaaactcactaagaatcatgaacatattataattcggttcacagcggcatggtgtggtccctgcagaatgattgctccagactttgaatcgttatccaatgattanaaagatatacatttcattagcgttgacgtngacaantctccggaactatctactgagtttgggantcacagccatgccaacgtttgtgtctancangatggtgancaacatantgaatttagggaacggaccgttnaaantttcc

SEQ ID NO: 92158 - DNA, 637 bp, Triticum aestivum
  unsure (1)..(637): unsure at all n locations
  Clone ID: PAT_TA_92158
gcgaatgtcgttttaataatctacaattaattatctgtctcaaaattcttcatcatctgaattttcgaattcccagatcttcagaatatcatatgtcgtacctcccggtcgtctaacggctcttatcacgacttcaaatcctagcacaantatctaaacaatcactcataatagcaaacatggtcaccgttaatatccgaagcgatatcaaggaccctttttaccgcnacaagatgagagagacttcaagtccaaaatcnaaggcanaggtantgggnataaagacagtaatccgtcaaccttcagtagtgttgcatcntcacttgctncgccctgggagcatatgtgatanagtactttgggtttgaacttggngctcaagcaaatcantcntgccgatgatcatggtcatcatggtgnccacgaagctcanaattcaagatacttntcacgatccacaatanttagtccggtgtaanaaatgcaaaacccaganaccgagttatattaaanaggcacatantcggattgtaaactgcgcaacatcggantgacctcgcgaataatgggtatactaggacagcacggaggaagangcaatagnaaaggaccgtaagcnacaacgagtattgatnna

SEQ ID NO: 92159 - DNA, 518 bp, Triticum aestivum
  unsure (1)..(518): unsure at all n locations
  Clone ID: PAT_TA_92159
ctcgtgccgaattcggcacgagatttcttctattccagctattccaattgagaagcaggccttttatgtccacacaatttttgaccctctattctcggaaattgaaaagaatttagcacaggcaaaatctggtaatttacaagcagtacagcagattcatcatgttattatggccctcgggaccttctctcatgggttttcagagtctcttccgaagaatacagtaatcgcaaatcatgttccangatagaagtttatcggaacagtttggccgggctgccgaagcaattttaattgctcttgaagcactccaagtcatcatttgagatccgaacagcggctaaggcctccgctttcggagacttaagggggtacttggagctgatatgctaccattcctgcctagatggtcgatggctcctaatatgcnagtctccnaaggangaatgccttatcccaagctcactagtcagttaatttgggttcaggaaaggttaacttgccttggancttanaaa

SEQ ID NO: 92160 - DNA, 430 bp, Triticum aestivum
  unsure (1)..(430): unsure at all n locations
  Clone ID: PAT_TA_92160
ctcgtgccgaattcggcacgaggtttggtcgccttccgattcgaacctccccgaaatccgcancagtcgacaggaggncaaaggcgccgccatggcccgtacgaancagaccgcccgcaagtccaccggcggcaangcgnccngcaagcagctcgccaccaaggcggcgaggaantctgngccgacgaccggcggngtgannaagccccaccgctacaggcccgggacngtggngctccgggagatccgcangtaccagaagagcacnncgctgctnatcngcaagctgcctttccagcacctggtctgcgagatagcacangacttcanaacggncctcaangttccannagnaacgccgtggctggcctccaggangnggncgaggcgtactnggnggggctgttcnangacacnaacctgtggcatc

SEQ ID NO: 92161 - DNA, 651 bp, Triticum aestivum
  unsure (1)..(651): unsure at all n locations
  Clone ID: PAT_TA_92161
tgaaaccgtgctgagctcccaagcagtgggaggggaaagtgatctctgaccgcgtgcctgttgaagaatgagccggcgactcataggcagtggcttggttaagggaacggaacccaccggagccgtagcgaaagcgagtcttaatagggcgattgtcactgcttatggacccgaacctgggtgatctatccatgaccaggatgaagcttgggatgaaactaagcagaggtccgaaccgactgatgttgaagaatcagcggatgagttgtggttaggggtgaaatgccactcngaacccaagagctagctgggtctccccgaaatgccgttnnggcncagcagttgactggncatctaggggtaaanactgttncngtgcgggctgcnccagcggtacaaatcnaggaaatccngaatacnagatntacccaanataccaagggtnaagnccggcaagtgagacatgggggataacttcacctcaagaggaaaaccggttaacanntangccctaatgccccnaatgataangagtggggntgaaagaacnagagttncataaancacccctttanggtggtanacnacgatgacccttgcctaaataagggaaatatcgcaantgggnntaatatcnangaatcnccctag

SEQ ID NO: 92162 - DNA, 666 bp, Triticum aestivum
  unsure (1)..(666): unsure at all n locations
  Clone ID: PAT_TA_92162
cccgcaacagattgtttggaaccaaagttaccgccggatgagaagaaaataagcaacgaagtaaccgaggatgaggaggaactatttaaattctcgcccgaaaaagaggcgtctttactagaggagacaaatgtactcaagttacgcgccaatgatctatttgcacagaacgcatttactcaagctattgagatttacgaccaggcagtctcgatctgtcctaattatcgccattatgaagtttcagttttaaagagtaacactgcagcctgtcatttaaaaatccgaaaagtggaaagaagcggcaaaattagcgacggactccctcngagcggttagaaaagttttanaaatatctggaggtanagaggaatctgcaagcgaaccttggtagtgctactaagagatgcaagagctcacaactctaacccatgaacctantgtatcaagtatggaacgggtgaaaacaangactatgatgcgacgaacgcgcgcaaatacgaatccgtggctgggcacatacaaagtgccatgatgatacanatcttcaaaaaggaaactccgtcgganacgtccgtggcancggaatagggcncttctcccgatanggagncagcaagnnatgggnttanggcataagnntcgaagnatcaacattgcnccagg

SEQ ID NO: 92163 - DNA, 237 bp, Triticum aestivum
  unsure (1)..(237): unsure at all n locations
  Clone ID: PAT_TA_92163
ctcgtgccgaattcggcacgagagcatgcgtggccagctattctcttatgccattttgggtttcgccttcgttgaggctattgggttggtcgatcttatggttgctatgatgtgcangtacgtgtnnattttaangagatggaattttccttgcctgatctactcaagacttgttgcttccagnggaattggaaccgtcacagatataggttgtgtaatatactgttaacaggagaa

SEQ ID NO: 92164 - DNA, 301 bp, Triticum aestivum
  unsure (1)..(301): unsure at all n locations
  Clone ID: PAT_TA_92164
ctagtctgagttttttttttttttttttttttttttttttttttttttttttttttttttttttttttttttttttttttggnnaaagcctgtttttagtttcttcnaaangccaanaanggcccgtcaaangcaangncgnaaaagccnggaataagcgaggggaaatnaatcnctgaaattttgggccancatanngcanaaaaactganttcactcanaccnttcaaccaacagtggctcgnanaatgcnttngccncancaacancccannccaacccatcgaaacagtcccacngc

SEQ ID NO: 92165 - DNA, 639 bp, Triticum aestivum
  unsure (1)..(639): unsure at all n locations
  Clone ID: PAT_TA_92165
gttagattgcattgccatcagggtgattgccgaggaatcacctgtgacgcttttcttgagcaagcacaagtagagaaacttgggttgttatatgatacaatcaacatccataggaagtcaaaaaaaatgcacaacacaaccatattaatcctgcttgttgagtgctgtagtacaagcagatggatcatggatcccattttgtgatatgcagctcacatctgagctagggttttgagcctgagttgcgcgccgtgctgcggctgcagcaggccgacggggaacggcgcgtgcgtgtaggccgngcgagagctggaaggagaagcggcgcangatgatggcgagcccatcttggctccagcagcgcgaagtctggccgatgcacacccgcgggcccaacccaaaggggaagaacccggcgcgtcggcggatgcattggagtcccctcggggaactctccggctgaatcngtcgggtcgggccaaactctngcgtgggggacnanagaacggancatggcacagccgccggtactgacccacaaccatggctgncncccngggtgcgnacgggttaancgaacngganacatgnncactagggttccctcnatcggtccgggccnagaccaagacncnctgn

SEQ ID NO: 92166 - DNA, 413 bp, Triticum aestivum
  unsure (1)..(413): unsure at all n locations
  Clone ID: PAT_TA_92166
ctcgtgccgaattcggcacgagcgatgtggaggcggcggatcagacgagcccgacgagaggtccgcccgggaactggagctgcagcgccgccggcttttcctcccaatttcttcgagcggagctggagcgatgccgccgccggcgtcgtcgagctgtcgagatatacctttgatgagatgatgaagatggagaaggaaggcaaccgaaacgggcgtagagaggtggatagaaagtaattctaaaaaatacagtattagtcgcatcacacgatagagggagtgctccggtcnatacccgtngttgctcaaaaaaccngatgcatccgttttttatacttgcgtatatatgaatcnatatatgtgtgttactgccacctaagtatgttgtccccnacttgnatttggggtccttt

SEQ ID NO: 92167 - DNA, 635 bp, Triticum aestivum
  unsure (1)..(635): unsure at all n locations
  Clone ID: PAT_TA_92167
cgtcgtcgttcgagaggccggcggcggccggcggaggggagccgctgtcgcagacatcggtggccacgttccccttctcgccgctgtccatgcggtcatcccacgtcagcgtatgaccccccacacggccacaccatgagccctcctctggccagtggatcaacaggtgtagtggcaccagtgaaccattgaccatttcgcactcgacgcaccttacaagtagtagtagcgtcattatgcttgaacagtagttggtttaaggtttggcagatgtttggggcgattgtaactttctatgatcgactctgccgaggcactggctaggggcaagtccactaaaatccanttagattagcgatttgttcnagccgtctgatgcaaaactagcaatcggatcattcttcaanntaaaatnaaaaaaggggggcccggtaccaatcgccctaaagggagctatangcgcgccatggccgtcnttanaangtcggacgggaaacctgggttaccaactaanncctgagaaaccccttcgcaatgcgtataccaanggcgaacnttcctccanantccaactaaggaagggcncccntngcgaantaccnggggttgngtcccangtactcaattcagcctgg

SEQ ID NO: 92168 - DNA, 546 bp, Triticum aestivum
  unsure (1)..(546): unsure at all n locations
  Clone ID: PAT_TA_92168
ctcccttcccctccttgcgccgtccctctccccgcgcctgcaaggatggccatcttctcccgccgcctcctccctccctccagtgccaccgcgctgtggcttcccccttcctcctagcatcgttgacgcaccccatgccaaggtcccagccgaacggcggcaactattttcggcgtcattcctcgcacgcctgagagaactgctcgtcgccgagtccgtcccactgcaagcatggcagcactgcgatctactcgctcctccctcgccgtangcaggcagatggtcaggaaccttaatccctaaggactactcccgaacaagcattcagattcttgaagatgtctccacacattctatttccaatacatanaacattagaacgcaagatatgctttctggatgtctcaaggtaagtgtcaaanttttgggactgcatgttgcctgatagtctagcaattggtttnatgtgctcctggtagatgaatgatggnaanagtcanagtgtatgatcnanaatctccttanaatcaanttgagctnaagata

SEQ ID NO: 92169 - DNA, 277 bp, Triticum aestivum
  unsure (1)..(277): unsure at all n locations
  Clone ID: PAT_TA_92169
cggtaatgtcttcctgcgcagaattcaagacgagattatccttggtatcataggctggtgaacaggatgccgtcgtgtgggttcgcaagtcatcttgtgacagagtgacagagatcgaagaattacatggaagattgagcacactatctcgcttaccccaatattttaccacagcaatgttaactggtgcaataacactggcctggtaaagtttgggnaggctctgtcatcatgggttagaagccttctcgtgccgaattcggcacgaggggggggg

SEQ ID NO: 92170 - DNA, 463 bp, Triticum aestivum
  unsure (1)..(463): unsure at all n locations
  Clone ID: PAT_TA_92170
gaatgatgcgtcctactttatgctagtgctagctctgtttcctcttgtgtacattattcggttctactacctagcttcctctcgttgtcacaaccgtggcctacggctccctccagggccatggcagctacctgtcttcggcagtctccaccatctttttggcgcactcccacaccgtgcattacgagacctatcaaggcgacacggccctctcatgctcctcatgttcggcgcgaacgtccggcatcgtcgtttccaccgccgaggctgccaaggagatgatgaaagacgcacgacaccaccttctgcgcgaggcaactgacctcaantctcaaaggcattagcaacatggctgggancctcttgccccgtacggtgacactgggcggaaatgccaantcntttcccccnactgcggangcaaacgatcgctcgtngggtcaatcagggaanaggancggta

SEQ ID NO: 92171 - DNA, 657 bp, Triticum aestivum
  unsure (1)..(657): unsure at all n locations
  Clone ID: PAT_TA_92171
gccacctcaaagcgaactaacaacccacaagttaaggaacgccaagccaagataacggctgagatgtacaacagacagtctgaattccctgttcgtattgcggcacagcaaaagtccttaaatctgcctttattccctacaaccacgatcggatccttccctcaaacaagtgaaatccgtattcagcgtaacaaatttgccaaaggtcaaattacaaaggctgaatatgaaaaattcatcgaaaaggagattgaggaggtagtccgggtccaagaagagtccgatcttgatgtgcttgtacatggtgagccaagaaagaaatgatatggtcaantattncgggcnagcagtnanacggatatgcttttactacccatgggatggnccaaccttacggtctcgttgcttcgcctccaatnctcgtgggaacnatccgcccctnaaccatgactgtaangggtcaaaatacctgctctccaacaangacaangaaggcatttgctggccaatacngttgagatggcattccccgagtgnntcaanatagtcangtganaatgcacggcctacgnaaganttgtgantgaactgtggatnggtancagtcacacctgcnnatgngccaaatngttgccanaaaggtntttanggcnggtg

SEQ ID NO: 92172 - DNA, 507 bp, Triticum aestivum
  unsure (1)..(507): unsure at all n locations
  Clone ID: PAT_TA_92172
aaagaattcccaaatattagaaagggaatttcaaaaattacaggatactggtatgaaaaattcagtaaaatttgatcttgataaaactgagttgattcattttgcaaagacaaaggaagctaaagaatgtcagatggccttacccagtggtggaaaattatcaccatctactgtgattaagtggctaggggtatggtttgatcaaaaactgacctttaaacagcacatcacagctagggtggcccaagccaaagcagctttccaaagaatggcaagactaacaaatactgaaagagggcttagccatatagctatgagacagctgtaccttgcctgtgtcattactatttctgactatgcaagccctgtctgggtggagaaggcagcagtcttttantgactactacagggactcaaaatgtacattaaggaaaatacttggatgttcaaatcatccccataagactatggaggtggaggattcttgtccgcctgagatcagntaat

SEQ ID NO: 92173 - DNA, 247 bp, Triticum aestivum
  unsure (1)..(247): unsure at all n locations
  Clone ID: PAT_TA_92173
gnccggtgtcnnagtttcccctctttgcttctacanatangagaaggcctcgcagcccacgggcggtcatctccatcctctccgcccactccaccccgcactaaaaaaccccgagagccatggnagcgttccaccccctggtcgcctcgcgcgtccgcctcaccactccgctcctcnncgccgcngntcccgccgccgccgcagnnggggtctccttccaccgggcgangcttcttgtttattcgtc

SEQ ID NO: 92174 - DNA, 498 bp, Triticum aestivum
  unsure (1)..(498): unsure at all n locations
  Clone ID: PAT_TA_92174
ctcgtgccgaattcggcacgagattctacagagatcattctccactcctcttcttgacctatccggcccagcagcacatctgtgatcactagcagcgaactcccacaaattgtatgtacacccgaatcatagacctatcataacacctggccaccagacttctgccccaaaagtcgcgattgaaacaacacaactatttactgctcgtatcagcgctcctggngctgtccctcaaaatgtggattgangcgttgcataagatgtgcaacttttattgcttttccagaccacgtcatcanntgaggtttgaagctaanatgggggatcaaagtaaactccangccagcgaacttgtcaagctggctctatgaanagtgccgtttacgtggatgccaanagtgcctcncgatgacgnagggaaattgcactacctcgncttttcnggncgaatgtacgggttgtaggccggtanttnctgtanctgcgctgtcaaccagg

SEQ ID NO: 92175 - DNA, 583 bp, Triticum aestivum
  unsure (1)..(583): unsure at all n locations
  Clone ID: PAT_TA_92175
gcctcttggaatgaggccgtcttcgccggttccgtcggccgccactgtggcggcgcggtcatcctcctcaccgaacagctccagggaccgcatctcctctggaccaaggactcgaagtcgcaggtccctcctacttcttccctgacgttgaccgccattgtcgctgtacggagctcgttgctctgctctgtccgaccttgccacttacatcatggttcttcatcgtttcaatagagtccggcaatgaggggtattacgagttcgatccacagcttcatcaggacgttgaccaggaagacatcgacgaatgcaagcggtcggaagattatgggtgcttcggccaatgtaccaatacagttggttcgttccagtgccactgccaacagggaacaagtggcgacccaataccctggtggctgcttcagtaaagtctaagtgcaagtgcaagtaactgtagnaatcatgcggaanctgagtgtgcataccatttggcanngtccgccaagtgcaacttcaaggtttaacctcaatgnacaaagcgcaccccanaatgatgccgntnatcgagtctnaactcctccta

SEQ ID NO: 92176 - DNA, 547 bp, Triticum aestivum
  unsure (1)..(547): unsure at all n locations
  Clone ID: PAT_TA_92176
ctcgtgccgaattcggcacgagggccgctgcgtctcgtctccaccaccccacttgcccccggactcaggaggatcgtcggagatgtcggacaccgatgagcaccacttcgagtccaaggccgactccggcgcctccaagacctacccgcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcttgaggatatcgttccttcatcccacaactgtgacgtcccccatgttgaccgccaagattatcanctgattgacataactgatgatggatatgtcagccttctaactgagagtggaacacgaaggatgacctgaagcttccactgatgatgttcgcttggcanattaagacngattgctgatggnaggactgatctgtcngtatgtcccatgggtgaagaacattntgcctgnaaggaatcggtggtggaa

SEQ ID NO: 92177 - DNA, 662 bp, Triticum aestivum
  unsure (1)..(662): unsure at all n locations
  Clone ID: PAT_TA_92177
attacaacggaggttacaatggaggtggaggcggaggctaccaaagtggatacggcaaccgcggctaccaaggaggaaacggatccggacatggcgatggtggctacggaggtgcataaacctatccagactcctcattgcaaacagcctcaaaattatgttactctagaagccttctgcggcaccgtaagaccagtctacaatggtgccgcggttcaaagtatgagaaggactaagatgatgccaggttggtaattacacttcaaatggcaattaaagtcgactacaccgaacgactaacgaataaatcaacaaaaaccaacgaggtgaaatgattgtacccaaggctgtgaacggcgttgggggtaagcttgacagtgtcataattatctagcgattgactcagtatacatggaataaaacngncaagaataanctaaaaanaaanaanaaaaaaactccagggggggccggtaccaattcgcctatagtgatcntattacgncgctcacggcctcgtttaaactctgacnggaaaccngngtaccaactaacncttcagaaaccccttccaacggggtatacnaaggccgacgttgcctccanantgccactatgcatggancccntacggataaccgggttggtcccactcctattca

SEQ ID NO: 92178 - DNA, 446 bp, Triticum aestivum
  unsure (1)..(446): unsure at all n locations
  Clone ID: PAT_TA_92178
ctcgtgccgaattcggcacgagctcgtgccgaattcggcacgagcaggaactctgcagataccaccatctacagcatcgagaagagcgtcagcgagtacaaagacanggtccctgctgaagtcgtcacggaaatccagtctgctgtctctgatctgagagcagcantggctggtgatgattcggacgccatcaagcagaagctggaggcggcgaacaaggcagtctcaaagattggacagcacatgcagggtggtggcggcgctgccggcggcgacagcggcagcagtggtggtggcgaccagactcccgganagctgaatacnaggaccccanggaggccaagatgtagatttggtctgcatcaangntcttctacnttttttgcgtacccagtttaggaagttaatactttaacctactccgtctgnttangtttcnnaagagg

SEQ ID NO: 92179 - DNA, 541 bp, Triticum aestivum
  unsure (1)..(541): unsure at all n locations
  Clone ID: PAT_TA_92179
agccaatcactccagacgtcggttcgccatgtcgcatctcctgcagaaacttttgcctgagaccctgccacgggcatggttatttctcttcctcttcttcctcgtcgtgtctgtgcagtactggatcaccgaaaagttcggtgcaaaaaggaggcagcgcctcccgccttcaccgccggcgctgcccatcatcgggcacctccacctcatcggttccctcccccacgtctccctccgcagcctancaaggaagcatggncccgacgtgatgctccttcacctggggcgccgtgcccaacctcgttgtgtcctcctcacgngctgcggaggcagtactgcgcactcacgacaactctttnatcaacggcccaatcccgtagctctgacacatcatgtatngtcgggnngaatcggcttnnccatacggngagtcctggnggaaanaaggantcgtcacanaacangtgagcgttacaggngggtctttcncgncgcnctgnaagangtnagatggnatgcaagntaacangaaaatgccgat

SEQ ID NO: 92180 - DNA, 270 bp, Triticum aestivum
  unsure (1)..(270): unsure at all n locations
  Clone ID: PAT_TA_92180
gtgcagaccagcctgttattctgcatatgctggatattgaatttgctgctgaagctcttaaaggcgtcaagatggagttgatcgatgccgcatttccacttctcaagggagttgttgcaacaactgatgttgtcgaaggcctgcactgggtgtgaatgttgcggttatggttggggggattccccaaggagggaaggaatgggaangggangntgttatgaccaaaaatngttcaatcctacaagctcaaagnaatcggcnctgaagctc

SEQ ID NO: 92181 - DNA, 684 bp, Triticum aestivum
  unsure (1)..(684): unsure at all n locations
  Clone ID: PAT_TA_92181
tttttttttttttttttttgtcacacataaacttgcatgcttttgcatctgacctttgccaccaattacaccttccgacagaccgaatcctaatcgaactcgcataagaagtaagaacacgaattaagtctttggacaagaacacacacaagcagttcctagcacgacctatgcaccaatgcattgtaaatcttattaaaacacgcatcatgtatcgatctattccgacgtgacgacgggcttgacggcgggaggcggcggcggccatttcctggcgttggtggtggcctgggtacttggggccttgggtgacgacccgcttccagtaccagtgcttgtcgaacagcaagcaagtctcctcgatgggaactgctcgtctccgggcagcagcangatgacgaagatggcatgaccacgatgagcgccgcgaaagaggatgaacaccccaccggaggtggacatggccgccaggaagatgcgcaacgccggcgtcaagaacaggtnaagnanacacangtntgcccggcgacggattccanngggaaaatcgtcggacaagcaccaagggccangncaccgtagcacaagacagantgcacacagacgntaacctggagtccccggccaattacgcagtngcgcacacacatgcngttacggccgctcagaaanacgcgcanggcn

SEQ ID NO: 92182 - DNA, 260 bp, Triticum aestivum
  unsure (1)..(260): unsure at all n locations
  Clone ID: PAT_TA_92182
gttttttttttttttttttttttttcgagttttattatttcattattaatcatatccttggncccantanccggctcttatttggctacagctcagaaccaccggctggaaaatatcttcccaacccagcaccgtccagcagcgattttaatcctctcactcaaccgctcaagccagccanatctccttctcaagtcncccccgtaacngaactagagggncagggagatgatccgacatttnnaagngttgtcggatcg

SEQ ID NO: 92183 - DNA, 389 bp, Triticum aestivum
  unsure (1)..(389): unsure at all n locations
  Clone ID: PAT_TA_92183
ctcgtgccgaattcggcacgaggcaccttccatcgttggcttgtgtttgtagtgtgaactgcattctcacaggcgaagtcttggcgcgcacaaagctcaattcgtataactcttgcctaaattcagaataatacgcccttcgagattatatcctttcctttgcatcgtcttgtaaacttgacctaatccctctcatgtccttccaanagaaatgtctctcattttagcgtcgatatganggagaagaaggaaagnagaattgcattgcttggttgggaatggctangaccctcanctgacgnaaggntactccgtngcaatccattaattngnggagnactttcctcaaggagaganngggcaantgtaagaatacatgttgcatattc

SEQ ID NO: 92184 - DNA, 525 bp, Triticum aestivum
  unsure (1)..(525): unsure at all n locations
  Clone ID: PAT_TA_92184
cctgaatgattataccaccacacattgcacattgaaagtcaacacgcactctctaactacaaatcacaatgggtctcataaaattcatcaanatgaatcatccaatatccagcaaactgatanccctaggaatgaggcagcttgcccctttgtctacttctacacgagctatggcagctggtgatactggatctcctaaagtcggaggctcggcatctgcggacgcatttacccagcgagaaaagtcaaacgaagactttcacattaggtcaagggaaagagagaagttgcttgaactccaaaaaacgtatctcaagacacacgatcactacgtcgacttngaagaacacctcgacgaacttttcaatatggatcccggtcaaggangaggggggaaaantagttagcaatgatccnattctagggactcnagtncacaggcgcttncttncacagcaatgcattgggnagggnatttagagtccnaaagttagtacntttgncatnngacaatcctcttctcaa

SEQ ID NO: 92185 - DNA, 693 bp, Triticum aestivum
  unsure (1)..(693): unsure at all n locations
  Clone ID: PAT_TA_92185
ctcgtgccgaattcggcacgagccagaccggaggaggaggagagcggcggcgaagatggtgtcgctgaagctgcagaagcgcctggcctcgagcgtcctcaagtgcggcaagggcaaggtctggctcgaccccaatgaggtcaacgagatctccatggccaactcccggcagaatatccggaagctggtgaaggatggtttcatcatcaggaagcctcagaagatccactccaggtctcgtgcaaggagggcacatgaggccaagcagaacggccgtcactctgggatatggtaagcgtaggggtaccaagggaggctangctccccaccaagatcctgtggatgcggcggatgcgtgtcctgaggcgccttctgcgcaagtaccgtgaggncangangatcgacancacatgtacatgacatgtactgaaaggcaagggtaacatgttcaagaacannagggcctcatgagatacacaatcaaagctgagaaggaagaananacctctcngacattngaggcaagcncncaanacaangaagnaggaagganttcagaggaggagaatggtcagcccatagtatcacagacaaggntgaantccgccagcaaattgaccaaaagcanaanaaggcgcaaacttacttcgaaaaaggtaccatttgnnanaataacgntcgnanctttgcntg

SEQ ID NO: 92186 - DNA, 293 bp, Triticum aestivum
  unsure (1)..(293): unsure at all n locations
  Clone ID: PAT_TA_92186
catacaccgaagcggacgaaggcctccgagccgagcgaccccatgnggaacaggttggtggcgatggngagcgagggcagccacggcacgagcggcaccccccacaccttgggcgcgcgcgccgccggcaccatcagctggatgccgagcgtccccagcagccacgccggcaccagcaccacgtagccctcccaccgctcgggcgtcgtgccccagtacgccgcgatgcccgccgacgaggcgatgatcaccagcaggaacaccaggagccgcaagcgcgtgcgtccgcgtcg

SEQ ID NO: 92187 - DNA, 610 bp, Triticum aestivum
  unsure (1)..(610): unsure at all n locations
  Clone ID: PAT_TA_92187
ctcgtgccgaattcggcacgagcgatagattcttcctcctcgtcactcctccagaagcctacctaccatccaccacctcctccaccctccaacaagatggacgccgccgtggagcgcctcaagancgggttcgagaagttcaagaccgaggtctacgacaagaagcccgatttcttcgagcccctcaaggncggccaaggcgcccaagtacatggtgttcgcgtgcgccgactcccgtgtgtgcccctcggtcaccctgggcctggngcccggcgaggccttcaccatctgcaacatcgccaacatggtcccngtcatactgcaaggaacaagtacgctgngtgttgggtcggncatcnaatacccgtctgtgntcncaagttgntgtcatcggggtgactggcacagggntgcggtgagataaggtctctctcanncaaggangngcagacanccttccactcgtcnangantcgtcaggatngggtcccggcaangagaagngagaggngtgggctnaatgctttgangacagtgacgtctccgaaagagcgngaangtcctcangaactcntgnctaccgtctcaggagggnnncacgtatcnnagt

SEQ ID NO: 92188 - DNA, 319 bp, Triticum aestivum
  unsure (1)..(319): unsure at all n locations
  Clone ID: PAT_TA_92188
ctcgtgccgaattcggcacgagccaacggttcccancgcgccacaccagagcaccagagcgcggcaccggcatggccatggncacggccgccagctcccgccaccacctcctcctcctcctctggctctgcgcggacgccancacggcctgggcccatggaggcggcggggacgacgacncggactccgganacgcngacgcggacggcggtgaaaagccggacctgcgtgcgccggggctgttggcggtcangctgtgngtgcctgncgctggtgttcgcngncacgctggcgggcggagtgtccccctacttcatgc

SEQ ID NO: 92189 - DNA, 187 bp, Triticum aestivum
  unsure (1)..(187): unsure at all n locations
  Clone ID: PAT_TA_92189
ctcgtgccgaattcggcacgaggtatgatagtctgtcaatcccctgatgtcacaaagtgatgacactcatacatcccgacaggntctgntcgcatctggactgccggnatggcggtctgntccggntcttgaatttcggntnggcntccgatngctcngggtctctcnttttanccccttnngataa

SEQ ID NO: 92190 - DNA, 568 bp, Triticum aestivum
  unsure (1)..(568): unsure at all n locations
  Clone ID: PAT_TA_92190
tttttttttttttttttttacaaagtgggcgcgggcaagcccgatccgccaaagcaacatgagataatcgacacgggtggagggtcaactacacgaaacgaagttccgcatagcttcacgctctgtaatgatccttccgcaggttcacctacggaaaccttgttacgacttttacttcctctaaatgaccaagtttggacaactttccggcccagggtgagtgttaccactctccccgggccagtccgaaagcctcacttagccattcaatcggtaagtagcgacgggcggtgtgtacanagggcagggacgtaatcagcgcaagntgatgacttgcgcttactangaattcctcgttgaaagagcaataantgnaatgctctatcccagcacgacagagtttaacaagatacccagtctttcgacaaaggaggaactcnntgngtctgtcagtgtacgcgcntgcgccaagacanctanggcacacagactgtattcccaacttcaacggntgagcgaanccccaacnancagacaccaagtntccagntatacagtaaggccgtcg

SEQ ID NO: 92191 - DNA, 516 bp, Triticum aestivum
  unsure (1)..(516): unsure at all n locations
  Clone ID: PAT_TA_92191
nacaatatggtcctaanntacagtattccaccactcccatatgcctacgatgcactatagccacatattagnggtcanataatgantattcatcatacgaagcatcaccaaacttacgttaataacctcaacaatgcattggaaacccttgacgctttaacganatcctcagatattgtctctcatctacatctacaagcagctataancttcaatgccggtggacacatanaccatactctcttttgggaaaatctttcaccaagcacatctactacggcgcangttagctcatcaccgnanntatccagcnggcactagccgtacnctgggggatctgtcaancgtttcangnagaggttactaacngtactgctgggcctcannggaagtggttggnnctggntattgaggcatncnagggggancctgaaatcatagnactanggccattnattgtccgggnnnaacaaccttatnncgattgctttggganatgntatcnttcagnccagt

SEQ ID NO: 92192 - DNA, 400 bp, Triticum aestivum
  unsure (1)..(400): unsure at all n locations
  Clone ID: PAT_TA_92192
agatgggtagtggacacttccccgaggaagggtttggcaaggctagttatataaagaacatacatgtggtagattcgttcgacaatctcgaaccactaagtgatgtgcaggttatagctacgcagaagaactgctataatgcagaaaatggtttctctagcgacatgggcacttacatctactatgggggagccggctgggaaagaactccaattgcccatgaagatcaccctttaagtaatgtaacacttttcctgcattactactgggccaaatacgtattgttaagggtctatactattgcaataatatgtgttgccatgtatggtttggtatgctcaagtgttgtgtggtatgacgcattgggnaagagtgagaataanaangggantcacatcca

SEQ ID NO: 92193 - DNA, 224 bp, Triticum aestivum
  Clone ID: PAT_TA_92193
ctcgtgccgaattcggcacgagtctaaaagctacatttgtggctgtcagcaatacttatggatatctcacccccaacttatggaaggagactaagctaatccgcagtcctcttgaagagtttggagatgttctacgagctagcaagcgctaaaaatatgccctagggcatagtgaagcaaacctgttaattcaatgacacatcctaatccgtaaaaaaaaaaaa

SEQ ID NO: 92194 - DNA, 541 bp, Triticum aestivum
  unsure (1)..(541): unsure at all n locations
  Clone ID: PAT_TA_92194
ctcgtgccgaattcggcacgagaaaaaataaaaaataaaaaatagggactcctccatggctccacgtatctccacccatgtgtgttgtggaccaatctctgattttcccgtcaagtgtccagcgatttgaaaaaagaaaaaggtgactantgatcctaaaaaacaggaaaacccaatctgtcacacttctatataaaaaacctgaagatcctataaataaaaatcccctcaattctgtcctccttcaaaggagtgtccatccgcatgttttatgctcctacctatcttcctcatcntccatcttgccacatctttcctttggaccgtcaatgactttgnngacccttcnaagttnnatcagggtnaangaantgggtcctatcactccatccctccngaanctntgattccgctctctcaatcaganactcgatncaaacagtttnaagtctgccaggggtatctaaactatttaatccancagagantngcncaacanattgantaacggattgtccacaaantngggcancatncncca

SEQ ID NO: 92195 - DNA, 385 bp, Triticum aestivum
  unsure (1)..(385): unsure at all n locations
  Clone ID: PAT_TA_92195
ctgaacacctgtcagtggtgtcctctacgaacctgggagtgaaatattctcccanagccgagatccagtcgcgaaagtgggtgggatgaattctacttgacggattttggacttgaaggagttgcactcgatattttggtcgaaaaatcagtcggcagagatttcacagccggaacaaagttgcacagaagctcatcaccactaacatacgattcacgantgggatttaggtttatctggtggtccgtattcaaacatccgacatctcttaaactcnttttatacttgcgacgnancatttcncaatcgatcctanacctgcgacctaccttnatacccgtccgatnacttacctacacacnccctaatgatcacanncacatgg

SEQ ID NO: 92196 - DNA, 381 bp, Triticum aestivum
  unsure (1)..(381): unsure at all n locations
  Clone ID: PAT_TA_92196
ctcacccccggtgctactcccgttcttccgccatcgccatggaggacgccgcgancgccacccagaccacctccaccacctcgtcggtggccgccgtanccgcggcggcccagcaccagcagcttcagcgccagctctttctcatgcagcaggctcaggctcaggcgcaggcccagccccacccgcaggcgcagcagctgtcgcagnaggccatgtcccgcttcccgtccancatcgngcngcncacctctgncccctcngaacngcatcngcttnnagcagacggngncgtcgcaagctccnaacccannccagncgcactcggaggggnagcgcancncaanccgtcccngcancangcgggcgagntnatngtcccga

SEQ ID NO: 92197 - DNA, 559 bp, Triticum aestivum
  unsure (1)..(559): unsure at all n locations
  Clone ID: PAT_TA_92197
ctcgtgccgaattcggcacgagacgaaaatgtcactctcaaacaaactttctattactgatgtcgaccttaagggcaagcgggtcttgataagggtggattttaatgtacccttagactctgcgctcaaagtcactaacacacaacgaattgccggagctactcccaccataaagtatgccatagaaaatggatgcaaatcggtaattctaatgtcacacctcggacgccctgatggcaaggtacagccaaaatactcacttaaacctgttgtgccagagttggaagccctccttggtagaagcgttgaatttgcgtctgactgtgtcggcccgaggttgaagatatagttaataaggcacagggggacaggttgtcctccttgaaaactacgctttcatctgaaagaggaggggagtacaaggacgcgatggaataagtaaaacaacaagcantgtcnaaaagtcncaaaggatgacactctagagattgtcacaatgagcattggaacgacacgggtaaagtcaaggtggtgggctacnaaaaggaccnggtcatga

SEQ ID NO: 92198 - DNA, 530 bp, Triticum aestivum
  unsure (1)..(530): unsure at all n locations
  Clone ID: PAT_TA_92198
ctggtgccgaattcggcacgagttcaaacatcacatctagctctacagtaacctaggcccctcaaataccggcacaacatgagcttcatgcccatcaatccgcggccgatgctgcaaaatcttgtgaacgaggaagtcattatccggctaaaatggggccagacggaatataagggaagactcgtgagcactgatagctacatgaatatacagctgtccggggcggaggagtggattgaccaacaaatgaccagtgtcctcggacaagtactcattcnatgtaacaatgttttgtggattcaaggcgttaaccagaatagtgggtaatacagataccgttatgggaggctaaacaaaatctattgncacattgtccatgaagaaagagcggggtgaacatgtgatgggttctaaatggaagtttggagagattagttcccaaagctcattgctaaacattggnaatagactgagattacctacccctaaatagccgtaagaatcacaaggngatgatgcaattctncccg

SEQ ID NO: 92199 - DNA, 573 bp, Triticum aestivum
  unsure (1)..(573): unsure at all n locations
  Clone ID: PAT_TA_92199
aagctagccaagaaggcttttcatacaaaaaaagacgataatggcataaaatttatctcagaaggcaacgtatccaaagtaaaattctgatgctactcttttcttttactaatgatgaaaacaaacaggaggctgttcacaggttcgtacgaagccacatgagctcatcatgaccgggccagcagagcccgggccgtcgcccttggccggtcggcgctggtaagggaaggcgccgatctccccttcgatcctgcccctgacgtcgacgagcaggcagcgcagcctggccgcctcggcctcgagcgcggcgtggtcctggaccttcttggtgagctgctcgttcatagccctgagacgggccgcctcctcctgcagcaccgccgtgtgctccttcttcttctcgcggtacttcgcacggccgcccggttcctgacgggcggcgcttcttgctccggaagtggcgtgggcgtctccggtcggtggggatcggggcggcggctcggangaggggaggcggcancttggatggcctgtggaagtntgtgtgggaagtctggcggcggtnnccttggt

SEQ ID NO: 92200 - DNA, 653 bp, Triticum aestivum
  unsure (1)..(653): unsure at all n locations
  Clone ID: PAT_TA_92200
ctggtgccgaattcggcacgagctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcattaagaagttcgagaccctgtcctacctgccaccgctcagcacggaggccctcctcaagcaggtcgactacctgatccgctccaagtgggtgccttgcctcnagttcagcaaggttgggttnacttccgtgagcacaacgcatcccctgggtactacgatggccggtactggacaatgtggaantgcctatgttcgggtgcaccgacccacnaggtgntaacgaggtggaggaggtcaanaaggagtacctgacncnatgtcgataacggttgaaaaatgncaggtcatgctcagtttacgctttaaccacggtnncaagatncggaaggctaanncnaccacangggcaatataaggcatgcgtttgcactcnaatgcttggttccttcatacttcgntgncaaaaaaaanttncattccaannccnaaa

SEQ ID NO: 92201 - DNA, 588 bp, Triticum aestivum
  unsure (1)..(588): unsure at all n locations
  Clone ID: PAT_TA_92201
ctcgtgccgaattcggcacgagctgagtttttcgactactaagccttggcagcgagagaatgagagctacacttccataaacgctgccgctcaggttgggaacccaacgagtgtttatgagtactgggcttcgttactacgtttgcgcaagacttacaaggatgtgcttgtctacggcgactttcaactcattgattccgataatgataacatctttgcataccttcgtacttctacagataaaaaggtattagttctcgccaactttcgaccatttaatgttacatggaagaagccggatggtctcggcgcattaggaccaatcctaattgaaaatgaaactacaagatatcaaaaagcgagtgcctaactcttaagcccttccaatcgtttcgtgctttgtggagtagatggnacgctcgaggggataaatttatgttcatgctaacgggcataaccanaatgaggtatggancctcatgggacatgattatgcattgatccnactggcttggcnacccaagntaagggaaagcaatcaantgangctgaatcanactgnggttaaangcattacttnaaggtaca

SEQ ID NO: 92202 - DNA, 215 bp, Triticum aestivum
  unsure (1)..(215): unsure at all n locations
  Clone ID: PAT_TA_92202
ctcgtgccgaattcggnacgagctntcctgttctttatnntcattaatacatttgagnttggnanttgctaanngaanggcagttcgtaacagtgttatgtctctgctgtgtatttttcantttgttttacatnangttcctttgccannntgtgatggtaatggnaatctganacattcgntccggcgtattcttagtcntcacctgcanctga

SEQ ID NO: 92203 - DNA, 623 bp, Triticum aestivum
  unsure (1)..(623): unsure at all n locations
  Clone ID: PAT_TA_92203
gacaagaggacgctctgccattgatgtccggatgaggaggtctcaggaattgtatttcattctggaattgtttcagaagatggtccaacagggtgtaaggccaaatgttgttacattttctgcgatcctgaatgcttgcagtcgctgtaataactttgaagatgcagccctattactggaacaacttcgcttgtttgataactttgtctatggtgttgcgtatgggctccttatgggttaccaagaaattgggtccgcaagcacagccctttttaatcagctggggacgcatgggatctccaaacatcgtctgccttttataatgctcttactggatatgctgtggcattttgggcaagaggcaaggactcaattaatgtgctccaaagggtaancgccgtgtgtgggaaaacacatggagtganttgcttgggctgcacttatgtcatgggtgcaactcaaacaatggccagcatggtccgaagtccntatgctccaagacacatccgattcaacatcnaaggtgggaanaacagatgcggngaaaactccactacaagatttaatatcggacttaagtagataaatgaggttgtccactcnggtctgttaaaacggcacaa

SEQ ID NO: 92204 - DNA, 657 bp, Triticum aestivum
  unsure (1)..(657): unsure at all n locations
  Clone ID: PAT_TA_92204
ctcgtgccgaattcggcacgagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcaagcacngtggcctcctcaagcangtcgactacctggatccgctccaaagtgggtgccttgcctcgagttcaagcaaggtgggttnacctcccgtgagcacaacgcatctcctggggtctacgatggccggtattgggcaatgtggaaactgcctatgttccggtgcactgacccaacaaggnatnaacaagtggaggaggcaagaggatacctgacctagtcgnatancggttcanaaatctnagtgatggtaanttacgcttnagcacggtncaagatccgnaggctaanntcatccgnagcattaaaggcatgnantttaactcgantncttggntcctccattactcaatgtccaaaaaagtgnncagtagtcaaaggtcnanacgcctnnaatnacgggattt

SEQ ID NO: 92205 - DNA, 392 bp, Triticum aestivum
  unsure (1)..(392): unsure at all n locations
  Clone ID: PAT_TA_92205
cgacaaacgccatcacaatgtccaactctaaggtcaagatcggccagctatggcccaagaacaagacgggtntcatgaagcnattngggngacnttangactgagctcggtcaacttngcacacaggnagatttcangaggtgncacatctaaactnccaaanatccacgacgtcaggaaatctatcggcaanggcctcacagtcaattacggcanacccaacggaatcnactnccgggnttttctataagcaccaaggagttnctntcactncgtttttncggccaaaaggnnattccnggcaattanggggactttttgccaagggngnatnaagcngggaaacttcccaggttcccnannggagaattcattncccncnaaagaagttt

SEQ ID NO: 92206 - DNA, 406 bp, Triticum aestivum
  unsure (1)..(406): unsure at all n locations
  Clone ID: PAT_TA_92206
ctcgtgccgaattcggcacgaggttaccattattctacattttgcaaagagtanatatagatcaaataatattggcaggaacagaggataatgaanctcangtgcagacagatgatacataatcaantancatttaattaacgtatancgttaacaggcaaaaggtactgacaagaggaatgnanacatcaacgtgtgcagtggcattggctttattcaacattttcgttanagtacgtgttgcatatgataatttggcnaaantgntaggcatggtngctncgatgcacagtaatgctanacatnaactatctcncnatgcaantacagnaanaccaccannatccgttatnacttgtnactcaactggatgtccctaacactattantggtangcnnccatttg

SEQ ID NO: 92207 - DNA, 235 bp, Triticum aestivum
  unsure (1)..(235): unsure at all n locations
  Clone ID: PAT_TA_92207
ccgaccagtcgaccaccagccagctcctccgtcctctccccncaccgccgccgcccccgccgtcgccgtccggngcaccccgtctcccncgtcgaccgnacagtcggccagttggtggatccgtccaccgccggnaaccgaatngggtagaggangaggggncagntcgantntccggtgagagtcgccggccatggttnagggnacgggctactantangtgttcggngtgatg

SEQ ID NO: 92208 - DNA, 556 bp, Triticum aestivum
  unsure (1)..(556): unsure at all n locations
  Clone ID: PAT_TA_92208
gagagagagaactaggggttcaaatagtccgtaccggcaagtaaatgcggctttccactcatcaccttctttgatgcggagcttattaaaggcggatatgatatcaagcttagtgtanaacttggcacgagagagttgacaaagggtttctgtaattaaaggaagagagcaccgatttctaacggagattgcattaagtcctctgtaatcaatacagaaacggagatctccatttgatttcttgacgaacaaaactggagcggtgctggtgacttggaaatcctgataaacccttcgaaagtctttgtccaaataatctcgtagagcctccagctctttttggntcaatgcntatggacnacnaaagggggtgntttccnggctgaagtcaattgatgatccaggggcnatgttgnagcaaggagaatgggctgtttccatcaantanancaggagcatgntatngaaggaggnntccttgggcggatcttggnatggnagtnaaatgtgatnggggggggaccccgcaactnggtcanaagtcaggccctcgtaa

SEQ ID NO: 92209 - DNA, 179 bp, Triticum aestivum
  unsure (1)..(179): unsure at all n locations
  Clone ID: PAT_TA_92209
ctcgtgccgaattcggcacgaggctgcatcgttatcccttccgctgtccancacccatccatcaatttcctgcacntgntacccactgctcantgtcatnatcatagttganatcgctcacatcttcgcttgatccaatctgcatcttatctagtttgtcttggtaagngggagagaca

SEQ ID NO: 92210 - DNA, 281 bp, Triticum aestivum
  unsure (1)..(281): unsure at all n locations
  Clone ID: PAT_TA_92210
ctcgtgccgaattcggcacgagcgtatatctacttctggggatgtctacagttttgggatagtgctgctggagatgttgactggcaaaaggccaacagatcctatgtttatggatggactggacatcntcannttcgngggcaacaggtttccacatcannatacatgaagtgattgacatttatctaanaggacgagtgcgagtcanaanattcngntcatcangtgcctccgtgtctctgctgcangtatcantctcgtgcacacactccatcccccgg

SEQ ID NO: 92211 - DNA, 549 bp, Triticum aestivum
  unsure (1)..(549): unsure at all n locations
  Clone ID: PAT_TA_92211
ccccaatctcctcccgcactcaacccaatccccacctacccgcaccccatggcgccgaaggcggagaagaagccggcggcgaagaagcccgtggaggaggagcccgcggcggagaaggccgagaaggcgcccgccgggaagaagcccaaggccgagaagcgtcttcccgcggcgggcaagacctccgccaaggacggcgacaagaaggccaagaagaagagcaagaagagcgtggagacgtacaagatctacatcttcaaggtgctcaagcaggtgcaccccgacatcgggatctcctccaagggcatgtcaatcatgaactccttcatcaacgacatcttcgngaagctcnccggcnaggcgccaaaatcgcgcgctacaatangaagccancataactcccgcgaatcanactcgtncgcctcgtctccccggggagtcacaacannccgttccgnggaacaatacgtntaaaatnactnctctagtngccgccccctcanggnacccngttgtccctgctgattgctgctaccaaanttangcagg

SEQ ID NO: 92212 - DNA, 502 bp, Triticum aestivum
  unsure (1)..(502): unsure at all n locations
  Clone ID: PAT_TA_92212
ctcgtgccgaattcggcacgagatcgaatcaggcaagaaaagggggatcgagggaaggaagaagaagaggagatcggaggccattccaccttgctgccgcccctgatcgccgacctgctgctctccanctcctcgctgccttccaccactcaaccaccaccagatcgaagcaggggattgaggggaacgagcagaagaaccacgatcgaaaggagagaaagggagaagagggcgccgggagattggtgnaggtgcccgatccaccgcctctctccaacgacgatgcnaacctgctgcactcctcggnctcaacctcaatgaaanggagctgtngatccctccanggagccnttnctgatcctctccaantngggttcnctgatcgncctcgtccctgctgcctccttcgcccacacatctaanggcaggagacanctataanccttttcccttaanggactttntnantttgccccgaaactccaaantntcaccnacccaa

SEQ ID NO: 92213 - DNA, 333 bp, Triticum aestivum
  unsure (1)..(333): unsure at all n locations
  Clone ID: PAT_TA_92213
agtttagaactccatccacaagctgttcggatactttcattaccttggctagcaagatcacgataactcaatttgcaagcagcttagntacttccatcaacttctctagcaagattgcggcctacattacgaggttgtacacangcatctaangcanctccataatagtaacaatggccgacgcgtgctatacagctcagagccattgatgaacgattgggctgctaagtcagcggnagctgcaaagattaacgactactagnttcatcatggccgcagcatgtgagccgtttgaaacgagcgtcgcggcgacttgcancgcaacgctaggca

SEQ ID NO: 92214 - DNA, 641 bp, Triticum aestivum
  unsure (1)..(641): unsure at all n locations
  Clone ID: PAT_TA_92214
atcgcatccacgaagagtaatgagccaagcaagctgaattgtgtttcaacaccaacatctccaccacctgcacaaaatcagagtaatacccaaacgaagaagaaacgttctaacggcaagccaaaaaagcccccgccatcagggtttgaagagttctatgctgacacgccaatcaccccaagtgattatgccgttgagcgtgatctatatgaccccgaaccatgattcaaagatcgtatgcaaacgtgtatccaaaggttagggtaagcgcaagctagaccaattacgcgctaacactttacaaaatacctttcactgggtggcgttagaaacaagngccaagcatttactgggggtctaagacaaagagacaatgaaaatcaacagctaatgagtcgccggatanccaaactacagactttattccgcacgaacatnaaaatacaaanattatgaggtctgataacgggttatgactttaaggatggcaaaaggttttcccccaatttccacatgctaccatgagagnaaagcaactgaaacatgcgcgtcatctacttcaacaaatcncacatgagttccgaaaacgcgaacatgcgccaaatatnaatcaanggnttgaatcaacccctaantctggt

SEQ ID NO: 92215 - DNA, 277 bp, Triticum aestivum
  Clone ID: PAT_TA_92215
ctcgtgccgaattcggcacgagggctaatgtgcgacctgatatctatggatggcatggaaatccactttgttgccgctattgaccttcaagcgaacagacaaaagtagatgcgatgatagacgatcaaacgagacacagcacatcattccacgaggtgacggtagaacaacgtgtataataagcatctttaaaaagatcaagcgaaataagtgatcgtgtccaggatatccatccaacttaatttcattggaatattaacactggaaaaaaaaaaaa

SEQ ID NO: 92216 - DNA, 657 bp, Triticum aestivum
  unsure (1)..(657): unsure at all n locations
  Clone ID: PAT_TA_92216
ctcgtgccgaattcggcacgagcaggagcggaaccaacaaatccccaaccaatctcgtctccgatcgactccaggctcgtcgaatccccaccgcctcaagatgcagatctttgtgaaaacactgacaggcaagaccatcacccttgaggttgagtcgtctgacaccatcgacaatgtcaaggccaagatccaggacaaggagggcattcctccggaccaagcagcgtctcatcttccgctggcaagcaagctgggaggatggccntacctccgctgactacaacatccaagaagganccacctccaactgtcctgcgtctgctttgtggcatgcagatattcgttgaagacctcaactgggaagacatcacccctggaaggtccagactcccgacacattgacaacgtcnaaggcaaattccaagacaaggaggattccccccggaccaacacgcctaactttggctggcaacaactngagatggccacctggccgatacaatccaaangnccacctccactggggggggtcnncttgggggatcantntcgngaanactcacnggaagacatacctgagtnaaaatcnaccattgcaattcaggtagntaggcaggggnattcccgncaaaagctnttnctgaacactgggangnc

SEQ ID NO: 92217 - DNA, 569 bp, Triticum aestivum
  unsure (1)..(569): unsure at all n locations
  Clone ID: PAT_TA_92217
ctcgtgccgaattcggcacgaggcgaaaggtaatcccaatccccacagaaatccccatctcaaaaccctagccctcatccccgatcccggcgagcgagatggccaacccgagggtgttcttcgacatgaccgtcggcggcgcgccggncgggcgcatcgtgatggagctgtacaaggacgcggtgccgcggacggtggagaacttccgcgcgctgtgcaccgngcgannaagggcgtcgntaagagcggcaagccgctgcactacaagggcaagcgncttccaccgngtgatcccccgacttcatgtnccaangncggccgacttcacnccgngggcaacggtancggctgnnagtccatctacggcgagaattcnccacgagaattctgtcaaaaananacanagcnggggattcttctccatngcaaagcngggccaacacnaanggtccattctcatctgcacgtccccgcaatngtnnaggaacactggtctcctgcnagtctncaaggnatgtcttntcanaaacnagaaggtggcncctcanagcacngtcataagngtatcg

SEQ ID NO: 92218 - DNA, 605 bp, Triticum aestivum
  unsure (1)..(605): unsure at all n locations
  Clone ID: PAT_TA_92218
atatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaagttcgagaccctgtcctacttgccaccgctcagcacggaggccctcctcaagcaggtcgactacctgatccgctccaagtgggtgccttgcctcgagttcagcaaggttgggttcatcttccgtgagcacaacgcatcccctgggtactatgatggncggtactggacaaatgtgnanntgcctatttcgggtgcaccgacgccacacaagtgatcaacangtggaggagtcaaagaaggagtacctgacgcgtatgtcgcatcatcggatcgacaacatgcgccagtgcagncgtcactcatcgcctnaaacaacgggctgcaagatccggaaggctaaacactcatcacacaggcatattaaatgcatgcantttgnaatcnanatgcttggttcctccattacttcta

SEQ ID NO: 92219 - DNA, 613 bp, Triticum aestivum
  unsure (1)..(613): unsure at all n locations
  Clone ID: PAT_TA_92219
ctcgtgccgaattcggcacgagtcgtcatctaccgttatctccgccgtgcctcatccaatacgagatccggattagcctctagctttaatgatgtatttcgtttgttcaaccaatctatttttgcagatatcataatgaggcagaatgtgcactaattgactgcagatgagaaatagactttagggatgaaatatcatcccaaaccacaaatgtaccaatcataaagttgaatctgagttcccacactagtctgcatgagataaatggggccaagatgtagattcagcccggggaccttgactgttcactaancacgagctggcaatttgtcactttgtccctgattataaccaatgcactggagcatatcnctcatangtgtgtgagaantaaaanttagtncttactttncaatttaaancccacaagaattcatgtttacatcaaacaaattgttccaatttgcccnattaaaccntcatttggntccaaactactactacccaaaaanttaaattcccctcgcnanatgagccccgtaaaacaacatcaagcaaantcaaatccgggaaatgncacttaantcntgacaanaaaccatttttcgtangg

SEQ ID NO: 92220 - DNA, 300 bp, Triticum aestivum
  unsure (1)..(300): unsure at all n locations
  Clone ID: PAT_TA_92220
ctcgtgccgaattcggnacgagagagaactagtctcgagttttttttttttttttttttttttangcccgtttcaaaatgcgatcaaaanggcgggaatggncattcatagctagtggttgaatccnagaaattttttgttgtttcncagattaaacagcttatgtacctanaaatgatttttggaaaaataannagcaagctatgaggcagctcnagttcanatttgncccacttcctgctgaancngcggcaatttggcnttttcacnagnaggagaaaactantctccagggggggc

SEQ ID NO: 92221 - DNA, 621 bp, Triticum aestivum
  unsure (1)..(621): unsure at all n locations
  Clone ID: PAT_TA_92221
ctcgtgccgaattcggcacgaggaactagccagcactagcagtcgtcttcttcttccactggtatattctcctcaaggatcgatccatccatcgtcgtcttcgttcgtcctcaagctagcacaaatgggaggaaaaatggagattgagaggtcatcgtggagcgacgacggcaacctagttcaggatgcggtcgactaccggggttgcccggccaacaggtccagcaccggcagctggctgggagcggcatccgtggtcgggatcgagctatgcgagcggctggccaccatgggcatcgccgtgaacctggtgacgtacctcacggacaccatgcacctgcccggcgccgcgtccgccaacgtcgtcaccgacttcatgggcacctccttcctctttgctcctcggcggcttctcgccgacgccttctcggcgctactcacatcgcatcttcgcgcttgtcaagccctcggaacggatctcgcgtgtcaacacgtgcgcatctccgcccgcacancggggccaanccntcaagangcacggccncanatgggtctgtagtgncccnactanccgtcggacgggggcnaatcaactcccggtnggacgacatnacaaacatn

SEQ ID NO: 92222 - DNA, 204 bp, Triticum aestivum
  unsure (1)..(204): unsure at all n locations
  Clone ID: PAT_TA_92222
cccnatcnggcaaccagatggcagccgncgccgtctcntcgctcaaccccccggcnccagaggaagccncacaagaggatccctcgccagcgcgcttcncctccaccggcgcggntgcccccgcgaccacggtgangtctcccggggcaanggaggtggcggcggtgatggcngcagtggnncnagacgccgccnncatcgccg

SEQ ID NO: 92223 - DNA, 383 bp, Triticum aestivum
  unsure (1)..(383): unsure at all n locations
  Clone ID: PAT_TA_92223
tttttttttttttttttttttttttaatcagatatggctcgtctattgttaggatattaanagatcttgagcggtcgatcancaaaactattttaccgccgataattattaactacaaggggttattgcnacgatcattcttcnatgtgagactcctcaacctgctccgatgccatancctgcctcagctgctgnctgngctgccactgccntggccccataatctgtgcttantggtngcanaatgacntgcncntcctttggttcaataattgttacagaatcacgtacagtttttctgtggnccancttttccnntcnggattcgaacctcgcatatcctnactttgntccaanaacacccttgtcgnacaangaacctg

SEQ ID NO: 92224 - DNA, 604 bp, Triticum aestivum
  unsure (1)..(604): unsure at all n locations
  Clone ID: PAT_TA_92224
ctcgtgccgaattcggcacgagcagccccactcctagagagcacgcacatcggacacgcacgaagtctcctcgaccagcgagcaatggcgaccaccgcgatggcgctctccccctcctccttcgccgggaaggcggtgaaggacctgccgtcgtcggcgctcttcggggaggcgcgcgtcaccatgcgcaagaccgcggccaaggccaagccggtgtcgtcgggcagccgtggtacggctccgaccgcgtgctctactcgggccgctatccggcgacccccgagctactcaacggtgattccccggcgactacggatgggacaccgcgggctctcggcgacccgaaaacttcgcaaanaacgggaactggagtgattcactgccggtgggcatgctgggcgcgctcggcgcgtcttcccggactgctcgccgcaaanggntcaanttcgcaagcctttggttaaaggcggtccantttnaacaaggnggcttgatactcggaaccaaactcgtcatccaaanatctccattggctcaagtctgtaagggccnnaaggtacctcccgggccctcggaattcaccgttaccgggannttacctggc

SEQ ID NO: 92225 - DNA, 612 bp, Triticum aestivum
  unsure (1)..(612): unsure at all n locations
  Clone ID: PAT_TA_92225
ctttattctaatcaaaccgtgagatgcgttttccaaggagctgacttgaagtataaatttacaaatgtttccccacggcgtaatacctctgagaaagcactactaaagtccaaacttctcatctcactaggtctcagtcctcttggattcaccttcttatacagtcagagagcttgctttccatacaaattgaatttaaatttcatcataacacctattacccaacggtaatacctggacacggctcaatctctcactgatttttacctaaacttgcacgccatccagtcgtataaactcctacggagcatacatcanagncaactgaattcaaattcaacatgnaaaatttcnctaattgcntctaatgtcacaggacttaacttccttaaagcctatgggtgctcacatggtttttgcngtatcaagagtgagtatgataatgtcanaaacctggnaaggtacaatggnatanacagcttgaagtgtaataccatataatggaaattccaananatatcgacggnccctaatatgnnaggacttnaagggaacagtaancccanttnaatantaangcanaccttattcctgtnggnaaaaagctacgtt

SEQ ID NO: 92226 - DNA, 204 bp, Triticum aestivum
  Clone ID: PAT_TA_92226
ctcgtgccgaattcggcacgaggtcaaacactttatttgcttcattagctagtctcttttcgcgacaggatgaaaactttctaatcatcagtcacatttcttttctacgaatttttcaattctgttactgaggattttttgtaaaaccatcactagagactggtaataaagaagagtattactcacatcaagaaaaaaaaaaaa

SEQ ID NO: 92227 - DNA, 610 bp, Triticum aestivum
  unsure (1)..(610): unsure at all n locations
  Clone ID: PAT_TA_92227
ctagagcgttaggcacggagggtatttacaagaattacatctttcgacaatcatatcaagtgctacagtaactgtatccacaagaagaaaccaaattatactttcaccatagaatattgtgtccgacgttgtaacctcgctcctgagacactcatcctgcctcttaagaaccaaagcaatacactgttcactacaaggagagcatccgacattcaaataaaatcaaacatactaccaatgttaaaatatttgttacagcaccataccacatcacctccgacaacgaattttgtcccattggattatcttggtcctggcgacttcctatattcctaaccagccatccgangttcaaattatcctactcacctcaatattcctctcacatctcagctcaaactaacaatggaaatacacattggnccaaantccccggaagtaccatcacactctaacccantccaacgggancctcaagaatcctccgtcaagntcatcacaagaggaacaatccaacgagaaaagcttctccaagaaacgtgatnaaattcnccanactggatggtcaaaaatctggttcaatattcccttgccggaaaaaanacttggg

SEQ ID NO: 92228 - DNA, 522 bp, Triticum aestivum
  unsure (1)..(522): unsure at all n locations
  Clone ID: PAT_TA_92228
gaggaggctacctccgaggaagatgaggagccagttgcagctaaagcgcgcaagacacaatctaaccaatcctctctgcaagccatacccggagttcccaacgagttattactaccaggggccatttttactcttgcgatagtaattgtgggggtatttactctcaccagagtaaccaatcgtcattagccttgacatttttcacatagacatcatttaaatccctaagaattgctcctcagggattttaatcgttaacaagccaacgttgacgccggagattttactacgtaatagtgctagaacgtttaattattagcgcaaatccattaactcatctcggatagctttgtagcctaaatgccggacataattatccacactatgtaagtgtttgtatacagaggaacaagatanataggtaggatcnaatggtatntacattggcactnatggnattacccccaatactgaggaattcgtgtacncnggcgganaancgtgtcaagattgaacgttgct

SEQ ID NO: 92229 - DNA, 641 bp, Triticum aestivum
  unsure (1)..(641): unsure at all n locations
  Clone ID: PAT_TA_92229
attggtgattaggtaaatatgatgtaattttgatacaaaaatataggacaaatgtgggattttaaattgtgaacttttttgaaaatcataaaagaagttgaactttaaaagaatcatgaatatttttcaaaccagtcaacattttaaaattcccaggaacttctttgaaaaaattatgaagatttacatattgatttggcattgtagatgttgataattttaacataaattggtcaaactttaataaattttgacttgagacaaatctaatacacggagtaaaaaaaacatgagggagtagctgaatgtctctcaatcctcccccacaattttaaattgggnatatacatacaggaagaaaaaaaaccccaagggggggcccggtaccaatccgcccaaaatganccctatacgcccncacggcgtcgtttaaactcctgacnggaaacctgggttacaactaanccctggagaaacccttcccacnggntaaacaaaaggcccacgntgcctccaantnccaacnaagnaatgganccccgtcggcataaccgnggtgtggtaccactgcgtaattcaggccaagccgcctcntctctctcccnnccgttccnagccacggnccttgncctaggtngacc

SEQ ID NO: 92230 - DNA, 602 bp, Triticum aestivum
  unsure (1)..(602): unsure at all n locations
  Clone ID: PAT_TA_92230
cctcaccctccccaaagccctaaccgctcgcccgctccgccgccatgaggtcnaaggccaacgganacaccgcnttcaaggcctccggcaagaacaagacggccaccggcggcgtcgccaagccgaagcgcgcccccacccccttcttcgccttcctggctgattcaggccacagtacatggagaagcaccccgaggcaaagggcgtcgccggcgtcaccaaggcggctggggagaantggcgcaacatttccgatnaggagaagcaaatttggcggcaagaagcaaatgcccaacaagcaagnngttaacaagaggaacacactccaagaagaccaagatacctgacaagaagtctgactttagatatnagaggttaggattatatnattaggaacacacngtgaacaactttctctaagtttaatcantccaanccgttantagtntttnggaanttaatctacctggnntgatctgaatctntttcaaaaantaacctgngnttctcggttcaacantgaaatntactnttcagttntaaacggttgtcaatctagctgtncttaaaaaaaancnggcgtcattcnagtnttcccccgg

SEQ ID NO: 92231 - DNA, 454 bp, Triticum aestivum
  unsure (1)..(454): unsure at all n locations
  Clone ID: PAT_TA_92231
ctcgtgccgaattcggnacgagttgcactacggtcgactcaactancggnttcaanacctaaaaaatcttagatttnacccatcaaatcatcatcaaatcatggctgaaatcccaagaaaactaagttatcgccgtgatggagcttggtggaaagacttgttaactgattgtcctccccaaagggcacattccaagaggccaagtgcaacgtccttccaaaaacaactcgcnagattccaaagttgggccggaaanaactncnactngcgctttgggataacggtgggccaaaaggattaacaacggccnggaacaacaacaatatcaagatccccaatgttaccctaaccgtttccccgttgatcanacggnttcccctggaaacttaaagagagtgtttccaaaatntgcattcggttgggggcccccanatccttggcgggtgtaaaaaat

SEQ ID NO: 92232 - DNA, 669 bp, Triticum aestivum
  unsure (1)..(669): unsure at all n locations
  Clone ID: PAT_TA_92232
ctccgacctcaccgggaaacctcccatcgaagcgaagccaaggctctctcctcctcctcctcaagatgcagatcttcgtgaagacccttaccggcaagaccatcacacttgaggtcgagtcctctgacaccatcgacaatgtgaaggcaaagttcnaggacaaggagggcattcccccggaccagcagcgtctcatctttgctgggnaagcactccgaaggatgggcgcacctttgcagactaacaacatccaagaagganccaacctccactttgggcttaggtcccttgggggatgcanntttncggcnaagacctgaccgggaagacatcacctggaggtttatcccccggaacaatcgaaactnaaggcaanttcaagacaaggaggattcccccggcnaaaantcttattttccccggaacactttaggtgcccaccttgnggttaaaatcanaggatccaccccactggaacaagtnccgggggatcaanttgnaaaacccatggaaacataccngnggttatccgaaaattnaattaaggcattcagnaagggggatcccggcaaaaccctttttcggaaaatcaggtggcncccttggtaaancaagggccccccntggcaagcccnggaaaattttaaccccnganaaacccgggggttn

SEQ ID NO: 92233 - DNA, 609 bp, Triticum aestivum
  unsure (1)..(609): unsure at all n locations
  Clone ID: PAT_TA_92233
gcacaacacaaacacaaacacagatcgatcgagatccagagcaaccaggagcaatggcgggcgagaagggcctggtgctgctggacttctgggtgagcccgttcgggcagcgcgtccgcatcgcgctggcggagaaagggcctgccctacgataacgcggaggaaggacctgatggccggcaagagcgaccgctcctccgcgccaaccccggtgcacaagaagatttccggtgtcctccnacgacggcgccccgtcaacgattccttcatattcttccattacctggaagancctttcccngacgcccccgnactgtcccccttcgacccctaagcncgcncgnaaggccctttntnggccgataanttnaaaanaaagngtaaaaatggggtgcccccctttggacncaaaggnaacccnaagggnaaagnccccccaaattctggatccccaaaaccctcaagggcctccgggaaanctttttgggggaaaatntggtcttnaaccnctntgncctaacgntggtcaaatncaaagnacggaattaactccgagtggncaaattcgngtgcaaccttcgaacggaaagtncaaacctatccgaagtt

SEQ ID NO: 92234 - DNA, 588 bp, Triticum aestivum
  unsure (1)..(588): unsure at all n locations
  Clone ID: PAT_TA_92234
cncgtgccgaattcggnacgaggggtgtttgcccttctaggattgttctcggnatgccactctacggccgggcatttgagaataccgacggccttggaaagtcatatctcggtcttggagaaggaacctgggaaaatggaatatatgactacaaagtattaccccttcctgggtcaaaagagctatatgacgattcgcacaagctacctacagttataatcccggcacaaggaactttatacatatgatactattttcatggggtatttgaaaaaccaagtgggtttaagagagagggcctaagcggtgctatgtngtgggaaagntccgccagatggaatccggagagcaaantttaatacgacaatggccaatatttgcaacatattgaccgtnntacaacgtctccaataccaacatcnaatttngaatttaaggacatcctcacaccatananttgggnaatatcctaaattgccactccggccanatcggtcctatntcaaatttaannaatgncacaatacggtgtttcaataaacnctgaagtcatagtccnatacncaattnttacncaaaaaaaaaaaa

SEQ ID NO: 92235 - DNA, 401 bp, Triticum aestivum
  unsure (1)..(401): unsure at all n locations
  Clone ID: PAT_TA_92235
ctccttcacaaagtattgcnaactacagcttgatcttgccaacctgatagtttaggactaattgtcgctatcattgttagtcttcgcctacaaacatggagtttaatttctcaactccgtttccanagggcgtaatttcccttccttgggatacagatctctataaagctggaccaatgcaatgcgcggnccctggacatactcccaagatgttcaagggcaactaatacactcaangaacaagggacccaaacaatgaaaattaccaaggactggcttnaacnggtggaaaaccaagttnatgaagcttgggaatacccccccncggccgatnacnccgattctttnaacnaacggtaaacctgaaaaacgttnctgattcccgaaatttnaggccaatc

SEQ ID NO: 92236 - DNA, 692 bp, Triticum aestivum
  unsure (1)..(692): unsure at all n locations
  Clone ID: PAT_TA_92236
ctcgtgccgaattcggnacgagcttcatagctaccagttctcgcaaaaacttaatctcacgctaacaactgctggccagctcctaaccttcaaaaaccctttttccatcgttaccgcacacctaactcactcacccgttactacggcgcaaaatggatatggacatggatatggatatgggacatgaccatcatggcgattcctatgccgatggcatcaaggctctatggctatgggacatggggaagcatgaatatgtccttccttcaagtagcacgacaactaatctccacactaaagatgtttgcgccnaagtatgttgctgcctaccaagcatgttcnatcctcatttcctncgccactttttgngcggctcnacgccttcaaggcttnggnggaaccctnttggtaaatgccnacggnaactcgcattcaccgtggtggtaaatgcacaatcnggaacaagggacaaatccggcgccgcaaatgngcttcaaaaaaggctttaggaaagtttatggnggaaactccntnggtccacntgggaatcgtgacctatcggcanacgggacaatacaancgtggtctactagtacggtagtcagaaatggtnnttaccatnangaccttntgnaaanccngccttgantttcananttggtaagattaaanttccttaagcggaaataaaa

SEQ ID NO: 92237 - DNA, 348 bp, Triticum aestivum
  unsure (1)..(348): unsure at all n locations
  Clone ID: PAT_TA_92237
ttttttttttttttttttaatttagaaccgagggagtacngtncatattttaangtaagactattagtacaaagtttaactaagacaacactaattataatgcttaacactttgacaggacaggtactcccagctacagtttaaaaaaaagaaacacctacatgatttccttgggctccaacatcacctaatacagaaaggataacaagagcactacacgtacgttgtattacattatcccctgcacaaggccgaatatccaacaaaaccttcccnatgcactaacaccnagactgcacctggcatgacgaaaccnccntgccnaattcngacagggggggggggggc

SEQ ID NO: 92238 - DNA, 218 bp, Triticum aestivum
  unsure (1)..(218): unsure at all n locations
  Clone ID: PAT_TA_92238
gagagaactagncncnagttttttttttttttttttttttttttgctgcaacgtgatatgtattcgaacttcatacattgtttctctgacacgatttgcattangaancantgtaacaaatgtganggatataacngtancngaanttaacctttctcttcctcaaaaatctcnccgtaacaaaggggaaaaaaaacncaaggggggggcccggntac

SEQ ID NO: 92239 - DNA, 656 bp, Triticum aestivum
  unsure (1)..(656): unsure at all n locations
  Clone ID: PAT_TA_92239
ctcgtgccgaattcggcacgaggccaggtcttggatcgtctcgagcgttacacccaggaaagcgaaaaaatcaccggactcctcggtcgcgaagatgtcgtgacaggcttacgcagtgataaagtggcaaatttggaattcctcaaaaaagagcacggcgtaacgattgaagaggcaacgtgctttatgacttggggctctatcagtattcatgcggaaactaccacgcaagcagctgaantctcctatcaatttccggctgttttcaaccgacaattgacaagggctcaacttgctaccttggggaaaattttcaagccaaatacccaacgacaaattgggaatccggcaatggaagagntttcaaaaggngaaaanccaattgatacaancctcnattacccacnggtcnatttacccaccaaccggttatcaacgggccntttnccttcttcaattatgaccaccctgacttaccgggnattttcncncngccccttaanaatacaatcaaananttccgtggatcccgttatcgacggtgcgtatacaaacgttacantgccaaaacgganatncaaagcagctaanatannccgatataagtcaaactcattncanttcatacntttngagggccnaacatttcctttaag

SEQ ID NO: 92240 - DNA, 342 bp, Triticum aestivum
  unsure (1)..(342): unsure at all n locations
  Clone ID: PAT_TA_92240
gtataaaagtcgttgatttactcgccccttatgctcgcggtggtaagatcggacttttcggtggtgcaggtgtcgggaaaactgtctttatccaagagttaattaacaacattgccaaagcacacggaggttactcaagtcttcactggcgtcggtgaacgtactcgagaaggtaacgacttgtacnatgaaatgcaagaaacaaaattatacaacttgatggggatccaaaggttgcatnatttttggncagatgaacnaccccctggacccggcccntgttgccttaactggccnaacattgcananattcccgttncaaaaaggccaaaagtctccttt

SEQ ID NO: 92241 - DNA, 557 bp, Triticum aestivum
  unsure (1)..(557): unsure at all n locations
  Clone ID: PAT_TA_92241
aggagattcaaattcatacataatctgatcctaaatccacaattcatcagatctcggaaaacacaccgcaaaagagtattacatcgaacagatctccaagaacatcgaggagaacatggtattaagaatcaaagagagaaaagaagtcatctagctactagctatggacccgtaggtctgtggtaaactactcacgcttcatcgaaagggcaattgtgtttatgtagaagccctttgtgatcaaatccccctccggcaggacgccaaaaaaggtccctagatgggatctcacgggtacataaggttccggcggtggaaaagcattttcgtggctccccctaatggtcttggggtataagagtatatatgggaaaaataattagtcaggagaccacgaagggccacaaggcaaggggcatgccctacccctgggngttcctccaaccttgtggcgctcgtggtcctccgactnatctcaaatcnccnggttgctcnggccaagaagttatccgaagtttaaccgttggancctttggcctttttgcaaatctaanatc

SEQ ID NO: 92242 - DNA, 427 bp, Triticum aestivum
  unsure (1)..(427): unsure at all n locations
  Clone ID: PAT_TA_92242
tcgcgctgccaggaggatcgctgatcccctccacccctctcgttcccaaccgccgccacccaatcccgcatgctcgaacgagggagagccccgctcgatccccttcttcgtcgaggctctcctcctctagccatcgcgacttcgcatccccgtcagctcctattgctcctgctccctctccaataggtcgccgccctgcgcgtgcgatcagggctgcgcctccctcctccgcgtcgtcgcctcccatggcgccgcgcccggcctcccgcaccaggcgccatcaccttccctcgtcggctcctctgcatcacaatttgcaagtgtcgatgataccgtgcaagtgatgcaaccaagctcaaggaggagtcgatgaaatcntgtcctttgngttgtttcattcnanttgatnantatgganccaatcggg

SEQ ID NO: 92243 - DNA, 233 bp, Triticum aestivum
  unsure (1)..(233): unsure at all n locations
  Clone ID: PAT_TA_92243
ccgcgaccgatcgaacaacccgaaccgcctgccaccgcagcagaggcaaatccgagcacgccggcggcggnggcatcacggcgcggggccggcttcaccgcacgcgcgcggctctcgtgccgtgcgcgcctcgacctccccccgctttccccaggcgccgggaggcggatcgtggtgggattcgcgtgccggtcaaaaggccggggatttgaggaangaaatggcggtgcggc

SEQ ID NO: 92244 - DNA, 630 bp, Triticum aestivum
  unsure (1)..(630): unsure at all n locations
  Clone ID: PAT_TA_92244
ctcgtgccgaattcggcacgagatctagagaaactatagttcactttaaaaagccattagagctaatttacattgtgtaagagaagctacggcggaagaaaacatgtcggtagtttcactgctaggcgtcaatgttcttcagaatccggcccggtttggtgacccatatgagtttgaaatcacgttcgaatgtttagaaacactccagaaagatctcgaatggaagttgacttatgttggatcagctacatccaatgatcacgatcaagagcttgatagcttactcgttgggcctattccagttggcgttaacaaatttattttcgtagcagaccctccggacaccaataagataccaagacgccgaaattctaggtgtcaccgtcatacttctaacatgtgcttacgacgtcgagaatttccgtgttggatactacgtcaataacgagtatgaccagatgaactgaacacagacctcccgcaaagccatattagagaaagtcgggtaatatctggccgagaagcaaggtaaccncttgcataaatgggacccgatgatctcgcacanctatcaccgagaacagaacagctaangcnatggngaaanacggccaaagntagacaaacaaa

SEQ ID NO: 92245 - DNA, 577 bp, Triticum aestivum
  unsure (1)..(577): unsure at all n locations
  Clone ID: PAT_TA_92245
cncgtgccgaattcggnacgagctgctctctgtatatatagtgctcaatcaatgagaatcaactacttctgtcaaatcactttttcactttacacgttatnagtacncgctctgccgagagcgacagagagcatcgcaggaaaggtaagatgggaaggaagggacctgcgtcgcttgcttccgctattgcacgcttcctccaagagagagaaacgtcgctttccgcgcaaccatcgccaacgtgctgcaaagtcgccgtcgccgtcaaggactggcgcaaggagtgggcctcgccgccgctttttcgcctggaacaaacgccaaaaccgccgccgtgggtaagcaagccaaagnaaacgcccgctccgttggcgaacacaacggtgcacaagctggacctcgntccggcaacgctgcaaacaagctgggcttcgntccgntcgggcgtcccgatgataatctacgacnatccgccgcatcgtctcacatcctccnangatggtcctggagncaacgggcatctcgnnaaaaaangtccctgnaatnccgcgctcgcccgtcgttncaacggttgact

SEQ ID NO: 92246 - DNA, 214 bp, Triticum aestivum
  Clone ID: PAT_TA_92246
ctcgtgccgaattcggcacgaggttaagttgtagggatggtgttcctgatcaatgatgttccccgttaagtcttagttaaattttagggatgttgatggatgcttttagtttaagtttcgttgtcaagaaaatatttagatgttgttcctcttgtaatatccactattgtaatccaacaattctatccaatatatgatttcttctctcatgagt

SEQ ID NO: 92247 - DNA, 596 bp, Triticum aestivum
  unsure (1)..(596): unsure at all n locations
  Clone ID: PAT_TA_92247
tttttttttttttttttttgacgttcattaaatttgaattagactttatagaagcaaaaggctgtataaaagtttgctgcctccatctcttcatcactgacaagtaaaggaccaccgcctctttctcgaacacccatgcgttcacttaatagaccaagagtctcgtcatctttctcggccttccatatttcatcaaaagtcttatgatattgcagctcaaggttgaaatcttcagcgatggctcggaacatctcccacggaaccacgtactcaggtacctcttcaactgcctcactcaaaaagaaattatacttccaaccaaatgggggtcgaaatattccatccgctgggtgttttccctgggaaaacgaacctgataaattcattacccaatgacgcaccttcttccgtaccttttctcaacatcgcgctctcaggagtctcgaatttggtgcctctgattacaacgctagattagggcnagcnggcgttgaatcntcacttttcacgaggactccgatggggatcaccaataatcgcccttttaagactcancaatctgacataacgggttnaccncttaaaaggtatgatca

SEQ ID NO: 92248 - DNA, 621 bp, Triticum aestivum
  unsure (1)..(621): unsure at all n locations
  Clone ID: PAT_TA_92248
gggacanataacttcaacantattgtanaaccacatctgcatccaatcaaatatttatacattaggtctctagaaattagccgcaagccgaactattgactaaatttgctcacaagtancatgatagaanaaacgtccgactcttcagtgtacacaaaaccagactaggagcacatgtcagtggtgtcctacgaatctggatgtgaaaattcctgccggagccgagattcattgatgacaaagagtaaatttaagagttttcactgaaatggcgatgagaaggagtagcggtggcaagttttggtcgaaaatctgacctgcagagatttctcgactaaacacctcgacgaaacctacatcctaaacaagaancgcagacaagataacacntgtcgaaaattctgttaaagaaatcaanaagctcactttcttaaactttcctagaagatcttccatataactcatctggctacaaccgaanctctccaatcaanagcatactcgaaatcacngancacgtggaattacctgtcgnacggtntgcgcgtgaactcatctagacaacctagntcgcataccagcaagaacataatcactgnacaaccncatantttcatnccn

SEQ ID NO: 92249 - DNA, 605 bp, Triticum aestivum
  unsure (1)..(605): unsure at all n locations
  Clone ID: PAT_TA_92249
ctcgtgccgaattcggcacgagagctcccaccccacgccatgtccaccctaccatttgccgccgccggcgagacccccaccgcccgctcaaaccaccatcagcgctctctgcgacgacctgctccgcaagatcttagcccgcgtccccgacctcccgaacctcgcccgcgccgccttctcctgctgcgccttcctccgtgacgtccgctcggaccccgccttccgccgccgcttccgctcgctctgcccgccgcccctcctcgcgttcttccttgaaattacatggatctgggtcctggtctacccctccccctggcgccctccgacacgggctcgccgacgccttcgcggcgcgatttcttcaagacccgccgcatgaacggctcaagnagtcnacactcccggtgggaantcgacacatttgggcacagatcaaatcgccaacgggaacagcagcaactaanccgcttagnaggcctgtcccttacccaaaggaantttgaaggaaanantcctnagtcaaangttctacaagaggacaaggctganaagtgtctgatcgcatacgtttggcncggaattnccnttcaacaaaaagggngaat

SEQ ID NO: 92250 - DNA, 512 bp, Triticum aestivum
  unsure (1)..(512): unsure at all n locations
  Clone ID: PAT_TA_92250
cgcgcgcgagatggcagcctccatgatcacctcgccgattgtggcgccgacgagcctgccgtccctctcccgccggggctcctccttcgccgtcgtctgcagcggtggcaagaagatcaaggtcgacaagcccctcggactcggaggcggcttgacagtcgacatcgacgccaacggcaggaaggtcggcaagaagggcgtgtaccagtttgttgacaagtacggcgccaacgtcgacggctacagcccaatctacacgccggaggaatggtctgaatctggtgaccgctacgccggcggaacgaacgggcttcntatctgggccgtcacctcgccggctcctcggcggcggcgtcctcctcgtctacaacaacaacgctctcgccggctaagagaacatctacgtgttacacaaggccgggtctctgcntgcatgcaagtctctgtaatctacttactactcctgtgaattttgtcatcaacaatcaaagtattnattcnacaaaaaaaaa

SEQ ID NO: 92251 - DNA, 649 bp, Triticum aestivum
  unsure (1)..(649): unsure at all n locations
  Clone ID: PAT_TA_92251
tttttttttaatacacaaaatttagattcgattgacagaaggtcaattcccctagcagtgaagcttaattaagaccatggggacaatttttcgaattccttagtattatatcccctttcgcagttctcgacttgccaatccttcacttccggtcccaatttaccttgaaggtaatgcaagtacactacaccggagaaattgcaaccatggtcaaatgctgcgtagttgtttgacatttcaccttgataaaatttctcataaggtcggcttcttgggaagggggatgaggaagtcacgggatccacctccttcagatccttgggagatataggagcctctctgaattgactaacgtgtagataccatttctccatgcacaattctcaattcggatgcctatcaaggcatcaccggtccaagtacatgctcacatgttgcaacctcctcgattccccaagcactgggcacgacaaacaaagaaccaaagcnggaacaaggtgacaaacttcttggtgacaacattggattggnccggagttaataacaagaattgtgacgggaatgattncaagaggaaaggctctgccaattggacaaggggggccgtaccaatccccnaannagcctatannncccacggctcnttaaa

SEQ ID NO: 92252 - DNA, 641 bp, Triticum aestivum
  unsure (1)..(641): unsure at all n locations
  Clone ID: PAT_TA_92252
ctcgtgccgaattcggcacgagccgccctgaaagaaaccgtgctagaattcgcttgtcttaaaccacaagtgtagattgacaccttccaaaatcttacaacatgaccgataaaaaagaaaatgagtctatcgaccattccatgattgatccagataccctgacaaaatacaagagtgctgctcagatatcccaaaaagtattggaggcagttactgcgctatgtatcgctggggagaaaattgtgtccatttgtgctaaaggagatcaactccttgaagaagagataagcaaagtctacagaggcaaaaagatagcaaagggaatatctcacccaacaactgtctctccatcttcgttcatcacgccatacactccacttttatctgatgaagcagaagcagccgtgacgctccgtnaaggagagncgttaagatcaactcggtgcacaaattgacggnttgggactatatatgcgatacaatcgcatatcatctatcgaaaaccaaatcnganatnagggcccanaactggactnattttggnaaattctacncaacancttctttanataagatccnccgggctnaacaccngaactganaaataancaagatttagntaancccccaanaaatttcan

SEQ ID NO: 92253 - DNA, 468 bp, Triticum aestivum
  unsure (1)..(468): unsure at all n locations
  Clone ID: PAT_TA_92253
agcaactcaaaaaagatctccggaaccatgcatctgaatttgatgcactctatgagtagtattgaaatgttgaaataaaaagtaaacaaagaggtaaaaaaaagcttatgcacaccatgtcgatgtgcagtggacgtggacaggtcaagttctgtgaacaaggcttgccacacgcatccagaacaatttatcagttgttgactttttttggagatagcgaaccactcacgccaagtggtgaataccgtctctcgaatggagcttataaattggttaggattcccattcggaagcaatgtggtactactaattagctgacaccatcccttctgaagttttaccttgacatgggccaaacgtaggccaatgcangaacgacaacaagggacccccaatctggcccgttttggaggaaaacccaagnatcnttgctgacatcaaccagacaagctctccaaaaaaaaaaaa

SEQ ID NO: 92254 - DNA, 494 bp, Triticum aestivum
  unsure (1)..(494): unsure at all n locations
  Clone ID: PAT_TA_92254
tgcaaattgggtgcaaagacgggaaattagttgcatgccgtggacacaacttcccggtgctgaggaccctgaaggtggacagatgtcccaccatgctcacattcgagttaggatcaatgacaaagctcaagacatttgtaatggattttcttccctccgaggacaataagataggtgttgtcggtgtagagaacttgggagaaccttaaagaggcaaggtcccgtggtaggaaaggcaacctgggcaatgggaacgtgcagtgggagcagctcaaagaccaccccaactccaacaagttcaaagttgtagcggactggtggtgaggtgcgcatcttaatttcctaaatttaggaactgcggtcttgtatgttttctacggcttaattagtgtgtttttcccttcaaactgcacatgtttgtgttcctaacttaattctgctcaaggctcgggctccnttcaacaattgggtatcctatggatttcaatgtcgtg

SEQ ID NO: 92255 - DNA, 613 bp, Triticum aestivum
  unsure (1)..(613): unsure at all n locations
  Clone ID: PAT_TA_92255
ctcgtgccgaattcggcacgagccctcttccacccctctctctcctgccataatatcatcgtggcctctccctccctccatcctctctgattgcccccgcgctcgccatggaggccgccgcgtccacgctgctcctctccgccgacgcgcccctcgccgccggccgccgcctccttctcgtcccttctcggcccgcgcgggcacggcggggcgccgcgcccagcaggtgcccgcgggcgtccgtccgcgcgtacgccgcggcgggccgcgccagcaccggcctctggaaacggcctcgccgggaataacaacggcgggtacactgttggtgacttcatgacgaaaagggangatctccatgtcgtcaaaacgtcaactccggttgatgaacgctcgagatgctggtgcagaacangatntctggttttcctgttatcgatnacactggganttggttggcgtttccaaatacgatntaataactttggactaatggaaggtgtggacggctgatacnantaaatangttcctgaatagtacacttggaaanattccgaaatcaanatcttgagaaacantggaaaattacgggagtanacccccaactctgtg

SEQ ID NO: 92256 - DNA, 401 bp, Triticum aestivum
  unsure (1)..(401): unsure at all n locations
  Clone ID: PAT_TA_92256
ctcgtgccgaattcggcacgagcacattcctcgcctgcgcctgcgcctgcgcccacaaccctctcttctcccctccccaccccgccccgatttggattcttccgccggccacctccctcccgctgctgtgtgtggtgtgcgcagcgcgcggtttctactangccctcgccgctccaaccagggggcggccctgccctctccangcaccacccacaaaggtttcttcttcttcttcttctggtgcgcccgtccgtccgtccgtccgatccacacaccagacgtctccttctccctccctgctcttcaaaggctctatcttgcggaggtgggacaacaagatgtcagtgctgncngncatgcnggcngnagatnttcggggagcncanctggcctngggtggc

SEQ ID NO: 92257 - DNA, 400 bp, Triticum aestivum
  unsure (1)..(400): unsure at all n locations
  Clone ID: PAT_TA_92257
gtcagctggggcctcggcttcggcgtgccgtgcgtgatcatgctgctcgcgctcgtcgtcttcctgctcggcaccaggacgtaccggttctacgactccggccacggcgagggcgccagcgcgttctcgcgtgtcggcaaggccgtcaaggcatggtgcaagaagtccccggagggtnggtgccctgggtgcaacacggtgactgcgccggaggacaacttctcaatgaagaagtttaagggnctngcgaggttttcccatttgggcaaattttctgcccnangcgttgtgttttcgcaaaccnccaaactntttaacaaacaagggggaaccttaacctntaattggggccccccccttgnangggcccccccccgggncaaaatttnnttggggtaaa

SEQ ID NO: 92258 - DNA, 370 bp, Triticum aestivum
  unsure (1)..(370): unsure at all n locations
  Clone ID: PAT_TA_92258
tctcgagttttttttttttttttttttttttttttttttttttttgacatttcgtaaaatgtctaacaacaaanaatgtgtggctgaaacggnggaggggctttcaagcnccacaagtgnaatgttgcgcggtgcaacaacgggtggtggcgtgatccaccaatcaatncgaagggggtacgacagnaggaanttttcctangatgtcggagncaccaaatcgtccgcnagtgtggacnttggtgcgactaaaatggacagtttgnatncggancaggcgatnaanttgtttaacaacancananaaaagtaccgggtgcacaagttgccacctgancaaatgtnngcctttgaaaangcacnatncgtt

SEQ ID NO: 92259 - DNA, 624 bp, Triticum aestivum
  unsure (1)..(624): unsure at all n locations
  Clone ID: PAT_TA_92259
gttacttttgacaccgtgaaaaaccgcatcaaagcagaagtatcgacggctatgaaagattactggggccaacatgccccaatttcctatagggagcttgccatcgactcataatctcgtcaccctaaggaactctcgctagccagaccattactctctagactatacgcttctccgctcaaggacatggtgactttgcaagagtaccaacgccgtttcaaatcaacgaagggcgctaaccttccattggtggatgccgaacagtcatttgccccattggtactttcccnagaggccgcctatcccaccacagttcccttcngagtcccacatcttccaagcatccccgnagatatttggctaagagccttgggaaggatcttacgttgtacaaatggttncctttccggatttcaacacaagatttgccctaagaatcctatattagggatnaatagtcttcaatcctgctcaacatttganctggcttgtgggtaatggttggtattctgaagggatcaatantatatccganacggtgtatatccaaacnntaagatccgngacaacttaagggtgtgcaccncacaatcagtacagantttctnaacnagtggattgaag

SEQ ID NO: 92260 - DNA, 524 bp, Triticum aestivum
  unsure (1)..(524): unsure at all n locations
  Clone ID: PAT_TA_92260
ctcgtgccgaattcggcacgaggaggatggccgtacccttgctgattacaacatccagaaggagtccacccttcaccttgtcctgcgtttacgaggtggcatgcagatctttgtgaagacccttactggcaagaccatcactctggaggttgagagctccggacaccatccgacaacgtcaaggccaagatccaaggacaaggagggcattcccccgggaccagcagcgtctcatcttccgctggcaagcagctggaggatggccgcacccttgccgactacaacatccagaaggaatccactctccacctggggtgctccgcctccgcggtggtcagtaattgccgtggggtgctctggtgggtgcccctgtcttccatgtgaagtgttagctcatttgtgtcaancctactatcattctggttcatggacatcgatccccgttagagtgtgttggttcctttaaacatttctgggatacaatacgtcaatatgaataatggacttggactaaaaaaaaaaaa

SEQ ID NO: 92261 - DNA, 600 bp, Triticum aestivum
  unsure (1)..(600): unsure at all n locations
  Clone ID: PAT_TA_92261
cccatctgtcagtctctatagtcagcttgagctagccacactctgttcttcgaccacagccacaagtcctctgagatggcattcgtttgtgccaaggcagtgctgctcgcagcggtgatgcttgcgagcgcggcacagctttgcatgggcgcgaggcgccgcatggagctgtaccggccggacccggccgacatgctctcctaccacaatggcgccgttgctccacggcgacatcgcggtgtccgtcctttggtacggcagcttcaagccggcgcagaagcggtgatcctcgactcctcctctcgctcaccgccgacctcaagccgcctcgccgtcngtcgcgcagtggtgggagcacatcgacagcatactctccccgcgagcgcgaatccaacgggcgggcgagaaatcgttcctgctcgcggacaatctccgacgngcgtgctcaagggcaantcacngaccttgacaattaacgccctggcgcgacggtanccaagaaagngggtcccgtggtctcacgggcaagactgcatggaggntcggatggccgtgaactnaggtcanncagtcggacaacaattggtcgaaccggaacat

SEQ ID NO: 92262 - DNA, 190 bp, Triticum aestivum
  unsure (1)..(190): unsure at all n locations
  Clone ID: PAT_TA_92262
ctcgtgccgaattcggcacgagctcgtgccgaattcggcacgagagctagcttcgacantgaacatcttgaaccancccatcagncccggcggngcccacncggccttcccggccgncgccgccgccaaggacngnggtatgccggnntcgctccgcttcgacgtcngtcncagcaccncccaccgcgcc

SEQ ID NO: 92263 - DNA, 543 bp, Triticum aestivum
  unsure (1)..(543): unsure at all n locations
  Clone ID: PAT_TA_92263
ctcgtgccgaattcggcacgagctctccctcccccgcccgctccaatgccgccgcccatggngctctccgtctccgtctccgtctcctcctccgccgcggccttcgccccgcgccaccgcctccccgcgccccgtagcctcacccgcgccgcccgcgccttctccacgggctacgccgcgagcttctacggaggngcggcgtccgcgacccgcacccgcggncgcgacgaggaggaggtcggggacgaggacgggtcgtcntcngggttcggcgggatgtcggcctcngnggcggcaatggcgctggaggagngcgagatgccgccctgcccgcccggcctccgccagtacnagacatggtcgtgctccgccccnacatgtcngaggaggagcgcctgggcctcatcnancgctacaangagctgtcgtggccgggggtgcatgtnccttgagtgttcaacaaaagggtatccactggcctaaagatcaggagangaaanaagacnggcngccttaactantagatgattacnctnggacaat

SEQ ID NO: 92264 - DNA, 549 bp, Triticum aestivum
  unsure (1)..(549): unsure at all n locations
  Clone ID: PAT_TA_92264
ctcgtgccgaattcggcacgaggagagattgtgagtgagtaactgagtagagtgtggcattgtccaaacaaagaaaaacttttaagaggatgcagtctattttgcccgctgtgtccgatttatgatttgatgattttaaaggcttttttatataactatctataaaagttgataaacaaatttattaaaaatatttatataactagctaccattttactaaactccggattgaatgatggtaacataagaaaccatgagatgcaagatgacgggttccacagatggtatgattcctgaatggctcccctaataacctccaaaacatccgagcatgccatccagaattaactccttccttggcaacatttcctcctttcatcctccngcaatcccaacaaatggatgattttaatagatactttgcttgtgcancattatgggccatgattccccttacnagagttaancaattttccantcaattggatttnaaaatatccctttgccatggatttnnaattcccattcctnaaagggtgggaaaaaaa

SEQ ID NO: 92265 - DNA, 212 bp, Triticum aestivum
  Clone ID: PAT_TA_92265
gccgcagttttgaaagaggattaaataaatagtcattgtgaatattagtcgttatctttattagcatcatttgggatgggggactgtgacctggcctagagcatttatagaatgtaaaagtaataaacgctctaaaacgttgcatagtacgctatcatttcgcacaatctttatccgaatagataattttcatccagcccaaaaaaaaaaaa

SEQ ID NO: 92266 - DNA, 231 bp, Triticum aestivum
  unsure (1)..(231): unsure at all n locations
  Clone ID: PAT_TA_92266
ctcgtgccgaattcggcacgagncattcccgaanctnanttcgcactttgnananaaaacgcccccatctcccccttctnctccaggtgctccacgccgggcgccgncgcncataggtcagcccatcgcccgatccatcgatcccgttccagcganagcgacngtgctgctgcaangtcgcggtcncaggatggtggacggtttccgncgcacgatctcgttccccgcncc

SEQ ID NO: 92267 - DNA, 568 bp, Triticum aestivum
  unsure (1)..(568): unsure at all n locations
  Clone ID: PAT_TA_92267
gcgaggaccgcactatattgtgcaaacgtagttcgaccaaggagaaggaatggtagccacttttgaaaggtactactacctcgaagctcaacgactccaattggtagttgtccggtgccacgtccaacgtgaccctttctagaggtgaagttccatgccagggattatgcccttaaatttttttgggtcggctttatgcaagattggtcgactttacatcttcccgcaatgttattaagcatatatcaattcaagttgctgccaccgtccatcaagaccatgatttgggtatacctttgataattggtccaagatgattcccggatttctgtttgtgaccacctttccgataattcgtttatcaaaanaatttggtgctcaaacaagcatgtattgttggacacaggtccgtgggtaactccgtaaccnttcacttctcncncttcaggtaacagttgcatccttacggaggtatgcttgcctntacaacactgagncanccatgcatggtgatcgcttnatgtgcctttcgcgctgcaatctgtatcaanttcgntggngtggtggg

SEQ ID NO: 92268 - DNA, 577 bp, Triticum aestivum
  unsure (1)..(577): unsure at all n locations
  Clone ID: PAT_TA_92268
ccgcctcttccctccctccttcggttcctcggcctcccgatcgagcagtagaagcagcgcaagggcaccgctagcactaaaggaatggcggccgagacgttcctcttcacgtccgagtctgtgaatgagggccatcccgacaagctctgtgaccaggtctccgacgccgtcttggatgcctgcttggcgcaagatgccgacagcaaggttgcctgcgagactgtcaccaaagaccaacatggtcatggtctttgggcgaaatttaccacttnaggcaccgttcgactacgagaagtttnttcgcgacacctgccgcaacatcgcttatctcctnatatgtttggctccgacgccnaccgtttcaagggctcgtcaaatccganaacatccccttacattgccaagtgtttaangnacttaacaaacnccgaaaagtcnggccggtacaaggataagttnggtatccaccacaaacctaactatcctaacactgtncacaaatggagtgcnaacagtccagaaggactcccggtaagctacgagacagtattcatactacaagatggcangacgttct

SEQ ID NO: 92269 - DNA, 570 bp, Triticum aestivum
  unsure (1)..(570): unsure at all n locations
  Clone ID: PAT_TA_92269
ctcgagttacattgttgagaggtctcagcatctagcaagcacttcacgttcccttgccgaagaagatctcgtggaggttgatggaaacagaaaaaagcttgagcagtggttggcaggtgatgagttggaacgctctgtgatagtgctgcatggtatgggagggcttggtaaaacaacttggctgcaaatgttctacaagaagaaagtgaaaatttttgattncaccggntgggccccctntccccaaacttatttcaagnanangttttttaaaaaatttacccaggggttttcaaagataaagcattgttccacccnanattgaaaccatggnatcataaccttttaagaagnacccaaatttttttacactcananttttnatccggaggagnntttgccccccnaatccnagatntttngggggggtatccttacaanaagggcaatnttnattcaacaggaagaaattnccattttccaaaggaagcttaaacnaaaccntcaaggngntaggaanctcgnaaantttcaaaannnaaatgatgncnaaacgcaattccataaggt

SEQ ID NO: 92270 - DNA, 479 bp, Triticum aestivum
  unsure (1)..(479): unsure at all n locations
  Clone ID: PAT_TA_92270
ctcgtgccgaattcggcacnaggctcntgccnaattcggcacganctcgtgccgcaaaccatccaaatcanacggccacgaccgaccgatngcccaaccaccggcgactccggcgatggcggcggcgtacgggtgtgcggcatgcagcncggncctgaacctgnccncctccnacctctacccgncggggacctacttctaggcggngaacaanggcacgctgtccttcatctgggtggacaattcgcngctgcagttcgcggnggacgacggattcgccccttcttccaaaacgtcgactactgggggatccaagcgggaagncaacgcgttnaatgcnacccctgcggnagtcctccngcaacnttaaaacaacagcctccctcanggaggganaagcaactcggaatgncccaacaattntnccccgctggccaatnacgnttaaattaaggcntancggcgcngntctccngttc

SEQ ID NO: 92271 - DNA, 443 bp, Triticum aestivum
  unsure (1)..(443): unsure at all n locations
  Clone ID: PAT_TA_92271
ctcgtgccgaattcggcacgagccgtgacttcatcaagaacatgattactggtacctcccaggctgactgtgctgtgctcatcattgactccaccactggtggttttgaggctggtatctccaaggatggccaagacccgtgagcacgccctccttgctttcacccttggagtgaagcagatgatctgctgctgcaacaagatggacgccacactcccaaantactcaaaggccgttatgaggaaatntcaggaatccctncntacctnaaaaggccggtaaaacntnaaaggtcccttcgttcaatcccggttttagggnganaaatttttanaggccncaaacttttangggaaaagggcaaacctttttgaggtcttgacaaattaatgncccaaaaggccccaaaaaacccggtttcccttcaagagtttanaaaatgg

SEQ ID NO: 92272 - DNA, 556 bp, Triticum aestivum
  unsure (1)..(556): unsure at all n locations
  Clone ID: PAT_TA_92272
agcaccttgagcttgaggtcagtggcaggcaggcaagcaagaaaggaagaagaagaaaaaaggacatggcatctgctactctcctcaagtcctccttcctccccaagaaggccgaatggggcgtcgcgcgccaggtcgccgccccgagggtgtccatggtcgtccgcgccggcgcctacgacgatgagtcgtcaagaccgcgaaaacatngcgttcccggggcgcggattccttggcattgacgattccaacgcaacttgggggaanccctccanccatttggcctggagaaanaaaaggnaaacgnagggtttcgcaactggtggtcctttcctngctcggnaaanatttccgggcaaccctncnaggaancctacattaactttacgganaattttcaacctgttggcnaganctnccgattaagtgnnaaaggctttccccaacgtcaacacatcttggcaaggcnnagggtccctccggaagcgctatacaaaagggccgttncaatggaactgcaatncaaggcctcactggcttagagccctggcnccnn

SEQ ID NO: 92273 - DNA, 460 bp, Triticum aestivum
  unsure (1)..(460): unsure at all n locations
  Clone ID: PAT_TA_92273
gcttttttccccttcctccgccgccgcgactagagtttcctcgctagggtttcgtctcccggtccggatccagcagcagcagcgggcgatggcggccgcgggagacgccggcgagaagaagatgatcacactcaagagctcggacggcgaggattcgaggtggaggaggcggtggccatggagtcgcagacgatccgccacatgattcgaggacgactgcgcccgacaacggnatcccgctccccaaagttaactncaaattctctnccaaaggcacccattntngcaanagcaatttcaagccaagcccccnatgggttgcncccggacccgagcccggctccgaaccgcccccgcgccccgcccanggcncaanaatngaccccanttcttcaagggcaacaagcaacncttnaatcaaaccggntgcaactactgaaatcaanggntgtggactgac

SEQ ID NO: 92274 - DNA, 269 bp, Triticum aestivum
  unsure (1)..(269): unsure at all n locations
  Clone ID: PAT_TA_92274
ctcgtgccgaattcggcacgaggatcctcccgcgtaccaagccaccgaccaacatggcagcgtctctccaagccgcggccacgctgatgccggccaagatcggcggccgggcctcctccgcgcggccgtcgtcgcacgtcgcccgggcgttcgggtttgacgctggcgccaggatnacctgctccctgcagtccgacatcaaggaagtcgcaagcaantcgccgacgccgccanaatggccggttcgccctcgcaattnngcncctttt

SEQ ID NO: 92275 - DNA, 372 bp, Triticum aestivum
  unsure (1)..(372): unsure at all n locations
  Clone ID: PAT_TA_92275
aagaccatcacccttgaggtcgagtcctcggacactatcgacaacgtcaaggctaagatccaggacaaggagggcatccctccggaccagcagcgtctcatcttcgctggcaagcagctcgaggatggccgcacccttgctgactacaacatccagaaggagtccaccctccacctggtgctcaggctccgtggtggcatgcagtttttgtgaagaccctcaccggcaagaccatcaccctggaggttgatctccggaacnatcgacaantcaaggngaattccaaggacaaggaggaatccccccngacnaaaagttctnacttcccnggtaaccactttaggatngcccnccctgnngggtataaatcca

SEQ ID NO: 92276 - DNA, 622 bp, Triticum aestivum
  unsure (1)..(622): unsure at all n locations
  Clone ID: PAT_TA_92276
ctctcctccagataatacattaccatggcccccgccgtgatggcttcctcggctaccaccgtcgcacccttccaggggctcaagtccacagccggtctccccgtcggccgccgctccagcggcagcctcagcagcgtcagcaatggcggaaggatcaggtgcatgcaggtgtggccaattgagggcatcaagaattcgagaccctgtcttacctgccacccctatccacgggaggcctcctgaaacaggtcgactaccttgattcgctcaaagtggntncctgctccganttaacaaggttggttcctctcccgttgagcacaacantccccccggggtactaacgacggccgatactgggacaagttggaactgnctangtttcgggtggaatnacncacacaaggtgctgaacagtnggaggagntcaagaaggataccctaccctagtccttttaaacggttctanaacngcccaagggnatgctcagtnaacgctttangcacggttcnaagatccggaaggctaaatacaatgaacatggctaccgtataaaggctttgtaaatnacttgcaaaancgttagaancgctttncgngcaacntttntaaaaaangggg

SEQ ID NO: 92277 - DNA, 375 bp, Triticum aestivum
  unsure (1)..(375): unsure at all n locations
  Clone ID: PAT_TA_92277
ctcgtgccgaattcggcacgagcaacaagtgaagtgcaccgagctgagcagtgagtgagcggccggggacgcggtcgacgagccaagaatggcgacgcaccatcgtgctctcctcctcctgctcgccgtgctgctccccgcggccgccttcaccgacccggacgccgtgcaggactctgcgtgccggacccgggcgcggncggccgttggagtcaactcatcgtcctaaccgtncaaggaaccngcaaantaagggngggaattncctttcnaaggnttnccccgggggaaattnnccggggaangggtntcgggggtttctttaaacccgggaatttcccgggctgaaactccgaattcttttgcgcgccacgg

SEQ ID NO: 92278 - DNA, 289 bp, Triticum aestivum
  unsure (1)..(289): unsure at all n locations
  Clone ID: PAT_TA_92278
gtaccgttgaaggtcttcagcaaggctatgttctgtgcgattcggataaacgctttctcctgctcttctccttcctcaaacgaaacctgaagaagaagatcatcgtcttcttttcctcctgcgcctgcgtcaagtatcacgccgagctcctcaattacattgacttgcctgtattggacctgcacggcaagcanaagcaggagaancgtaccaaaacttctttgaanttttgcaatgcaaaacaagggaacnttatgnaagggttttcaaacctggcccannacccgag

SEQ ID NO: 92279 - DNA, 525 bp, Triticum aestivum
  unsure (1)..(525): unsure at all n locations
  Clone ID: PAT_TA_92279
ctcgtgccgaattcggcacgagcggtcttctcgctctcgcgcccctcccacagtttgtagcgtggctggcagcagcagggtgcctcgccggcagctctaatcttggcactgagctgtgcctccaacgtgtttgagtgaatgcgcaggtggacgcgcttgctttcttccacgcactagatcttgtgaatttccgtctccacctgatttgagattcaccgctgaccatggctgacgcctccgccggcggcggtccctggatgaataccaacatcgaccaactctttcacgttggcctctgccgacggctcccggantcacctcgcgctgctgcgcgccgccggaaacntctcacttnacccgacctttacgccttcatctcanccgtccttcntcttctcttcgcatctnaccctgcgttccaacaaanctcgcacggcgataacgcgtnttcaagccaacgtatcgagtaaaccggangtcgacgnaggcttagncactgtgtcagtgttnnccanagctgcntnt

SEQ ID NO: 92280 - DNA, 542 bp, Triticum aestivum
  unsure (1)..(542): unsure at all n locations
  Clone ID: PAT_TA_92280
ctcgtgccgaattcggcacgagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccancccaagtgccccaagggctggtcngcgtnccgcgtggtgtccaccganccccnaaatttgcgctgcgcnggatatgaaaccaacgtcgacggaacttccgtggggcctgcaagaagtactgatnggntcaatccaacatgatatttccgcctaaaatgaattaaactcccgacanatnaacaactcatcntgccaanctgtgtttttggcaacaanatgttacaatatgcctgtcttctccgggttttcnccccanaaaatggggtgctnntttaaanaccgganacccctganaataagattccttgggn

SEQ ID NO: 92281 - DNA, 301 bp, Triticum aestivum
  unsure (1)..(301): unsure at all n locations
  Clone ID: PAT_TA_92281
ggtaaattgctcatatttccaacaatccaaaaacctctataggcaatttaccccgagtggttttgttgcttccatgagacctcctatgtttgagggtatccactataagaggtggcgcgtgagagcagtcttatggtttcaaatcatgagttgctatgacgccactctcgataaacctaaaggagagcttgatgctcaacaggacaagnttttcaagaaatgatanccgttttaagggccncccnagatttcttggggnaaaaaaatttancctanggtccaatganaatgngaaaatttg

SEQ ID NO: 92282 - DNA, 326 bp, Triticum aestivum
  unsure (1)..(326): unsure at all n locations
  Clone ID: PAT_TA_92282
cagtgccccggaagcctcacaaacagcatggctagcaatcccctgattactttcaaagctggtacctgcgtggtagatcaatcgagtaggccctacaaagtgattcccaatccgacgctcggattcctatacctgtatgccgaagagaatctcatccacttctgctggcgtgagcgcggcaaatcggtgcatgacgagcaagaatcttgacctcgtaatactgcctgccgactgccgcttcattccatacaatgatgctccngccatgtcaatnggantttcttcgnccttaattcccctncancccaanagggtacttttctggg

SEQ ID NO: 92283 - DNA, 585 bp, Triticum aestivum
  unsure (1)..(585): unsure at all n locations
  Clone ID: PAT_TA_92283
ctcgtgccgaattcggcacgagggagaatccttcaataaatctcctgtaatatccggccattcctaggaaactccgcacatctgtaacattggcgggtggcttccagtctagtatggccttgactttttctgggtctacggccacgccttcttgggttcaatatatggcccatgaaaccaacttgccttagccaaaactcgcatttgctaaatttggcgtacaactgatgtttcctcaattctcccaaaacaatcttgaggtgctcagcatgctcttctggtgtccttgagtaaaccagaatgtccgtttatgaataccaccacaaatttgtccatgaatttcatgaacacttttgttcatgaagtggacgaaatatgccggggcgttcgttagtccaaaagnatcaccgttaactccgtataaccatatctggaagtgaatgctgtcttggggaatctccgtcccgtactttnatttaangnacccatttcaaacaancttngaaanacttgggtgggcaactggcaacaacatgacctggaacgaaatgtttgagggacantgaggccatncatcaaccatac

SEQ ID NO: 92284 - DNA, 567 bp, Triticum aestivum
  unsure (1)..(567): unsure at all n locations
  Clone ID: PAT_TA_92284
ctcgtgccgaattcggcacgagctctagactgggttgatcaacaaataatagcggcaataatctgagctcgtgtctgccccttccttgagttggagcttttgggagcctgacaagaactaccctagtactaccactacagagtaaatcggaattattcatctgttgtccatagatcgtggcgatgtatgcgtcggcgagcatcttgccgagccagaccaaggctgtgtagtgaggtgcgtgatgtcnttgggaatggggaacccgcacgcctctgtccttcctcaacaatccagccatcccctgccngtcaattgtggttcaaaagcaattgccgatncaacttgccaatatctgaggtttgcagaatttggattgggacagctttcaagacattgcttgactnaggacaccgaacaacatgtatgcctaatcngatgtacgtccngatctcantcgtntagacatgatggccaattattcaatncaacaactccctgctctatcctctgnancacgggaaanagatcacacgnggaaaaaaacatcntcacgcanaatggtaggcn

SEQ ID NO: 92285 - DNA, 578 bp, Triticum aestivum
  unsure (1)..(578): unsure at all n locations
  Clone ID: PAT_TA_92285
gccaccacaaggaactccaaaaaacgcaattctgtcactaaagatgtgatagtcacctctgactcagaatctgaacctgagtttgttggcgacttactcgaaggtattttttctgaaagcgaagatgaaaatagcgagaatgatgagactggaggtgaatcagactcagatgaatctagccacagcaatgacctgggcactgatcggggacaataaagacaacgagttaaagaaanctataatctctccgaaaacagcttacttcaagacactaattatgaagataataatgaagattcgtccaaactactccagtaatagaggatgccaatggtggagaaaagatacgtctacgatgaaatagtcctatatatgattcaagatgactccggacgcgccagtcactaacaatacgattggnaacatcccgttaactttcnacgatcctanctcacatcngatataatatcaatggnaaaaagtnatgaggcaacaactggagatcatggatcattatagcatataaggtcaaaaggtggacggccacgataactaaggaaactccaactngcaaataa

SEQ ID NO: 92286 - DNA, 484 bp, Triticum aestivum
  unsure (1)..(484): unsure at all n locations
  Clone ID: PAT_TA_92286
tgccaccgctcagcacggaggccctcctcaagcaggtcgactacctgatccgctccaaatgggtgccttgcctcgagttcagcaaggttgggttcatcttccgtgagcacaacgcatcccctgggtactacgatggccggtactggacaatgtggaagctgcctatgttcgggtgcaccgacgccacacaggtgatcaacgaggtggaagaggtcaagaaggagtaccctgacgcgtacgtccgcatcatcggattcgacaacatgcgccaggtgcagtgcgtcagcttcatcgccttcaagccaccgggctgcgatgagtccggcaaaggctaaacagctcactcaacacgggncacatataaagtgccattgcggtttgtcaaactctgacattgctttgggttttccttctcattancttcctggntggtccnaaaanangtgtagtccatgtcaangttncaaaangtctcnagaaaaca

SEQ ID NO: 92287 - DNA, 469 bp, Triticum aestivum
  unsure (1)..(469): unsure at all n locations
  Clone ID: PAT_TA_92287
cgcccatcgccatcggcttcatcgtcggcgccaacatcctcgccggcggcgccttcgacggcgcctccatgaaccccgccgtctccttcggccccgctgtcgtcagcggcgtctgggagaaccactgggtctactggctcggccccttcgccggcgccgccatcgccgccctcgtctacgacatctgcttcatcggccagcgcccccacgagcagctccccaccgccgactactgaaaacctcaatctcatctcgtccatccgtcatcgccatgagagattgaaatcgcttcaaaaattccagcaagtgtacgtcgtcggcgtcatcatcaagtaagccagtttagtttcattgcgctatcttgtccttgagaaatcagggtaaacagtgtgtgcgagtcagtcagtcangaataatctcatccttctcttancttggtgtatgtagtacgtcctcaattatgatgctt

SEQ ID NO: 92288 - DNA, 462 bp, Triticum aestivum
  unsure (1)..(462): unsure at all n locations
  Clone ID: PAT_TA_92288
gtgggaaagaaagcatcccatattcaattccagctctctttcaaacctcagctgctaaaaaacactctttctacagatcgtcgtaagaggaaatttcccaaaagtcaccgtcatcatgaaattcctatactctgctatatctgcttctatgctgggcctatttgccacagcttcttcacatataatgttctcctgcccaagtggttatcaaatacttgaaagtgatgtattagccgcagcccgaaatatcgatcctaaagcaaaaatatacgaaagctcagcangcagtaccggtgacgctcagtacaagttcagcttngggtcgaagacctataataatgttttatacttaatctcaagctataatttaatcacgagatatgacagtcagggtattacaagactggatataaatctcgaaaggaaaatacgccatctcatnaaantangtgagtcnaatag

SEQ ID NO: 92289 - DNA, 463 bp, Triticum aestivum
  unsure (1)..(463): unsure at all n locations
  Clone ID: PAT_TA_92289
agaagtggaaaacagtttttttccatccggtggtcctaatacccagcttgaaagagtcaacggctacttagttagtgcataaatcttttgattgcgaaaaaattgatgactttgaaggaaatttcatgagttgaatatttttcaccgaagagaagtctagaagatcacgactatcaaaatgtccgcatcagcaaaagaggaggcaaatccttcctcagaaccggctccttcgaaaaaaggagcgaagaaggccgaagccaaggcaaangaaagaagcagaaaaggctcgaaaagcagctgagcgtgaagcggccactgcctcagctaattctactgaagtccaagacacagcaaaagataattacgggtcaatcacaaatgcaactcagctcgcctctaattcagttcatcttagagctctctcagaggagaatgtaggtnaatagtcaantgcgtgcatggg

SEQ ID NO: 92290 - DNA, 466 bp, Triticum aestivum
  unsure (1)..(466): unsure at all n locations
  Clone ID: PAT_TA_92290
gtgaggcgtaccaagaaccctagcctccggatccatccatccgcccctcgctgccgctgcatctcgtctccaccaccccacttgcccccggacccaggaggatcgtcggagatgtcggacaccgattagcaccacttcgagtccaaggccgactccggcgcctccaagacctaccctcagcaggccggcgccatccgcaagggtggacacatcgtcatcaaggcccgtccctgcaaggttgttgaggtctccacctccaagactgggaagcatggtcacgcaaagtgtcactttgttgccattgacatctttaatggaaagaagcntgangatatcgttccttcatcccacaactgtacgtcccccatgttgaccgccaagattataagctgantgacataacttatgatggntattcancctctaacttagagtggaacactaaggatgacttnaacntccnctt

SEQ ID NO: 92291 - DNA, 466 bp, Triticum aestivum
  unsure (1)..(466): unsure at all n locations
  Clone ID: PAT_TA_92291
gaaatttgtagctagcaaaactctacttctacgtccaggtcctatattagctttcttatttgataagataccaaactccgcaatctctcattattccatataaattcatcgtatcgtaatacgaaccctcttgaagcaaataactcctattccaatgagcacgtcaagcaaatagagatttctcctgccaagtacgtaatctcgttattctgccttacaccangaatacactaatcctcgggactctgttagtatagcaattactgaggaaacatttgctttgtttcttcatcactgagacgtatctcatggacaggatctctttttcgttctaacgactcgaactcganatcaacgtatgaaaggtaagaatatttctggantccactcatatcctgcgagtacgaacacatgttaatcangacganggaactcaacccggtcccnaatattnntaactgtgttg

SEQ ID NO: 92292 - DNA, 464 bp, Triticum aestivum
  unsure (1)..(464): unsure at all n locations
  Clone ID: PAT_TA_92292
gattttaagccactttgcggaaaattaactccaccattgtcccagatctcaattaatattctcctcaaactattaacaaatcttttctcatggcatcgcctgccgcatctaccggctcaacgaaaattgacgccgccataaaaaagttagctccggacacaccagaaaaactcagcggcgtcgctctatattcgagatttgctctagcaggcgccgtatgctgctccattactcatggaggtctaacgcctgttgatgtggtaaaaactccgaatacagcttgatccctgcaacttacaacaaaggacttatccggaggattccgtcangtcataagcaaaggagggtgcgggcgctttattaactgggagctggaccaacattcgctggttacttccctacaaggcgcatttaaattttggaggntacnacttttttaaacaacaatccataaattatctagg

SEQ ID NO: 92293 - DNA, 293 bp, Triticum aestivum
  unsure (1)..(293): unsure at all n locations
  Clone ID: PAT_TA_92293
gcctcgcgtattccaaagtctatatcttaaatgcggattacttacgatanatggacctaaatttacccttattttgtcctcattataatgatagtgccataattgagttaactatatcattatcnttctctttaaccgccttgacanccttttttcnggaaacattntcttggntcatcagcagctcaatatncntaatctcangtcctgtctcatcnatctnttctcngtngncatcntcatngtcattntccttttttatctcagactcagacactttgctcctacaatgc

SEQ ID NO: 92294 - DNA, 358 bp, Triticum aestivum
  unsure (1)..(358): unsure at all n locations
  Clone ID: PAT_TA_92294
atcggtcgagccctccgcngccgccccgccttcagctctctccttccttctccgatcnaanatgaagttcattgctgcctatctgcntgcttacctctctggcaacgccancccctctgcagangacctgacatccattcttgagtctgttggntgtgaaatcgacaatgagaanatggnactcatgctgtcccaaagtgaaagggcaatggacatcaccgagctcttgggctgccgggtagggagaaattttgctgccggttcaacctggtggtgggtnagttgnctgttnaaactnctgccccnggtggctggaagtactgctncccctnnaactaattcaacaaaagaaganaag

SEQ ID NO: 92295 - DNA, 475 bp, Triticum aestivum
  unsure (1)..(475): unsure at all n locations
  Clone ID: PAT_TA_92295
ctcgtgccgaattcggcacgagaaatggcgcagggaatattcaaatctaaaccagcgaaggctaccacaacttcaagccggcgtcccaatgtcttaggtcctaaaaaaggagcgcgcactattgtgccgcgcaagcctggtctcgtgcggcaaaacaagttgactaagaaatactcagctggtcttaccgcttcaacagagagaacacttggtgcgcgcgttggacatctcgagctccttgggcggcggcaagggaaagaagacacgcaatcagaaagagaacccagggaagaagttggacacaatccaaggacgccaccaaaaactcatgatatcgatatccaattaagaatgaaggggtcataactttggacgatttngagatgacaactaagactaagccttggtcagagagtcacaaagcaagatatcaatctaattatttgtccctanatgacaataattatttgccctt

SEQ ID NO: 92296 - DNA, 450 bp, Triticum aestivum
  unsure (1)..(450): unsure at all n locations
  Clone ID: PAT_TA_92296
aatcattcttgtgactccttttcggccaaatttgacctatttatcaacgcttgcgcaataatatagattttactagcgatgaatgtcattgcatccgtcacacaatcgcgtgtgatacacgcgacaccatctattatggcccgtcttgcctcaactactcttccatgcatgaattgctggggctccatgatgcgactcaaagggccaagtaaattatatccccgattcttgacaacttaccacaaagccgtgagcttttcaaaagtacaactaccagcctctgggtcaacctacacagcctgttaagaagataaaagtctatccaactccgccgtcgccggcccaaaaattcaaagagcctatcaaagacttaacagccagccagattgcacgctagattcgacggggcgcgcacaatctcttattcgtacaaaccaagaancgcgaaag

SEQ ID NO: 92297 - DNA, 389 bp, Triticum aestivum
  unsure (1)..(389): unsure at all n locations
  Clone ID: PAT_TA_92297
tggatacctaggcacccagagacgaggaagggcgtagcaagcgacgaaatgcttcggggagttgaaaataagcatagatccggagattcccaaataggtcaaccttttaaactgcctgctgaatccatgagcaggcaagagacaacctggcgaactgaaacatcttaagtagccaagaggaaaagaaagcaaaagcgattccccgttagtagcggcgagcgaaatggggagcagcctaaaccgtngaaaacgggnttntgggaanagcatacaagcgttttgctgctaggcgaagcggttttagtgccgcaccctaaatggtaaanccaatttaccgaaanatcactacttaacccctgancccnnttacaatggggacgttgaacccg

SEQ ID NO: 92298 - DNA, 387 bp, Triticum aestivum
  unsure (1)..(387): unsure at all n locations
  Clone ID: PAT_TA_92298
gaataaacctctttggattcatactgtcaaatcaaggaatcatcactctgactaaaggaagtaagtttcagaatattaaccaaaacaaccattgaagcgtaagctcatcacaaaaggtcctcctagaggaacacttgagctcatgtccatgccaaagatctgcaatggtcttatattcttctcattcaaccaaaaaccgggcccccaaatccctccgaaatggccatgctttcaacgagaaggtgccaagaaccgggcgtcgaatttaagaccttgagcaccgtgcccaaccgtccttcgcnccccgagaacttccggccnantggccgggccatctcctngccaatggaaccatcctnccggtngtccccgggcgtcnaagccgcc

SEQ ID NO: 92299 - DNA, 453 bp, Triticum aestivum
  unsure (1)..(453): unsure at all n locations
  Clone ID: PAT_TA_92299
gatgagtcaacggcactccccagcgccctggacggtacaaaagaagttaggctaagctactatacagcaatcacgctctgtcaagacttttctgacatttcagcacgaccttcgggaaggagttggaaggaggctagaaaggcagagggtgaatttcccgaggtacacacaagtctgcagcgcccagctggctggcctcttcgaacgcttcagaaggggcaatatgtcttccggatttattccctaatgtcggtattangaagagccccgcacccagtggtttttgcgaatttccccggctgccatacaccccgcaaatggcatcgtttccttggctggagaaggggaagataatgaanggcaaaaggtccctcttaatggatgatncnatgaagacttttnaagggtggtactggttttaggggaactgttatgggaaggataagaagggaa

SEQ ID NO: 92300 - DNA, 458 bp, Triticum aestivum
  unsure (1)..(458): unsure at all n locations
  Clone ID: PAT_TA_92300
ctcgtgccgaattcggcacgaggcacgaacccccctccgccgccgacctcgcgtcttctcctgtgcatctcggaggtgcttcttggtttccacgatgaagctgatcgctgcctacctcctcgcctatcttggtgggaactcttccccaagtgccgctgatgtcaagaacatcctgggactcagttggtgctgaggctgatgaagaaaagcttgagttccttcttgctgaactgaaaggcaaggacatcacagaagtgattgcatctggaagggagaatttgccgctttgccttcaagtnggggttccattctgtgggaactccaactgctgatctggtggtggcgcaacactgctctatcaaagnaaaggaggagaaggttgaagagaaggaagaatctgatgaaacatgggttcaatccgttcgactaacactnantaatcccccctanctctcttt

SEQ ID NO: 92301 - DNA, 446 bp, Triticum aestivum
  unsure (1)..(446): unsure at all n locations
  Clone ID: PAT_TA_92301
ctcgtgccgaattcggnacgagcttccctcctctctcttttccactttcnccncncctccgcctccgccatcgcctcntcccctctcctccctctctcncgtctcctccctctcaancctagncgtcaccacccagtacccaccctctactgctcnaccgcgcacccacctccccttggatcaggtgnaggccggccggtgcgngcaggcggcgganctcnactcnagggcaaangnaggcaacngcggnggtggccgccgtggacacccgcggctatgacgaacccgctgctangaggccaccatggangcncgtcccgagntcggctcgccnctcctccggtgancctcgatgngcctggattccgggtcnggcggatcngacgatttcccgaangccaagctgggcnggnagcnggcctatggggatgagcctccatggtgcg

SEQ ID NO: 92302 - DNA, 415 bp, Triticum aestivum
  unsure (1)..(415): unsure at all n locations
  Clone ID: PAT_TA_92302
attctgttctatgattgctttctttccaacaagatgtctcaaatttaaacggtttatttgagctgatattcgatttagatacgtgtttcagctaaaagtttttcaaccactaagtctagagcgttcatacccttctccaatggcccctctagacaagtattaactccgacataacgccacttttctgaacctttaatcaggatgtgattcattaacatttaattcgtcgaagtcacacaacagttcagttatatcaatttgtggggtctccgtcttcgccgtcatcagactccattatgctcatagcatcttcatctcgcttgggcttttgttgggccttaaanaaggcattntttgacncanataanatcncttnaantcncgcaaaaacatcncanaaccctttccattttcc

SEQ ID NO: 92303 - DNA, 371 bp, Triticum aestivum
  unsure (1)..(371): unsure at all n locations
  Clone ID: PAT_TA_92303
ttttttttctaaaatactatttgatggaagctttcattgcaaaacaaataaaacggttatatcttactgttgtttgaggtatcataattcgagaagaaaaacattgtctttaaccaacatacaacaatgtaaccatctatcaaagaatgaaaaatattgggggcttcctcttgtagtgctcattctggcccaagatgagcgaacaccttgactatatgaaccgtggacacacacggcaactcgcctggttcactcatccaacttgacagcaatgcctcgagtancgctcaagggtgcccctaacngccttgttctggacaacggncaagntgaanatcccaacccggtacanggggnttaaggccaacaaa

SEQ ID NO: 92304 - DNA, 642 bp, Triticum aestivum
  unsure (1)..(642): unsure at all n locations
  Clone ID: PAT_TA_92304
gctgggtgcaatcttatggatcaaggtgtgtcaagccaccgattatctacggtgatgtgagccgccccaaccccatgactgtgttctggtccaagatggcacagagcatgactgctcgcccaatgaagggaatgttgacaggccctgtcacaatccttaactggtcttttgttagaaatgaccaaccgaggtttggagacttgctaccaagattgctcttgcaatcaagaaggaggtccnaggaccttngaggctgggtggtattcaagtcatcccaaattgacgaagctgctttttagagagggtctgccactccgcaancctgagcatgctttcctacttttgactgggcctncatcccttcaaggatnaacaaactgcggtntncaagacacaccaaattcacaccacatgttctacccnacttcaaacgactcatccatccatcancaacattgacctatntnattacanccaaaanccccgnccgacaaaactccgncctctccgccaggtgngtgtacggtgctngatntgccggtgtgtcaaatcantcccagatcntcaagagagatncacgttcaaaatctccgnctgaacaaaacttgtanctacgcgntcanaccannccagtnaccnccc

SEQ ID NO: 92305 - DNA, 602 bp, Triticum aestivum
  unsure (1)..(602): unsure at all n locations
  Clone ID: PAT_TA_92305
ctcttacgggcacactacagcggcaagatcaagcggcgcaggcgaggagagaaggagacgcgggcggcacggcaccggccagcaagctctagcgcctcctccctccgacgcctcctcactccggcgagcagcgcgacgcggcctcctccctctgacgactcctccctccggcgcctcctcactccggcgagcagcgcggtgcggcctcctccctctgacgactcctccctccggcgcctcctcactccggcgagcagcgtgggcggcacggcacggncggttagcacgcggcgctgcctcctccctctgatgatccaccttccgggctcctatttcggcgagaacgcnggcggcgccgcacgggcggttacacacgcgtctcaccctcangcgctctcatcccggcacaatncnggcggcccggacactggtaggttncagctcgtccttcggtctctcatccggnacacacggcgtgcgctctcctcancgctctaatcggaananacgctctcatcggacactatccggtggctctcttcctcgttgntantcctcacagggaacaatctcctagcaattgggcgnaaatncncgaagtt

SEQ ID NO: 92306 - DNA, 234 bp, Triticum aestivum
  Clone ID: PAT_TA_92306
cgtgcgccgaaccagcagcagcagcccccgcccccgctccccccttttataccaccacgccgccagttcacaccaaagcttctcttcctcccttcccccttcgtcttccggctggatcacgcgcgcagtcaggagggccgggcgcttgtggaatggaagatccgctctttttagccacttgtggtcagtgagcggtttgggtggtggtagttggctcgctttcttggagggcgg

SEQ ID NO: 92307 - DNA, 401 bp, Triticum aestivum
  unsure (1)..(401): unsure at all n locations
  Clone ID: PAT_TA_92307
attttcttccatacatacatacatagatatatatatatatatatatatatatatatatatatatatatatatatatatatatatatatatatgtctctcgtaangattagtatgtagacttgtgtacttgtactaatanctagtgatgctttatatcttancaacngcacctatctacctcatggttatntatgcanacctagtatgtgtatgtaacagggaancatatggagtggntttgcctctctggtgcatttganacaactanatgcctactgtnctatgttctnggtaacattccactaacgctggggttnnagatttngacttgtanattttggnatggcgctnctatataacattggaggaagagttctccccacngtnttnaganggaatta

SEQ ID NO: 92308 - DNA, 418 bp, Triticum aestivum
  unsure (1)..(418): unsure at all n locations
  Clone ID: PAT_TA_92308
agcaatctcaactgcctgctacctaaaaaatcgcctccctcattcagggctacccacccacaccacgccatatgaggccttgctaggcactaaacccacaatacaccatctccaatcttttggcaaaaactgctttgttcacatacacaaggactcgcgacctgcaggaacaaagtattgtaatttgtttgctagacctggcggtgtagcttatcacagttagagaatgtattctagaatgcagtggtggctcgttacagatgcgattgtgacaatacaattnagggttgtatgaaagttgggcacttctatgggctcaattgtgtggaggttgatttaattattgatgatattgcttgttatgtctatctacagagaatgtgctacagttctacatgtgcccgtnaaaaaaaaaaaa

SEQ ID NO: 92309 - DNA, 508 bp, Triticum aestivum
  unsure (1)..(508): unsure at all n locations
  Clone ID: PAT_TA_92309
ctcgtgccgaattcggcacgaggaagcacacaagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaggccgccggcgccaccctcctcgtctccgccaccgccacccacaaggcgagctccggcgggatggagatggcggccgagaacggcggctgcggctgcacccagtgcaagtgcggcaccaagctgcggctgctcctgctgcagctgctagatccatcatcgatcatgcatgcaccgtgccgtgcgtgcatcatcgatcgtatcgatctactactaacataccatgtnaccgcaactgatcnaaggcttatgttacgcacctgactgcatcaacatcaagtgcaagccatgatggtaacaagcccctaataaactccttgattaataaaaa

SEQ ID NO: 92310 - DNA, 623 bp, Triticum aestivum
  unsure (1)..(623): unsure at all n locations
  Clone ID: PAT_TA_92310
ctcgtgccgaattcggcacgagcaatcgttgtctattcctctactcttctcgcccccttctccgctcactctttcgctcgccctccgtactgatcattcaacaattgttcgtcgacacttgcttctgacctgatcagcatcgaaaaccatgtccgtcgcaaaggtcgaagaaaaaacgcgccgtgccagccccagcccacaaccgagtgcaccctttgatttggcaaaatatcagcgcctcaatcgcagtatttgggtactatgtccccgaaaaacagccaagcacaccaacaggcgcgcccagtgtgattcttctcgctggatggatggcagcaacaccgcgacacatttcgaagtattcangcaggatatagtgctctctacccacacgcacgcatcattgctatcacgacaacacatggggacatgttccctatagatgtattccgggggagttggtcntgtacagccgatattagatatctttanggctgaacctatgaaaaatcctcatgacacatgtcnaacgnggtattanacancgttanatgcacggttnaaagantacggccttgcngcgataacgcaatgggccaaatgnccagcaggaanaggnngaatnt

SEQ ID NO: 92311 - DNA, 638 bp, Triticum aestivum
  unsure (1)..(638): unsure at all n locations
  Clone ID: PAT_TA_92311
ttgatgcccaaatataggattaagactattaacattgctattacgatattcgcgatacattactttactcccactctggaaagttaaacgtatgtctaaatgattctgacaaccagtaaataaaatacataagtggagttattcaatgcgctttgctttcgtagcttatccagctagctctaggaatctacatcacgtcgctgcaggcgcaacgccttcacgactgggtgaaccatcaatcaactagcaatgttttattcaagagacacttctttctaaaactggaccgcttgcacgtgtttggtcctccgccaacaattgagcgaaagctatcaaaaaancatgtccttgcaaacaaacgtaaaagatacgttgaagccattggtacgccaaaacaagaactcttggcacttcggactaagcggcaagttacttcttgggggtagtgagaatatataaggcgaaaagtaattacctttgggacgactgcaatgaggcctttaaaaataaaatggtttcaagactccgggaataanacatggnagaagnacaattgcacangtgatgcctgatnctcccgacntntcactaagggatgtcctnaatgcgcncacaaacgcgnanttccttcaatannn

SEQ ID NO: 92312 - DNA, 627 bp, Triticum aestivum
  unsure (1)..(627): unsure at all n locations
  Clone ID: PAT_TA_92312
cgaagatccaggacaaggagggcatccccccggaccagcagcgtctcatcttcgctggtaagcagcttgaggatggccgcaccctggcggactataacatccagaaggagtccacccttcacctggtgctcaggctcaggggtgggatgcagatttttgtgaagaccctcaccggcaagaccatcacacttgaggtcgagtcctcggacacaattgacaatgtgaaggctaagatccaaggacaaggaaggcatccctccggaccaagcaacgtctcatctttggctggcaagcagcttgaggatggccgcaccctggctgactacaacatccaagaagganccacctccaactggtgctccgccttcgtggggggcatgcaanctttgtcaaagacctcaaacgggcaagacatcaccctngaggttgancctctgacacatcnacaatgttaangcnaanccaaggacaagganggcatcccccggacaacaacgccggncttcnctgggtaacaactgaggatggcccacctggcnggctatacatcagaagggtccacctnnactgggctcgtcccgtgnggcantagtgctgnaangacggnttccttggtggttaagtctt

SEQ ID NO: 92313 - DNA, 622 bp, Triticum aestivum
  unsure (1)..(622): unsure at all n locations
  Clone ID: PAT_TA_92313
ctcgtgccgaattcggcacgagccatggtacaatatacaatcattcacacaagcgtgtatcttttgtacttcaagttccaatgggcaaacaagtttcttcgcttcattcgtgcttctggggagcacattatcttccggaagaatttctttgaaaatacctaacatctctgtgaagcccttgtttgatagaccatttgttgctttaaatctcagaagcgccagggtgggcactcaacctggaatatttctttttgcaacctgttgctacctcttttagcactgcgttggttttccnccaaanagcaagggatgatgcaccaangtagngtaagnatttcccttantttttgagnaacaaaggtatcantctagtnaggaaggtaaccccnatcctcaanactgcacaaaacaaataatcccnncaaccaacgcaaattggggtgtcaatccctatagggcacttaccaaaangaatcgganngatatnataagaaanattttgggattttatgataagntccaagttaattaggnaanttattncatccattannatttnggggattgtatatnaaanaaccnggggaanaggttcanagggttnttnncaggggccgacaat

SEQ ID NO: 92314 - DNA, 233 bp, Triticum aestivum
  Clone ID: PAT_TA_92314
ctcgtgccgaattcggcacgaggtcgtacctggggacactatgtacgccggtatcaatattaatggtgcagagctcgattgtgctaaaattaaagtgcgcgtagaagaatccacgagcacctatgagtattgcgagtcgtgaatctttgagaatattgggggatccgagaatttctctagcatagtatttgtattttatttaagtaaagttgatctacgccaaaaaaaaaaaa

SEQ ID NO: 92315 - DNA, 599 bp, Triticum aestivum
  unsure (1)..(599): unsure at all n locations
  Clone ID: PAT_TA_92315
tttttttttttttttttttcagatatgtagtttggttatattcaaatatttacatcatcgctagagcaatggacataagtgtctaagtatttaaaatctctaacaacatgttatactgttcttaattttatacagcgaagtcaaagggttagagttatgccaattttgcatgcgtgaaattggcacgaaaataaaaatgtgagtatgtatgacacgccgagacgccggtttaagtatttttcgattccgctctagtcaaagcctctatttttctaaggccaacaccattttttgtctctcacttttccgcttctganttgttttatcgtgtgctttcgctcattctcttgcctccttccttaatagctttcaattcctcatttttaatttctcccggcctcctcaanaacttangggaatatggcgattctttaaaccttttaattccgggaaaagtncatatcttggactaaagcccatggactcaagggatggccncnctaagacttgntcctcccntttganccntgggncgcaaaaactaagttcntcatcagaccagagagataaattangcagggccactnatgaaanaccgc

SEQ ID NO: 92316 - DNA, 629 bp, Triticum aestivum
  unsure (1)..(629): unsure at all n locations
  Clone ID: PAT_TA_92316
ttacgggtctcgttgcgttcgtcctccaattctcgtgggagacgtatcccgcccctcacccatgactgtcaaggagtcaaaatacgctgcctctctcactaaaagaccaatgaagggcatgttgactggtccaattacctgtttgagatggtcatttccccgagatgatgttcatcaatcagtccaagctgagcaattggcactggccttacgtgatgaagttgttgatcttgaagctgctgggaattagcgtaatccaggtcgacgaacctgctctacgtgagggctaccacttcgctctggctcaagagagagaggttactttaaatggggccgtggaaccttccgcctctcatctccgggggtgaaaagacgtaccaaatcatctcaattctgctactctgaatccaagattcttcaanccatancaactctagagcagattcctctcgatngagaanccaaacaagacgccaacgtttaggnctttacgacaagggtacancgtcanaacgtcgggtgttatganaanacacgagcgcatcctaggagcaagagattaagncgattaggaatttcagtctgaancaganantttggntnatccgatgngcntaaacccaagngtg

SEQ ID NO: 92317 - DNA, 631 bp, Triticum aestivum
  unsure (1)..(631): unsure at all n locations
  Clone ID: PAT_TA_92317
ctcgtgccgaattcggcacgagattttcaacatttttcggcaagttccagggtacacggaagatataattatcgacacctatgcgccgggatactctgagcgacgacagcttctagagcgtgtgactgggaaaccagccgtcccagtaataaagtctcctaaatatatcccgaaaacgacacaaattaataaaccaagcatagagttccaaactgatatcaaaccgggagtccttcgtaaagagcgctcatcccaaaatataggtgtcactgaagttcaactatgcaactccaagaaacaagaaagtattaaaacgaaggatattgactctcccgcactgaatccaactagcttcgggtccaagggccactttcttttgggaatcctcaagcttctcacaatataacgaanagcgtcggatacgattcaagtnccccgatcctctcggcgataatcccgcctaagcactcttgacgttcaaatttcctagcaacaaggatgccaaaaaataagccagctctgactcnaactttctgccgagatctcaanaaacnacacaaatcanatactgnagcaaaagngatatgatggaaactacgggatttttcaaagaatggagtttccgaanagg

SEQ ID NO: 92318 - DNA, 609 bp, Triticum aestivum
  unsure (1)..(609): unsure at all n locations
  Clone ID: PAT_TA_92318
gcctctccgacctcaccgggaaacctcccatcgaagcgaagccaaggctctctcctcctcctcctcaagatgcagatcttcgtgaagacccttaccggcaagaccatcacacttgaggtcgagtcctctgacaccatcgacaatgtgaaggcaaagatccaggacaaggagggcattcccccggaccagcagcgtctcatctttgctggcaagcagctcgaggatggccgcacccttgcagactacaacatccaagaaggagtccaccctccacttggtgcttaggctccgtggtgggtatgcagattttccgtcaagacctgaccggcaagacatcacctggagttgatcctcggacacatcgacaacgtcaaggcaagtccaagacaaggagggcattcccccggacaagcagcgtctatcttcgccggcaagcagcttgaggatggcgcaccctggcggatacacatcaagaaggnccacctcaactggtaccaagctcntgggggancaacttgtaagacctcatggaagacaatacctggaggtgagtctcggcacattacaannnaaggcaagttagacaagaggatccccgncaacaagcng

SEQ ID NO: 92319 - DNA, 347 bp, Triticum aestivum
  unsure (1)..(347): unsure at all n locations
  Clone ID: PAT_TA_92319
cggcggcggcgggaacggcggcagcagccggagccagaggaggaggcgggagagcgcgacggactgctccggcagaagcccacagacgccgtcttcgtcgacggactccgacgaggcgctccgcccggtgctggaccaccaccggagggcgacggcgtgtgatctccggggaggggtgatggtgtcgaagcagccgcaatggctggtgcgctgtctcagccttaggatggcttgatcgatttcacgacgagacctcgctactgtaggctttgctaagttgctatactgggttccccgggtggttgctggtaaatagntcaaaaaaaaaccncccaaggggggggggg

SEQ ID NO: 92320 - DNA, 637 bp, Triticum aestivum
  unsure (1)..(637): unsure at all n locations
  Clone ID: PAT_TA_92320
gaccatcacccttgaggtcgagtcctctgacaccatcgacaacgtcaaggcaaagatccaggacaaggagggcatccccccggaccagcagcgtctcatctttgctggcaagcagctcgaggatggccgcacccttgcggactacaacatccagaaggagtccaccctccacctgggtgctcaggctccgtggtggcatgcagtnttcgtcaaagacctcacgggcaagacatcacactggagtttgagtcctccggaacatcgataagttaaagcaagatncaagaacaaggagggnaatccctcccggacnagcacgcctgaatctttgcttggnancaacttgaagatggccnttacctggctgactacaacatccaagaagganccacccttcactggggctnaggtccttggtggatgcaaattttngtgaagacctcaccggcaagacatcacctngagtggatcatctnacacatcgacactcaagggaaatttaagacaaggagggattccccggacaanaactctaacttnctggaaanactcaggatggcgaccttcgncaaanacaaaagancacctcacttggntaggncttgngatgaaatttgcaacctacggaaacancacc

SEQ ID NO: 92321 - DNA, 592 bp, Triticum aestivum
  unsure (1)..(592): unsure at all n locations
  Clone ID: PAT_TA_92321
tgggaatgaagatgagtctgtctgggccattgagtggaggggtatgaaaccggggtgttttcttatgccagcttgtaaccctatacgcttctgtgagacaagagacctgatctactttctcgcgccacatttctcgcttagcttttttcaccgccttgccaaagacgcggcgttcagcgatggccactgatcccgagcgcttggcttagcagagtgcgtttgtgcgcgtttgtacagtccctgggtccaccatcgatttcgccggccctgtgtacttttcccggaacaagtacgtttaanantcctcaaaagaagtctaccaagaatgangtctctctctggtctgaanaaggtgcggcataanccgtcgggagatattttacggaagtgatctatcccaagcagatacctaatttccanaagtaccgtttcggncccgggtctaaattnattggtaaattctgtggccgaccgactcaantcnttcgggaganaanagcttnagacnattctgcgancaagntaaatancccgnacatagtaggcaataaatcanacttttccctgatttnaacccngggggccgacaatt

SEQ ID NO: 92322 - DNA, 602 bp, Triticum aestivum
  unsure (1)..(602): unsure at all n locations
  Clone ID: PAT_TA_92322
gccagagctgcgagttttaagccctctcggcctgtgcttggtgttaaaatggacacagatactaatttggcccccaaatataatttctctgaaaacttatcatctcttagatttttgatagagtccaagaagagcctattcacgccagaagtcacagtagcaatactccgttgtcctcacagcccattactacttcatcttttcatttttccgctccgccaaccgtaaacccttccgtccatccgtgcttctccgggcatgcgattcgggcaancttctctcttggtttgcttgaggggtgcgcaaaacgtngagncttatactctcaacttccaaacgacgtttgactttccctccccggacgatagagtaccnggtcaaacaaantacgctccatcaatgatccacaatcttactttccgaaatcanctcaaccgaacaccgggaacggtaagctgcgatactatcgctggngaaattacgccccaanacgaacgggntnctcaggtggnccaactcctaaaatataatagacttacggaacgnagaatactcatgattacatggctnaaaaaggccacaantacaacgnttccttcatg

SEQ ID NO: 92323 - DNA, 441 bp, Triticum aestivum
  unsure (1)..(441): unsure at all n locations
  Clone ID: PAT_TA_92323
cgatggccggtattggacaatgtggaagctgcctatgttcgggtgcactgacgccacacaggtgatcaacgaaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaatgccattgcagtttgtcaactctgacattgctttgggtttcccttcnccattancttcctaatttgtncctaaagatagtgtantcaagttcatgtnccaacatggtcnaagaacatgccntatntaatgcnnccggtgggctaggttatcacggcccatatattttcatatttcaactaatacntttaanggaaaaaaaaaaaa

SEQ ID NO: 92324 - DNA, 471 bp, Triticum aestivum
  unsure (1)..(471): unsure at all n locations
  Clone ID: PAT_TA_92324
ctcgtgccgaattcggcacgagctcgtgccgaattcggcacgagctcgtgccgcaccgccccgcggtcgctcatcctcgtggaggatctggatcggtacctgcgtggcggcgacggggagacntcggcggcgagggccgccagggtgttgggcttcatggacgggctgtcgtcgtgctgcggcgangancgcgtgatggtgttcacgatgancggnggcaangangggttgggacccggacgtgctgcggccggggaggctggacgtgcatatccaacttcaccatgtgcgactccgaaggttcaaaggcctggccaacaactactngggctcaaggacaacaagtgncccaagttggaagggaagggtttccaagcccggngcccggctgacccggccgantcggnaaattatctcgccaaccgnggtccccancccgcgtcngaacgtnataangcctgcaatgntggg

SEQ ID NO: 92325 - DNA, 344 bp, Triticum aestivum
  unsure (1)..(344): unsure at all n locations
  Clone ID: PAT_TA_92325
ctcgtgccgaattcggcacgaggtttcctgtgtatttggcattagatagtggtgtgcgttgtctaacttgtcctaatacaactgggcgtgcctggttgtagacacgttgaacttcatcatttgaaatcacatgattgttgccacatctatattctgaaatacactgcaccacacctatgatagatattatccaaattccaaggcagctgagcaagcaattggagtgcatgttgtgtgtatggggaacccgaaagagagatgataacttggccaagaagacacctgggtgtggcgaagcataaacagtttaagttagaaatcaanttttgtccaaaaaaaaaaaa

SEQ ID NO: 92326 - DNA, 585 bp, Triticum aestivum
  unsure (1)..(585): unsure at all n locations
  Clone ID: PAT_TA_92326
ccgaaaccaacaccacacgcacgccgcgacatttcccagatatttcccccatcctgcgcttttcctcctcctccttccttccttctccgccgcaatcgctcctagctatccttaacacaacatgccggaggcacctgcacgggccgccgccggcggcgcctccgcccccgccgacgtcgacgtcgtcacctccagcgggccgccgcaagatcgccgcccattcctccgttcttggcgtcggcgtcgcctgtgctgggagaccatcctgggagcgccggctgcagaggtcagggagagcggcaagggcggcaggccgttcgtccgggtccgcggcgtcaccgacgacgtcgcggcggcgttcgtccgctcctctacgccggnagcaagcgtggcgaagggcgaagtgaacgagacgtggagaatacccggacactctnggctgggcgacgctacggngcgtggtaacgtggtgcaagagcanggnccggtcanccggagtntgacccncaacngcgatctgnanccgggngactcgtgatccctgtccaagatccgncctnacgacaggatgggttctcggaacan

SEQ ID NO: 92327 - DNA, 619 bp, Triticum aestivum
  unsure (1)..(619): unsure at all n locations
  Clone ID: PAT_TA_92327
ctcgtgccgaattcggcacgaggttgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccaagagcaagacctacatggaggtgaaagggtaccggcaccgcgaaccaattgcccgaccatcgacggcggcgtccactccttccccttcaaaggccggcaantacgagatgaagaatttctgcccggganccactcctttaaccgtccaanggcgaaggatccagaaagaacgagcgncggcttccaagaaaacaantcaataccctctcaactacaccttttacaaatggaagccgtcnagnccgngccnacggacctcnantctagagaaaggacggatcaatagcggcncacctnnaattccgggagngacnatgcctctctcacgtcaacaactgtcctacggaaaccnnagtancggccttctctgcanctnagggtctcttcccacaagggcctgggnctangtaaaaaccttggctcc

SEQ ID NO: 92328 - DNA, 623 bp, Triticum aestivum
  unsure (1)..(623): unsure at all n locations
  Clone ID: PAT_TA_92328
gcccgccgccgccgccgccgcagagccgcagggagagaaggcaaggaggaangaangggaagatgccggcggggcacgggctgcggtcgcggacgcgcgacctgttcgcgcggccgttccgcaagaaggggtacatcccgctcaccacctacctgcgcacctacaangtcggcnagcacgtctacgtcaaggtgaacngcgccgtccacaagggcatgccncacaagttctaccacggccgcaccggccgcgtctgcaacgtcaccaancgctccatcggcgtcgagatcaacaagcatgtcggcaacaggatcatcaagaagaggtncatgtccgtntnggagcacgtncaaccatccaagtgcaacgaggattctccaagangaaatcaacaacgacaacttaagcggangcaaggccncggcnaagtcataacaccaanangaaccagcatggcccaaaccgggttnatgtttnagggaacacatctagacgtcacccatccgtatangtctcaacgtnncanggtgctacaaagcctgctcctaactgaactnagcantctaanaacanctgtccaantctggacgatanttcttttgncgcatgtaattccgtgtaan

SEQ ID NO: 92329 - DNA, 621 bp, Triticum aestivum
  unsure (1)..(621): unsure at all n locations
  Clone ID: PAT_TA_92329
cctcctcctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaattcgagaccctgtcttacctgccaccgctcagcacggaggcctcctcaagcangtcgactactgatccgctccaagtgggtgccttgcctcgaattcaacaaggttgggttcatcttccgtngacacaagcatctcctggggtactacgatggccggtatttggacaatgtggaaactgcctaagttccggtgcaacnacgcaaccaagtgatnaacgangtggaggaagncaagaaggattaccngaccctatttcccatcaatcggatcnacaaatcgtcagggcatggttagctnaacgcctnaanccacgggctcgaagancccgnaaggcaaacacnacnacaaaggcatttaatgcatncantttgtnanctanatgcntgggttccttccaatacttctattt

SEQ ID NO: 92330 - DNA, 506 bp, Triticum aestivum
  unsure (1)..(506): unsure at all n locations
  Clone ID: PAT_TA_92330
gccattgttactcaagctagcaagcaagaagcacaaaagaagccaacaccaatcaaggcctccatccaatcccaagcaacctcgaagatgtcttgctgcggaggaagctgcggctgcggcagcgcctgcaagtgcggcaacggctgcggcggctgcaacatgtaccccgaggtcgaaggcgccgggcgccaccctcccgttcgccggccaccgccacccacaaggcgagtccggcggatggagaatgcgcggaggaatggcggctgcggctgcacccagtgcaagtgcgggaacaactgcggtgctcctgcttcanctgcagattaattgatcancgtttaatgcatgancgcgcgcatgatcanactatattcgattcanncatccatccttgnacaaggttacctccttaattnanggcttttttnagnttaagcacttccaacaatagcanncaagtgatcccatcatgttnaccgaccctaataaacccgtggnttaccaan

SEQ ID NO: 92331 - DNA, 230 bp, Triticum aestivum
  Clone ID: PAT_TA_92331
gagaaatccccaatccaattcaccgaaccctaaccctaaccaagcaggcggcaagagagatgttggtccagaagatgccgatggccgccggctacgagggctttcccctcatcccatcgttccaggcggacaaggagcaggcggaggcggtgttggccgtcagggccatcaaggcaaaggcggaggaggcgtcgttgatcctcaaggcggggtgcggctccaagagaagg

SEQ ID NO: 92332 - DNA, 232 bp, Triticum aestivum
  unsure (1)..(232): unsure at all n locations
  Clone ID: PAT_TA_92332
gaaaaaaaggaagaccgtcgcagaggaagaggagcacgcgaaccgaaccgagcctcgcgccatggcgggagtagcgtccctcaacgccgtgtccctgttcgcgccgtcgccccaggccccgggggcgaccgccgcccgcggccgcctcctcgtcccggcggcccgtcgcttcccgtcgctgcgggccgcgcggcgcgtcgtcgcggcgcgggcggcgcccgtggaccnaatt

SEQ ID NO: 92333 - DNA, 611 bp, Triticum aestivum
  unsure (1)..(611): unsure at all n locations
  Clone ID: PAT_TA_92333
cgcgttctctttagcactagcctaccattccttccgcctccagatatccctgtcagctctctctaagttgaacaattttatcaacaaaacagatacttgactaaaatctacattacattgttcagtcttttgatctccaatagtcagataaagattatatttggatatgtctctatctcagaagttacagaatctaatcaaaggccatggaaaacagtcgcgatccgtcccgtnaagattcctgtcaaaagtccgcacgccaacaatcaaaaggttgaacangaaaagggaaattactcccaagcttaatgccaacatggactggccaagaaaacctcacaagctatcaatggccacaacatttggccggtcatgatgggcaaatattcggaggtcaaaaacatcnacagaggacgcattttaatggacacaaanggaaaaacccccaaancgacanagaagactggcgcgtagggccnacangagataaatnagggaaantaccaataccggggcnanaagatggattaccnaaaatggcatgggctcataagttacggcccgtnaaaggaaggagaagtgcataagttgccagtgaanatcgcanggng

SEQ ID NO: 92334 - DNA, 490 bp, Triticum aestivum
  unsure (1)..(490): unsure at all n locations
  Clone ID: PAT_TA_92334
aagaagctcatagccattcaaagcctctccatctccgaagctccaacccaacctcgaagatgtcttgctgcggaggaaactgcggctgcggcaccgcctgcaagtgcggcaacggctgcggcggctgcaacatgtaccccgaggttgaaggccgccggcgccaccctcctcgtctccgccaccgccacccacaaggcgagctccggcgggatggagatngccggcccgagaacggcggctgcggctgcacccagtgcaagtcggaccagctgcggtgctcctgctgcagctgctagattcatcatcgatttatgcatcaccgtnccgtgcgtgatcatcgatttgtatcgatttactactaccataccaagttaacccaactgatntaaggctttatgttnngcacctnacctgcatcagcagtcaaggtccatgccatgattgtaaacaggccccccttaataaactcccttggattaaaaaaaaaaaa

SEQ ID NO: 92335 - DNA, 612 bp, Triticum aestivum
  unsure (1)..(612): unsure at all n locations
  Clone ID: PAT_TA_92335
tccgattcgaaatactccttccccagctagggttttgctgcctccgccgccgcctcccgccagcgtcgtccccccatggcgctgccgaaccagaacaccgtcgattaccccagcttcaagctcgtcatcgtcggcgatggcgggactggcaaaaccacttttgtgaagaggcatctcactggagagtttgagaagaaatatgagcccactattggtgttgaagttcacccattggttcaccactaactgtggaaagatccgtttctactgctgggacactgctnggcaagagaatttgggtgccttaagggatggatacatatccnanggcaagtgtgcgataacattttggatgtcccttcaaanggctgacatacaaaaaggtcccnacgttggaaaaggattttcaaggtgtgtnaaaaaatcccaatnccctnttcnggaaaggttatttnaanaaaagcagttaaggcaacnagtaattcacaggaagaanactnatacatnaacctgccaananaatacactnagaacctccttactgcaggaatggtgngtcaaatantcgcanttggctaacccgagnactcactgctaganaaaagtactngt

SEQ ID NO: 92336 - DNA, 309 bp, Triticum aestivum
  unsure (1)..(309): unsure at all n locations
  Clone ID: PAT_TA_92336
gttcgctcaggtggtgcacgccggcaccgtcgcggccatcaaggttggcccaccgccgccgctctccggtggactccccggcacggacaactccgacgaggcaagggacttcgacctgcccctgaagaaccggttctacctgcagccgctgccaccggcgggaggcggcggtcccgggccaaggagtcggccaaggacatcctcaacctcaagccgctcatccgacaagaagcaatggccntacgtcatgaaacgactccgctccaaggctcctaactaagctatgactcaaaaccgtcatctcctcca

SEQ ID NO: 92337 - DNA, 641 bp, Triticum aestivum
  unsure (1)..(641): unsure at all n locations
  Clone ID: PAT_TA_92337
ttttttttttttgatttgatttctctttgtcattgatccacattggatttttctaagatgcgcgccgccgccgaccttggtggattggtgaatcacatagtggtcaacagacatgcggaggcattcttcaccatttccctgtagcaacaacacatgggtattatatgctagatgagacggaggtgctcatcatcattacaagtccacagaattacaagatagtttagggaagggggcccatgaaagccctgtgctagagtgtgatgaccatgctcattgggcttggattgattattttgtttgtggagcgggtgaacaacatgagtccctccgtgcttcaaggtctcccaaaacatttattactactttaattgctaattcaagcaagcacactcgtggattagcctatcaacattgcgcaatggactcccgccaggcctncggangcacgcatcctccnggagtcaatcacgcgtgtcnactctngggcctctcccctccatgactccctacnanggttcaactgggcctctaaatatcccaactcaaccgatcccatcgtgnctntacaanttggncgctcccncaaaaggcagaaanatggacncccnaatcctcagcatantcaacggtgggggaan

SEQ ID NO: 92338 - DNA, 580 bp, Triticum aestivum
  unsure (1)..(580): unsure at all n locations
  Clone ID: PAT_TA_92338
ctcgtgccgaattcggcacgagatctcactgcagcccatgcaggacccggtcacggcgcccaccggcatctcctacgaccgacgcgccatcgagcggtggctcgccaacggccacgccacctgccccgtcaccggccggccgctctccctcaccgacctcaccccgaaccacaccctcctccgcctcatactctcctggcatccagcgtcgaaggtggcacctgacgtggcgccgacgtttggagcccgatgattcggaggtcgctgtgcttgtcgcgaagtatgtccccgattcttgcccaacanccgatttctctgcgaaggcngcggcttcggccgccgttnaaacacggggccggcggtgaatggtgcccgcccggnttgcaattgngcttgtccgtcnatcctcntcctngcggtaagacanttccccnctgttatccaacgtttaancgtgctgnntcctttaancctcanntctcgggcgaaaactccggctctcgtttccggaacaaaaatcttcaacccctnaccactncggtgacctcanaatagactaatccgngggtcggaaaggaca

SEQ ID NO: 92339 - DNA, 604 bp, Triticum aestivum
  unsure (1)..(604): unsure at all n locations
  Clone ID: PAT_TA_92339
ctcgtgccgaattcggcacgaggctcgttctgttaatcctatggatcagcctgttatagtccgtagggagttagacgcttggacggtttcacgtgcactctcaggcgaggtgacgtttaatttcgtgcctgtcgcagatcctgcgtatatatttagtgaatttcattcgcttgcctttccgggcgtagcagagaggaatcttgagtacgatactgctagtatttcgttggatcctcaagacaagacatttggcggctccgtatatgaaattgccgaaagtactttggagatgctccgaaacctaagttgctttatcattccaaaattaaggcgcttaatgtgccaaaagcgacagcaagacgctacangacttattcctgcgattaatgccagaaattgtagtgatccgaaagattgcgttaccgcaagatgataaagtgacangatggcggtgtggaaaaatttccgggacaaaggtgtgaacaagacncccaaaaaantgataaattcccaanaatcngttggctggaaaagatggttcaaaatgggggccaatcaancaaaaangttctcgtatcaaanttgaaaaatggccncttgaaaa

SEQ ID NO: 92340 - DNA, 549 bp, Triticum aestivum
  unsure (1)..(549): unsure at all n locations
  Clone ID: PAT_TA_92340
ctcgtgccgaattcggcacgagctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcttacctgccaccgctcagcacggaggccctcctcaagcaggtcgactacctgatccgctccaagtgggtgccttgcctcnaagttcaacaagttgggttcatcttccgtgagcacaacgcatctcctgggtactacgaagggcggtattggcaatgtggaaactgcctaagttcggggtgactgacgcaaacaagtgatcaacaaggtggaggaggcaagaaggatacctgaccgattccgataatcggttcacacatctcagtgaatctanctaatgcttaagcacggctcaagatcggaaggctaa

SEQ ID NO: 92341 - DNA, 654 bp, Triticum aestivum
  unsure (1)..(654): unsure at all n locations
  Clone ID: PAT_TA_92341
gcagcgtatgtgctaaccgacaccttgctcgactcttctctccccatcgcttccacctctcgcgcgctcccctcctccgccacccgcggccagccgggctcttcaaccctcctcccggcggcgtcgactggagctggcacggccgtggtgtgtgctgtccacggccaggacaccaccatccaggaccaaggaagcaggtggaaaccaactgtctgtgtgctccttggggagctcatcaacacaggaactatactattaggcaaggtagcagttgatggcggcatgtttatattctcattgctctgttatagaagcattctaagtgtcattttcatcatgccatttgccctactcctcgaaaagagggaagtggaaagaattggntacaaagctcttgtgtggtctccatcaaagcttttgtccggatatcgttgcctttgggaatgtatactatgggctacatgacacaagcgctcctaagggtgatctcncaagttgacncgctctcaagtttgnctgtaataatgctggnatgnaactgccccaatcaaaganggcaacccaaggtgttgggaatgtaagtttggngggnttgtgttaccgtnancgaaggatgatccttaccggtaaaaggatacaanntcaagggtnagg

SEQ ID NO: 92342 - DNA, 600 bp, Triticum aestivum
  unsure (1)..(600): unsure at all n locations
  Clone ID: PAT_TA_92342
ctcgtgccgaattcggcacgagggcacgccaccgccctcccctcaccgcccacaggtccgaagcatggcaatcacgcggaattacttctggcacgccgccgccctcgcctcgccgcgcccggctcaccaccgccctcgcctcgccgcgcacaggtccgaagcatggccatcacgcgctcctcctgcagctgggctggacgcgccggtggaaatggctcacacgccgcccgccgcctgctcttcctgctcgccactgccgctcctccacgctggtgcggcaccgacatgggcgagctcggggcgggcacggcgcangcatgggcccgcccgaacgggtggggccggcggggacgacgccggcgccccagatgatgtcggctcgtcggccggcgggcgacgaactcaaggctgggtcngcgctgctcaaggaacggtcnatggaccgggacggggcnaggaaccgggcaagggcggtcaaagtcggctcaancgccgtncaggcgctagcctaacccggcggngaaacaggacangggaccccgnnggtncggaaaaatgttgncaggcctacaaataggnccganatcntngccncccgga

SEQ ID NO: 92343 - DNA, 240 bp, Triticum aestivum
  unsure (1)..(240): unsure at all n locations
  Clone ID: PAT_TA_92343
gtggcctcggntcctcnccccatctcctctctcgccaagaaccaccgagcttggagcgccaccgncatggncatggccacncaagcctcggcggcgacgcgcnacctgatcancgnggtctggtcgcnctccgccaagccccgctccgccaccctcgncatgccatcctccgngcgnggcccggtccgctctgcgccncngtntccgaganccccnccncagnggcgccgcctgcngagt

SEQ ID NO: 92344 - DNA, 644 bp, Triticum aestivum
  unsure (1)..(644): unsure at all n locations
  Clone ID: PAT_TA_92344
ctcgtgccgaattcggcacgaggtactgagaactcaagcgctgtacctgcttctgaacttcgccgcagtggttggatagcgcgccaatcgaagagatactacgacaatctgaagaggccaattgtaacgatacatgcacttggaaactcattgaagaaaaggcacacacggcattatggggggatggtactccaagctgtcggcattggtgtggtcaaagaaagagattcgaattctgattctaggactggataacgcgggcaagactaccttactatacagactaaagattggcgaaagtgggtaacgacaataccaactattgggctttaatgtggaatcaattgtattcaaaaatttaaactttaacgttttgggaactgggtgggcaaactccatacgtccttactggagatgctactacccaaatncaacaaccgtaatattggtatagatcnacggatattgatcactgganaacctctgataantaccggnatgttgaacaagatgactaaggatncgcgtacaaggtccgaataacaagacaactgggcaaaggactggnantacgaaccctaagcnggnaattagnacggaatggganatgnattagcttaatgaacgcttgtaggatgatgctt

SEQ ID NO: 92345 - DNA, 625 bp, Triticum aestivum
  unsure (1)..(625): unsure at all n locations
  Clone ID: PAT_TA_92345
ctcgtgccgaattcggcacgaggtcgaatttttgcactcacccctttctaatcattgacccaccagcattactagtgtcttgctagattccagcgcataccctacttcagaaatttgagttgctgaaagttaccatatctccaaatctcaatcatacccatgactgaagaaacagctcccgcaagtcctatgtcagtagaggacaatgaagaacagttgatgaaagtagtggagtcgcaagatatccaacctgagtgtaccaacgacttaaattttgagaatcggtttcaagctaacaggcatcgtacaaagcacctttttcaagatggattctctgatgcaagtttcccgaaaagagctgaagaactagccgacaaaattaagattcaagcagagtacggcactgcatgggtttaccatctcacttgcngntaaagtacactgttgggccaaacaaaaatntccaacggggaaacggtgatacaggataaattacgcatcacatcttgnttacgcaaagctcaacnacaacgaaactcaaatcaggctacaggnggatcacactatgtacangacaaatggaccacatgaactaccataaacaggccttggaggtaggcttact

SEQ ID NO: 92346 - DNA, 520 bp, Triticum aestivum
  unsure (1)..(520): unsure at all n locations
  Clone ID: PAT_TA_92346
ctcgtgccgaattcggcacgagctcctcctagcaagctatatacctacatagcacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacctgccaccgctcagcacggaggccctcctcaagcaggtcgactacctgatccgctccaaatgggtgccttgcctcgagttcaacaaggttgggttcatcttccgtgagcacaacgcatcccctgggtactacgatgggccgtactggacaatgttggaagctgctangttccgggtgaacgangncacacngtnatnaacgangtggaagagncaanaaggatacccnacgntangtcgcatcacggtngacacatnnncaggtgaatg

SEQ ID NO: 92347 - DNA, 604 bp, Triticum aestivum
  unsure (1)..(604): unsure at all n locations
  Clone ID: PAT_TA_92347
ctcgtgccgaattcggcacgagattgatgacaaccaaacctttcaaagcgaaccgaaacttcctcgtttagacgataaatttgagatgaaatgtctctcagcccaggcttaccgggcaaaacatatacggaaatttgccaaagaagcttacagtcaatatatgagaggtgaactgcaagcaggcacgtttacccgttttcctggggtaactgtttacaaatatgttgtcggtaatcactacgtcccagatgtcgggtacgcgtaccataatatccttattgacgagatcggcacctttttggccggaatgctggaatacccagcttatagggagatggcttacagtccttgtaaattttcaatttataccggttacgaatcttacgcaaactcccgacaactccatactgaagacgacgaagtttacgacgtctctaaatatgatcacattttcagcaaccgccaataggatctggnagaggaaccccggcaatctagtagaggtntggtaaaagtgggttgggtaataagaacgnacaagtactccaaggaatgaacattatcncggaattgccatgtacanctggaatcaagcgtcnccgta

SEQ ID NO: 92348 - DNA, 655 bp, Triticum aestivum
  unsure (1)..(655): unsure at all n locations
  Clone ID: PAT_TA_92348
ctcgtgccgaattcggcacgagctcgtgccgaattcggcacnagaattcatcggctcangcccacgtttattccaaccaaattctatcccgccatcatcagcctctccaacgcaataagtcgctcagacgagaaatctcattgctaaaagaaaatcgaaaatcaccttgtcagagacaccatcnagatgaagctcctacancaggctcccgtcattgcatttttgagccatctcattacagtttctgctatgaaacattatgtttgtccattttcggctcggtttacggaggccgaaatcaatcagttccggaacgaagtaattggaaaggcgagcgactcctttgcaagtctatggtatgcatgatggcgcacactcnatgaaatccggtaacagactgtangagaggagacacactactccctactaacaggtaatctcaacactgggcatttcaangtggtggaggaagaacantgagggtttcangatgtanactacagtagactacggggagtancttgggnaaatggaantcacgtcagcatcttacggaatacagacgtatanatagggtctggatcganntgcaattggttaacactnatngagaccttacatcagtccacggaancaagnnttccgcagttgccgg

SEQ ID NO: 92349 - DNA, 631 bp, Triticum aestivum
  unsure (1)..(631): unsure at all n locations
  Clone ID: PAT_TA_92349
ctcgtgccgaattcggcacgaggcgtttcttgacttcagctcacatgtggatgctgttgctggatttcttaaactacagaaaagagatctgtttcttggtactgatgttagagcacaaatatcattttcaaacaccatttcacaagatgataaggttatggagaaggtaaaatctgttttcttggatggcttaccgcctcattgggatgaagacgacgtgagggaaaagtttgggaaagttgggtgaaattgataatatacaacttggctagaaatatgtttacagcaaaacgtaaagattttgggttcatcagctttactacaagacaagcggattagattgcatttgatatggtcaataaaggcgctttgggtgaagnagtggaaaaattccgcaagaaggtaccctacaaagacaaagcctactttcnaaaagctccaaggnaaggggatancacatgtnggcgcaggagggtttattggcaaaattatgggacagagaacccacctaacaatcaagnattangccgggaagactcttatcaaanatncaactacccgggacaaatccggaaggtagtggagtgccccatggggtgatatgnaaaaccgntcatnagaanaggctaca

SEQ ID NO: 92350 - DNA, 634 bp, Triticum aestivum
  unsure (1)..(634): unsure at all n locations
  Clone ID: PAT_TA_92350
agacaattgaaaatgagaataagtgcaaccaaaatatcccacttttcaaagaagccatagtacttcgagatgaagcagcaaggctattaggatacccagatcacgcgacctttcgcatcgaagacaagatggccaaaactcctgcaactgtaaatgagttcttaggtgatctacgctcaagattagctgctggcggcgttaaagaaatgaagcatcttctggatattaaaaaagaagaccttacgcaacggggacttgaaactaccttcgacggtaacttttatctctgggattcgagattttacagtcgaatgatgatcgaaaaggagtcttatccgatgaacagaagattgcagaatactcccacttcaaagcactatcgaaggcatgttgaagattttgaagaacccttgggcttggnttaatgangtggtgggtgaagaccgagcaaaaatatcaatacnggaaggctgaggatatacatggcatgaagactcaaaattttcngatgggatgataagganaaggaatgggttgttggtaacccaacnaatntcatcanggcaagcaaannggcacntgcaacttnataaaccggatccttaccaangaaccacttcccnnaaaaccatct

SEQ ID NO: 92351 - DNA, 636 bp, Triticum aestivum
  unsure (1)..(636): unsure at all n locations
  Clone ID: PAT_TA_92351
gttgtacctgtactgcaggaataagaaaactcgctattcactcagtttattttccataataagttatgtaggagagatggccgagcggttcaaggcgtagcattggaactgctatgtagacttttgtttaccgagggttcgaatccctctctttccgtttttattaattcatcaacgttaaggatcacaatgtatcaaatcaaataacaattttttccaagcaataatataatatcttatattatcttattttgatttaatagaaattagaaattctctatagcaaattactgtggtatgtaaaatacacatagaggaaaaaagaaaaaaggttctaatcctaaggttaatcaatttaactaagttgatgggaaaatacgaattaatggnaatggtctaaggcgatntcggggaaaanggggaagggaaanaaaatccaatgaaccttcccttttcgtaagttaaatcctgacnagagtatatccacaactaacaactcattaattttngaccgaccactcctancaaggnttantacaanccttaaatcaacggtcaannccaatcntggaattccccggtcntgaacataaattgacaacnttgtcttggaccttcanaaaaacccggttnaca

SEQ ID NO: 92352 - DNA, 535 bp, Triticum aestivum
  unsure (1)..(535): unsure at all n locations
  Clone ID: PAT_TA_92352
ctcgtgccnaattcggcacgagccgaagccaaaggaaatccactccaatccaatccccacagaaatccccatctcaaaaccctagcccgtccgatcccggcgagatggccaacccgagggtgttcttcgacatgaccgtcggcggcgcgccggccgggcgcatcgtgatggagctgtacaaggacncggtgccgcggacggtggagaacttccgcgcgctctgcaccggcgaagaagggcgtcggcaagagcggcaagcactgcactacaagggcagtcgttccacgcgtgattcccgacttcatgtncaaaggcgggactnaacaaagggcaacggaacgggcgcgantccatctacgggaaaantcnccgacgagantctcaanannacacagccggatctctccatggcaagcggcccaanacaacgtccattcttaatctgacntccctgnattggtcaangnanaatggctcgnaagctcnanggatgctctcaaaantcaaaaggggtcccaaggacngtcaacaatnc

SEQ ID NO: 92353 - DNA, 211 bp, Triticum aestivum
  unsure (1)..(211): unsure at all n locations
  Clone ID: PAT_TA_92353
tttttttttttttttaagaccggaccaaacgttgggccggctcgagtactgccttttcattattattattatcaaaacaagcctgccattcanntgctcnctctcggncananatgtacntgaagtnganggagcttgtcanctggatcanctngactgtgtccantttgtcctcancgcacncnttcatcnttaacgncaantcatgcac

SEQ ID NO: 92354 - DNA, 617 bp, Triticum aestivum
  unsure (1)..(617): unsure at all n locations
  Clone ID: PAT_TA_92354
ctcgtgccgaattcggcacgagcgaaagtgtctacctcttggggacttcactcgctcgccccgttattgcacgagctcagattcgtgtagcccaaaaagaaggctgcattgctgtctcgcanggctgtactggtaagggtaacgatcaagtccgtttcgagcttgctttctatgcccttcagccaaccattaaagtaattgctccatggcgcttaccagaattttccgaccgcttcgcatgtcgcaatgaccttctcagttacgccggagcaagcangcatacctngtgacaagtacaaagagtaaacttggagcaaggattaaaacattgctcactgcagctattaggccggattttgggaaattcagattcacaacgcccgaaatatgtggaagctaacgtaattcaattnaaagcgccngaaaccaanagactttacttaanattaanaaaggttaccaagcaagctacacaaaacgggaaacattacggatcgttatcatcgttnagataaagctacgctcgtcgcacgggttgcaaatnacatgtcaaatcatcancggtaaaaccntgttacaaatccggntcactgcaagcagcaacactaaaggnggtt

SEQ ID NO: 92355 - DNA, 350 bp, Triticum aestivum
  unsure (1)..(350): unsure at all n locations
  Clone ID: PAT_TA_92355
ctcgtgccgaattcggcacgagggcactaggtcggaaacgtcaacagaagactgcacaggaagtagcagagcctacgaaaaagagcaaatctgttgagaaaaagcactctgatagactcgctacccaaggaaaagtcgacccagctctagaaaaacagtttgaagctggtcgtctatttgccgttgtgtcttcaagacctgggcaaagtggacgttgtgatggttacattttgggaaggtgaaaaactcgctttctatcaagaggcaattaaggaagttagaaatatacatacacttttgtaaatggcacgttacaattatcacacctaacttgcatcctgcacaacccn

SEQ ID NO: 92356 - DNA, 339 bp, Triticum aestivum
  unsure (1)..(339): unsure at all n locations
  Clone ID: PAT_TA_92356
ctcgtgccgaattcggcacgaggatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccattgagggcatcaagaattcgagacctgtcctacttgccaacgctcaacaaggaggcctcctcaagcaagtcgactaactnattcgctccaaattgggtgccttgctcnagttcaacaaaggttggttcaacttccgtgagnanaaacancccngggnganaanaaatgcccgta

SEQ ID NO: 92357 - DNA, 369 bp, Triticum aestivum
  unsure (1)..(369): unsure at all n locations
  Clone ID: PAT_TA_92357
tcgtgccgaattcgnnacgagctcgtgccgaattcggnacnaggccacctctcactctctctctctctctctctctctctctctctanatnggcacgcttctccgccgcgtcctcctctccctcncgctcctcgccgctgccgcgacnccnngcgcggcggcaggaggnggccaggctgtcgacgtcgtactacagccgcagctgccaccgcgtggagcagatcntctcggacntggtcgacgccaancagcangccaacccgtccacggaggcnggcacgctgngnctcttcttccangnantgcttcgtctcnggntgctacgctcngttctctntcancgctctcntcgganngtagccctgancg

SEQ ID NO: 92358 - DNA, 299 bp, Triticum aestivum
  unsure (1)..(299): unsure at all n locations
  Clone ID: PAT_TA_92358
gtttcttccagttcactgatatacaagtgcgaatacattatctggagtatatccagaactccagaaacacagtatgccatgcacattggcgactggtcgatccttgctcacaccggcgacgtcgggttcgtggacnccgacgacgagatcttcatcgtggaccggctcaaggagctcatcaagtacaaaggcttccaggtggcgcccgcggagctcnangccatgctcatcncccaccccggcatnnccgacgccnccgtcttccngatnaangatgatgccaanggngangtcccggt

SEQ ID NO: 92359 - DNA, 591 bp, Triticum aestivum
  unsure (1)..(591): unsure at all n locations
  Clone ID: PAT_TA_92359
ttaattatatttctatgggaaatcaggaatgctcaatgcactactataaagagaattaccgcaagttctattctgcaataaaagcatcctacccagatatcaaaatcatatccagctgtgatagatctaccatttcaccggtcgaacctgctgatctgtatgatgttcatgtctatacctcatctgggtgatatgttttccaaatctagcatgtttgacagcacacccccgaggcggaccgaaggcaattgttaagtgaatatgctgtgactgggaaatgatgctggccgaggaacactagtactgcttagctgaactgcattcctaattggatttagaaagaaacaggacgctnttnaaatggaagttgtgctccatccttcngtaaatgacaatgatcgcaagtggganccaaatgcatanctcaaccaatgggaacactatggtgtccaaactacggatgttacattctcaaagganccaantgggcaacactcanccanctacaataantttcnaactatatcaacggtccatcggnacacttggaaaatcaagatggaatactactaaaataaggtccaattngga

SEQ ID NO: 92360 - DNA, 595 bp, Triticum aestivum
  unsure (1)..(595): unsure at all n locations
  Clone ID: PAT_TA_92360
ccacgcctgcctcatctctcggagcagcagcaggaggagcttgcaggaacaatggcggcccagggtcttctctctgggaggcagctgcttgggaggcctctgcagtcttccatctccaggtcgtcttcctcccggaagtccgccttcgtcgtcagggcatcgtccagcccccctgccaagcaaaatgacaacaggcagctgtggttcgcgtccaagcatccctcacctacctgggacggcacgctgcccggtgacttggttcgacccttggggctgtccgacccggaagggcaccggcgggtcatcgagccaagtggctggcctacgggagattttcaaacggccngacggatatgcnttgntggcatatngccccggaaggccttgagnagngggcttgtgccccggaanggatncgttgtccaagccgggcattcgccannggnactacattatgggcgacctaaagtctcnttcaaatggctaacggtccngacacggggtcaggatgganaacgggtcatgggaacatantctggcccaaatactcgtgtccgnaaccctaccgggggcaactaccntcgttngacaaaaa

SEQ ID NO: 92361 - DNA, 630 bp, Triticum aestivum
  unsure (1)..(630): unsure at all n locations
  Clone ID: PAT_TA_92361
ttgaaaacacggtcccttgagcactggaataaatccttcaagatacacacggctaacttctccgagatatatcagatatccagtcgaagaatatgcacgtgttcctgcagcttggccttggcctcatactgcttggcgcacattgtgcctctggagctgcggttcctagctcacagtgccgaaggaggtgcggcaaggttgagataccgtacccattcggcatcgaccccaactgctctctcatggcggacgtcttcgacctcagttgcgagcttagagatggcatcctcaagccatttagggggatctttgaggtactggacatctccctaacccacagcactgccagggtactcaacaacatcgaggcttcctgctacaacaacaccaacaggagcatggagcatttggctatcaagagagcgcgaacgganggcctcctccgtccaacggctctcggacgtccanaacagtcacgtcatgggtgtagcgnatccccgccatgtcgatcgnatggnagggctacaagggatggncgtcncacattctgactgtcggcctgngacggtccgtccggatgggtgcccaaacatgtaccaagaggttgtatncaccaaatnccagtcgttn

SEQ ID NO: 92362 - DNA, 617 bp, Triticum aestivum
  unsure (1)..(617): unsure at all n locations
  Clone ID: PAT_TA_92362
cgattatcgcgctaattcttactaaccggctctaaactgaactaatacgttggacataatataatagcaggtaaccgattgagccttctatttggatcatcatggtcccttgattctctttgcagtgtatcggagtataattctgagctaataaaagtgagcttttcccacaatccacaaccatatgcctcaatcagttttccaagtaccgaatctaaaaagggacgcattcaagactcatctaggcaaagcggatagagagagtagatcatatggatgtgcttgtaaaagtggcgagttgcaaagctcggagcttaagtcgaaagatcccatttcttcatctctacctacttttccaaagctcaaaaatgacanatcaatgtatgataactttcatgagttgattcgatagcgcggtctcaatantggcgtggtcaactggtagtggccgcacgaatgcaactgaggcgaacaagctcccgcacggcaatcacttcataagatnaacgcgacaaaaaaaatgtaantcaagcaanaccgnacaatctacttggcaaacaagtgtctnaagaacnccnatggnagnttcatttgaagcaatggggggttcctcaaac

SEQ ID NO: 92363 - DNA, 593 bp, Triticum aestivum
  unsure (1)..(593): unsure at all n locations
  Clone ID: PAT_TA_92363
caggcaccctgcaaaccattgattaagggattcatacagttcatgagtacatacggaggatctacagaaatacctctgcttgattctgttattgctaatgccgtgattcctggatctggcgtatcaacagctttaagccttgaagaccgtgaagatatctcgttgttgtttctaaagtttgttgacctttatgggagtgtccaagaactcaagaaaggcatgggctcgacacagcaaacttttcctcacaacacaaggaacctgtcacaagcggcactgtactactgactgtaacaagaggagaataactgaattctgaaggttgcncaagacggtcccccnnaagggaagatcacatttaaacatcatctaaagtgaacttgtccttgggaaattgataagaatccgttcccaagtggatatggatgcttcaatcaaggaggcaaggatatgatgatnancaaaacaccggacantttatcncaacaagagtngggatacactcacggcaanaaactgggcaatntggatnaaagcaaatgtttaaanctaacaagattcatcagaattacgtancaacaattgcaacacaa

SEQ ID NO: 92364 - DNA, 619 bp, Triticum aestivum
  unsure (1)..(619): unsure at all n locations
  Clone ID: PAT_TA_92364
aatccagccccctccgatcgaagcgaagtcaaggctctttcgtcctcctcctcaagatgcagatctttgtgaagaccctcaccggcaagaccatcaccctcgaggttgagtcctcggacaccatcgacaacgtcaaggctaagatccaggacaaggagggcatccctccggatcagcagcgtctcatcttcgctggcaagcagctcgaggatggccgcaccctgggctgactacaacatccaagaaggaatccacactccacctgggtgctcagactcccgtgggtggcatgcagttttccgtcaaagaccctgaccggcaagaccatcaacctgggangtttgancctccggacaccatcngacaacgtcaaggcaagttcaagacaaggagggatcccccggacaacancgtctcattttgctggnaanaactccangatggcgcagctccctgactacaacatccaagaaggaccanatccactggtgccaaggtccgtngtggatcantctcgtcaagacctgacggnaagacatacctggaggtcagtctctanacatcacaantaaggcaagntcaganaggaggatccacgncaacaagtnatctntngaaa

SEQ ID NO: 92365 - DNA, 585 bp, Triticum aestivum
  unsure (1)..(585): unsure at all n locations
  Clone ID: PAT_TA_92365
gtcacagcttccaaaataacccgaagaaactacttcacgctctcacacagctcctactgttcctttgttaaaatccgataagtctacgacattaaaactatcgacaaatcaggtcaccccaccaaaatataagcaatatttattttacacaacagctgcaaaatgagaaccttcagtcttgtgtcactggcggctattttaaattatctaacgcttccatctgccgttgggagtggccctgtcgctaacgcttcaagttacaagtgtcatgacagggtcattggtccggttaccttaaatgatcagatagaaaangcatatagagaagcactagaagcaggcacttcacctaaacggactaaggaaaggacagaatttggttcaaagatactttaatgtaatccttaaaaagaggagaagagatattaaatcgaatttttgtgggaacaactatttgnaagaaattattatctacangctaagtccanagcgtatgctanatgttaccaacaacanngaggctcaattaacataatcgcacnntaatnaggagaacttaagaccaatattgtnacaaanttcacc

SEQ ID NO: 92366 - DNA, 419 bp, Triticum aestivum
  unsure (1)..(419): unsure at all n locations
  Clone ID: PAT_TA_92366
ctcgtgccgaattcggcacgagcaacaccggcgctcgttgagaaatcgcaggtagatttgcgcggagggggcgcgtcgacgtcgcatccatggccgccgccgcgttctccatcagggggtacgcggcgagcatgcggagcgaggcggcggcggagggtcggcgtcccttgggcatcgaacatctcccgcctatcaaggcgccgagattccggtggtgggcggacgagctggcctccgccgtggcggctgctgctgctgcggcggcgccgtccctgaggaggtcgccaaggaangcgaaaccgccgaagaagaagnccatctcttgactcttcgccgcggngcccccttggacttccccccgccngtgatancggatcaacgacaaacgtggttgacgngacaaaggctttcgcattttt

SEQ ID NO: 92367 - DNA, 300 bp, Triticum aestivum
  unsure (1)..(300): unsure at all n locations
  Clone ID: PAT_TA_92367
gccgcacccgcaccggagcgtcggtccgtcgaacacctagcaggcagccatggccctccacctcctcactcccacccacctccaccacccctcgtgccgggccacgccgcgccggcatgtcggccatccgcagctcgctcatcgacccggacggcggngcgctcntcganctcgtggcgccgccggggagccgcgcggtgctgngggccgaggcggaggcgctccngcgggtgcggctcncggccgtggactggaatgggcncangtgctcgccnanggctgggcgtccccgcngcgcgg

SEQ ID NO: 92368 - DNA, 613 bp, Triticum aestivum
  unsure (1)..(613): unsure at all n locations
  Clone ID: PAT_TA_92368
gatcagtcgaagcaagtacattggttttatctgaccataagaatttggaacattttactaccaccaagaaactgaatcgccgccaagcacattggagtgaactgctagcaatatgacttcaaaatcgtctttagacctggtaagcagagcggaaagcctgatgccaaaataccaagaatcaagtcctgattaaaccatatcatatacttcgtcgcattggatacgagcaatgtccaaggcctacccccgtgggaggaacacctgtgttccgcgccatcattcaacgaatggggaaaagcactgcgaggaagacgaatttaccaaacgacctaaagagacatttgagaaccaagcaattgaacgaaagatattcaactggcggaagactccctggagatatccttgaacaactgcatgaaatcccaagtttgggcatagaagaacgctccttgtacanccggtnaanccaantttngggggctaattcatnaagngcacaatncccanagtgttaacagtcaacaaaatatacctgtcaaaancatatganttanaacctgcagaactcagctnanttcgaattaccctntttangaccttcatagtaataagg

SEQ ID NO: 92369 - DNA, 609 bp, Triticum aestivum
  unsure (1)..(609): unsure at all n locations
  Clone ID: PAT_TA_92369
gagagagagaatagaaaaaccggtgaaaaccataaaaacacgttgaaaagaagaaaaccggtgaaaaagagcgataaataaaaaaagtcaacgaaaattaaggttagaaaatcaatgaaaatggaagaaagaaaaaagaaagcaaagaaaaaacatagaaaataaaaaactagtgaaaaaacaaataaaaaaccaggtgaaatggagaaaaataaataaagaaaaccgaagttatatcaaagaataaagaaaatccaaagaatattgggtaaaaaagataaaaaaacaaaaaagggataaaccggagcaagagcgaacatacaacgagcaaactacagtgagcaataacttccgataatancccgtcagtttggcgatacgcttgaggcaagagnccctatagcttaaagtcccccgttgtggncaacctggttaatggcctacaagaaaagttttccattaancaatagcnacccatatgtatgataanactaccatcgatgttttagatcaaaagnacttaagataaggattgggctttacctttggtcgactaagcagggtaagatcactatncanagtanctttatagatcaantcgtancatgt

SEQ ID NO: 92370 - DNA, 425 bp, Triticum aestivum
  unsure (1)..(425): unsure at all n locations
  Clone ID: PAT_TA_92370
gactccttctcgccccctcctgccccgtggtccccaaccgccgtccgccgccgcagaggggagaggcggccgccgcccgccgccacagcaccgcaggccccgtcgcccccgcgcaccccgccgggtttgatcccatggcgtccaagaggatcctcaaggagctcaaggacctgcagaaggaccctcccacctcatgcagcgcaggtcctgtaggtgaggacatgttccactggcaggcaactatcatgggaccctctgacagtccgttcaccggtggtctatttttggtgaacattcatttcccaccggattaccccttcaagcccccgaaggtctctttccgcaccaaggtgttccacccaaacatcaacagcaacggcagcatttgccttgacattctcaaggaacagtggagcccggtttna

SEQ ID NO: 92371 - DNA, 229 bp, Triticum aestivum
  unsure (1)..(229): unsure at all n locations
  Clone ID: PAT_TA_92371
ctcgtgccgaattcggcacgaggtcagtctcttcttcttctctagcgagcgngcaggctaggcttggaggtgaccgaaaatgccggtcagnangatcgccgtggggagccaccgtgaggtgtacgangtgggcgccctcaaggcggnnctcgccgagttcatctcnacgctcancttcntcttcnccggacaaggctccggcatggccttcagtaagctgagccccgac

SEQ ID NO: 92372 - DNA, 437 bp, Triticum aestivum
  unsure (1)..(437): unsure at all n locations
  Clone ID: PAT_TA_92372
ctcgtgccgaattcggcacgaggcaaagcttgagatggcgcaaaccatggcgtccatgaccggcctgtcgcagggcgtgcgtctcccaggcccggccggcaggcgcgccagcaggttcatcgtgagggcgtcgtcggcggaggcggaggccgccggccgccgcgcggtccttggcctcatggccagcggagtcgtcggcagcgcgttcgctcaggtggtgcacgccggcaccgtcgcggccatcaaggtttggcccgccgccgccgctctccggtggactccccggaacggacaaatcccaacaaggnaaggaacttcaacctgcccctgaagaaccggttctacctgcagccgctgcaccggcggaaggcggcggtccgggccaaggagtcggccaagacatcctcaacctcaagccgctcatcnacaagaagcaa

SEQ ID NO: 92373 - DNA, 400 bp, Triticum aestivum
  Clone ID: PAT_TA_92373
tttcctgctggctattgatatatgaaaatttcagtatccttcaaaacggtgagaagatagcactccaattacatatggaaaatgtcgcatcctctaaacttatatatatgcgtggaatcattgcatgcttgctcactctgaaataaagattgcgtcgttgaaacttcaaattgacgaatacttggcaacgaattcaataatatgcttgtctgaggttcctccttcccgcattgccttcttagcctttttcatccacttcgtagcattcctttggtactcatccttcttctccccatccattacctctctaacacacctctcgacctccgcactccttagtgctccagtttcactcttccgcaatctcacacccataccccacatgctctccacatacttc

SEQ ID NO: 92374 - DNA, 415 bp, Triticum aestivum
  unsure (1)..(415): unsure at all n locations
  Clone ID: PAT_TA_92374
cttgaaatttccattgtgatatttctctgaagttgatatacacttaaacaaaattgtatagaggatacactttcaacaaggggcctttaactatgccttagtaaaaccttaccaaagtaaatcttgaaagaacaactgaaattttttaacggcatcagtttgctgttttacaaccgaattaacaaaccaaaaaatgtactgcccagtttttggctgggccacgccgttgatcagcaacttcgtcgccagtttctgcatgcttatcagcacccgccgtttgggtcccaagttgagcacgantgggctggnccctggnatttccggaaaaanaacttgccggatgaacccgacaacggactcnccggaggtggcttctccggcgccccactcctctcccaacagcgggcgcgcnggg

SEQ ID NO: 92375 - DNA, 448 bp, Triticum aestivum
  unsure (1)..(448): unsure at all n locations
  Clone ID: PAT_TA_92375
tgcaaggctgaacctgttaaggggtatgtttccagtcattagaataggattccctaagttaaggatgaaatagggcnaatactttgtncaaaaancgtgaaaccaaagttccanggatcccaaattanagctggacattctgactaccatttggcgcggnaatatatctcgtgccgaattcggnacnanttcanaaccagnngaaancagntanttcnacaanccatccattagaacctcagccttctnattcacgtggnccaatttagttaaaaaangggtancgggggaccctggaaattccctacagaagggcatttnaaaaaggctttaagggacccanataagggtntttcaaanccaantttcaaattnatncacnaaggggcaaccgaatcnccaanttncantgaaaaccttancaanccggaaataanttaattatttn

SEQ ID NO: 92376 - DNA, 465 bp, Triticum aestivum
  unsure (1)..(465): unsure at all n locations
  Clone ID: PAT_TA_92376
cttacccatggctcttaacaactggctcaaagtttgtggccaaaccagatcaactaattaagagaagaggtaaaagtggcctactagccctaaataagacctggcccgaagccaaagcctgtattgcagcacgagctggaaagcctcaaaaggtggaaaccacggttggggtcctcagacaatttttagtagaaccattcgtaccacatcctgagggaacagaatactacattaacattaattctcaaagagagggtgattggattctctttactcatgaaggaggagtcgatgttggtgacgtcgatgccaaggctgaaaaactactcatccagtcgacctcagcgaataccatcaaatgaagccatcgcaaccgggcttcttggcaangntccaaaggtgttcanaatgttctggnaatttntcacaagactttcncgttacttgacgtcaatttactatctg

SEQ ID NO: 92377 - DNA, 462 bp, Triticum aestivum
  unsure (1)..(462): unsure at all n locations
  Clone ID: PAT_TA_92377
ctcgtgccgaattcggcacgagtcatcatcccatcccccaagtcataaacccaagtcggactcgccttcctcctcccccaactactcctcctcgcctccgcgcatcgcaccgcaccgggggtcacctgagatcacatacacaatggtgaaggctgtggctgtgcttaccggcagtgagggtgtcaagggcaccatcttcttcacccaggagggagatggcccgaccaccggtgacgggaagtgtcactgggactcaaggaagggctccacggcttccatgtgcacgctcttggtgacaacaacaatggctgcatgtcaactggaccacacttcaancccgctggtcatgtcatggggnaccgaagatgaaatccgccatgctggngatcttggnaattnacactggaacggtggtgtttctaaataatgttactgatgcanatccccttacnggncaaatna

SEQ ID NO: 92378 - DNA, 462 bp, Triticum aestivum
  unsure (1)..(462): unsure at all n locations
  Clone ID: PAT_TA_92378
gcgccccgtttattattccccttcccgcagccgccccccgtgtcccgcgcgcaccttctcgaagcctcctccctccctcccccatggcggaccagctcaccgacgagcagatcgccgagttcaaggaggccttcagcctcttcgacaaggatggcgacggttgcatcaccaccaaggagctcggaaccgtgatgcggtcccttgggcagaaccccacggaggcggagctgcaggacatgatcaacgaggttgacgcggacggcaacggcaacatcgacttccccgagttcctgaacctgatggcgaagaagatgaaggacacggactcngangaggagctcaangaggcgttccgcgtgtttgacaaaggacaagaacggnttcatctcnggggggggactncgcacttatgacaaactcngganaaacttacggccaagaagtggccaaatattcggaggg

SEQ ID NO: 92379 - DNA, 474 bp, Triticum aestivum
  unsure (1)..(474): unsure at all n locations
  Clone ID: PAT_TA_92379
tgataatttccagggtgtgcgtgagggcggccaaaatgatgggggttctcagcctgacccagtgcagcagaatgtcatgcacggtgccatcacccctgcaggacacttccagattgaaactaacaatgtctgagtcgagaaatgcccaagatgaagggaagcatcggatgcgaggaatgtgagagaagtacgccaaaccttggaagtacttctctcgtcattgaagtgatgctgctctctaaaccttggaccaattagaattagctcccttttctccttcccacacttttgagagagatttgatgttcaatgagtgatgtgtatattgtctactcaagactgatattgctacccacgctactcagactgctattgctacctcacgcattttaagcaaccgacatactaaaattcccggatccaattgcaaaaataaacattnagacatagcatatctccacatgcaagcttcat

SEQ ID NO: 92380 - DNA, 484 bp, Triticum aestivum
  unsure (1)..(484): unsure at all n locations
  Clone ID: PAT_TA_92380
ctcgtgccgaattcggcacgaggtttttttttttttttttttttgtcgagagatcgatttatattggnagatacctgactatacatatcattacgctaatacgcctgcacgcctaccgccatgattctatggttttctctactttaaagctaatcagaagcatacatgaaaccaaagtagttcgcatgagcaataattaaaatgttgcaccgtagttcgagtttccaatncgttgtgtatgggtgtncaaaatttgatnatccgaatcctgataaacagtnatacgacgggcancctccgaaaanaactccctnaactnccaattaatttgccttggtggcaacanaaaacccanaatnttcccttgtaaaaaatcccnctacttgnaancancatgacggntaanaaggttcatacngggnggaanaacatcctcaagggatgtttggcacntcccaatgtggggggcaaaaatanaaagact

SEQ ID NO: 92381 - DNA, 485 bp, Triticum aestivum
  Clone ID: PAT_TA_92381
ttggatgctggttttttattagctatgtgtaagtacttcttccgtgcataaaactgtgttcatgaagttttagccctcccatcttgaacccttgtagctactggtcaactcaagttcgacctcaatcatagcggtgttacgcgcacgggcaataatcttcttggaatgcccacgaacctcaatacttgcgtcatggttgtgactattctatgaatcattgactgccagcattataccagcttgttaactaccacaattttgatcgactgccctctctgcactaaagtcgtcctccttgccttaaaccgataattcaatctgctttgacccttcaatatttgactgatacttttgcaaaatggcctgcacttcgccgcccgtaccacagtatctatgacctgttcggggcagcgggcaatgaaatcctgggatcgagcatgccatcaatatctgacagatcggcgaaaaatacgcgctatcctgaa

SEQ ID NO: 92382 - DNA, 450 bp, Triticum aestivum
  unsure (1)..(450): unsure at all n locations
  Clone ID: PAT_TA_92382
cggaaaacgtttaaattaagccggctgatttccacgccgctcaaaccgcctggaacgcacgacaagtgtccagccccacgcgtcgctcgcaaccgccccagcctgatcttctccgtgtccacacgttcgccccactccttcccaccctttgttgtcacgcaccggagaaagaggcatggcgctgcagcacgaaggaggaggccggagcctggcgccgctggtcgccggtgctgcagcacaacacgggaaggccggaggcgggcgccgtccatcgtcggaggaagtcgcgtcctcgtggatntcgccacagcgacggagctacaatacagcacaagcgacgccccgacccgttaagctcgccggggcatactgcttggtgcaaggaactctcccgggggtccnatgttgcttgcaatgtcccccggtgtcngagtacatgtcaatgaaann

SEQ ID NO: 92383 - DNA, 459 bp, Triticum aestivum
  unsure (1)..(459): unsure at all n locations
  Clone ID: PAT_TA_92383
gttcacacgcagtcaatcatatcataagttctgaattcaaatatttagagtaacgggagattcacaagatgaactttataactcgccgagctctttcaactttaattcctccgaaggtcgcatcacctactgtcagtaatccaccctagaaacttcaaatatctggctatccagagccttcggccgcaaaaatttcaaaagtccaatatgtgaacgattttctgaaggcggaacgcggctgacggtttaggcaatcggggccgctcaagatgctgctcgcatggcgcgtgttgtaagcttttatgaaaagcttcctcgtggtccggcgccggaaatcaagccgaaggcatgctcggcagatatcaagcacatacttcggcaaaaactcaagtgcaacacaatcatccagtcatgtatcatgttancnttgggtaagctcaaaactattacttcaaccng

SEQ ID NO: 92384 - DNA, 482 bp, Triticum aestivum
  unsure (1)..(482): unsure at all n locations
  Clone ID: PAT_TA_92384
ctcgtgccgaattcggcacgagcttggctctataccactggtgcacatcaacgacgtctgtgaagcacatatcttttgcatggagaggtcgtttgatgttgctggtggccgatacctttgcaccactgcgcacaccaacatgcatgacgttttggagcactatgctggcaaacaccctgaactcgagatagtggacaaagaggtggtgggagagggagtgagggtgcatgttaacacaaacaagctcgtggaactggggtttaagtataagtaatggagcaaaggaggtgcttgatggtagcgtggattgcggtaagaggttgggagtgctatgatgtgcatgcacataacattgatcaacatttgacaatccaattatatgtgtatacgttatttggttaaatcccgtgtanattccttgaaacagttgagattacngtccccttaacataaatttgggttgtgcatgantttcaagtaaa

SEQ ID NO: 92385 - DNA, 238 bp, Triticum aestivum
  unsure (1)..(238): unsure at all n locations
  Clone ID: PAT_TA_92385
ctcgtgccgaattcggcacgagcttctcctccccttccggttcgggttcgggttctggttcggttcgggtcngagagtagctagcctagtctagggtttccgtanagaggaggaggagaggaatanagagatcnatggcngcnacggantatcgctgcttcntggncggcctcnncctgggtcatcgatgacaataacctccaancatgccntcagtcagtatgtgaganatcctcaa

SEQ ID NO: 92386 - DNA, 461 bp, Triticum aestivum
  unsure (1)..(461): unsure at all n locations
  Clone ID: PAT_TA_92386
gttgatgtgaagaacaggcaggttaaggccaagcaggtgacattccacaggaagaagaacctgcagtactatgaaatctctgccaagagcaactacaactttgagaagcccttcctttaccttgcaaggaagctggctgngtgatcccaacattcacttccgtccgaagctgtggccttaacccccggaatgaccttccgacctgggccatgcaagcaacagcacgaggctgacttngcggctgcaagcggcacaccactgcctggatgacgatgacattctgattcgagtagagagaggatncatgatccttgtccnnccttancaaatccaatactttttnaagcccaaaactgtncaatcgnttttaagtttnaagcttgattttggagtaatcaanccggattttttcccgtccgccttgccttttccngggtnggctgcaacntttggtttaatna

SEQ ID NO: 92387 - DNA, 447 bp, Triticum aestivum
  unsure (1)..(447): unsure at all n locations
  Clone ID: PAT_TA_92387
aagatttgttcattttctttgactcttctattcttcaaaaggatctaaaacaaggacttttggtcctctttggcctcgcagaagaggtatttgctgtatcaagagttgttatttgtcttggcaggtcgattgataatttaagtcgcaactcgctcatgaaaaatctccgctgggttggatttgagcccacaacgttaagcccttgggcttaatcgcctcagtataacaagcgataaatggcctttctccggattagaaatgttagtccggagattatcaatttcactatggttatgatctaaaacaggaatgctcctgttagataacattacgtgcacctgcttaataagacatcnaaaacangatccatgattcacgctcagcctcccgttacaacatacaacccttaacaaattggggatgaacccttaaagtccnggaagcaaa

SEQ ID NO: 92388 - DNA, 244 bp, Triticum aestivum
  unsure (1)..(244): unsure at all n locations
  Clone ID: PAT_TA_92388
ttaccaaataggtatactcaatatctttanatattaacannacatgcccagcaatcgcttggatgcgatgcggtacttaggtanaaaggataaaacatcagatnttaaantggnatgcttaannngtgtaaaggcanctgncgtcgtnantcctcaccgttgggtcnaanttcttggtagtctggtcggtgaancctgctngtacaggcancagtaccttgctgtgcccctttacntccnccta

SEQ ID NO: 92389 - DNA, 221 bp, Triticum aestivum
  unsure (1)..(221): unsure at all n locations
  Clone ID: PAT_TA_92389
gagcaagtgggtttcgagggcatcgcggnngcggtcatnggcggtaggcggaccnagggtggcgcgagntcaagcgcggngcggtcggtcangctcgtccggaagctcgccaccgccttgtccgagggccggatggancgcntcgccancggcatctggagcgcggnaaacgatccggagangttggntgacgtactctcattctcgttacagaanctcga

SEQ ID NO: 92390 - DNA, 353 bp, Triticum aestivum
  unsure (1)..(353): unsure at all n locations
  Clone ID: PAT_TA_92390
ntaaaaacaagtgggctagatatgcttgtctactgancctcaatcaaatgctcttcggttagtggagtcaaaaaagtgcaatgccacctgntatctttacactcangaaagcaggttgcttcntcttgcatctggaatgcantgtacgctgttcactggatatcagttttctgctggtgggatcntcaaattgcctaantttganatggngatgtcnaaatccgnagcaaataacaagcctgtcctaaactgctgctgatgttcacatngnaacagtgtaaggnangatttactgcttgcanntgggtagantccgtatgggattgnacccgtnccgattccnaccggtgatg

SEQ ID NO: 92391 - DNA, 292 bp, Triticum aestivum
  unsure (1)..(292): unsure at all n locations
  Clone ID: PAT_TA_92391
ctcgtgccgaattcggcacganagaggctcggcctttgacctagagaggcaggtccnacctgcagtccnagcttgggttaggaatcgtcgctcacctaacgtcaaacttcacatggngagtctggcaaccaatcctgccanttcaaccccacatacnattcagcccannagaagattggtggcgccacaaatcccantttcttgaaacgcagtcgcttgctttctannaaagctgcnacatntatattattccaggctnagttgcgtcnanccagactancctctctgttca

SEQ ID NO: 92392 - DNA, 453 bp, Triticum aestivum
  unsure (1)..(453): unsure at all n locations
  Clone ID: PAT_TA_92392
ctcgtgccgaattcggcacgagctcgtgccgaattcggcacgaggcataacctaacttggtatcagacgcgagcatcttcgatcctcctttctctcttcgcttccgccatgaaccgcctccttcgccgcacccgctcggtggacttggactcgccggcgaccgagcccttcgccgcggtccctctcgccaccgccgcgctccctctcgccaccgccgcggtccccgcgacccgacgcgcacccctccgccgaccgcgacaagatgcccgtccccaacggcgctggggcctccgtcctcgtctaacccagccctcgcatcccaccacccgcgggcatcctccggaccgtggggcaanacgccgttccccggcctcgcgctgggcancccggcgggccgttctcccgcacgcggcttngngcccccgatgcggccttcttcgtngccggctgcgc

SEQ ID NO: 92393 - DNA, 452 bp, Triticum aestivum
  unsure (1)..(452): unsure at all n locations
  Clone ID: PAT_TA_92393
tttttttttttttcanaaanctcnatgttgcgcaaatttttgcatacagatgagagtgattatgaaactattgtactaaatgaaaanaagtgattactggtgtatatttcaaggattctcgctcttcatcatcctcactcatactagcatatccacgcgtcctgcataccaataanacgtttggngananctaaacagcgctttactatcncaacctttgtagttataggtaagccactcttctcgccttcccatacctccaanccanatacggaggccacccgcaagcctttcaanagagtttgtacanntggcagctactaaactgtgtccgttganatctccattaatttnnacgttgcattganctaangngtgttaaatttcccgggtgagatcntgttgatnacatgtaangccnttcatgaatccgatgggtgctgggcancttg

SEQ ID NO: 92394 - DNA, 423 bp, Triticum aestivum
  unsure (1)..(423): unsure at all n locations
  Clone ID: PAT_TA_92394
taacagatcatanacaanatcaagctatcaatatctatacttgntttaatgatcactccaatgatacgatgccttagacccatcaagtgcaacttgccaaagcacattttaagaaaaaattcnacattcactcaggccgtcacaaatcccgctaataggacccaaatctatatctctcagtcantaaatccatacgtaaacctttccattnaaacttacttcctcttaaatacaccggtancactcancaatcttatttctcnactcaaaccgnncaagtattatcctcnngtcccaactaaaatccatggnactanactnaacttncgtcnactngctctancttncccgaaacactcctcnttcganccgctctgtgcngcnggactgtattcatgatgncggtnatgtgcntacatgtta

SEQ ID NO: 92395 - DNA, 430 bp, Triticum aestivum
  unsure (1)..(430): unsure at all n locations
  Clone ID: PAT_TA_92395
agacagacagagcttgagagagcgcgcgcgagatggcagcctccatgatcacctcgccgattgtggcgccgacgagcgtcccctccctctcccgccggggttcctccttcgccgtcgtctgcagcggtggcaagaagatcaaggtcgacaagccccttggacttggaggcggcttgacagtccgacatcgacgccaacggcaggaaggtgggcaagaaggcgtgtaccantccgttgacaantacggcgccaagtcgacggctacaaccnatctacacgccaaagaatggctnatctggtaacgctangcccggnganaacngggttcttaacnggcgtaacctngccggttccttnggggggtcnccccgtctaaaaaacaagttttcccnggtaaaanactaacgntaanaaggcggttcctcttnan

SEQ ID NO: 92396 - DNA, 490 bp, Triticum aestivum
  unsure (1)..(490): unsure at all n locations
  Clone ID: PAT_TA_92396
ttttttttaacagggcanaatctcttgattcaaccaaaacacaaccacaccaatttcacgattaccattacaaagcaaatcccacaattatcagaaagttttcaagacactcaacatctgacagttactgacaccaacattggagagtcnactgacaaccatagataagagcaaaaatactgaagacagcatagattttagcatacagtgcgattancacttgacctctttcagcccatgtgcaaagtacaggaaagtggatcagcagtccctccttggtagtacgcgaacaccacgccgccatcatcatgcatgctctcgccaacaaagaangaaaggccttgagctgccaagaagatactttgtggcngnctcaacatcctccttggaagcatctaagncatccccctcaagcctgggaaagaggtcctgnngtacgctcatgtngcgaganaacgctcctngtcaaaacagttgnccggaagacgaa

SEQ ID NO: 92397 - DNA, 309 bp, Triticum aestivum
  unsure (1)..(309): unsure at all n locations
  Clone ID: PAT_TA_92397
ggtcattgaatattctgaacctactggatatcgcaaaattcctggtgatacatgcaccactaacggttatccaggaatggatgaaagtacactgcatccatgtcccggaaaggaagaagagttcagaaagaagcatagtgcctcaggtgttggtatcttctttgcggttatagcttcgtttgcaattgccggtgcagcangctggtgggtatggaaaaattggggcccataattaagcccnatccntttgggaaannnacctttgaaaaaaatccctaaccgnagntcccaaccttnaattccggccgg

SEQ ID NO: 92398 - DNA, 288 bp, Triticum aestivum
  unsure (1)..(288): unsure at all n locations
  Clone ID: PAT_TA_92398
ggcgagggaggaggcagaaatcatggacgacgccggcctgntgatcgccgccgcgttgacaggcggaatcttcgtcgtgttgctcgtcctgctcgtcgtcgtccttgtccggangcggtggctggaccgcgagggcgtggcgtccggccgcggcttcgtcctgttcggcgtctgttgccaggacggcacccagggccggttcgtccggacgtcgtccctggccagganccggcaacgggcggcgcgcggcggcgaagaagcngatgacgaaccggacganggcgactc

SEQ ID NO: 92399 - DNA, 227 bp, Triticum aestivum
  unsure (1)..(227): unsure at all n locations
  Clone ID: PAT_TA_92399
ttttttttttttttttttttttttttttttttttttttttattgaaantgnattcatttaacganatttggtgacatatgggcccatacatgtcggancatgaactctaacatttanaaagnacaaaacttttgtggnaaagacccctcgaattttcaatttttttacactttggtttnatgttgccttcaagaagtgcacnaacactantatgtccagtgcanata

SEQ ID NO: 92400 - DNA, 489 bp, Triticum aestivum
  unsure (1)..(489): unsure at all n locations
  Clone ID: PAT_TA_92400
taagcatcagcattcagcagcaccagccttctacctcctctgctttgcattccgccttccagttccaattccaaccgcaatcaatggctgccatgaagatcgccctccttgccgtggccgcgatggccgtcttgctaggcaccgcgtcagcggtaacctacaacgtcggcgatcagggcggttggaccctcagcaccgactacagcagctgggtgtccggcaagaantcaacgtnggtgatgaattcgtcttcaagtactccaacccaacgcacaacgttggccaaaggtcaacaaaggccggtacaatccctgnancatcgacggggcatcaaaaccttggctccgggaannagntattaacctcaaagcaacggaacccgnatttaaacggggggntcctaacaattnaacccaaaggcgccgcanaagaggcnngataangtcctcggnccccttgccttgtaacaaagcaacnnaggccngggnn

SEQ ID NO: 92401 - DNA, 478 bp, Triticum aestivum
  unsure (1)..(478): unsure at all n locations
  Clone ID: PAT_TA_92401
gctggcacccaagctgcggccctcctaggccgtgcgcgatgagcgacactgcgataccggagcccccgggcaccaccgcggaaagagccatgtacgccactcgcaggacgcaacaggccggcgtgcgcgcccggacgccggcggaagcggcgtgcgaccgcgagaccgtgacagagccccttctaacctggttagaattggagcgcgtcacggtctatgcagtctcgccgccaaccacgccagcagaagcgctggcgcgcgtgcaactgtcctccacttccccctgctgcggagaactcgacnattggagagcacaattcaagccttgtcaattcgcaacaaagatngcaancccgaanggcccccgtcggggtctnatcanccatcctnccgcgtgaaggtcggggatcccncacaatntgaatctctccccggnggcggaaancgccgctgtnaacaaggcgacnaccaatnnttt

SEQ ID NO: 92402 - DNA, 476 bp, Triticum aestivum
  unsure (1)..(476): unsure at all n locations
  Clone ID: PAT_TA_92402
gagctattagaattcataaagataactatagaaatgatcatttatctaatgaattaccctctctaggaattgatcaatcacaagatgatgttgaacatggaaactatgatgaggatgatgatagtgactatgaccttgatgatgcgatgagacactttggtcttatggcaaatctcgcggctacatggcaggaggaaaagcatgggtccttgatagtggatgtactgatcatatgaccagagataaagatatgttccgtgagcttgctgaaaacgacgacctcgaaaatattcactcctgggtgataactcaaanggaaaggttgttggcnccngtaaagngggcatctcacatgatactcccatacaaaagncanccngttgaaccctggggtacaattacttcatanccaaacttccgatttgggtcaaggttatcnccgagtaatgccatgttcttnaaaaacctaaanggcn

SEQ ID NO: 92403 - DNA, 485 bp, Triticum aestivum
  unsure (1)..(485): unsure at all n locations
  Clone ID: PAT_TA_92403
accacaccaatttcacgattaccattacaaagcaaatcccacaattatcagaaagttttcaagacactcaacatctgacagttactgacaccaacattggagagtcgactgacaaccatagataagagcaaaaatactgaagacagcatagattttagcatacagtgcgattagcacttgacctctttcagcccatgtgcaaagtacaggaaagttggatcagcagctccctccttgtagtaggcgaacaccacgccgccatcatcatgcatgctctccgccaacaaagaactgaaggccttggagcttgctaagaagatactttggtggcggactcaacattctccntngaaagcatctagncatccccttcaagcttgggcagagaggtcttgatgtagcgctcatgtgnagagataaacgctcctgtcaaaagcaggtgctcctgaagacggaagtgtcaacatgtcaacacttacngctng

SEQ ID NO: 92404 - DNA, 289 bp, Triticum aestivum
  unsure (1)..(289): unsure at all n locations
  Clone ID: PAT_TA_92404
ctcgtgccgaattcggnacgaagtcggacaccgccttcntcaacccccacanccttatcgcctccctctctcgcatggccgactacagccgctacggccacggccaaggatacgcgccctcctcctcctcgccgtacggcaacggccagggatacggccagggcaacggctacgcgccctcctcctcgccgtacggggcaacggccaagngatacggncagggcaacggctacgcgccctcggcgcctctcgcgcccacgctctcctcctcgncgtacgggtatancta

SEQ ID NO: 92405 - DNA, 536 bp, Triticum aestivum
  unsure (1)..(536): unsure at all n locations
  Clone ID: PAT_TA_92405
ctcgtgccgaattcggcacgagcggcacgagcacccattggcaaaggacatgtctctctaaacttaaccctacgccgaacgtttaatcttttcgcgaacgtcagaccatgccgatctattgctgggtataaaacgccatacgacggtgttgagactgtgataattagagagaatactgagggagaatattctggaattgagcacgttgtcgtagacggcgttgttcagagcatanaactcatcacccgagaggccagcgaacgtgttttacgttttgcatttctgtatgctcagaatattgggcaagcctaaagtgcgcgtagttcacaaagccactattatgaagatgagtgatggcttatttttggctactgcanagcgggtttcaaaaagactttcctgataattgagtttgatgcngngcttctgggntnaacacctgccctaaaaaantgtcaccggattcagttccatacaacgacaanggttttgggnaatgnctaatcccctaanggtgnacatccntggtcctgana

SEQ ID NO: 92406 - DNA, 245 bp, Triticum aestivum
  unsure (1)..(245): unsure at all n locations
  Clone ID: PAT_TA_92406
gtggtaaacagaaacgaaaaaaaagcagagctactgccaatgaaacagtcccggcttgataaaaatttcacatgataagtctatatcttatttaatctgagctggagtctttggctctaaactaagactttagaagcagttaaatagttgctagttagtgactaggactattcgtttctaaaaaaaaaaaaaaaaaaaaaaaaaaaaaaaaaaaaaaaaaaaaaaaaaaaaaaaaaaaaaaaaan

SEQ ID NO: 92407 - DNA, 517 bp, Triticum aestivum
  unsure (1)..(517): unsure at all n locations
  Clone ID: PAT_TA_92407
aagatatggtcatatcatcggccgatgttagagcagcccacgaaagggccatctcgcgcataaataatccgagtacagataacaaatttccgattaatattcaatacagaggaaatattacccccacagctaatcccgcctattattggtatgtgacgcaattgacagactcccaaggtcgggcgggaatgaagtactatttgctgacttcagcgtcgggcgacattttggggatgataagcactggctgggggagggatcttggcacaagcgacacatggtgtacctaggcgtaaacggctaaagtagacgggcaattttccaatagattccgattccaaagttccatttcctgaaaatgcctcaaccctcacaagacataatcaagccataactcnaaaattctcgctacctggcctnnaaaaagatgggngcaaatttcnaatcatccaccaagaaaaatnaaanncaaaaaccccaggggggggccgggtaccaaattcncccaaaanngagn

SEQ ID NO: 92408 - DNA, 415 bp, Triticum aestivum
  Clone ID: PAT_TA_92408
tttcaagagggacatgaatagccgacgctctctagaaagggacagatcaaaatctgttgcgagttcagttgttcaccggttactacatctctgagtaggacatatgagttaggatcaattggtttgagaaatattccggatattgaaatttcagtagaatcttcggcggtaggaattcctggaaatacgtcaagattagtaattgaaatgctgctgtcaatatcttcatccgtgcagtagtacactaggttagctccaggtaacatctcatcggaagggtttgaaatgaacgaggccgatatttgctgacccttcttcatgcaatgcgctgcagcaattgtgctgatcgccaatgtcgcaagagtattcaaaaacttcatgttgctcgtgcccgaattcggcaagaagggggggc

SEQ ID NO: 92409 - DNA, 516 bp, Triticum aestivum
  unsure (1)..(516): unsure at all n locations
  Clone ID: PAT_TA_92409
ggttaatttatctttaaatccagttttttcccgcctgtcggatgggctagtttgggagttgattctactttggttttcagaaactcgatccgagcgccccttcctcttccagaagcaaaatttggctagaattcgtttgaagccggatttgacgaggcagcagaagcagagcagtattataagtgcgattccggctgtcacgccaatgactataccggcaatggctccgccagatagcccgttgctgtagctttgagacacttcgggaaagctgcttccagaggcagtggcggcgggttggaatggaacagtggtggtagcaagagattgtaaagaggtcacctgaagtaagncgaactggtaaccgaataagttgggttaacaacagctggnacatgtgcaattgcaagaanttggcgaangnacaacgctgggtacntgcgcaacaaataatggccgcacgatgactcaactaaacctgggttgtgcaaataaccgggcggcgtgattggttgg

SEQ ID NO: 92410 - DNA, 203 bp, Triticum aestivum
  Clone ID: PAT_TA_92410
ctcgtgccgaattcggcacgagggttgctcagggaggggtcgatcatctcgatgacgtttcccctgttccagtgctcccatacaagattcacgagatcgatgtcttgctcgatgttatatgatccatcatttcttcttcctgtgacgatctctaagaccaagacgccgaagctgctcgtgccgaattcggcacgagggggggg

SEQ ID NO: 92411 - DNA, 378 bp, Triticum aestivum
  unsure (1)..(378): unsure at all n locations
  Clone ID: PAT_TA_92411
cggctagcaaaattactcctttttcctcataaaatttaagtacatgaatatgtcactaccaactctgtttcgcctacaggctganatanctgaggtacangactcgtcnantttttgcgcctgtaaannaatganatcaacctanngagcaacagtccttcccgcgcgcgagcactgagctctcgcgcagattagcagntagcacgcgttngactngntaccgtaagacccctctggcctncgtcnttcaagcatctcnaagggtccgtctgctgcacgtttgccgatgataccctnggtnctcctcntcatncgtccngtgcccgttgaacgccgaaggcaagcctgccggaanattgntccccggttggggatcca

SEQ ID NO: 92412 - DNA, 525 bp, Triticum aestivum
  unsure (1)..(525): unsure at all n locations
  Clone ID: PAT_TA_92412
tttgaggaggctcgatcgatatggcaacaacatccggtcccggttccaaggcgaggaactcccacaggcttcgcgatctctgctgcgacctgcaagcgcaaaggcactcccggtcgctgctgaaatgcctgctcttcatcctgccgggcctcgccgttctggccgctggcgtgctccttctgctacgcttcgccgtcaccccgcaactcaaggcctacatcgaggacgcccgtctcaccagcttcgttcccactggcatcccgtcaccgtccggctcggcggcgacgtacaacgtctccatctcagtcgccctcacggttcgtaaccccaacggagccatggacatcaagtataccaagcccctcgtgtctgccttcctcttctangaccgggcgcctgtacaacgtcaccgtnggcaagcgcaagggcacaagcaacaaggccgctcaaagaagggaaggtgcacatcctccaacaactnggcggggaaggtccccgtactttctgggacgccgcggcngccgc

SEQ ID NO: 92413 - DNA, 422 bp, Triticum aestivum
  unsure (1)..(422): unsure at all n locations
  Clone ID: PAT_TA_92413
tttttgattcacgccctagtctaagaagaatttatcgtatctagccaccaagcccaacactatttacatttagtcccctcccgagtattataacagaattttggaatggaatcagattatagctcacctatcaaacaacaccaaagccacggagatgtggtttcaaggcgcgtgccttagcacaaaacctacgtcaaggtcgactatactcaaaacctccattttcaaaagatgaattcaagacatctgtgaattaatccttcatattgggctatactgggttttcatgctagagacttttcttagatgccgatagattacttgcaaagatgataaggattatttattaggattctagaattttgtggattaaatcttaatcaataacaaccctttactaatcattttgnagaaatctaaaa

SEQ ID NO: 92414 - DNA, 533 bp, Triticum aestivum
  unsure (1)..(533): unsure at all n locations
  Clone ID: PAT_TA_92414
cctagcaagctatatacctacatagtacagccatggcccccaccgtgatggcctcgtcggccacctccgtcgctcctttccaggggctcaagtccaccgccggcctccccgtcagccgccgctccaacggcgctagcctcggcagcgtcagcaacggtggaaggatcaggtgcatgcaggtgtggcccatcgagggcatcaagaagttcgagaccctgtcctacttgccaccgctcagcacggaggccctccttaagcaggtcgactacctgatccgctccaagtgggtgccttgcctcgaagttcagcaaggttgggttcatcttccgtgaagcacaacgcatcccctggggtactaacgattggccgggtactgggacaatggtnggaagcctgcctatgttncgggatgcaaccgacgccaacgcaaggtgattaaacgangtggagggaaggtcaaagaaaggagtaacccttgacgcctaatgtcccgcaatcaatccnggatttcngacaaacaangcgtcaaggtg

SEQ ID NO: 92415 - DNA, 509 bp, Triticum aestivum
  unsure (1)..(509): unsure at all n locations
  Clone ID: PAT_TA_92415
ctcgtgccgaattcggcacgagatttcatcaagcctaactgatctgttatcatgcgcttttctagcatagtcataatctttcaaagcgcaagcatctttctgacagtccttgctgtctacaccaaaagccacatacctgaggaaagaaaaaaatttctttgtggcggacgctctattacctatagcgaatattcatggtcagcactggtggaaacaacaaatgtgtcaggaaatagaatttcttggtcttgggctaatcaattgagtcacttgatgagcgattccagtaatcaaaattttgtcttgttcggaccagagtctgaagtttccaagttttacatcctccaagatttgacaacaggggggtcttctgataatcacaatcatgtatttgaatatatcgtcccttgttgacaaagattgaacgcacttgtgggaatgaataatgagaagtaattgagtcgccntaactccaaatagtgcgaagntcaccaagacaaaatttctca

SEQ ID NO: 92416 - DNA, 214 bp, Triticum aestivum
  unsure (1)..(214): unsure at all n locations
  Clone ID: PAT_TA_92416
ctcgtgccgaattcggcacgagggattatatatttttatatacaggtatatgttagacttagcgcttacatttataaacaggggtgctgaaaanatgaaaacatggctacattagtttacagaagaagttttgaataaatgaggtaaccaagaattaatgcgttcaattccatncccacgagaattttctgccatcattgggccacnaactttg

SEQ ID NO: 92417 - DNA, 536 bp, Triticum aestivum
  unsure (1)..(536): unsure at all n locations
  Clone ID: PAT_TA_92417
ctcgtgccgaattcggcacgagggtccaaatccaccgaccgaccagtgggccccagtcctgcactccctcagaaaaaaaaaaagcactcccgtccacgctccggctccaccctcgaaacctcgaaccacgccaccgccccactccgacttccacccccaaacacgctcgccgaccgcgaccgggaggcgccgggatccacggggagctccaccgccccgtgcttgaccggtaagtttgacggccggctggctgacaacgacggcgaggctgcagcgagatcgacgatcggctcggctctgctgggctggccgcgacggcgagctcgcgacacgggatcggttggcggccgcgacgctaacgacggngggacgctgaggcagtgagcaagcttcatgggaaactctcgacgtttgaancaagangagttacaactagatgggcaattcaatgggnttgtatgctggctctgggnccaaaatcccttctctggccnttgtgctctggcaagccaatgctaatggnaanagtaacttgn

SEQ ID NO: 92418 - DNA, 506 bp, Triticum aestivum
  Clone ID: PAT_TA_92418
tcgaagtaaatcggatctaaccaaattagatgttcagagcgaatcttctacttggtgcggtaaagcctatcaaacagaaaacactgctattccgccaagtggacagtttaagtatccagaagcaaagccaattaagtctctctatttggacgtgaagcctcgatacacaatcttcctagatagtgacccgaccattgagctgcttatagatgcttcattttcaaatttgttcggcacgcctctgcctgaaaatgccacaacaagttttgagacacttagtattgatctccaatgctctgaaatgaatatgacattaagtcaaatcatggttaccgttggtaaagagataaacaagatatctctcagtaccgggttcctccctgcccggttgcagccatacctcatcaccgttattgggtatccaccaaattccgaacaactgtacaacacgaagtacggctgtttatgttctaccttctcgaaagaccgggaagtgctgtaaagat

SEQ ID NO: 92419 - DNA, 507 bp, Triticum aestivum
  Clone ID: PAT_TA_92419
gttgcttcctctccactaagccttgcccttaatatcagacggcttatttcctcaagctcgcatctcgattccgtggaaccactttcccgaaatgaagtttatcagcactgttacagccgcggcgttggccggtcttttactactggtaccggccgcttgtggaaatcgacactatatttgtgaccgtggcgatcccatagacgaggtagtggctttacgagccatgaataatgcttttatgatagagcactctcatgaacacccagctattcctaccggggagccacaatggtcattttttttcactaaaagtttgaatgcacatagattaggtatagcttgctacttactacaagtatatggggatcctccaaattaccaattatctcaaagtttcaagaaggaatggagactatgttccctggaagataagagttagcaagacaccaagaattccacagtcattggcatcaatttcggacctcccacggaaactcggctatgata

SEQ ID NO: 92420 - DNA, 381 bp, Triticum aestivum
  unsure (1)..(381): unsure at all n locations
  Clone ID: PAT_TA_92420
tctcgagtttttttttttttttttttttttttttttttttttttttttttttttttttttttttttgacgaatctggcaccggggnanaaaaacaagncaaanttggaagtggaattgtggttatcaaaagtaattttaacctanaatcggagncacncgaaacccacccacggtcngctggtgccggattcaggaggagccttttgggaaaattagataatggnanaggtagnccananaccccttcacctacattacccttgccgacttgatcgataattccggatgaaataggtatgggccatcaaagcttcaaattttgnggnatttttaacngtttcttgtanacaaaccttcncttaagagcttaaatataanac

SEQ ID NO: 92421 - DNA, 513 bp, Triticum aestivum
  Clone ID: PAT_TA_92421
agaagacgcactaaaaagagaacgcatgttggctctaataatggaccggcgactaaattggcttcgagcaaatcatcaaaaactcccaaaacgatggtgattcgcattggagctggagaagtcggacctagtgtaagccagctggtaaaggacgtaaggttaatgatgtcgccagatactgcggcgcgtcttaaggaaaggagggcaaacaggttacgagactacatcaccatggctgggcccttatctgtcacgcatcttatgctcttctcgcgttctgaatctggcaacactaacttgcgagtcgctatcacgccgcgcggcccaacactgaatttccaggtcgaaaagtattcactgtgtaaagatgtgaggaaagcatacaaacgccctcgaggtagagggaaagaatacataacagcccctctgctggtcatgaataactttaccactccttcctcagccgatacaaaagccgaaaataaggttcccaagcacctcgaagtctctcgt

SEQ ID NO: 92422 - DNA, 511 bp, Triticum aestivum
  unsure (1)..(511): unsure at all n locations
  Clone ID: PAT_TA_92422
cctacatactacanccatggcncccaccgtgatggcctcntcggnnacctccgtcgctcctttccaggggctcaagtccaccgcnggcctccccgtcagncgccgctccaacggcgctagcctcngnagcgtcagcaacggtggaaggatcaggtgcatgcangtgtggnccatcnagggcattaagaanttcgagaccctgtcntacctgccaccgctcagcacggnggccctcctcaagcaggtcgactacctgatccgctccaagtgggtgncttgcctcgagttcancaaggttgggtttatcttccgtgagcacaacgcatcccctgggtactacgatggncggtactggncaatgtggaanctgcctatgttcgggtgcaccgacgccacgcaggtgatcaacnacgtggnggaggtcacgaaggngtaccctgactcgtatgtcngcatcatcgggttcgacaacattcgccaggtgcaattgcgtcaagcttcancgccttna

SEQ ID NO: 92423 - DNA, 285 bp, Triticum aestivum
  Clone ID: PAT_TA_92423
gctcgcttcactgaactgaaacacgctgcatgccatgctcctcctgacatccattccatcgctgttagtttagctgtaaaatttagagatgtacgatttcttctagctagctaccaaagaaaagaaaacgtgcgattttctggtctctttcttttttccttttccttctgcgttggttccaagcaatctgtaaatgaaaccggtattagtctactcagacgccatgttgacaagccattggttcgaccaaaaaaaaaaaaaaaaaaaaaaaaaaaaaaaaaaaaa

SEQ ID NO: 92424 - DNA, 508 bp, Triticum aestivum
  unsure (1)..(508): unsure at all n locations
  Clone ID: PAT_TA_92424
gtggcccggtctctttcgggatgtagttaatccagcagaaatttatccttggatttgtaccaatttcgctcctcgactaaactttcccgatataatcacttataagattacggaagatgcatctggagccattgcaggttggacagctttacagattccatggaaatatttgcatccgtcggtaatgacagatgagctaaaggctcaagtcacaaagaaagaattgcctccgcctttaccgggcatggatgtggaatcgctcgccgatgcgtatagaacgatggggggatcaaaactatatggctacgatccagaaaatgattaccaccgtagagggactatgatccgtcctgacatgcagagaaaaggatttggctccttcctcactcagtactgtaatcaaattgtcgatcacacgggtgataggttgtggacgcgatctcgtccatcatcgcagaaaatgttccggcagaatgagttcgtcgaagttggccgcttggatagtcan

SEQ ID NO: 92425 - DNA, 506 bp, Triticum aestivum
  unsure (1)..(506): unsure at all n locations
  Clone ID: PAT_TA_92425
ccgtgtgctcaactcatggattccgaagctacccctcgtatccttaccgtaggcgtcctcgccttacagggggccttcagcgaacactttacactgctgcgacaagccgcgcgcaatctgaccacaccatgctcctggacctttcgtgaagtccgtaccgagcccgacctggcggcctgcgatgccctcatcttgccgggtggagagagtacgaccatggcgctggtcgcacagcgctctggcctgcttgagccgctgcgccatttcgtcaagattgctcagaagcctacctggggaacctgtgccggcttgattctcctcgccgacgccgtcgtgangggtcaggggaaggaggtcaagatctcattgggggcctgcatgtccaagccgcgcggaaccactttgggcgccagacggagagtttcgaagcagatctgcatcttccctttctcgccgctaacagcccgcccgacgcctcgacggaagcancgcctgccacaactgct

SEQ ID NO: 92426 - DNA, 523 bp, Triticum aestivum
  unsure (1)..(523): unsure at all n locations
  Clone ID: PAT_TA_92426
ctcgtgccgaattcggcacgagccaacccagattgggcgggcgattactaccccgattcccaacctagcggcggcggcggcgcttccaagtgcggcggccgccgtctccctcggtccacctcccatccggccagccctctcctcactccctccccccggcctccggccttcgccgccctccctgccgccaaggccaggggcaagtccgcctctgccctccggtctccctggctcggctcgccctgtagggctgtaggcgcccaccacggcacgtctcgacctccggcagtccagcctccatggctccgtcaaaggagcaaattcctggctccgccactgccttgactgcagaacctaacgaaaggggtgcctccccaggaggatctcgtggatgctggtgggatgggcggttgaggttgagggaggctcgtcggctggagcagcaggacgagaagctcgaggtggttccggccttccgggggcgttgcaaggagtgaaggtagangtcgcgtcaaccgggagg

SEQ ID NO: 92427 - DNA, 522 bp, Triticum aestivum
  Clone ID: PAT_TA_92427
ctcgtgccgaattcggcacgagcatcaggcctacatcctcgtggtcaaggctattgacaagacaaatacaatgcacccaaccacggctgtgaaaatgttcaagactacaaatagaatgaggagcataccaaaagaggaacagtctgctcacactatttcccaacgactccgtaatttaaaaaagataccgcctgaattaatacctcttggaatggttgttggtgttgctgttgggtttgcaggttactctttgttgaagaaattctgggtggataagacaatgcgactgagccgtcaaaaccgtaaagattgaccctgagatacaaaccagtactcaagcatttttatggcctgtaaaccatgagcatagatgctcaaggtataaaagtgcgtgttgaatgacaatgggtgaatttgacagctactaatgcctaaacctttgaaacacgattcaggatcgtccttgtaaatgaagttagcaagtaacagtaaactaaaagtaattgataatttaaaaaaaaa

SEQ ID NO: 92428 - DNA, 350 bp, Triticum aestivum
  unsure (1)..(350): unsure at all n locations
  Clone ID: PAT_TA_92428
ggatagtgaaatataagctgtttgttatacacaaatcccatttttccaaccctctaaccattacagaacctaatgttacaagcctcgactaataattgtctttggcccgtgacacttgcctttaacaaaggacatactatattactataaagacaaaatctgggccaatttaacatgtacatgagtctacttgaaagctttacccgaacagtaanacctgtaattgatcgtanattgatagaacacccgcaccagcgacaccacggngganattggntccagcacctttgnataacgacntgacgccctctttggcaatnntttggcntccggcgtcaanggatgattta

SEQ ID NO: 92429 - DNA, 552 bp, Triticum aestivum
  unsure (1)..(552): unsure at all n locations
  Clone ID: PAT_TA_92429
gaagaacatccactaactgttagatgcttagctctatcagagaaatggttactgtttgagtcacctctgcatcttctaatggagtggtagccgcaaggctcatagtcttaggacgcgctcctctcgtcctatggcgggcacattagtggtagaaggtgtgggcatcagcctgtaccatactagctagcaacccaatctcgactcaattaggctcaggtcacgtatctgaggtgatggagggaggaataggagtgcaatctgttgctangatccgactaaacccgaatgtttggacgaacccgagcaacatccgacgtcctgtcagtctgactggcaagcaaaggttggagtcctgtggatgactgggccgattggctagacaagacctaaagacacttgggggaaaagcactactgataacccgtcctcggggcgtggattcaagtggctgggcccctnctccttgcggggtcaatggtggcaanaccaaggattggtcnnaaaggcctgaaaccttgcttgtnccgggcccgccccnnttggnaaatcaan

SEQ ID NO: 92430 - DNA, 471 bp, Triticum aestivum
  Clone ID: PAT_TA_92430
ggaaaccccttactattctggctcagacctcaacaaccttgcggttgcagcggctctggcgtgcgttcgtgaagagagtttgatagtggacaaacccgcacactcatcaccgcggattcttgagaagcggcactttgaccaggcgttgggagaaattagtgcaagcatagatgaagatatgcattcactagttgctatcaagaaattcgatgaaaaatatggcgatcgcaagggccgccggaagaaaggtcccggactcggttttggttcatcactattagtcgagagagattctaatgcagcgcgagtgcgaccaccactaagtcccaaataagcacctatgtttttatctcaagtccttggtaacactatggagaataatttcattgtaactgtatataattgggttaaattcgaggctggggttctgggaaggcttaacgaaatttaataattttaatatgccaaaaa

SEQ ID NO: 92431 - DNA, 557 bp, Triticum aestivum
  unsure (1)..(557): unsure at all n locations
  Clone ID: PAT_TA_92431
gacgattgaagatatggcttgcccgataaaacaccctactttgctcattcctggacctatcgaatatgatgaagctgtcctccagtctatgagccactacagtgaaagtcatatctcaagctctttcattgaaactttcagcgagacactttcaatgttacgaaaactattccaaactgaagatccttcttctcagccttttgtgatatctggctcaggtacacttggctgggatctagtagctgccaatcttacgaaacctgggagatgatgtgttagtgctacattctggctactttgccgattcctttgcaaactggttttggagatatatgggattccgggcaacgcanctgaagggcccaattgggtcaatgtcctggattggnaagaagtccgaagaaaggcctaaagaagaaaaggattnacaaaatggttggactggttaacccaaggtccgaataacgtcaaactgggtggccctaaagggncaattaaatccccttcccgagnttactncgccgaacctcnnccngaaacccctaatngtggagaag

SEQ ID NO: 92432 - DNA, 550 bp, Triticum aestivum
  unsure (1)..(550): unsure at all n locations
  Clone ID: PAT_TA_92432
ttttttttttttttttttttggtgatgttactggcctttctttatctatgattctacagaacatccaactcctctttgcccacaggccaaggataaagaaaaaatattatgcgggttactacagagcctgcctctgcattggttcaaactaactcgtgcgttaagtctcccggtgcttccccggatcagtaatacgcatgatacagtgataacaagtagcttactaactgaaccagaatattgccttaggtatgaaatgattcgtaaacaatgcaatcgatgcagtccaagccccgtaacactgcaagagatcaacctatcttactcatgtataggaagtctattgtaattccaacacaacgttagataaccaaaactttttaatatacaacactccttgtgttctattattgattcacattttgctgcccgcgctaattctcttaaaactcttaaccgcatccacaanctggatctttccaaagaagtaatacctgaagcctaaatancncanttgtcttcnagttatngnacntacaagggcctttnn

SEQ ID NO: 92433 - DNA, 276 bp, Triticum aestivum
  unsure (1)..(276): unsure at all n locations
  Clone ID: PAT_TA_92433
ctcgagtttttttttttttttttttttttttttttttttatttttnatttcaccatgaatatgtattccacacatttccaataccttataccaagcaggtcntaacaaagtggagagtactgntattaatactgctcatgtnnaagtgcacagtgcatccaaacaacaagagagaagaccttgncttcctaaaanaatggnacaatcctggccttgcataaagcaaaacagagtatggttgaaatctgaatcaantaaagtgatacaacatactat

SEQ ID NO: 92434 - DNA, 317 bp, Triticum aestivum
  Clone ID: PAT_TA_92434
tttttttttttttttgtttgttgtttgtttattcatttaggtcctaggtctaacccgttatccccgaagagtcaaggaccggttttcacagccaagatcctatctctgataggcccaacttgatcccaccgcatgaaccactaaacaataagtagctagttaaaaattcgtgaccgtacatgaattgaacctttgaaaccaaactcctacccacaaaactatacagccctgcagatttcccaatttccggtcagaaaacaaatcttctcgccttgtattccttcctgtcatatcatctgtatgacctcgtgccgaat

SEQ ID NO: 92435 - DNA, 382 bp, Triticum aestivum
  unsure (1)..(382): unsure at all n locations
  Clone ID: PAT_TA_92435
aaacacccttccgtcggcggttgcgcggcccagcgatccaccaacccgcgccgccgctccaatccgcgcgcgccggcggggcgccatggccggctggatctcctccaagctcaaggccgcggaaaccctcctccaccaaatcgaccagcaggcggcggagtcgctcggcaagtcctcctccgcctccgacctcaccgccctccagcagccctcctccgccgcgctcctcgacgcccccgcgccgcgcaggccgccgccggcgaccccgccnncctccctcggnctccgcatcgccgccaggcgccactcccagcctcttctccgtcccctccgcgccnngncgctccgcctccgnggnggcggatttctcggtcgcangatc

SEQ ID NO: 92436 - DNA, 552 bp, Triticum aestivum
  unsure (1)..(552): unsure at all n locations
  Clone ID: PAT_TA_92436
ctcgtgccgaattcggcacgagctcgtgccgaattcggcacgagcgcattgctaccgcagcatctgtcagcatccgccacctccatttttatattactctgccagtgtggattatagtcacaattagtcgatatctcggtctaacttgatcaataatcatcaaccgcagagtccttcacgccagttgtgcctagcgacatctcacaccaagcgagaagacgaatattcgaaacggattcggcaaaaatacgcctagacgatccctcacgtcgcaaagatgatgtctggtgaagcctggctgtacttgttgtcggtgntgataaatgccgtcaatctgtttttacaagttttttttacgatcatgtacagtgatctgggaatgtgactacatcaatcctaatcganctttgnaaccgtctcaagtacatacatcattccagaagctgcagtccanggattnctgaccgccttgtttcttattaatgggtancgggatngnactcattcctcaacctancctttantggtggncaacaatcaattaaactcctg

SEQ ID NO: 92437 - DNA, 548 bp, Triticum aestivum
  unsure (1)..(548): unsure at all n locations
  Clone ID: PAT_TA_92437
ctcgtgccgaattcggcacgaggcactattgtcttcatccaaatcaagacgcccgatcagttnacttctcgagccgagcatggagcggacggcctcagtcggcagcgcggatcatgctacaggcactagcttccggtgcaaagaggacgatcgggtaaatgaccgcacagggcttatgcacctttttccggcgatccgatgctcaagctcttcgccgagcatcgtctacatccgcatccgaaacccgcattagagcaccacaacgagacccaagtttatgttccatgttaaccaagatcctcatatgcgcgtggcgtaaattttcaacgacatacgaagacaaccaagtacgaacgagaaactcgcctcgtgattgactcaggctacagcgaagtacggtcgtaaaaattagtttgtcgctggtagtgggcttaatggtatttgcgggcatggaatttgaccaaggagagcgggccacccacggnccacttgcagccatcccttcacgccgggagactacctgaagttagtcctctcgatactagncc

SEQ ID NO: 92438 - DNA, 535 bp, Triticum aestivum
  unsure (1)..(535): unsure at all n locations
  Clone ID: PAT_TA_92438
cttgagggtaaaaattccgccggctctactttaaatggagccgatggaacgatcaattggagtgtaatagatcgatggccggttcatacaggactcatcgaagctatagctcaaaatattaagaaaaaacttttggaatattctgaggatcaacgcgataaggtcatacttctcttctcggctcacagcttacccatgtcagtcgtaaacagaggcgatccatacccagctgaggttgcagctactgttaatgctgttatgcaaaggctagagcattcgaacccatatcgattagtgtggcaatcccaagttgggccttcagcctggcttggagcccagacaagtgacacagtcacaaattacatctctaaaggaaattataacatgatactagttccagtggcgtttacttcagatcatatcgagactctttatgagttagaccaagaagtaatcggtgaatcggggcaacaggatancgtnaagagatctgagagccttaacgggcatcctggttttaatcaagctttgggcg

SEQ ID NO: 92439 - DNA, 544 bp, Triticum aestivum
  unsure (1)..(544): unsure at all n locations
  Clone ID: PAT_TA_92439
ctggtgccgtttttttttttttttttttttttttttaacgtgaaagatattctaggcttgaaggggatttattttctacgcgacgcttgcgatagactacagagttctatgagccgcccaagccgattccagctcatgacaaatttagctacacatacaatgtcgtgcacaatgtagcgcctaagtcgctttaaccccctcatcgcccctcgcgcaataaggacctgccacgccgaggatgtttcatgggcctgtggagatgtcggattgggatctctcactgccgttcatacgcacgaagctaatcactgacggtagacttcagtgaaagtaagcaccgaacggaatgaacttgatgacttagtagagttgagatgctgcgaaattctcgttggcgcaccgcaaccactatgggctttgctagttgcacgtgatcctaaatagatgtgaatgccgtggagaagntatttcccgcaatgactgagggcgtgaggaattttctcgcatacgcgggcccagagaagcnacagaggcgtttatgtng

SEQ ID NO: 92440 - DNA, 535 bp, Triticum aestivum
  unsure (1)..(535): unsure at all n locations
  Clone ID: PAT_TA_92440
atatttcattaaacaaagtgtagcaaaagataataactggaaccgctcgtacaacatttttcgtgtaaaaaagggaatcatgatgactgtattagtctataggtgattaagaagagtagcagcatttatcagaaggcagattaacttgtgtactcccgtcgagaacacatctatcttcaccattgcaccgcgccgtggaggtggccagcgaactccctttcccctccggcgccgttcttcccgcgatcgccaccgaaggcagcctcgaaatcaaccccccttgcaccctccacgccgccgtacgccctccgtccatgcgccgcacccggcgccgcgtagaacgttgtcccggtcccggggctgaaccccatgttgacgcccatcatgagcccgacgtgcgcgtccgtggccgcccaagtcgctatcctggacgccgcggtcgccaagcccgtgcgggtacggcggcgcaagggatcgccggcggcagaganggaagaatgccgtcctcgtcgccgttgccgcgaagccgccgacc

SEQ ID NO: 92441 - DNA, 359 bp, Triticum aestivum
  Clone ID: PAT_TA_92441
gactcccgacctcaaccggagattggcgaggggcatcactgactgatgttatatttcaacctcctcatccgcatcaatttaatatgcgaaggcttgaatcaaggcaaaaacctactatctggcaataatgaatctgcaaattagactatccgtgtaaatatcatggcaagaaaacgttaatgccatcaaacttacatacaacgctaaacagtgacttgtggttgtaagttcagaagacaaggtatatgactgtgttctactctacccctcatcggccacggcgaagtttagtagttcacatgaacaaattgatatattatgtggctgaggttgagcctctcaaaaaaaaaaaaaaaaaa

SEQ ID NO: 92442 - DNA, 547 bp, Triticum aestivum
  unsure (1)..(547): unsure at all n locations
  Clone ID: PAT_TA_92442
ctcgtgccgaattcggcacgagcgctcagcacggaggccctcctcaagcaggtcgactacctgatccgctccaagtgggtgccttgcctcgagttcagcaaggttgggttcatcttccgtgagcacaacgcatctcctgggtactacgatggccggtattggacaatgtggaagctgcctatgttcgggtgcactgacgccacacaggtgatcaacgaggtggaggaggtcaagaaggagtaccctgacgcgtatgtccgcatcatcggattcgacaacatgcgtcaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttanctttcttaattgttcctaaagaatatgtgtatgtccatgtcaagtnccaacatggctccgagaaaacatgctcctaagtgaatgctaaccngtgggtangtatatgcan

SEQ ID NO: 92443 - DNA, 389 bp, Triticum aestivum
  unsure (1)..(389): unsure at all n locations
  Clone ID: PAT_TA_92443
cgagtttttttttttttttttttttttttttgcataagatttgtgcatttttgctacttgactttanaacttanntacaagagttcanaggntttcaaattacaaaatagagccacagtcttatcctcaccttanatctgaacatgtggctggtatattttcaggccttaatttctggtcggtcccccatccgcatctaccacagcctgacatcttgctggcatactctgaatgagtcncanaagattttcggaanacactgaancccatgcctcctttacaaagttgcgangacnatcttganttcgctgctttccgcaanccaaattcggctcagngacgctggatgtaatcctncatcttantccaancaagcttcaatcnngtta

SEQ ID NO: 92444 - DNA, 544 bp, Triticum aestivum
  unsure (1)..(544): unsure at all n locations
  Clone ID: PAT_TA_92444
gatggatgccaccactcccaagtactcgaaggcccgttatgaagaaattgtcaaggaagtctcttcatacctgaagaaggtcggttacaaccctgacaaggttcccttcgttcccatctctgggttcgagggcgacaacatgattgagaggtccaccaaccttgactggtacaagggccccacccttcttgaggccctggaccagatcaatgagcccaagaggccctccgacaagcccctgcgtcttccccttcaggacgtgtacaagattggtggcattggaactgtgccagtggggcgtgttgagactggagtcatcaagccaggcatggttgtcacctttggtcctactggcctgaccactgaggtgaagtctgttgagatgcaccatgagtctctcctggaggcgcttcctggtgacaacgtcggcttcaacgtcaagaacgtggccgtcaaggatctcaagcgtgggtatgtcgcttccaactccaaaggacgancctgccaangaggctgccaacttcaacgcccaagtcatcatcat

SEQ ID NO: 92445 - DNA, 459 bp, Triticum aestivum
  unsure (1)..(459): unsure at all n locations
  Clone ID: PAT_TA_92445
gccggtactggacaatgtggaagctgcctatgttcgggtgcaccgacgccacacaagtgatcaacgaggtggaggaggtcaagaaggagtaccctgacgcgtatgtccgcatcatcggattcgacaacatgcgccaggtgcagtgcgtcagcttcatcgccttcaagccaccgggctgcgaggagtccggcaaggcctaaacagctcactcacgacaggccatatataaagtgccattgcagttttgtcaactctgacattgctttgggttttccttctccatttatctttcttatttgttcctaagaatatgtgtatgtccatgttcatgtaccaacatggctcgagaaagcatgctcgtatgagaatgctatcggtggctatgtatatgaacggacgcataatattatacaatatgtcgactatatacgttttaatggtaaaaannaaaaaaaaaaa

SEQ ID NO: 92446 - DNA, 532 bp, Triticum aestivum
  unsure (1)..(532): unsure at all n locations
  Clone ID: PAT_TA_92446
caacgtcgtaaattcttcaacaccgaaaccctacaaatcgtctgtccctgaaacaatggcacaagtatcgggccttggggctttttttattataattttcctcctcgtcttgggatgcaccggctggatcatctacaccaacgtccaagcacggcgcttgggtctgccccaacctacactctcttcacaccttccattcagaaatcaatcaagcagcccgggctcaggcggcttcggtgaaaaggtagttgggtgggtccacgataaagtgcatgttttccgaaggcgtaagactcaggcaggggccgaaggctacgcggaaccgctaagtcgtagtggacgaggcggcgtaaacaaccgaggctttggacctttggatccaagatgatgcgtgggatacgcgtgtgggcacaaaagccgatctttacgggccgagtggatatcangaagaacatgagttgaacgcccatcatacgtccggatcacaacacgctatgaagaaaggcgcaagtccgatttcatcggcgcctcn

SEQ ID NO: 92447 - DNA, 159 bp, Triticum aestivum
  unsure (1)..(159): unsure at all n locations
  Clone ID: PAT_TA_92447
gccgccaagcnactccaaccccancccacagnggncanacacgcaccannggtcagggcgggtggctcatcatnagctccctcgtccacctnngtgctcctcatcctcntcctctccgtcgtcncggncatgcctcnnttcgatcccggtctaccgatg

SEQ ID NO: 92448 - DNA, 379 bp, Triticum aestivum
  unsure (1)..(379): unsure at all n locations
  Clone ID: PAT_TA_92448
gccaactacgggtcggtgaagaaggtgtacgtggtggccatggaggacgttgctttctccgaggacatgcagcgctggatggtcgacctgagccccggcacggaggccgtggagatcgccggagccgaccacatggccatgttctccaagcccagggagctctgcgatgttctgctcgggatcgccagcaagcatgactgagaatcaactaacgggcacatgatcggtcaataatccttgtcgcggtgacagacatttcgagtgttgtggttgtgtatgactgtacgtccggccttgaggtttgtgtgtcacaccgaatttgaaggataaaaaanaaanaaaaaaaaaactcnaggggggggcccggtacccaattcgc

SEQ ID NO: 92449 - DNA, 554 bp, Triticum aestivum
  unsure (1)..(554): unsure at all n locations
  Clone ID: PAT_TA_92449
ctcgtgccgaattcggcacgaggcgtgaacaacctctccacccgagcttatcgcaattcccactacacgttctttaaagactcgatctcgcttcctccacatcatcaacaagtttaggaagcgacggtcaacgaccactaccaatactaccgccgtcaccacctcttcagagaagactatgaactctcagacctccaatcttttcgactacgctctcaagtcgaacgacgcatgggcaaactacaaaggccatcaaaacccggcattctttcaaaaggctgaggccggtcaagagtccatctatcttatggttgggatgctccgactctcgcgtgccgggaaactacggtcctaggacttcaaccaggtgatgtattcgtacatcgtaacatcgccaatattatctcacctaccggatataaacaagcatggcagtaatcgaagtatgccgtcgaacacctcaaagtaaaccacatcatgctctgcggtcaacacttgctgtggcggcgcaaccggccgcgctcgacgatgttcgcgtccgtggggtcaatgan

SEQ ID NO: 92450 - DNA, 564 bp, Triticum aestivum
  unsure (1)..(564): unsure at all n locations
  Clone ID: PAT_TA_92450
ctcgtgccgaattcggcacgaggcgccgccagcgggaggcaggcgaatacggcgttgagttcctcccagagcctgactatgcggcggccgcgggaggcgcactcggagtagaagccgtactgcttgttgacggcggcgcactcgtggttgccgggganggaggaagaaggcgtccgggtacttgagcttgtaggcgaggaggaggcagatggtctcgatgctctgcgtgccccggtcgacgtagtcgccgaggaagaggtagcggttggcggcggagggcggcccgatctcgcggaagaggcggaggaggtcggggtactggccgtggatgtcgccgcagatgttgacgggggcggagagctggagcagcgtcggctgcttgaggaggagctccttggcggccgcncaaaggtgccggatntcctccggctttcancggcggggcggcggacngcgaactgaaggggcgcctccgcgtcaacaaggcgcttggttaacgtncgtcaangtccaaattcggccgccaatcattcgcngttccaaacanntttgggtnactgcntg

SEQ ID NO: 92451 - DNA, 567 bp, Triticum aestivum
  unsure (1)..(567): unsure at all n locations
  Clone ID: PAT_TA_92451
agaatctacagtagctccctcccgtcatcattcatttcttcccgcaaagcccaagattccgtaggtcattaattagatattggtccatcgacgacaccatggcatgagatgagatgagaaggcggccatggtgacaactgctggagacgctggagcgtgtgaagggccgaccgtggaaggcggcatcgtcggacatgttgcggtcgacatcgacaggtcggcggtgacggctgatcggcaggggcaggttggaaccgggagcggctgcagaatttgccagcttgaggacggcgacctgccggcggagagcgggaagcgggcaanttggtaaaacctcggcttgcggcttgccgangcgaaatngccggcggcgcaaccggcnggtgccgccgagggcaatgggttctcccgttaagggggcaacaaggcgggtgccaagatntgcggcgaanaacgccggcgnaacatcaactgggatgggggccggcggcgggnaagggagttcatgcngcaattggcaatgggaatggccaaccttggnntggagggaggtcaaccaaaggcaag

SEQ ID NO: 92452 - DNA, 550 bp, Triticum aestivum
  unsure (1)..(550): unsure at all n locations
  Clone ID: PAT_TA_92452
ctcgtgccgaattcggcacgaggtttgttcaagcccttgcatctcctctatacctgaatcatctagcatcgcaaaagtactttgagaacccagcttttatcgcatatttacagtatcttcagtactggtcccgaccaccttattcccaatttttaacgtatccgggtcccactctcaagaatctggaactattgcaacaggagcgctttcgtacagatattctaagccccgaaatcgtaaaaatgatggtcgaagaaggcattaaaatatgtgctgagggccctagtgcgagctgtgagactacaaaggggacacaagagaatccgaaaattccttgagaccttatcagtatgtcatattttgttcactcatagaaaagacgcatatttaatgacatggaagcagcgtactttttaccttgaacaaaccaaagcaaggcagattcactgagttgcccccattttgaccgaaatatgtaccatatttgataaaaaaatatttgatattggnaagtcctcaatttttgtaagagactgtaaattagtccccc

SEQ ID NO: 92453 - DNA, 318 bp, Triticum aestivum
  Clone ID: PAT_TA_92453
ctcgtgccgaattcggcacgagccaacctccagaaaggtacatatatgccgaatgttttctctgttaaacaacatgacagagttgtatgcgcctgaggacttggctaccgaagattgtagtttaggatagactaggagtttgttatagtttatattcttgttatcttgaatatctatctctagtctatcccttgttctccaagattgtaatcccaacgacttgtacgctatcagggaggtcgcgaccctgtctataaacacgaagccgtcggccctggcaaaggcacgacgttcccagccaaaaaaaaaaaaaaaaaa

SEQ ID NO: 92454 - DNA, 251 bp, Triticum aestivum
  unsure (1)..(251): unsure at all n locations
  Clone ID: PAT_TA_92454
ctcgtgccgaattcggcacgagggcgatcgancgagcgagcggacggtcgccgccgcnatgcagcgccggctgccggcactcctccgncgcgcggngggcgcgnggcccgcgcgccggtggctctccgcctcctcctctctcctcttcgatgacacccaggagcagttcanggatagcgtgtaccggttcgcgcangagcacatcgcgccgcacgccgncgccatcgangcctccaancacttccccaacg

SEQ ID NO: 92455 - DNA, 559 bp, Triticum aestivum
  unsure (1)..(559): unsure at all n locations
  Clone ID: PAT_TA_92455
ctcgtgccgaattcggcacgagcggcacgagcagcacttcaaatcaatagtatctcaaaaattacctgctgtcccaaataaactctgcaatccgattaggagctctcataattaaattatctccaaaatggcgcctggaggacctcctggctccggccgtggccgtggtggaaaattcaagaaattcacccgtggtggtggtaaaaacttttccaaaaatcttcgtccactagacgcagaagggaacgaaatggctaaacctgacgccgataacaattccgagaaagaagaagactcctcagatgaagattctcttgaagaagaggagtctaatcaagtcaaacttaaatcgtgaagaacgccgtgctgcagccaaagctaagaaagaggctgcaatcttcaagaaaaaagccaanggttgtttgagactggtgatttaccgactaatttccgaaagacgaaagtcaagattaaagctatgcaatctaatccaaaaccacacaaaaggatccgcgggatcaaaacaatggccttccgcanatttnggaanagatgantn

SEQ ID NO: 92456 - DNA, 542 bp, Triticum aestivum
  unsure (1)..(542): unsure at all n locations
  Clone ID: PAT_TA_92456
accacactcatctgatcacccactagctagccagctagcagcttaaggaactagcttgcagctagcgatccatggctcgtctcaacagcaaggctgtggcggccgccgtggtcctggcggcggtggtgctgatgatggccggcagggaggcctcggcggcgctgtcgtgcgggcaggtggactccaagctcgcgccgtgcgtggcgtacgtgacggggagggcgtcctcgatcagcaaggagtgctgctccggcgtgcaggggctgaacggcctggcccgcagcagcccggaccgcaagatagcgtgcaggtgcctcaagagcctcgccaccagcatcaagtccatcaacatgggcaaggtctccggcgtgcccggcaaagtgcggcgtcagcgtgcccttccccatcaagcaatgtccancaactgcaacaaatgtcaactaagtttcaatatataatccttcctacgttgcatgcattggacgccctttgcgtggagcttaantttcnacttgatggagttgctcaatacgatgttgagc

SEQ ID NO: 92457 - DNA, 253 bp, Triticum aestivum
  Clone ID: PAT_TA_92457
ctcgtgccgaattcggcacgagtctgcttccagctcatgatgcttcatctgtcgtgctctctttccacgtccgaatgtttccatattttttgctgcttctatggcagcgtctgcttcacgttgctctaaaatcttatcccatgctgaaaagttgggagtagctgactggtcatcttcattctgatactctgcaagagatcctttgtcgttagcccagacacgagcaaaagcaaattgtgattcggcgggttta

SEQ ID NO: 92458 - DNA, 530 bp, Triticum aestivum
  unsure (1)..(530): unsure at all n locations
  Clone ID: PAT_TA_92458
ctcgtgccgaattcggcacgagctggcacagaaatgaacttcacaaccgatgagaaatatgccagtatttgcgatgataaaaatatgtacgttgactacaagaacataaccaaagttattgagcccggccgtattatttatgtcgatgatggagttcttgcgtttgacgttttaaagatcgttgatgaacaaactattcatgtccgatgccgtaataacggcaagatatcctctaaaaaaggtgttaacctacctaacactgatgtcgacctccccgctttatctgagaaagatcaggccgaccttcgatttggtgtgaagaataatgtcgatatgatctttgcttctttcattcgacgtggcgaggatattaagcatattcgcgaaattctcggcgaagaaggaaaacatattcaaattattgccaaaattgagaacagacagggtcttaacaattttgctgaaatcctcaaggagactgaccgggttatgggtgccaaaggtgacntgggtatcgagataacanctgc

SEQ ID NO: 92459 - DNA, 540 bp, Triticum aestivum
  unsure (1)..(540): unsure at all n locations
  Clone ID: PAT_TA_92459
aaagacaggccagagctacgggacaactgtaaaggtgagaaagttctttcaaatttgcgggcgttacaggattttctcccaaaatcgggttgcggtaaaaaagatattctcgtccctcacgaaattttgaattagccacaagataaaagtctagatgaaaattatgtggcctctttccgataatcccgtcgagatcgtaagaacaactcaatcctagagcattacactggtaatcaatttccatggatgctcgaacacataactacatatcgcattgcaaggtgccttatgctattgtgtcaagacaactaaacgtctctggatcaagtttgtaagagggaccaaaattatccaagctttatcattcagatggtgagactctaagctgtccccattctaaatttgttgccagtcaaacctttgaatcccttctacgcagctcaaagtatcaacatctacgtcacccggatttttgggattgaataataataaaaataacaactagacataaatttttgncaaaatcatatgtagtggatt

SEQ ID NO: 92460 - DNA, 445 bp, Triticum aestivum
  unsure (1)..(445): unsure at all n locations
  Clone ID: PAT_TA_92460
ttttttttttgcatcagattttaattgcttttgcagctatctagctatgtgtaaaggttaaagaaaagtacagaaaagatgactcaattgacaagaagagcactcatgcctcagatttcatttgcgagtaccactccgaagttatggtggcttttccttcaccccaagtcaacctcttcacctttaactttccccatagacactgattacagaatgtcttgccataacacatagggcgccaaatcaggataatgaaatcaaaatcaaaataaccaataaaaatttccttaaaggaggtcggagaaatcttgtagcgttggtgtcggaacactactaatggttaattcacaaagcttgtgtgcggttactcctcgtgccgaattcggnannaaagggggggccgggtacccaattcgccccaaaagtgagtccgtattacgcgcgc

SEQ ID NO: 92461 - DNA, 541 bp, Triticum aestivum
  unsure (1)..(541): unsure at all n locations
  Clone ID: PAT_TA_92461
ccgccgccgcctccgctcggttccttctccttcctccgagcttcagccatgggcaaggagaagactcacatcaacatcgtggtcattggccatgtcgactctggcaagtcgaccaccactggccatctgatctacaagcttggaggtattgacaagcgtgtgatcgagaggtttgagaaggaagccgctgagatgaacaagaggtctttcaagtacgcctgggtgcttgacaagctgaaggccgagcgtgagaggggtatcaccattgatattgccctgtggaagttcgagaccaccaagtactactgcaccgtcattgacgcccctggtcaccgtgacttcatcaagaacatgattactggtacctcccaggctgattgtgctgtgctcatcattgactctaccactgggtggttttganggctggtatctccaaaggatgggcaaacccgtgagcaacgcctncttgctttaatcctgggagtgaaacaaattgatctgctggtggaanaagattggncggcaacnatcccaaattttg

SEQ ID NO: 92462 - DNA, 543 bp, Triticum aestivum
  unsure (1)..(543): unsure at all n locations
  Clone ID: PAT_TA_92462
ctcgtgccgaattcggcacgagctcgtgccgaattcggcacgagctcaattactcggcagtccctccaatctagaccgtgtagccctgagctgaacgggataagcttgctgcaaaatgaaatttctttctattgctaccatggccttattcgtggttatgtcggcttcaatccacataactgatgaaggtcaaatcttcagtaatggagccagacgtcctgttttaaactctaacttcagtatgtcatgtctacaaaatacaatttacaccgaaacagaaatagtagattttgccgcaaaagcgtatcaagaactcgaacgtagtgtctctagcctgggaaaaatgcaaatttgacccgtttcccaacgaattgctttacgcttatcataatgggaggtagtcaggtgccatattttggtgaataccatcattatataattatcaaacttggtaggggaaattttttggctggcttttcccaantaacaatattagacattggaacgggnnacaaaattggtgcaacgtttggttgaaggggg

SEQ ID NO: 92463 - DNA, 531 bp, Triticum aestivum
  unsure (1)..(531): unsure at all n locations
  Clone ID: PAT_TA_92463
tccgcacgtatgcggccgtcttctccgccgccgctgacgactcttacaagaagacggtcaacaggaacacggtggcctcgttcctcggcgccctgagaggtctggccgccgtgagccacatcctgctccagggcgccctcgagtccctctgccacgggcacccgagggtcgccgtgtccgagtacgctttcaactccgacgtggagaacatgtaccgcgagttcgtgcaggggatgcgcgatgtggaggatgagatacggagcgctagcgctgtgaagacgtgcaggctggtggtgccggtgatccttgccagcacggagctcacggggtccttcgtgggacttatgctggatcggcgtaggagggcgctggagaaggcgcgtagcgaaatcggcggtagtatgacttttgtgagtcgtttcgctctaatgtactaagtaagctgtaggctgtagcccgttccaagaggaaaaaaaagtggtggtttttaantaaacaccntgtccaaataaggntccctaagaaattaan

SEQ ID NO: 92464 - DNA, 557 bp, Triticum aestivum
  unsure (1)..(557): unsure at all n locations
  Clone ID: PAT_TA_92464
ctcgtgccgaattcggcacgaggttggcctacatgctctagctcaaccccaatatcatcaagcgctcgaagagtccagacgcggccaatggcccagcatatagaatgacaaaattagaaacatcctcaagaatcgaagaacagcttcccctgcatttccaccttctcgaagcatatatccaccgtcatccatacgcttaattgtgcacggtttcacaagtgtgtctaaggcggtccaattttcncaattcgtnggnataaaagnctnaatttgaacgcgcaactgcggttgtagctgacatacggtatgaatctgccagctatttgctccctgtgactcagagtgttgataggataactatattccctgctctgcctgttgtatttcatcactctaaggccggtcaacnnaagcttccttgtgaatgctggaaattcatnacaagccgtcaaatgnaccgcnggtttctattaaaatcngctgaaaaatcaannacccaatgcanggttgatttancgatnttaagaagctnncacncctgggaanctggcaatttt

SEQ ID NO: 92465 - DNA, 497 bp, Triticum aestivum
  unsure (1)..(497): unsure at all n locations
  Clone ID: PAT_TA_92465
ctcgtgccgaattcggcacgagctcgtgccgaattcggcacgaggttttagccactggcggcgcaaagatagacgcgaagggtgccgcctatctagcggggaccactaggttcttcttaactgcttcctcaagagccaatatcctttcttcaaaaggaaatttcagtgtctgtatctccttccactccctgctgtgtattttgaatgcactaacggcctacgcgatgtcttctgtagtgatagtaatgatgccatcgtcgtcttcatctgagtaatgaattctaagcttcctcattagcttccttgacatgcccgcgtttatctcgatagcagctgattgaactccattaccttgctcctacgtccgacaaattgccgaatggttgatttctgaacgcgggtgaggtaaatgtagggtataaatgcgaataacgaagtcacattggtggtcaaggcaacatggagtgctgcgcggcttttattangaaaaacaatca

SEQ ID NO: 92466 - DNA, 544 bp, Triticum aestivum
  unsure (1)..(544): unsure at all n locations
  Clone ID: PAT_TA_92466
ctcgccggaaaatctcctccgacagatcgaagcgaaggccatctcgtcctcctcctcaagatgcagatctttgtgaagaccctcactggcaagaccatcacccttgaggttgagtcctcggacactatcgacaacgtcaaggctaagatccaggacaaggagggcatccctccagaccagcagcgtctcatcttcgctggcaagcagctcgaggatggccgcaccctggctgactacaacattcagaaggagtccaccctccaccttgtgctaaggcttcggggtggcatgcaaatcttcgtgaagaccctcaccggcaagaccatcacccttgaggtcgaagtcatctgacaccattgacaacgtcaagggcgaagattcaaggacaaggagggcatccccccgggaccaacaagcgccctcaacttcgctgggcaaagcagctttgagggatggccggaacgctccgccgactacaacatccaagaaaggagtccaaccctccaactgggtgcttangctccgttggtggnaatgcaaatcc

SEQ ID NO: 92467 - DNA, 341 bp, Triticum aestivum
  Clone ID: PAT_TA_92467
tggcaggtggctggacatgtgccggcagaaactttgaaggtgacgaggtgagggcgcaagctgagcattgggctagggagggcatcgataaagtctccgattttgtaaacgatgaagggggacaattatactatttcgaagttggccgagaaactcaacttactgaatcatgcacagggtgccgcgcttacacgaataagtccggaaagatatacaatcttaggtttttggattacgacgacggtcaatggaaattgtgcaccccttattaagaagaccgtgaaagcagtaaccgttagacttttgaaatatataatactgtggaagcaaaaaaaaaaaaa

SEQ ID NO: 92468 - DNA, 529 bp, Triticum aestivum
  unsure (1)..(529): unsure at all n locations
  Clone ID: PAT_TA_92468
ctcgtgccgaattcggcacgagaaattatctaacccatcaaaactactgcaggtgataacgtcgcttttgtaaagtttgtttttacagtcgtcacaatatatccgtcttgttgatcaggaaatatgccttcgtacaacctggaggactcgcctttaggcttatttcgcaacaacgccttatcaagggtgcttgtggacacatacaattcatttgcagagagaagaacacaattaggcctctcaaacccaggatgcgtcgagaatatttctcgagaagtacaagcgtgatgtgttgcttaataattacacattttctgggcctgagaacgggattctcaacaaaaagnccttcagcatatcaacaattattccaaggtcctccgcaattcaattttcaatcaagtttaaaaagangcctaacaaccaatntncacctngccgcggcttttccggnaacgaacaaagtaatcctaanaggggaaatgntnatncgacnggaatccntcaaccaaggtcaattacggggggg

SEQ ID NO: 92469 - DNA, 210 bp, Triticum aestivum
  Clone ID: PAT_TA_92469
gtttttttttttttttttttttttttttttttatgaactttaaacaagtcaagctttcgaattatggtatttcttcatacacatcttttttactccttggaggaagcaaaaaatctttggggacatgttccgagatctgcttcttctcggcccagcttcgaatggcctcaaaatttttacattcatgctcagtgttaaaaaaaaaaaaaa

SEQ ID NO: 92470 - DNA, 520 bp, Triticum aestivum
  unsure (1)..(520): unsure at all n locations
  Clone ID: PAT_TA_92470
tcctcctccacctagggttttgctgcctccctcccccaccgccgccgtcgccgcccgcgtccaccatggcgctgccgaaccagaacaccgtcgattaccccagcttcaagctcgtcatcgtcggcgatggcgggactggcaaaaccacatttgtgaagaggcatctcactggagagtttgagaagaaatacgaacccaccattggtgttgaagttcacccgttggntttcaccactaactgtggaaagatccgtttctactgctgggacactgctgggcaagagaagtttggtggccttagggatggatactatatccatggncagtgtgcgattatcatgtttgatgtcacttcaaggctgacctacaagaatgttcctacgtggcacagggacttgtgcaaggtttgtgagaacatccccattgtgctgtgtggcaacaagggtgatgtgaagaacaagcaagtttaaggcaancaagtgacantccacaaggangaagaanctccagttctntnaan

SEQ ID NO: 92471 - DNA, 398 bp, Triticum aestivum
  Clone ID: PAT_TA_92471
tcgtgcgaattcggcacgaggatatttttgtttctagtcaacgacattagtaaagtaaagtatgttaaccaaaaataaatctcttctctaggaatacagccaagttccatctggatcagatatttataaccaatgtaggccgattttataaatcaacataaatgccagttagcagcaagataaaaaatgagccgaaattttctgggattccagccctgatgatttccctaaattcaagagacgcgataaacctgtatcaagattttgagttttaaggtcggattttatgatggcgtaggttttctgataaataataactatgtcatattaggtgtgacctgggttaatagtaaattcttttgctagttcattttaaatacatatattagtaaaaaaaa

SEQ ID NO: 92472 - DNA, 514 bp, Triticum aestivum
  unsure (1)..(514): unsure at all n locations
  Clone ID: PAT_TA_92472
ctcacaggccagattgttacatatctgcgttcgatgtcacgtctaccaacctctcagtctattagtttgagctttcatagaatgcgataaagatgcggccacgtaaaagacgtcaggacagctcgcaaccagccattacctcctactttacagcagattgcacatctccaacggaagcagaatccacccctaacaccatcagccaaccaattattccggcatctattcaatcatctcttctcaatgttggtatgcggatccgtaaagcagttccagaaggttataaaactaagcacaacaaccagtctcccaagtccattgtagaacaaattgcaccatatgaaagaggagcgaaaaacgcaacggaatctaaatttgtatatgataattggcaatcgagcatgcatcacaaacctccgaccccagttagttaagagagactcantccaattccggcggccggcttaagtgggnaactggnaacaacaagccttcaacaatcgtanggaactcc

SEQ ID NO: 92473 - DNA, 545 bp, Triticum aestivum
  unsure (1)..(545): unsure at all n locations
  Clone ID: PAT_TA_92473
ctcgtgccgaattcggcacgagggaaccaacaaatccccaaccaatctcgtctccgatcgactccaggctcgtcgaatccccaccgcctcaagatgcagatctttgtgaaaacactgacaggcaagaccatcacccttgaggttgagtcgtctgacaccatcgacaatgtcaaggccaagatccaggacaaggagggcattcctccggaccagcagcgtctcatcttcgctggcaagcagctggaggatggccgtaccctcgctgactacaacatccagaaggagtccaccctccaccttgtcctgcgtctgcgtggtggcatgcagatattcgtgaagaccctcactggcaagaccatcaccctggaggtcnagagctccgacaccattgacaacgtcaaggncaagattcaggacaaggagggcattcccccggaccancancgccttatccttgctgggnaaagcancttgagggattggtcgcaacctnggccgactacaacaatccaaaanggngtccaacctccaacttggtgnttggg

SEQ ID NO: 92474 - DNA, 525 bp, Triticum aestivum
  unsure (1)..(525): unsure at all n locations
  Clone ID: PAT_TA_92474
ctcgtgccgaattcggcacctcgtgccgaattcggcacgagctcgtgccgaattcggcacgagatcttcatgtcctcgtcttgagatctaatcagttctacggttccattggtgatcttgttcgggatcagcaatccaaggagtacttctctagcttgcagattattgatctagcctcaaacaatttctccggcaatttgagttccgaatggtttgggcggttaaaatcattgatggccaacttaaacagttccggagaaactattgttggtcaaaacatatcagcagctcctaggggattctatcaagattctattgagataacatacaaggggtcagttgtgacatttgaaaggatcttgactacctttacagcaattgacttctcaaacaataggctggaaggtactattcctgaatcagttggacaacttanttcactacatgtgctgaacatgtctcacaatgctttcaaggggaaaattccagcgcagcttgggcacctgactgatctggagtcnctgg

SEQ ID NO: 92475 - DNA, 531 bp, Triticum aestivum
  unsure (1)..(531): unsure at all n locations
  Clone ID: PAT_TA_92475
ctcgtgccgaattcggcaccagtaacacccaaagtagtgtaaaaagtaaagcctaaatctactgctcgccattcaagttagagtatcaatctacacccttgcgccgattacgtctccccgaaaatacgattctcgcgccttgcaactgcttccctccatccacgcacatgcagtagagagtcaaaatcagtcctccatatcaggctacattacaagaaagcctcttgcatctttgatccaccagcgcgacaccccaaaatgaactctatcagtcttgcctcggtcattgcgttttttggcatattagccttacagcctgctctcgtcaattccgatgggaaaaacgcccttttcctctgtaatggatgctgaattttcacttgcgcaagctaaaacacaagtttcatacgcctacaccatcaaacantcaacncgatgggaaaggaaaaaacaggctaaccagatgatctatccnttannattcaancatccgggactttccaatagttatagatttcctatccgccantg

SEQ ID NO: 92476 - DNA, 364 bp, Triticum aestivum
  Clone ID: PAT_TA_92476
gagagaacaatgtcgcttcgagtagccgagggcttaagagatttcaacactgccggacagctttgataaatttctattcattttggggttgggtggtattggtgcaggcatggtgaaatgaggtgcgagggttgtttcgaaatgtgcagagaatcatcatccagtaattttcactaaaagtctggtgcttacgattaatccaaggaatgtataatttcttctttaatcgcggcgcatattctgggccgatggtatgtgggaattagagatatggctctgatgtaatctttcgatgatttaagcacgtctagatttaaatgatctaaatttattatcgtgaataaaaaaaaaaaaaaaaaaaaaa

SEQ ID NO: 92477 - DNA, 523 bp, Triticum aestivum
  unsure (1)..(523): unsure at all n locations
  Clone ID: PAT_TA_92477
catacccgcccctgcggcaatccatccccatcctattcgctctaccgtaccacccaccacatcgccagcctcccggaatccgctcacctgccgccgccgccaccaccgcggccagaggccacgcgccccacgcggccgctcgaacccgaggctgcttgttgagcaattccatggtcctgggttcacactgaacattgcaccacctcgcctctcatcggcgccgccgtaccgcctacacagcctccgagtcaaggcgttggcgatgctcttcttccatgatgaggtgattttggcgtgagtgcggcatctctccttctgctccttccaaactctcaaattgattgtctgcagctcagtcaatcttctggtttcatctgggagggggatgacgatgacgaggacctggcgcttgtttgtggtgagcaaccatataccaggagcgaatagaagatgctgccattgccaataccttagaaggatgatgaaccttctaacaaatgatagatgattgtnacctccaacn

SEQ ID NO: 92478 - DNA, 554 bp, Triticum aestivum
  unsure (1)..(554): unsure at all n locations
  Clone ID: PAT_TA_92478
ctgaaactctcatttgctcacaacctagaaatcatacttcaccaagacgtgctctacaaaaccatttagcctcaacatcggtagattatttcagtctataacctcatcagccatcaaaatttaatcaacctcactggacccctcaacggactcccatctaacaccccctccttcgccgtcccaagctcaagacaatctatctccaaatattctgttgttatatgtcgacttgactcatcgacatcaaaactcctccagatcagtattaagacttgttaaaaattcggcgttaatttaaaataataatagattgcccatcacggaccctaaacaggtgaaagatagccaactcaccactcaccgccacgaatatttttcacctgcgataaatagatttttggnctccaaaaatgtcgcaaaatccgggctgctggcctttccgagttttgagaaatggggggaaggttatccgtgaaaaggnacaaggatgggcgtcactgggagaaganccggggatatgcaatacactcaaaggtaagantggttgggaaacg

SEQ ID NO: 92479 - DNA, 531 bp, Triticum aestivum
  unsure (1)..(531): unsure at all n locations
  Clone ID: PAT_TA_92479
ttcagtacaaggcagtagaagtgagctccactcttactagtgcgtgtgtgtgtgtagccttgagttcacgtcctcttctgctagtatagctagcttgcactggctgtagtctagccgtgtatcctctgtgttagactaggtagttccataccgtatgcaccttgtatagctcgccatacggtatactatggatcatgcagcagttgtatagctagtggtgcacgtcctgaggtagtggcatacccacgatcttggctcggctgatgacagcaacctgtacttaaacccagcctctgagcataatcgatgtgtgttgaatcccaatctttctcctctcctcaacatggtatcagatacccgcgaccagaacccttttgctccggtcggccgattcccgcttccgccatggacgacaaacccgtcctnctcccctcgttcctccgtccaccgtgccggccgggcgtcctcaanggccgctcctctccannaacgttnacccaaccgcngccgggcgcgcccggccgcgccttg

SEQ ID NO: 92480 - DNA, 518 bp, Triticum aestivum
  unsure (1)..(518): unsure at all n locations
  Clone ID: PAT_TA_92480
ctactcatcatctggcgcatgtgaggaacgcctgtcgccacttcttcggctctggtgttgccatgcgctatccaacaattattgaagctagccatccttttcttcacgcttgccgctttggactaagtggggacacaaaactaaaatctactccctaaagcaatgaacctaataaggttggatttctgaccatacgaaccttactcccgacccgtcacagcgaccctcaccatcatttatcatgaacagtatcaaaaatctccaagtataacacttatcaatttaacggctttagctggacgcttgcatccagttttgtgaaaggcttaaaaatgtattttctgcgttgagtattacttattactccttggtcagtggagtcgtcttgaccgccggaaaaagactaagaagatcaagagcaacatattgggtagattagctatactccaatgcaagtctcagtcgatctggagcttgtcaaactactttgagacacaatctctgcttcccnaaactng

SEQ ID NO: 92481 - DNA, 542 bp, Triticum aestivum
  unsure (1)..(542): unsure at all n locations
  Clone ID: PAT_TA_92481
tttttttatcctagaataatgttgtcctttattcttactaaataccctctaatttgtctaaaagcactagcctgcgccatctttgtgattcagtagaaatttttgttactctcatagcacttatcgcccgccaagcgcaacaagcgacgtcaatttcatgcagtaactcaaaggctctatgccatcgaacaaaatatctctcctggcttattaacaacttcaggtanaaagccttgtgggagccatttcattgccattgacgctctatccatgccatttgccactgctatacaattatctatcctttcttctactttaaagcagtgcgtgcaaaagttgggagaatgaaactagctttgtgggatgtcgggagttatagtagcggagtaanttttcttcatcttcagcactnaagggatctggangggcgttttgaggnttctctcctgcatccntgcagcaagacaatgaatcccgatctgggcaaaagggtatgtagggatggggggtgtaagnaaaattccaacgnttggggaagactt

SEQ ID NO: 92482 - DNA, 556 bp, Triticum aestivum
  unsure (1)..(556): unsure at all n locations
  Clone ID: PAT_TA_92482
ctcgtgccgattcggcacgagtaaaactttaattgtaatactatttgcacaatttgtacatgacacagttaaataaacgatgcatactatattcaactagttcacccaggtcgtacaagagcggaaggtatggaatgaatcttatttggactaatctggtcagcatatgaagccgttgtcacctggaaaataacagagcaaacgattatccgtgtatcataattcagaagtagactggtttgctccactactactcctttagaagactaggtgacttgtgaatatttaaaacttgaataatatcaaaatgattgattggaaacctttaacacccgctagccagccaaataatagttcgtgaggctatgtagcaatccttcactgaaatggtaattttatgtcnaaggccaagtcatccgttacaatcacaagtttcccctgggtaancggaatcgtggctaacanggnagtcaaaaagnccgagatatctaagagttattccaagctccggcaagaaacnggaattatttcaaaaagtcccaatngaaaagnttgg

SEQ ID NO: 92483 - DNA, 524 bp, Triticum aestivum
  Clone ID: PAT_TA_92483
gaacaacagcggggagaagcggctccagggcgggtgtcccatgacgcctcgcgaagctgctgtgttcctcaaagccatgggatatccttccagcactaaaatttacattgtggctggtgaaatttacggggcacacagcatggatgcgctgaaagcagaatacccaaacatttacacgcactacagtctagccacagtagatgaactagagccgctcgagttgtaccagaacaggctagctgctgtggactatatcgtggccctgcagagcgatgtctttgtgtatacctacgacggaaatatggccagggcagttcagggtcaccgaagattcgaaggtttcagaaaaactataaaccccgacaggctgaagtttgtagagctcattgacaaactcgacgacggttccatgccctgggatgaattccaaagtgaagtgagggaagcatcatgaaggatagacttggaggtccgtatgacagattactggtgagagtccaaaggaaggaggaatacttctaccc

SEQ ID NO: 92484 - DNA, 542 bp, Triticum aestivum
  unsure (1)..(542): unsure at all n locations
  Clone ID: PAT_TA_92484
ctcgtgccgaattcggcacgagcaaagacaagtcaacctcaccgaggagaagcagagagaagggagaagatgtcggggcgcggcaagggaggcaaggggctcggcaagggcggcgccaagcgccatcggaaggtgctccgggacaacatccagggcatcaccaagccggcgattcgacgtctggcacgtcggggcggcgtgaagcgcatctcggggctcatctacgaggagacccgcggcgtgctcaagatcttcctcgagaacgtcatccgcgacgccgtcacctacaccgagcacgcccgccgcaagactgtcactgccatggacgtcgtctacgcactcaagcgccagggacgcaccctctatggattcggaggctaggctccggcgaagcgaatccaagctcgcacctgctgatcagatattcagattancaattagctaggcgtttgttcaagtgttcaaggtgatccatgttatttatgatgttangggtgcctgttcntttggaatgggtaaatccgctgttantttacccttan

SEQ ID NO: 92485 - DNA, 331 bp, Triticum aestivum
  unsure (1)..(331): unsure at all n locations
  Clone ID: PAT_TA_92485
gtgttatgcacagaggagaaggggcagaggaatagcacttggtaagtcttcaaagtcctttttaatttggtgggtattgcgctgggagaagcaatatccacaangcaacttttgacattgggtaaggatgactgatcaatttgaaaactgaaatcctccangttttagcaaagggnaactaagtgcaattcccnaacccttttttccggnngtcnttggcaataatggtncnccctccggttccgnattacntggcctggntttgcccaaantaanaggntcccaaacccnatttaagggncaaaaacccccggtcccnaaaaaaccncaa

SEQ ID NO: 92486 - DNA, 521 bp, Triticum aestivum
  unsure (1)..(521): unsure at all n locations
  Clone ID: PAT_TA_92486
ctcgtgccgaattcggcacgaggacagatcagatcaaacctcgtccgcacgcgccacaccccttcgcgcggacaacggagaagcgaggaacgcacagccgatgaggcctctgcgcgccgtcgctctgctcctcgtcgcggcggcagcagccgcggccgccgcgacgccgtgggcggggagcggccaggagtccggctccatcagcaaagacgacttccctggggacttcagcttcggggctagcacatcagcttatcagtgggaaggcgcggcggcgggangacggncgggacccccagcgtgtgggacaccttcgctcacgctcacgcccacgcccacgccggtgatgactctgtaaatggtgatgtggnagctgacggctaccataantcaaggagggatatcaanttaatgaagganaccggctggnttcttanngatccccaaccncttggncaaggcttattcctaaaggaagaggngaatcatnccaaaaggggtnggtcctacaantaancccn

SEQ ID NO: 92487 - DNA, 556 bp, Triticum aestivum
  unsure (1)..(556): unsure at all n locations
  Clone ID: PAT_TA_92487
aaaattaccgataatctagtagaatatgtcaagcacattcatgctaactataacaacatttccttaatatttgaagctaaagtcgcggctgaaacgcacaaactatttaactttcccatctataccacggaatccttgaatcttttttccacgaaggtagatctagtcacgacgctaggcggagatggaacaattttacacgcatcctccctattcaatacaacatctcacgttccacctattctctcctttagcatgggtacacttggcttcttgggagagtggaaatttgatgagtacaagcgggcatttcgcgaagtgtatatgtcaggagctgcagcaggctcaccacttttacaaggccaaagccatgcacagatacaggctccaagatgagaagattatgaccgggtggtcgggcgtcagaggcaagtcaatggcccacgagaagctccacaatatcctacgaaaccgagttcaaatcgggcgtatttgntganggagggaaatcgccgtcacaagatttatccangcanaaggcgagaaggnggnnttt

SEQ ID NO: 92488 - DNA, 256 bp, Triticum aestivum
  Clone ID: PAT_TA_92488
atgaaatagtggaattgtgcgctctctgcacggacgtacgctgagtctgttcacttgtggtcacttgtagaaaaataaatgccagtcatggttcatgtcatggtcgtcatgggatggcccatgtggttatatcattatccgaaattccgaactagagatgatatgtgtattattcggactggagatgataccccatgcactgtaagaaaaacatatgttgccttgtatttcttcgtaaaaaaaaaaaaaaaaaaaa

SEQ ID NO: 92489 - DNA, 542 bp, Triticum aestivum
  unsure (1)..(542): unsure at all n locations
  Clone ID: PAT_TA_92489
ctcgtgccgaattcggcacgagccactcaattacttgtgtcacacgatgaagctctacactgtcttttcgtcgattgcaatcttaacaattgcatccgcacattgtgtactgccagcccctccaaatccaagttaccaagagcaaattgtcgtggaggaatctttattcgttccaggatctcgcatcttagcgttctgttcacatgaggacaagaaaaacgagatttcaatcaccaaaatagagacatatcctgatgtacctgctactggcgatactgttcatggacggattattggtaggcagcgcggggtattcggccaaggtgcctatgtcatctttcgggactccaagaccaggagaaagctcaatattgagcctgttgacttttgcaaattcctgaagactacaggaagagattggcactatcccactgggcgtatttgacctacgcnttgaattttaaagtccgacccctttcggggactggacaaccatgatgggttgacttgggaactccaattcaacgatatgataagaagnn

SEQ ID NO: 92490 - DNA, 539 bp, Triticum aestivum
  unsure (1)..(539): unsure at all n locations
  Clone ID: PAT_TA_92490
ccacctcctacccaccaaccccctgagccaccgccgcagtcgcctgtaaccccgcgagctactccgcgggccgggatagtcccatccattatcgtcgcccgctgctccccgtcgatctccgagcgccgctgccccaccctccccaccatccccgccaagcaccacctaccgccgacggcgcccacctcccagccgccgtcgcagcccactcccgagcggctaaatcgcgtcgccgcggcccgagtcccgactcccaaccattggatcccgctgccgccttcccccaaacccatcgcccgccacctcccctagtgcaccagccacctacgacccgcccgttgatgcacactgccaccaagcctcgcgctccggcgccacctgcgaggtcgacttcagcgacaatctcggtttagaatggaggtgagtgcgcgggagcacagctcggggacgcatggcangtcgcgtaggaagagagggaagtcncgctggagggtagagaaggtcgggctnggnactcccaanggaanggccgctnccng

SEQ ID NO: 92491 - DNA, 549 bp, Triticum aestivum
  unsure (1)..(549): unsure at all n locations
  Clone ID: PAT_TA_92491
gaaagtaaacgtcattcttaaaattcttaccaagaaatctccataaccttaattcttcgttgataatgtcgtcgactatcgctgagctgtgataattcactgcgggcatgcctaaattgaagcatgtccgtagtccttcagccaacgagatcttacacacatccatcgacctcaacgaagcatcagactctttaaagtaggtgcctcaaggccaacttacacaacacgaagggcctggacaaccatagacttttacatccaacctttccccacccgagggaaggtatttctctacgaacgaatatatttttatcggcagctcaagtttcacttaactaggccgagtttttgcaaaaagccattttgttctggaaagaaaccccccgaccctatccgattatctgtataactatacaagcaaatttacacttttaaataaaattatcgcttcaacacatccttaaatctacttagtgggccctacttgttcccaagcttcaaaaaataacaatatggtctaaattaaatccgaaaagggcgctacnccac

SEQ ID NO: 92492 - DNA, 331 bp, Triticum aestivum
  unsure (1)..(331): unsure at all n locations
  Clone ID: PAT_TA_92492
ctcgtgccgaattcggcacgagcaaaccctcncctcccctcccctatncggatccacacctctccctcgcggcggcggcggcggncagagcgggaagcgaaaactcgaagcagcccccgagcggcgagcatggccagcgaaggcgagcacgcggcggnngcgggcgagcanacgccgctcaagaaggcgggcgangcggagcagggcgaggagctccaggccccctccggctggaccaagaancttaatcncactcggngtgggaagtttgaggttgcttttgttgcaccanctggcgatgaggtcangancactagagttttaaccacat

SEQ ID NO: 92493 - DNA, 154 bp, Triticum aestivum
  Clone ID: PAT_TA_92493
ctcgtgccgaattcggcacgaggcaacatatgtctgcaactaaggcccgtcaacccatacttcactcttccctttgcaatacaaataatatgcctacagaggtacacataaacatcatatagctcgcttatataccaaaaaaaaaaaaaaaaaa

SEQ ID NO: 92494 - DNA, 309 bp, Triticum aestivum
  Clone ID: PAT_TA_92494
atttgtcaaagaattacattccgggtttcagttactgaatctgaagaatgactcattgagacggagatgcgacagcatcaagtataatgtgaagaagatcgaggatattgtctatgacttatcgctccggaacctgatcccgagcactgtgcccatggaaacggaaggtcaagcaaattaagcgtagttggaatcagtactagcagctagttttaatcgctcggtattgatgcacttagattgattggaattatctaaaactatacaagcaagttgctcctagaaaaaaaaaaaaaaaaaaaaaaaaaa

SEQ ID NO: 92495 - DNA, 548 bp, Triticum aestivum
  unsure (1)..(548): unsure at all n locations
  Clone ID: PAT_TA_92495
tttttttttttttttttttccaggctcagacattttttcttttccctacagttaatttatattgaacattttgtccagtccataatttggctgtaagttaacgatatcaagattaaatgccgaaccaagtcttagctctctcatagacataaaagctcgctgcggccatgggcaccaccttcacgtaaccaattgttaggccgacccaaaaacctcttattccattttccttgaaaataagactgaaggtctcattgatgcgtagacgatgcccgtctcctactgctcctccaacttgcatgcgtcttctcatgatctctagcgggtacgcgcaggtctgtgatataagaccagccagtccgcctgctaaaagttgagcccacgagtgaagggggggtggctttgtcgagagtgaatgattatatttagtttgtaccgtgtaaggtgctaaaatgggcgatctaagaatatcaccggctgtatcatgggtcaggaaaagaaattccagcatacggtagcatcccaagaaccgttaccgaaaaagccnc

SEQ ID NO: 92496 - DNA, 556 bp, Triticum aestivum
  unsure (1)..(556): unsure at all n locations
  Clone ID: PAT_TA_92496
ttctggatggagcagactttggttgggtatgagccatataccggaattcccataaccgagttcattcaagcaaataatgcgcaggtcagaaacttcatgaaagcattcaccaaatggaaatgtgccaaaagatgtgtgcctgactgtctccggatccggaaaatagcttcccttggactcaacgcctgtcgcaagtatagatacgaacacctacgagtcaaggtggaaaagcttgttccagtagcggcagttggcgttttgtatggggtcaaaattcgtagaccgactaaatggcccgaagaaggtttttcgagccggctttatcacgagttcttggaaagaggggatatggagagagattagtggtgctatacgtttcactttggctggggatgagaataatgaaagcttctctcaatgtgtcccgtcaagatttacaggcaatctaccccaagaggatcacatatttctcccaagtgcagtaagaactttctaaaagatggnaacactaaatttcgccgccgactaagtanctacttanacctcaaggncnggg

SEQ ID NO: 92497 - DNA, 553 bp, Triticum aestivum
  unsure (1)..(553): unsure at all n locations
  Clone ID: PAT_TA_92497
gcatgaacgacgtcgcacgacgccagtcgacgacttgtcgcgccaaacttaccagcagctgatattacactcacctacgccgtcatctgacgtcgctgaaacatgtcagaacgaggaaatcatcggggaagccgccgcggtggccgtggaggggcgggccgtggcagccatgaaggcggccgaggagcacatggtgggcagggcgctgaacgagcaaaaaaggagaatatcctcgacctcagcaagtacctggaccagaagattgccgtgaagttcacaggtggccgtgaagttacaggcacactgaaaggttatgatgctctcatgaatctcgtgctcgatgacgtagaagaaatgatgcacgacgaagaaaacaaaattaccacccgaccgctcggtctcatcgttgcgcgagggactcttcttgttctaataagccccatggatgggagtgaagagattccgaacccatttgtgcaacctgaagactgatctagaagagaangnggcaatanttgggggtatccaatttgtaatatcctcctgacctgcg

SEQ ID NO: 92498 - DNA, 548 bp, Triticum aestivum
  unsure (1)..(548): unsure at all n locations
  Clone ID: PAT_TA_92498
ttttttttaagggtgggtcaataaagtgaaaacttctgtctcatatagctgcaaaacctcatattttacagatcgaattgatcaacggaaaggcggctaaacctattcttgatacttgttctgaccgcataacgaaagtgcatgaaatcgaatcaatggcttcagatcgataggaatacagattgtaattaaagaaatgaagccatctttcctcgcccccggaaggcgcctgctctttagttgagtatgaaaagtgccccgcgaaggaacaaaaccaactcaagtcaaccgtcccgtcgattcgatctgaagtatgaattggccgaagcagataccaaggcttcattgaacagaggactagatgagatgaggccggcctatccacactgtaagtaacggcaagtgctaatgcctctgagcttgacctggaaaaaccccttttgtgaacttgaaaaccgacatggtcaaagcacggaaaggaaagtattggaaaagctaagctacatcaacatanggtcnaatctgctaccttcacttctgactcantc

SEQ ID NO: 92499 - DNA, 559 bp, Triticum aestivum
  unsure (1)..(559): unsure at all n locations
  Clone ID: PAT_TA_92499
ctcgtgccgaattcggcacgagctggagagtcactgaaggctgtcaccaaatctccgttcctagactcactgaaggagaagaacttcgaagtgctcttccttgttgaccctatagatgaatacgctatgacccagctaaaagagtttgatggtaagaagcttgtcgatatcactaaagacttcgacctcgaagaaactgaggatgagaagaaggtgcgtgaggccgaagagaaggagtacgaaagtttaaccaaggccctgaagaatgttctgggagataaagttgagaaagttgtcgtcagccataaactagtaggatncccatgcgctatacgtactggtcaattcgggtggtcagccaacatggaacgggatcatgaaggntcaagctctccgcgacacanccatgtcctcatacatgtcatccaaagaagacattccgagatatctcctccgcttcccaattatcaaaggagcttaaggaaaaaagnccaaggaagattggggaaaggtncaagaacaatggaagtccaattactcaacttccggttcgaganan

SEQ ID NO: 92500 - DNA, 570 bp, Triticum aestivum
  unsure (1)..(570): unsure at all n locations
  Clone ID: PAT_TA_92500
gcagctcatctccacggccgtgcancacacgctgcncgacagntacgtccggtcggtggnggaccggccncgcctcgacgaggtcntgcccgacgccgacatccccgtcgtcgacntcgccaaccccgancgcgccgacgtcgncncncagatcggagccgcctgcagatcccanggcttcttccgggtgctcaaccangggctgccgctggaggtcatgctggnagcgatggnnagtggcgcacgacttcttccgcctctcgncggaggataangccangctctactcngacganccggccataaanatgcgcctctccacnagcttcaacgtgcncaatngntaccgtgcacaactggcgccactaactcnncntgcactgcnatccgttcgagcagtttcntgccgaagtgntnaggcanttcaccgcgnttcanggtatgtcaannatnacagtacngcaaaggatgttcaggcanctccgntttccgnntcctacgctatgatatcgnnaaaagnctgggantnggagcaaggctncatcatnaangtcctcgcgnnaanaaggt

SEQ ID NO: 92501 - DNA, 530 bp, Triticum aestivum
  Clone ID: PAT_TA_92501
tagtctctcattgaccagaaaacttatatctcggatccaatacttataatatggtttttcggataagttcttcaactctctgcctaacgaggggatggcttagaccccttgccagtctaacgtcaagcaatcctagattaatctcatacagatcagtatcagctttagcagttcttgaactgaaagacgggaagttaattcaaagctcgctgagtgccgtctctgccggacagaaattgggcggttctttaactggatttatagccggtggtaatataagtgaatctatgagggaaacagccaagatcagagggatccataagataatatccatcgagaatcatgcatacgacaagggactgccggagaactttgcaccactgctagtagcaaatatcaagaaaaggaggatttactcatatactcgctggacacactacttttgggaagaagttgatgcctcgaagttgcagctctacttgatgtcgcacaagatatcaagatattacggcgattgagaacgaaaatac

SEQ ID NO: 92502 - DNA, 463 bp, Triticum aestivum
  Clone ID: PAT_TA_92502
ttcattttttttacagatggcaaagtgctcattttgccgtctgtagaaaaaaaaaaacaaagacggcaaagtattttgccgtctgtgtttttgtttgcaggaggcaaagtgagctctttgccgtctatgttttttccacatacggcaaagtctatctaccgtctgtgtttctttgccatctactgatgacggcaaatcctttctttgccgtctgcccgacgaaaagctcacagcaaaggcgcccccgacagcaaattagctgattcccgtagtggatctagacccggccaagcccaaaacgggctcgtgaagctcccgtcgccgccctgcagtaggcccgccaccgtctctgcaatcccccgcacgagccgcacctccgtccgccagagacgtcacaggctagacctggccaggcctaccctgaccctgatggggcccaaaagggcctaaatctgggccggta

SEQ ID NO: 92503 - DNA, 485 bp, Triticum aestivum
  unsure (1)..(485): unsure at all n locations
  Clone ID: PAT_TA_92503
cgctagtctcatttacgatacagtcacaattattttattgaaaggttttcaaggaaattaaattctcatcagaataaccctgatcccaaaaatccattcaaactttaacttattttgaaacccatctcacctccgaaaagtattacaatcacaggaatcgagaataccacagcggcactggaatccgtggtagcaattagaatccagtcaaaatctccacgatggtaaaagataccaaactatatgatactctgggtatttccccgacctgtactgaagccgagttaaaaaaagcatacaaaatcggagcacttaaacaccatcctgataaaaacgcctcaaatccagccgccgcagaaaaatttaaagaaatatcgcacgcatatgaagtactatctgaccctcaaaaaagacacatatacgaccaatatggcgaagagggccttgagggaggtggtggtgctgcgggagggatgaacgcanaa

SEQ ID NO: 92504 - DNA, 508 bp, Triticum aestivum
  unsure (1)..(508): unsure at all n locations
  Clone ID: PAT_TA_92504
cgctactcccctgcctcccccagagctcgttagggttttctcctttttcgggggagaaatctcaagaggcggcaccatgctcgtgtaccaggacaagctttccggcgacgagcttctgtcggattcgttcccgtacagggagctggagaacggcgtgctctgggaagtcgacggccattgggtcgttcaaggagcagttgatgtggacattggagccaatccctctgctgaagggtggtggtgatgatgagggtgtcgatgaccaagccgtgaaggtggtttgacatttgtttgacaacttccgtccttcaaggagcaacctgcttttgacaaagaagcagtttatctcctcacatgaaagcgctacatcaaagaacctctcctgccaagcctttgaaggggatgacctaagatgnttttaaagaaagaatggttgagtcctggcaacaaaagtaacctccttaacaaagctcaaaggnaccttcaattcctttggttgncaaaaaca

SEQ ID NO: 92505 - DNA, 474 bp, Triticum aestivum
  unsure (1)..(474): unsure at all n locations
  Clone ID: PAT_TA_92505
ctcgatttaatcgattttctatgcctctacatcacagctgtcttcctgccacttttgattccaatagtactgttgattaattgacatcgactcatcctacctttccatcacctttacacttgacataaaatttaacgttcttcggggcgaaacatcaaacaaaatctattgaaaaacttacgatctacacttcctgcaaagacgttgtagccatcttacacaagttaatgcaagagaacttagggaaagatttttcaaacaaaagtggcgatcttcccatgatggaagcgatcgataacgtcgcagttgacgacgaagcctacaacacaagaagctgagcagcgtatacgcatactcncaggctcaaatgaaacaagcaagcttccgttcgaagttcaagaatgaagatcatacactcggtaatgcgttgcgatacataattatgacaaaacccatggttgaagttttgcggcn

SEQ ID NO: 92506 - DNA, 466 bp, Triticum aestivum
  unsure (1)..(466): unsure at all n locations
  Clone ID: PAT_TA_92506
cacgtacacaattaagggaaaagaggaaggaagctagccatagagatggcggctgaggcgctggtgagcgtctccacaggggtgatgaactctgtcttagagaagctagccactttaatgggggaggagtacacaaagcacaagagcatgcagcgagaggtggcgtttctcaaggatgagctcagcagcatcgatgcagtcctcaagaagctcgagaacatggaagaggaactggatccacagaccagggagtggaagaaccaggtgatggaaatggcgttccacatcgaggactgcatcgacgactttatgcacgaatctggtgaggattctaacagaggaggtgttggctttgttggcaaaattgctcagtacatcaacgcgttgaggacgcgtcaccaattcgccaaccaaatccagcagctgaagacgtgggtcanagatgtgagngaacgtcggaaaaagg

SEQ ID NO: 92507 - DNA, 392 bp, Triticum aestivum
  unsure (1)..(392): unsure at all n locations
  Clone ID: PAT_TA_92507
ctcgtgccgaattcggcacgaggccgtcgctcgccggcggcagcggtagcatcaggaggggagggccacggggcaacgccggcctcgctctgacgctgccggccgggcgtcggggtcgggagtggagggcgccggtgtcgtccttctcctccttcctgccgtccttcttcacggggagcaagaagaaggaggaggaggacgccaanaaggcggcgacgctcaaggaggagctgctggcggccatcgcgccgctcgaccgcggcgccgangccangcccgaggacaangancgcgtcgaccagatcgcgcancagttggaggangtgaacccgaccaagganncgctcaaagtccgatctcctnaacggtaactgggaantcctctanaccac

SEQ ID NO: 92508 - DNA, 491 bp, Triticum aestivum
  unsure (1)..(491): unsure at all n locations
  Clone ID: PAT_TA_92508
ttccggtgcctcaaggacgccatcgccgcgcagctgcggcacacctgcgagctgctgggcgagaaggacgccggcacgagctccgggctgaccaagggggagacgccgcggctgcgcgccatcgaccagagcctccggcagcagcgcgccttccaccacatgggcatgatggagcaggaggcgtggcggccccagcgcggcctccccgagcgctccgtcagcatcctccgctcctggctcttcgagcacttcctacacccgtaccccagcgacgccgattagcacctgttggcgaggcagacggggctgtccaaggaaccaggtttcgaattggttcatcaacgcccgcgtccggctgtggaagcccatgatcgaggagatgtaccagcaggagaccaaggagctggagggctcctccgccggcggcggnngangcaggcccnantctngcaacgaccctccggngccnacgactttcactccccaacgtt

SEQ ID NO: 92509 - DNA, 477 bp, Triticum aestivum
  unsure (1)..(477): unsure at all n locations
  Clone ID: PAT_TA_92509
ctcgtgccgaattcggcacgagccgagatatccatctgataagcctggacccttatccgcaacacctgagcttcattcttaacacagataccaactagtctgatagatccttcttccactaaagtctaagtccactcccgagcaacctcaagtctatagcaaggaacctacggcaactctcgacagcaatgtaatcgtctcaacatctttcactcgaccaaggcgacgcatcctcgctgcttctcatccagtgtccgtggagacgcaagggcattagcagaagtgtgctatgtccctttactctgagcctccttcagctcgctcctttcgagacgataagccaacattgctggtctgttggtggtgcacaatcttcgcaatggttataattttattccgcgtatgtgggcgctatgtgcgaacggnaaaactttttcgggaagactggatanccttttcatgcattattccattatt

SEQ ID NO: 92510 - DNA, 485 bp, Triticum aestivum
  Clone ID: PAT_TA_92510
aagatttgaactttgtcaaaatttgattttcataatgaagcaagatataaggctgctagtaataaatactcacgatcgagatatctcggtcttgactgcatgatcatttaagtcgtcatttagttgtaactataaggtatgtgatatgagacttgtttataacgttcatcccgaagattgcaattatcctaactgaaagtcttgaataaattctttttttgcagtttctgtacttatgcgtaaaatcatcgcgtatttttagcaattgtcattttttctgacatcttcatgttcagcaaggaacttttcagcttctaaggctgcaatacatcccgagccggcacttgtaatagcttgtctatatcttttatcttgtacatcacctgcagcaaatacgccctccacatcagtatagctcgtaccgggctttgtgataatgtagccctcttcatcagtagccagctgcccttttactaaagccgtag

SEQ ID NO: 92511 - DNA, 480 bp, Triticum aestivum
  unsure (1)..(480): unsure at all n locations
  Clone ID: PAT_TA_92511
catcaatttctcaccccctcttcatcggcccatcagccagccacgaagttgtcaactgttcgtcacactctatctcatttacatcctacgcagtaaactaccacacattgctcctaactaatcagcgattttcaccttgatctcttcctacctctcccgtgttgcctgttgctaaaacatactcggcaaaataacgctcgcctgacacacctggggccaataacactggcaaaaataaatagcattctcattcaagacttttcacaaatatttcttgccctcactcgaccctatccacctcatgcctcctgtccgaacaacagcttctagagccggaaagtctgaacgaactcatgaagaaaatgtagagcgggctttcatagcagcttcacgacggtgtgatagaaccttagagggccgacttgagtctgcaaggcgagcatctgagattcacaaggnccgtangggacgcgggctccg

SEQ ID NO: 92512 - DNA, 483 bp, Triticum aestivum
  unsure (1)..(483): unsure at all n locations
  Clone ID: PAT_TA_92512
gcatctaccaaaatgtttaaggttattcgaagtcacccctttgcctctacgatcaagtgttttaaatcgggatcagtttacaatgcacaacaaaagagagctttgagcattcatgagtacctttcggtcgacctgttaagtaaatatggtatcggtgttccccgcggctctgtcgcaacgtcagggatagaagctgaagccgtcgccaaacaaatcggcagtaatgatatggtcatcaaagctcaagtcttagcaggcgggagaggcaaaggaacgttcgacagcgggttcaagggaggtgtacgcttgatctactctcctgccgaggccaaaacactggcggaacaaatgattggtcataaacttatcacaaagcaaactggagccgctggccgtctctgtaactctgttttaatatgcgagcgcaaatttgttcgtcgaagaattttatctcgctatcctcatggaccgagcatctcaagn

SEQ ID NO: 92513 - DNA, 514 bp, Triticum aestivum
  Clone ID: PAT_TA_92513
ctcgtgccgaattcggcacgagctcgagttttttttttttttttttatgggctagcccccatattttcagtcaggcataagctattggaaagtttctttattttctcatctatggtgatgtaaccatgggttctcctataatcgaagaagctgctgtagtagcgaagaaacgaacatcaacgtcttcatcattttgaagcttctctagatttggcaaaatcttctcctgaatgagtgcatctgcttttgctgacggaatacctacagctcccgtcttttcgagagagtaaattgtaccttcgtcaggcagttttttcaaaaccgagatcaattcagcatatgatttggcgacattgaaacgaatgttaggaatttcatcttcgacaagcttatccatcattggaagaatggatcttgagatcacgtctagactaactactgttgcaagtgtcgtgatagcaaaacatgttgtcattctatacaggtaatttgtgtgggcaaccaagggcaatga

SEQ ID NO: 92514 - DNA, 515 bp, Triticum aestivum
  unsure (1)..(515): unsure at all n locations
  Clone ID: PAT_TA_92514
cgtgcttgaccgcctgcacaccggcctcgtctttggcctcgacgcccgcatccacttactcgtggtcgagccagcgagtccgtgcaagccgctcgagtctcgcattgtcgtcaaaagtccacagttcctcgaagctcaatggggatatgacgccaggtgccatggcaacaaatgcggcgttatcgtctctcctttagaatccagccctacgccggcgacagtccgcaatctgtttattgaaactacactgacatatgttttgacttacatcgccgaactctgtccacaactacactcattccatgccgacatcactattcttgccgatgcggattactactcgaatccaccgtatccctcgactgtctatcctcgcttttcaaacttctctgttccgctggcaggtgctcacaagactggacttggctcatcagctgccctcgtgacggccttgactgccgctctcctcaaccactatctaaccancttctgccttgatattgttgcaaaccggt

SEQ ID NO: 92515 - DNA, 496 bp, Triticum aestivum
  unsure (1)..(496): unsure at all n locations
  Clone ID: PAT_TA_92515
ctcaccatacattcaacgtatttattagacctaccaatcgcaagagactttttccaagctaggctcatttataaccaacaaaataacacccatactcttttatagctagtgttttacgacgccgatcatgtccggcgaaaaagcagaaatgaatgtcaaagaaaagctagaggcacaaattaaatcggtggatatgacggaagaaatgcagcatgaatccattgaagttgcgcaagaagccatgtctaaatatagtgtcgagaaggacattgcaatgcacattaaaaagacattcgacgaacgaaaagggccaacgtggcattgtattgttggtcggaattttggatcttttgttacacacgagacgaagcattttatctatttctatctaggacactgcgccatactcttattcaaaactcaatgaactcgtattaaagccaannnaaaaaaaaaaaaactcgagggggggcccggtacccaattcgccctatan

SEQ ID NO: 92516 - DNA, 290 bp, Triticum aestivum
  unsure (1)..(290): unsure at all n locations
  Clone ID: PAT_TA_92516
caacatccagtgtgtggttgcaagtcttcacaccatcactantcaangacnancaactgcacatctacctgtcngttccanatttnccccaagtctccaaaacccaatccanacatcgtcnnaanctcttcnacngggagntcctgccccgcgaggcgtctcgcttcggtcatgaagctgccgtttcaacctccatatcttcaccccngtttgcgcccctggcactttcntgncgntcctggttctcgagtttcctngagagaagtnncctgctgccaagttancaggtt

SEQ ID NO: 92517 - DNA, 491 bp, Triticum aestivum
  unsure (1)..(491): unsure at all n locations
  Clone ID: PAT_TA_92517
ggaaaaggcaaggaaggtctcgcacacaggctacaagagaatttataacgagtatccacctactaagatcttggttcaagatgtagctagggtcatgcaagaagcaactcagtcgggtggagtcaggccttacggtgtcagcttattagttgcagggtgggatgagggtactgagcccgaagttaatcaagctgaaaactcggatggaaaatcaggtcaggaagaatccagcaacaaaactggtggcgacgtcaagggcaatccaatgttgtatcaggtggatccaagtggaagttatttcccgtggaaagcgacagctattggtaaaagtgcgacctcggctaaaacatttttggagaagagatacacggaaggcttagaactagaagatgcagtacacattgccctgctgacgctgaaagaaaccattgagggtgagatgaacggagaaactgttgagattggaattatcggaccancagctcatcatt

SEQ ID NO: 92518 - DNA, 509 bp, Triticum aestivum
  Clone ID: PAT_TA_92518
ctgcaaagctgtcatggcgaagcccggtgtgtatccttgttctatttccctgcaagccctgactgttttctctgtgctcgtagttcttttggaatatgtccagggaggagacaagtgcccaagtttttcatgcgggcatctccgagacgtacggtatcctttccgacgtccaggcgacccacctgggtgtggtgctgaaggatatgagctggtttgtagcagtagcaaggctacaatttacatcaacactggaacatactatgttactggcatcaactatactgattcatccttctgggttgtggacgccaattttaatgccaacaagcaagctgccctcttcctcggtggaaccaaggtccttacacatacggcttcattgattcacattactatcttgatttggcaattgaagccaactgggcatgtttcaccaattgttcgcgagcaataactaataacagcatgtacaaggctgttacatgcctgagcgcgagcaattcacatgt

SEQ ID NO: 92519 - DNA, 151 bp, Triticum aestivum
  unsure (1)..(151): unsure at all n locations
  Clone ID: PAT_TA_92519
cgaattcggcacgagtgaaatttttgatagacattaattgcatgtgataccatggctaaaaaaccaaagtcaagaaccattgcagtgcgcctcatatccatggcgctcactggatattataagaccatggtacgacctcgancacanaggc

SEQ ID NO: 92520 - DNA, 193 bp, Triticum aestivum
  Clone ID: PAT_TA_92520
ctcgtgccgaattcggcacgagcgagtagtgatgggttgtgttgtgttgtgttcgtctgagtggggcgtgggcgttactccgttgcttaatattcttttgtatcatacattgctgcgtgtattatttctgtctcgtgtgtcgttggttctatgaataaagattggatggtggttcaaaaaaaaaaaaaaaaaa

SEQ ID NO: 92521 - DNA, 484 bp, Triticum aestivum
  unsure (1)..(484): unsure at all n locations
  Clone ID: PAT_TA_92521
cgcagacagacagaacttgagagagcgcacgcgagatggcagcctccatgatcacctcgccgattgtggcgccgacgagcgtgccgtccctctcccgccggggctcctccttcgccgtcgtcctgcaacngtgggaagaagattaagggcnatnaacccctccggctccgggaggcggttngaaattcaacancaacgcaaacggaaggaaggncggaaagaaaggggttttacaagtttgttgaaaagtacggngccaacgttcnanggttacagcccaatctaaacccaagaggaatgggccngantcctggtgaccggcnacgcccggcgggaacaaccggggcttctaanctnggggccgttaaccttcgcccgggcttctncggngggggggtcctcctcgtctanaaaaaacaaacgctctctcccggggtaaaaaaagcanctnacntgtttacacaaagggnccggtctcctgggt

SEQ ID NO: 92522 - DNA, 432 bp, Triticum aestivum
  unsure (1)..(432): unsure at all n locations
  Clone ID: PAT_TA_92522
tgccgccctcctcaaaccagcaacgcccgcgtcaaacccatgtgcccgctcccatctacgcgccgcatctctgcgtgccgagcgccactagccaccatgacgccgtgccaaccccgcctagttaaatcccagacgagtagcagcagcagcagcagtggtagtgattagtgaacttccaaaacaagttaacaacttccgagcaatcctcgtggcagagcagccggcaatggcgagagggcgggagggcgaggtgaggaacctggtgctgggcaagtacgagctggggcggatgctggggcanggctccttcgccaaggtctactacggccgcgacctgcgcgacggccaagagcgtggccatcaaggtcatcgacaaggnccgcctccgccagacggacggcatggtggagcaactgcgccgggagatntcca

SEQ ID NO: 92523 - DNA, 429 bp, Triticum aestivum
  Clone ID: PAT_TA_92523
ttaccaaggatttcccgatagtggcatgacctgtggagaatggaccataacaaaagcaggagttgataaagcagcagaaaatgcctgcaaggagtttaatagtcgcaagcatcacatgtggattcgtactaggaaagtcagggggctttactataacccgaaaggcaagagtagaatattcaaaaaacgacactacatgtatcctcttcagaatcaacaaagcatcaaaaagagtgaagaaaaaccaatccctgtcattttcattgacaattcttgcaaactatacgctgtttatatccgctctagggtaaaaacaagaagatttgcacttttctccaaaaccaagtttggatcctgttgggacgctcgcactggaatagtaaaaaaaactgatcgtactgactctacagctggcattactaaggacga

SEQ ID NO: 92524 - DNA, 425 bp, Triticum aestivum
  unsure (1)..(425): unsure at all n locations
  Clone ID: PAT_TA_92524
ctcgtgccgaattcggcacgagctgaaacgtatcangaatgtgggggtttctattgntagcggtagtaaatcgtatcctacaccctggcgccctanaaagtttatgagcgcttttgcctttatcccccgctaccttgaagtacgtcagagtanatgtgccggtgtttacctacgacatcctgtancgaggccagncttatctgaagtaccatcaccatatcccatggaantcangcanctggcttacaattggtatctacgccggcgctagaangccaactctangtacgtataatataanaagtctttttgacttgtacataaattatttaaattggggtgcaacgggatttaatgactatattactgctancaatcggaaaacaataagaagtaccacactgcaaaatatcttgtatcctaaa

SEQ ID NO: 92525 - DNA, 419 bp, Triticum aestivum
  Clone ID: PAT_TA_92525
cgggggtgtggcccccctcacggacggcgatgacacagtagtagacgttctgcggtaacggtgcggcgtgaatattattaaatactcggatcgcgataaaatcatgagttttttacacgacgtgggcacatgtgctataggaacgatggtaatttttcataatttttggtgatggagaagtatccgaacaattccctctccacggattgcccttcgcatgtctacgactgtggctggcggcctccgtgggctagcatgccgccaatcttgcgtatgcggcttctcacaagtctgaaggtgttgtggcggttgcaaacgcccggcacgcatctccggggcgtggcctcccagctcacggacggcgccgccgccggcacctggaggggtgaaatggacgcgtcaggtctacacggagggga

SEQ ID NO: 92526 - DNA, 392 bp, Triticum aestivum
  unsure (1)..(392): unsure at all n locations
  Clone ID: PAT_TA_92526
ccagcgcacggtaccacgcgaacagcgagggcgcagcgcaccacgcgagagggaagagtgcgccacagcgagcgaacccctttctggcagcgagagcggacagaggtagctgcagaaatatctccctcgtcaccccctttctcttcctcgtctcttcccatcccgctcctctcctccatgccgccgccgctgcttcccccctccctctcggccgcctgtctcccccgccggctggcgcagctcctcgcgtcgccttcctctcctcttcatgcgcggcggcgtctcgtcatcaacaagccacggcccatccccaagcccccaccctagcctccccaatcccctcctcccgcatgaaccctaagcagagagagaagattgagaggganangaga

SEQ ID NO: 92527 - DNA, 557 bp, Triticum aestivum
  unsure (1)..(557): unsure at all n locations
  Clone ID: PAT_TA_92527
tatcgccatcttggccgcaagtcttcgcatcgtcaagccttgctccgaaatctagtcacttcgctcttcacccatgaatctatttctacgacgtggcccaaggccaaggaggcccagcggctggcggaaaaactcatcaccctcggcaagaagaataccgagtcgagccgccgtagcgcattgagcatcttttataaaccccatgacctactcccaaagctttttggtccactgcgcgagcgctatgccctccgtcccgggggttacacacgcgttctccgcatcgagccgctcaagcccgaccaggcgccctccgccattctagagcttgtagatggcccaaaagatattcgctttgccatgacggctaaaactgtctcccgcacgcgcaaagagggaaagccaatcaatgaaattaccgacttcttccgtaaaaaggttacgcgattcccgaccgaacggggaagctgaattcgatcagatggttgagaagctcaacaagctccganggtagtgagaggaataacgcaagatagtaaaagagcgtcgattggggg

SEQ ID NO: 92528 - DNA, 497 bp, Triticum aestivum
  unsure (1)..(497): unsure at all n locations
  Clone ID: PAT_TA_92528
ctcgtgccgaattcggcacgagctccccaccaagatcctgtggatgcggaggatgcgcgtcctgaggcgccttctgcgcaagtaccgtgaggccaagaagatcgacaagcacatgtaccatgacatgtacctgaaggtcaaaggtaacatgttcaagaacaagagggtcctcatggagagtatccacaagtccaaggctgagaaggcaagagagaagaccctctctgaccagtttgaggccaagcgcgccaagagcaaggcaagcagggagaggaagattgccaggagggagggagacattggcccaaggcccgagagatcatgcancagcaccagcgggctgcagctccagctgccgcaccaangaanggccangaagtngaanttctgacatgaagcttaacctttctgggtactatgaaanggttaanctaantttggcacancagacngttcaaaaactggttnctngtccaantancntggttttgngtcaa

SEQ ID NO: 92529 - DNA, 412 bp, Triticum aestivum
  Clone ID: PAT_TA_92529
ctcgtgccgaattcggcacgagggcacggccatgactctcgcgaaagcagaacctctcgcggaagcaaaactgtgactctcgtgaaagaaaaaaaacaaaaaacacgtttttttcgtttccgagaggcacggccgtgactctcgcggaagcaaaatcgtgactctcgcgaaaggaaaaaaacagaaaatgtaattttttttccgcttccaagaggcacggccgtgactttcgcgaaagcacaaccgtgtctctcgcggaagcaaaattatgactctcacgaaagggggaaaaaccagaaaacgcgtttttctccgtttccgagaggcacggccgtgactcttgcgaaagcacaaccgtgcctctcgcggaagcaaaaccgtgactctcgcgaaagaaataaaaaaaaaaaaa

SEQ ID NO: 92530 - DNA, 556 bp, Triticum aestivum
  unsure (1)..(556): unsure at all n locations
  Clone ID: PAT_TA_92530
ctcgtgccgaattcggcacgaggacagctggaaacgtgtagttaggcccgatggctctagctcggaaactccaactcaaactagtgagccggcgctcgtgctagggaaagatggtaagccgtgtcgttcgtgtagctcgagcgctgctttttcctcctgggtcacacagacgaagaaagtaacagatggggccaggccacgccaacctagttccggctgtccgcccgacgttgaagcccttggacgctcctcgtggactctgctgcacaccatgactgctaattatccaacccatccaacgcacaaccaacagagaaacatgtctcatttcctccatttgtttgcccagttttatccgtgctgggtctgcgctgccgacttcgaaaagtatatagaagtgaacggtgtgcgttctgcaagccgcgacgacttgggacgctggatgtgcgangcacataatgccgttaacaaaaaactcggcaagcccagtttcgactgcggaaaatgggaagagcggtggaggactggctggaaagatggaagttgtgactgaatc

SEQ ID NO: 92531 - DNA, 548 bp, Triticum aestivum
  unsure (1)..(548): unsure at all n locations
  Clone ID: PAT_TA_92531
ctcgtgccgaattcggcacgaggaaatctataatttttggcaatgacagcctcccaggaagaagccgtagcttacaagaatgaaggaaacaaggctttctctgcgcatgactgggcgaaagctatagagaattacacgaaagccattgagctggacaataagcaggcagcatattatgccaatagagctcaggcaaatatcaaatcagaagcgtatggctatgccattgacgatgcaacaaaggcaatcgagattgatccaaattttattaaggcatattatagaagagcacttgcgtataccgccattctaaggccaaaagatgcacttaaagattttagagctgttgtaaaaaagtacctagcgataaagatgccaagttaaagctggcagaatgtgaaaaaatagtcagaagggtagcttttcttgcggcaattgaggtcggtgatgagccgtcagcaactgangggctagatttagactctatgaaaatcgaagatgaatatgatggaattagacttgaaaacgaagatgacggnaagaattac

SEQ ID NO: 92532 - DNA, 180 bp, Triticum aestivum
  Clone ID: PAT_TA_92532
cagcaaggcaattcgtgttctaacagtttgctcgacagactcaattttctgtagtactatcttctgtatgtttaatttcgcagcaattttcatgggtgtactttaaaattgcaaaaaaaaaaaaaaaaaaaaaaaaaaaaaaaaaaaaaaaaaaaaaaaaaaaaaaaaaaaaaaaaaaaa

SEQ ID NO: 92533 - DNA, 526 bp, Triticum aestivum
  unsure (1)..(526): unsure at all n locations
  Clone ID: PAT_TA_92533
ttttttttttttttttttttttttttttttttttctcatggatagcaaagctaccacacaattttattgaggtctacgatttttcagtgttcacctctgcgacagctagtgatgaagattcatcgaccctccaagacttcgngtttcatttctatataagattattgagagcttacttgtcgcttttaanccttaatttgctgcatatttttgcgtatacttcgttgcctctgcttcaaatgccttgcgatcgtgcttatacttttccgctacctctgtttctatcgcgtcatctggcagtggctctactagaagctgttgggtggctatcaggacattaatgatttgtgaggatggtttccaaatgtctggcttcaggattccaatacacatgctacctttgtcgtcaaaagttatgttggggtgatanatgcgaagttttaaagganaagcttagggggcntgaacggatattccctcgggagagtgaggagaagttcaaataaagccgccgggcgtaaggngg

SEQ ID NO: 92534 - DNA, 540 bp, Triticum aestivum
  unsure (1)..(540): unsure at all n locations
  Clone ID: PAT_TA_92534
ttggcagagtgaaatacttttatctgtaatttgctatcataaaaaacaattcctctatataatccgttcaaaatgaccaatttggaacctaaaattcaatactaatgtttcgctcaaaaaaccatgaaaaattaatcttggacgcggaatcgtttgaagatgggatagtatctcattttatacccgcaaccctcgaaacaactgacattcaatccaagtatcaggatatcaatttggttagagctaatgtggagtaatatgtccttcacttcgtttgacattttcccttcgtttatgaatcctaaatttcgggcaagttttcgtctgaatggaaagttaacaaagctacgagataattgtcaattaaagtccacctatttgaacgatatttcttatcacttaagtgctgatatgtctttgatactaattaacctttagtacttaacctttggcataccaatctcaatgtcacatggattgacttcgttcaagagantcaagctggatgtggnattctaagtagcgaaaaatttcatattt

SEQ ID NO: 92535 - DNA, 542 bp, Triticum aestivum
  unsure (1)..(542): unsure at all n locations
  Clone ID: PAT_TA_92535
ctcgtgccgaattcggcacgagatcgacgagaacgcaattgacgatgatgatgccagccgcccaactctttctgctactttccctcgtcgcatgtcacttggggcgcaagccattcgcagcgccagaggaggtggtaattcaggtctcagtggcggactcaatgtttcggagcaatttaaataccgggccgaaagcgccgtttcgcaagcctatcaatctccgctctcatcttcgccgaattttgggcagaacactcgaaaaccacaccacagggctaatagcgtttctgaaatgatgccagcgcccgtaaatactgcatctgcaccggttcccgtgggaccagttcgccgaagcccggatgcatttcaagagcgtatacttaagggtgatttttacatggattaagctgtctgaatatttctgtaataattttgaaggtgtcgttcgtgggctcttgaggtggcctttttaaaatattgtctaattaatttctctggtgccaagacgaatatagtaaacanggatcagagcacttcggtag

SEQ ID NO: 92536 - DNA, 536 bp, Triticum aestivum
  unsure (1)..(536): unsure at all n locations
  Clone ID: PAT_TA_92536
gccactcttctccgctggagctgctgctgccaaagtttgtgtctttctctctgtccgtccagtagatgagcatggcggcgacggcggccacggccacggcgtggccctccacctcctcctctgtcctcgccccccgcacccgccaccacgtcactcccagcccccgcgccctccgctccggcttcctcggccgcgccctcaccctgggccgccgccaccgaccgcccctcctccgtctccatctcccgtgcgcgcggcctgggaaggnccgctctcctcggngngcctcatcatcagggncgcaaacgtnaaacttgacggngaaagctnaaggnngcaaaatccnagggacaangtggggcncccggtngnaaancaacgcggaacttctgcgggaaggtggaacgtnctgtctctccggaccgcggnngcnaacctcagcaagggncccaaagcttctcccgctgctaagncacgctcttcacaaggcgccacggcgtncntgcgcacccatgnaggangangaagtaatccta

SEQ ID NO: 92537 - DNA, 558 bp, Triticum aestivum
  unsure (1)..(558): unsure at all n locations
  Clone ID: PAT_TA_92537
ctcgtgccgattcggcacgagatttcaaaacttgggaaacaacatcttatcaacgcagctctaaaatttttaaatttgctaaagtcatggatcttctctcaacaatccgcaaagaaggttctcgtggnggagttgaattttcatggncagacgtaaccacttctcagcatcgcgaaaattacctgggccattcagttatggcaccagtaggtcggtggcanaaaggaaaagatctaacatggtacgcaaaaggcagtancatatctagtgctggagatcaaactgtagaggaaagaaatctccgagagagaaaanaagaaatangaaagatacaggaagctgaggaagatgctttggctaaagctttgggccttccagtaaagcancnaaatactctgaaagcactgccatcacattaatgcgangttaatcaanccggntaagggacnctggcgtcggtgaanataacggggtaagatactggnaagaagttttgggagactttcccagcananctcaaggttcccancgtggggtccgaacntactcaaggaaatg

SEQ ID NO: 92538 - DNA, 521 bp, Triticum aestivum
  unsure (1)..(521): unsure at all n locations
  Clone ID: PAT_TA_92538
aatcagtcaacttgagataatgctcaaggtcatttcagcaacaagacctattcttgagctgactggccggattttttccggccgctcaagatcctcgcttagcggcatgacatctatccgtgacccaaatactctttctaactatgattgctggaagacaaagcacacaattgtcaactttgcaatcgacttccctcagaaaggtctctcaggaaaggtgaagctagagctcgaatctctcacagatcgagaatccagagagattattcttgatactagttttctcaacattagctcggttctgcttgaaggcactgtacatgacgattggagtgttaaggatcggactgaaccctacggcagtcctctcaccatcaaactatcaagaaggtgtatgtaagggggctatagttgccgtcgaaattatcctctcaaccactgagcgttgcacagctctccaatggntcacacctgcccaaacgtcaaacaaagaaattccctaaatgttttctcaatgccaa

SEQ ID NO: 92539 - DNA, 505 bp, Triticum aestivum
  unsure (1)..(505): unsure at all n locations
  Clone ID: PAT_TA_92539
tcggggttggcttctcctccccttccggttcgggttctggttcggttcgggtccgagagtanctagcctagtctagggtttccgtagttcggagaggagagaaagggagagatccatggnngcgacggantancgctgcttcntgggcggcctcgcctgggccaccgacgaccacaacctccagcaggccttcagccagtacggcgagatcctcgacgccaagatcatcancgaccgcgagacgggcaggtcncgtggcttcggcttcgtcacgttcggnagcnaggagtcnatgcgccangccatcnanganatgaacggnaagganctcgacgggcgcaacatcaccgtcaacnaggcccaagtcccgccggtccggcggtganggcggtggcngcggttacngnggtcancgcggtnggtancggnggctacggcngcggccnancgtggctacggnagncacggcngtngaggctactgccagtgaggcnggnggcnggct

SEQ ID NO: 92540 - DNA, 531 bp, Triticum aestivum
  Clone ID: PAT_TA_92540
ctcgtgccgaattcggcacgagcaatgataatttaccgcttcgtcctggtgtcctaacccgttttcactcgagaactcctccagcaatatcggttgccgaatatttacagcgattagcaaagcacgcaacgctcacgcctcctttactgctttcaattgtgtactacattgatcaattgtgcttactttacccaccctttacaattaacagtcttactgtccatcgcttcttgataacggctggtactgttgcagccaaaggcttatctgattcattttggaataatgctacatatgctcgcgttgggggtatcaaggttgctgagctcgggttactggagctagattttttatatcgattggattggaagatagttccaaaccctgaggctctagtaaattattatcagggattgatagcacggaatcctagttacagactcaaggaagatgaaaagtcttcagtgtgtgacgaagatggcaaccaagattgaggaacccatagacgattcgtcaagttggaaggagaca

SEQ ID NO: 92541 - DNA, 537 bp, Triticum aestivum
  unsure (1)..(537): unsure at all n locations
  Clone ID: PAT_TA_92541
gttacgagccacaccagcaaattggaaagaaaagccatcaggccgagttcgaacgcgcatatgctccaaacagatcggtacccctggctggacctctttacggaagacaaagggcgcgcacaaacacgaaactaacaagcacactagcgctagaaaaaatgtgttcaactgaatctaatgcaccaatctccaaaattcgaaaaattgacacagcctctcttttagaacctaatggccctgtctttcaaacaagtggcattccagaaaatcgagaaggatcaatcatcgatagcttcactcgacatctaggaattggatggtcatcactttctgatactgacccagaaacccaagcagccacccgtggctggattaaattcatccgaaaatcattttccactatcaaatgtaaggatacaactacggagtaaaagggctggcaaagctaccttatagaatcctaatgangggtaatttccccntcggtgaagatttaagcaaggttanacccgtaaagttgtgaaatttggngaaaan

SEQ ID NO: 92542 - DNA, 534 bp, Triticum aestivum
  unsure (1)..(534): unsure at all n locations
  Clone ID: PAT_TA_92542
ctccaggcaataaagttaacctatgtgaagttattggtagcaagaaggctttgattattggggttccggccgccttcagcccttcatgctctaattcgcacatccctgcatacataaagcatcctaagctgaagaatgccggaaaagttttcgttgtttctgttaatgacccttttgtaaccaaagcatgggctgatcaactcgacccaacgaaaacttctagtattcgctttctaggtgatccaactgctagatttacagaagcaatcgaaatgaattttgacggaagtgcaattttcggcggccagagaagcaagcgttatgctctcaaaatcgaagatggtaaggtttcgaaagtttactgtgagccagacaacacaggcctcgacgtgactactgccgaagaaggtactaggctaagttttccgatgataaattatcanagtggntgcccgggattgcaaagctcctctcgctttgggnacttgggatatcantaaccgggaatcacntatcacatagttaaaggnngag

SEQ ID NO: 92543 - DNA, 551 bp, Triticum aestivum
  unsure (1)..(551): unsure at all n locations
  Clone ID: PAT_TA_92543
ctcgtgccgaattcggcacgagcttcgatacaagattcgtaaagtatggtttcagtgactaccaggtacctgagatatattctcttcggagtttttggacttgtaatactcctcttcatttcttcttcgtcctctgatataccttccaacataatagagaaaggcaaaaaatggactggtattccctcaaggctttctcattcanacttctcatctccggtcgcatcacctatcgcatcaccgatcgcatcaccggttgtagacacgacactagatgaggaagtaagcctacccccagtggtagtaagaggtttccaagatgaatgcaacttttgttactctggcccgtaattcagatgtttggcaaattgcccggtccatccggcaagtcgaagaccggtttaacagaaaatataactangattgggtgttcctaaacgacgaactatttgntgaaaactttaaggaangtaactaacgcctccttgccgaantcnggacgaagggggggcccnggtnaccaattnnccctaaaagggggtcnggantnt

SEQ ID NO: 92544 - DNA, 537 bp, Triticum aestivum
  unsure (1)..(537): unsure at all n locations
  Clone ID: PAT_TA_92544
gaaacacagcactctatggctctatctcgctgtcaggttctctttttctgatcggaatcagttcattangtacctgggggcatatgggcgcaggtgctcttcatgggagtctggtcatttcttttccagtcaactattggctcggtatcgtggcctataatttccgaagtgtcgaagtcttcgttgcgcggacacactcaatcacttgctactgtcacgcaaggcgttgttggtgctattgggggcgttctattaccatttgcagtcaatccagacgcaggtaatctangtgngtagggtancttttgtatatggtacagtnttanncgcgagttgtgttggtatatggtggtggcancccgaaaacgaaaggtaggacgttcaanggaaatanagagnctnatttgagatnggcctcanggccnanggaatttcaaaangacanaatttcgngncanaagcagntaaggtaaacnttttaaaaattnaacaaacannaaaaaaaacccgtggccgcncantccggaattngggnag

SEQ ID NO: 92545 - DNA, 544 bp, Triticum aestivum
  unsure (1)..(544): unsure at all n locations
  Clone ID: PAT_TA_92545
ctcgtgccgaattcggcacgagctcgtgccgaattcggcacgagtaatgaaagtaacacatctcatacgcctaggtacagcatgagagcaagaagccaggttccaatatttgcggaccgcgagagttcgagagagggaataagacaacactgataaaagctgtatgctgatttggtggcttccgcttttcatagcaggggcttggacatgggggcaatgattccttgcttgagcaagatacgcggcttcgtcgcatcttgaaaggtttccttaagtggtccactcttggccgataggaagtcggagggaacgctcatactgtaagcgcgtctcgaaggggtggggcaggcttgtagcgaggtatttaccattctttttgacttttttctcactgatgataacgcgttgaaggtggacatcctttcgtttctgcactcgcacgccgtcngtctcggtgaaggaatctaaccttgttacgcttttgctccctccttatcaaaacatctccaccangtttcccaaaccaagaaaggnatttcaatat

SEQ ID NO: 92546 - DNA, 537 bp, Triticum aestivum
  unsure (1)..(537): unsure at all n locations
  Clone ID: PAT_TA_92546
ggatgtgcgtgccgcttacctagcctccctggcaactatttgaggactctattttatttaaaaactctcatatctaagtactttattaaaacagcaagcaaaacaaaataaaatgacattcaaaggatagcacatatcatgtgaagaagcaaaaacttaggatcaaccgatactaaccgataattgttggtgaagaaaggtgggatgcctaccagggcatccccaagcttagatgcctgagacttcttgaaatattatcttgggatgccttgggcatccccatgcttgagcttttgtgtctccttaattccttttatatcacggtttccctaaatcttaaaaacttaatccacacaaaactcaacaaaacctcgtgagataagttagtataaactaatgcaaaaaccttatcattctctactggngaaaatcactaaaattattaatcaacaattgcatactaaatgcctccgcatanttaatactcccaaccccaaattngaatcaattaaccaagcnaacatttgccanccttnn

SEQ ID NO: 92547 - DNA, 552 bp, Triticum aestivum
  unsure (1)..(552): unsure at all n locations
  Clone ID: PAT_TA_92547
tttttttttttttgggtctagtatatcagatttgagtccataagaaaaccaaaatgttacacataagttgaaagaacatagcatgataaaacttctgcctttcaggaaaatcatcacacacataccatgcaagcaccacatgagacaatcaagccatataccatgattacgatataagtccaagaaagcttccaaatacaacttcctgcttattcagcgaggattcaaaaattggttaaatcaactcggatgattctgacgacgaccgcggtatgaccgtctgagcggttccatcggacagcaaggatgggcacccatggcaatgccaagcgtcggcggtggcaggctcctctccttgaagagctggacgtcgggattttctcacgaaatatgcacctatgtttgatccattttggctaactccagcgacagtggcagaagcaggnaggagaaacacggtgggcgggnagcagcaacgacnggaggagaaaacgtgttgcaacgacatggaagaagagataatnnaaaccnggcgctacgccaagcnggggg

SEQ ID NO: 92548 - DNA, 530 bp, Triticum aestivum
  unsure (1)..(530): unsure at all n locations
  Clone ID: PAT_TA_92548
aaattattcatccaagagtttagcaaaatgactattgcggaggagcttgctacaaggaatttcagtatctacggtcaatggactggtgatctgtatattcctatgctttgcattggggatatcgaatctgttccatgttaatatcatgattttattcggagctctatgtttaacaagctctttcctaataatatttatcgagatccccctactcttacggatctgtccaacctcctccaagttcgatacttttatgcgtcgattctcaacgaactatatgcgaagcaggaatttatctcgctatgggtacagctcaatggctaagccttatcggacaaccatcaagcttaatcgctgcagctataatgctcactcttgctggaactttctacgctcttgccggagtaaaggggcaagggtttgtcngnagcaaaacattanggtggtgaaggagttgcacaagatgattatcctaggaaaaaaaattgcatgttcaagttgcncgatnaatccgtcattaattggtagaa

SEQ ID NO: 92549 - DNA, 530 bp, Triticum aestivum
  unsure (1)..(530): unsure at all n locations
  Clone ID: PAT_TA_92549
aagttaactgactgaaatttattgatcttacctcagcttgagttaaacttattgtcataaattaaatacgtctatggttcgaaacatatacatgaaggcccgaggataaagcatgaagtcttaagtagttcggctgcagaaaatcgatacaacactttatgtgatgactgcgctagcatgtgaatttatacctttcttcgttttaaaccccaatttcgagcgataagcagctcttcatgagtatccacgggggtatcctccttatgttcccctacccacgaaaatcgaacagtttgccgttctcgtcttcaaagccggctgcagcgagatagcatgaatggtttgagggtaaattatactacatgagccgcccggctcacgcaggatgtttaggcacaaatctagaaatttaagggtcaactgacttcttcctgttcaaaattctanntggcgatnaagcntgcgtctaagattccgagtacgtccaataagttttttggnattgggcttttcaattttcaaatttccgg

SEQ ID NO: 92550 - DNA, 346 bp, Triticum aestivum
  unsure (1)..(346): unsure at all n locations
  Clone ID: PAT_TA_92550
ctcgtgccgaattcggcacgagctcgtgccgctcgtgccgaattcngnacnaggcttcttcctgtacgccggcatcgcngcgcttggatgggttttcttctttaccttcattccggagacgcgtggcctgccgctggaggagatanggaagcttttcggcatgacngacacncccgtcnaanccgaanacaccgccannaaagacaangcgaaagtaatggagatgaactantgagccangcgtcaaccaantttgccgatgtaccatatagatgtaactgatgaatcgtggtaatatacgctatcanggactcgtgctgctcaaaacaancaaanaatnctaaaa

SEQ ID NO: 92551 - DNA, 544 bp, Triticum aestivum
  unsure (1)..(544): unsure at all n locations
  Clone ID: PAT_TA_92551
ctggtccggccagtgcgccgccccgcccccaccccaccttatgtccatcggatcccactgccacctcctacgcgggatcgagcatcgccggtggtttcctccctagacgctatcgccggccttctactgcgacagtgccaccgcgggcgagccacctctgcccacctcagcgtgagcccgtcgcccacaccgcatcggccaccctgcgtccccttcgatgcgacacaccgacggccaccacccgcctccccatcgacgccgtgcgccggcggccaccacccgacgtccaccgtgcctacctgcatccacctacagctagaggagggcttgacctgcagcaagaggacgacacgacctgcagctcggtggncacatccggcagagaaggatagaggcggctgggtgatggatcttgcacgccgcctccgggcacgangnttccgaactgctgggtcaaccgtcanaaagcaannacaaggtcgtcctttccnactncccgttcaaaaacgncagacgaatgctggagcntnccaagccccccctn

SEQ ID NO: 92552 - DNA, 495 bp, Triticum aestivum
  unsure (1)..(495): unsure at all n locations
  Clone ID: PAT_TA_92552
ctcgtgccgaattcggcacgaggtcaattgtgcttcaaatccttaaatttattcactcccacataacctcaaagtacagctaccctagcaccaccgtctcaattttcccagtctcacctcgctcccaatcttgaaagtaacacgaagaatttccaccttttcattacttcaacagaactctacggaaaatgtcttccagaatagcatctggtctcaatgaatcagtcacagtgactcaagtacacggnaaagcaacggncaaaaactgtgtctcaatcgtctcttctgacaaacctgactcggatgcgaagacaattctatctaccccgactgctcctacgattaagccanaagaagcagacgagcccttactgcaagagaatcctaaccgttttgtcctattcccaatcaagtatcatnaagtctgggcanattgtacaagaagggnggangcaatcgttttggncagcagaangannttgaccttgtcgaagg

SEQ ID NO: 92553 - DNA, 401 bp, Triticum aestivum
  unsure (1)..(401): unsure at all n locations
  Clone ID: PAT_TA_92553
tttttttttttttttttcgagaagataatacgtaattactgacaaaaagaataaactatgccacgaggataagttctaccagaaaatgtaaaatattgttccgcgggatactatagttccacattananataattacaggtggctacgcttgtatctgtttcatcttggattctacctgacgttttagacttttatcnataccaaagaatgatagatgtgtgacactcaacgccctatagacccaaacatttatcgggctgacaagagcccgaaacccgttacatacganttgtcatnacatcgtnacccggnaaacgcncatgancaantcggacattttctcatacnattggcgantctgtcancancacactngntanacgaaggtangtccacacac

SEQ ID NO: 92554 - DNA, 498 bp, Triticum aestivum
  Clone ID: PAT_TA_92554
ctcgtgccgaattcggcacgagtagatattgaagatttaaagactcagggcaaaatccgctcagatatgggaaggcttcaatactttgacgatttaagtgtcagtcgggctgctttggatagaaagaaagaatatgaaggaccatatgatccggacctccgggaagcaaacatccaagaaaacgtagctgccgtactagaagctgcagaaaaagttttatcaaaggttccagaagggtctggtgaagagcagccaaaagttggacagaattaccttcaatctagcagtgatgagtcggacgagaagttcaagccaattattagtcgcatgaatgtatggaagattcaggataccatgtcactagcgatgggaaaagatggacctatatcgcgcgaccatggtcaaatgcaagacttcacagcaccaggtctaccaagaaaatttttgcccagggaaagaaaagctcaaaaagaagaggagaacgattcagagattctg

SEQ ID NO: 92555 - DNA, 484 bp, Triticum aestivum
  Clone ID: PAT_TA_92555
ttttttttttttttttttttttttttttttttttttatcacttgtaaactcatgctgtaacatccagtttctctctgtgccagattattgacaaataaagaactcaaattctcattcaacatacatagtgttgtagcaataaatctctctatctaattgcgcaaagcttactacccgctattgtgtttcctaagtacgagtcttcgtaatctcctatttctgagtcaaagcgtattatgtgttccagaacagcacacgctcgggccttattgtcaacaacaagggtgtacttatatttgttgaggttgtcctgtttaacatccatttcacaaagataatgcttgacagtcgatccatcatcatgatacatcattttggttcttccccacacaccagtatacaacgcatcaagttcatgactttggatttgttgaagtctatttatacccccgtaataagttgatattatttatcacatcaattg

SEQ ID NO: 92556 - DNA, 477 bp, Triticum aestivum
  Clone ID: PAT_TA_92556
ctctaaacccgggaattcaatcaaaatatttttttccaaaggcaactcacatcaagtctagccataatcgtctccaaaatcctcagattaggttttccagcctagagcaattgccatcatgtctttaaccaattgtcgcttctatgaggaaaagtacccggaaattgatagctttgtcatggtcaacgtcaagcagatagcagagatgggggcatacgtcaagttgcttgagtatgacaacatcgacggcatgattttgctttctgagctttctagacgtcgaatccgaagtattcaaaagctcattcgagttggacggaacgaggttgtcgtcgtactgcgggtagacaaagaaaaaggctatattgatctttccaaaagaagagtttctcctgaagacatcataaaatgtgaagaaagatacaacaagggcaaaatggttcattccattatgcgccacgtcgcagagaagacact

SEQ ID NO: 92557 - DNA, 479 bp, Triticum aestivum
  Clone ID: PAT_TA_92557
agaagatctctgtcatttacgctacaaagttatatcgaccaagcttgttgcccccatatgcattggacttgtcaggcgccgagaattgaaggcgcaaaaaatctagggaatatttgcctcatagtgtgaataacttcgattacttgctcttcattttccactgccatcttgcttattcagttatttactcgcaacttcgctctctaattcacgcaagtaatgaagtcaagtctagactgactttatgccaatctaaactcttcgaaaaaagctccggaagcccgatcagatttcgtgacaccgctgaactatggagacccattctactagcgatagccagattgacagtgcagaatatttagcctcgagttcagaagaaagacacctatcttcttgcggccggccttcacactcttctcactccaccgattctattccatcccaagagaataacaactctcctaaaacagatatcgatg

SEQ ID NO: 92558 - DNA, 484 bp, Triticum aestivum
  unsure (1)..(484): unsure at all n locations
  Clone ID: PAT_TA_92558
gagccaaccaagtcgccgacctagctttactcctcctcctttctcccttttttctttagcttttatttactccttctcctctccccgcccacgcctcctcccaaatcctcctcgcctccgccgcttccgttcggagttcagccggagatacgcggagaagcggatcgcgtctgatggcgtccccggcgcggccagcctccgtctccggccccttcggcctcgcccccgacctcgcccgctgctccttcgaccacacgctccgccgagaggattttcaggacaacaggctgctgaggtcattgggttaagcatgcgcgaccaggaaaaccattccaaagaaattataacggaagccatcgagaagctgcatgaacaaacaagcaagaaaatctggtgaattcactgggatgtcatcagtggaangctgtcgcaattggagttatactgctacaagcttgaaangnccatcggagaactgcgaagc

SEQ ID NO: 92559 - DNA, 491 bp, Triticum aestivum
  unsure (1)..(491): unsure at all n locations
  Clone ID: PAT_TA_92559
tgggaagaaaaatgtaaccgtggacattttgaaaacttgaaacagatggagtattcgagagaaaattcaacgggaaatcgatcaacgactgatacagctgatagacaaagtcgtcatgtctatgatgacgaatcgcccgtagaagattctgctgacaccacacgccgtattttaaatgctaaacaaaccatggtccagaataatacctctgcaatagaatcatcttcatcgaattggttagtggaactttcatccgagaacgatctactcagatcatcaagtcaatgcccatttgacccaacttttctcaaagtaaatgaaattaaaaatagaanaattgcacctctagaacatgaagattcactagctacattctctgttgaaaatccgtcccatcatgacttacattgtaccaaccagaagattcgtggnactcnaaactcgcagcaaagtctttccaagtttccgaacccggtggacgagaactgcac

SEQ ID NO: 92560 - DNA, 482 bp, Triticum aestivum
  unsure (1)..(482): unsure at all n locations
  Clone ID: PAT_TA_92560
ctcgtgccgaattcggcacgagtacagttccattacttccagcccccgactttggaattgacgtagcatctatcttggaaagaatttcttcccctgaatctacatcgattaaaatcatttttatatgttccccaggaaatcctacaggtaatttaataaaaaaggacgatattaagcaaatattggagcaaccgacatggaatgggataattgtcgtggacgaggcatacattgatttcgcaccagaggtcacatctctggcagagtgggtagcggagtggccaaatttagttgtcatacagacactttcaaaggcatttggtcttgccgggattcggttgggtgtagcatttgcatcgcctcctgttgcagctatcttgaataaagtcaangngccttacaatattagcagtccaaccagcgccttcgcaattatgagcttgcatcccgctggactagaaataatgggaaataacangaaa

SEQ ID NO: 92561 - DNA, 326 bp, Triticum aestivum
  Clone ID: PAT_TA_92561
ctcgtgccgaattcggcacgagggacagtggctagcaaaacttagtattcaggagctggggccttcgtatccctccccgaaacaaacctacacgcctgctatctagaggttaataaatttcgtctaaactctgtaagatctcaatggtgaggtggttaagcccttggacaccgtgtggatatacatcgaggtttcgggggttctcgtacagtctggcatgactgccattttattcctagaccgttaattctttcagggcttccactgattcatccgttcttatcagagtgtaataagttgtctcaattatttgagcaaaaaaaaaa

SEQ ID NO: 92562 - DNA, 487 bp, Triticum aestivum
  Clone ID: PAT_TA_92562
attgaacttatgtagataagtctataatgcggttttaaattacaagcttgtaaaagaaataaattatagcgacactctggagttatgatagatgaggtgtagtagcaaatttatgttcctatctcgcgagcgctggtagtctcaaccaatttggtgacataaatatgaggtctataagtctttgcgaaggtcaacggaatcttgttaatatctgccaaattggccaactcaggatttttcctgcatgatttttaagcgtctagttttcatgttcaacataaaagaattgactatattcacttttgatcaccttagaactgtcatttacacgggttgttttgtgcgtgtctccgactttgatagttgataaaagagtgctagacgatgtgtaacagcttgtggaaatactatgttgggtgaagtaaaatctagagctgctcattgttatatgagttgaagtaagcgaaccttacaagggtagaaagaa

SEQ ID NO: 92563 - DNA, 476 bp, Triticum aestivum
  Clone ID: PAT_TA_92563
gagaaacacagggcaagaagagaagagagaagcaaagcttgagatggcgcaaaccatggcgtccatgaccggcctgtcgcagggcgtgcgtctcccaggcccgaccggcaggcgcgccagcaggttcaccgtgagggcgtcgtcggcggaggcggaggccgccggccgccgcgcggtccttggtctcatggccagcggagtcgtcggcagcgcgttcgctcaggtggtgcacgccggcaccgtcgcggccatcaaggttggcccaccgccgccgctctccggtggactccccggcacggacaactccgacgaggcaagggacttcgacctgcccctgaagaaccggttctacctgcagccgctgccaccggcggaggcggcggtccgggccaaggagtcggcccaggacatcctcaacctcaagccgctcatcgacaagaagcaatggccgtacgtcatgaacgacctccgcctca

SEQ ID NO: 92564 - DNA, 516 bp, Triticum aestivum
  Clone ID: PAT_TA_92564
cgacaggctgtctacgacctttacaataagcgcggtgctgagggtgctgctcgagaacaagaatggtgtaaactttttgaaaagtactgttcaacttatgagtctgaagctaaagacctcaagcgtcgcctttccggggagctccctgagggctgggaaaaaaacttgcccacctattctccaaaggaccctgcaattgcaacacgcaaattatcagagactgtcctacaaaaaatatactcatctgtacctgaattggtcggtggctcggcagatctaacaggctcaaacctgactaggtggaaggaagctgtagactttcagcctccatctctaggtatcggaaactggagtgggcgttacattaggtacggtgtgcgggaacacgccatgggtgctataatgaacggtctcgcagcgtacggtttatttataccttacgcaggtacattccttaacttcgtctcgtatgcctctggggccgttcgtctatctgcattatctcaagtccgcact

SEQ ID NO: 92565 - DNA, 486 bp, Triticum aestivum
  unsure (1)..(486): unsure at all n locations
  Clone ID: PAT_TA_92565
gataacttcgccatggttcaccaacatcaacatgactgttggttccggaaaattccttctaattactactaaaaactcaagcgacagcacagcaggcactacttcccacgaccgccgagccgcctattcacctcaatctgatagtagtacataccaagcgctaacggctagcaaggacaacagcacaacacccgcgggtgcctttgatatcccagccaaagatcaaccactgcctaccaactggtacgttcagagcttgcatgtaaacggcgtattgtggaatcgaagctggctaagtcacgacgattttcggaacggtggcacactagagtttgaactaggcccacttccaaagaaatgggacacaggggaagtcccacctagtcctggacatgttgtattataaatgtaatcatacggagcaaaacttcacttcacaataaatttaattcatcaaaannnaaaaaaaaaaaccgaggggggggn

SEQ ID NO: 92566 - DNA, 491 bp, Triticum aestivum
  unsure (1)..(491): unsure at all n locations
  Clone ID: PAT_TA_92566
ctcgtgccgaattcggcacgaggactaacgagctcgctgctggaatggaggatagagttcagcttgttacctatgccattggcgtcacccgtctccccgaagatgtgaacaatccagaaaccaggggttggagactcattgagctccaaaaaagtggcagagattacatctagccaaggcatcataaaaaaaaggttgtatacccttgcttgttttcgcttggtacgtctcaccacatctcgagatgacaatcaagcggtattgtatgtctaaaggtgcatggcgttcaggatggggcttgaaataattaggcctggcactgatatatcttcgcgaggctgctttctgctttggtttccaggctccacaccactacttgtcaccaaaaagttacacggccggcgtgtctatctgtactataatgatgtataattatttttgagaagtattactagagccctgaaactgctcaaggattctaaaaagcctgn

SEQ ID NO: 92567 - DNA, 475 bp, Triticum aestivum
  Clone ID: PAT_TA_92567
ggcgcgagcgcgagggcccgcgcatcccgttcacggcccggctcaagatcgcccaccagaccgccgaggcgctctcctacctgcactcatgggcctcgccgcccatcctccacggcgacgtcaagacgtccaacatactcctcgacgaggattacacggccaaggtctccgacttcggggcgtccacgctggcgcccacggacgaggcgcagttcgtcaccttcgtgcagggcacctgcgggtacctggacccggagtacatgaggacgtgcaagctgaccgacaagagcgacgtgtacagcttcggcgtcgtcctgctggagctgctcacgtgcaggaaggcgctcaacctggaggagctcgaggaggagaagtacctctcgtcgcagttcctcctggtcctcggggagaacaggctggaggagatgctagacccccagatcaagcgcgagcagagcatcgaggtgctcgagca

SEQ ID NO: 92568 - DNA, 524 bp, Triticum aestivum
  unsure (1)..(524): unsure at all n locations
  Clone ID: PAT_TA_92568
ctcgtgccgaattcggcacgagtttcctctcgccctcgttcgcgctcccgtttcttccgtcacacgagcaccacgcgctccagcttcgaacagattccagcactcgctcataccaacccgattctccgcatccgattccttctccctcctgcaaggccgtccacaagttccggcctgcttgttcttggcgcgttagctatctggtacgagctcatcacgagagctacgagcagcactggaatcaagcgcggcgttcctcgcgccgcggagccaggcataggcagcatgggcgcgggcgcgtcggacctcgcggcaccggcggaggcggcggggtccgggctgggcgacatgccggagctgtgcgcgggggaggtgctgctccggctgggcgcgcccgacatatgccggctcgcgcggctcaaccgcgcgttccgcagcgccgcgggcgccgacttcgtgtgggagggcaagctgccggagaactacgggtacctcatggggttcgtccgtggcancgccgggga

SEQ ID NO: 92569 - DNA, 178 bp, Triticum aestivum
  unsure (1)..(178): unsure at all n locations
  Clone ID: PAT_TA_92569
cttcaaaccaagaaacctcctctagtcagttttaatcctcgcaacgttcgattgtcatatgatggcggagaccaaggcggtggctgctgcggtgccggtggaggcgagtccggtggaggtggggaggagcaggacggtggctgctgcggtgccggtggaggcnancacggtggacgtg

SEQ ID NO: 92570 - DNA, 242 bp, Triticum aestivum
  Clone ID: PAT_TA_92570
ggcgtttgcccggctgcagaatgattaattaagtgctatcagttaggggattttcggtaatgaacttcactatagtgtcgaagtatggatcagggtcgatctacacgtgttttggtattgtagatcaatctagtccgcgtttcttgttttagattgcacgaaaaatagaggcgtgtacaccatgtatagatctactggttacgtacgtgtattttgcatgcttaaaaaaaaaaaaaaaaaaa

SEQ ID NO: 92571 - DNA, 515 bp, Triticum aestivum
  unsure (1)..(515): unsure at all n locations
  Clone ID: PAT_TA_92571
ctcgtgccgaattcggcaccagtgacttgatcgagcatggctacttggctctcagaccttgacattgccattgccgtcgttgtggtcgatctgctcgtcgatgttcctgacgggtcccgtgaaccacttcctggcgtcgacgacccaccagagcatgatcaaacccaggacgacgccgagcgcgatgggcgcgtagttgaaggtgtccatcttgatggggtacacggtgggaagcaggaagacggagcaggtgtagcagatccacaggaacgccacgaggcagacgggccggctggctccccggaggtagaaggggccggggcggaagtcctcctcccgcatcaccatccgggcgaagatgggcaccgcgtagccccccanccagccgatggtggcgaattgaggtgatggccgttgaacaccacgttgattcacaagatgggcaagcccagcagcgcgcaaaacggcggggcacaancacacgggggttccgggcaccttgccntggggtggat

SEQ ID NO: 92572 - DNA, 553 bp, Triticum aestivum
  unsure (1)..(553): unsure at all n locations
  Clone ID: PAT_TA_92572
tggcaacagaggatttcgagtaaatctgccaaaccaaacgcagcagtgtgactaggaatctaatcaatcccaattagagaatgttgtttagatatttgtaggtataacaaaggccacgtagataatcttaaattatgcggcttacggatgcccacaacaccctcagcccgcaccaccagcaccacatttctgaatcacgcaaatatgaatggcgcagcaaagttcctgcagcccatcacagccgtcgaatatgatccgatcgagcacctgaaccagatattctctaatccttcgaccctcgaccacgttcaagaagcggttcatgcccttgaccaccaccagaaaaacatatccctcgatattagctttctctcggcccagcaagctcttaagaacgatgcctcactcaaacgcatgcaagagcactaaaaatgagctcgctgagcttttcaacaagatttgaatccgtccgaacccgagccatcgagaccgagcaagaccataacatctntgacggtggatatcaaacgattnagatggtcgaaaccgtttg

SEQ ID NO: 92573 - DNA, 542 bp, Triticum aestivum
  unsure (1)..(542): unsure at all n locations
  Clone ID: PAT_TA_92573
ctcgtgccgaattcggcacgaggccgccgctgccgtggtccacgcgcttgtccgtcgccgtcgacgtcgcccgcggcctcgccttcctccactcccgcgacgtcatcttccgggacctcaagtcctccaacgtgctgctcggccccgaccaccgcgccaagctctccgacttcggcctcgcccgggccggccccaccggcggcaagacccacgtctccacccgcgtcgtcggcacgcgcgggtacgccgcgccggagtacgtcgccacgggccacctctcggccaagagcgacgtctacggcttcggggtggtgctcctggagctcatgaccgggcggcgcgcgctcgacgaggcccgcggggtggcgtcggagctgctggtggactgggcgatgccgatgctgcagggggagcggccaaggtgatacgggtcatggacaccaagctcggcggggcaatancccaaagaggcangcgcanggacaatgggcgcgctcgcgcttcgctggcctcaaaaagaacctaaaangccggccctccan

SEQ ID NO: 92574 - DNA, 550 bp, Triticum aestivum
  unsure (1)..(550): unsure at all n locations
  Clone ID: PAT_TA_92574
tttttttttttctaagatcaaaatgaaatattatctctgtgaatcaataactatcaagttgctacatagaattacgagtgaattttatttatttcatgagagaaaacccattccagaattttattactcgcggtagatttggagtattctcgactggtgacaggggttaagatcaaataagtcctcaggtactccatgttgaccggattattaataaagggatttcagtagtttaatgtatttgtgcctgaataaaacattgtagtatgataaccacttcccatctctatcactgggcattaagagtggcagattggtttgatttgagactctctactattcattccattcggctgctttgtagtacaaggacaccagtaaaattgacactcgccaaactttacaaagcaggtaaatcaagatgagttgcatcatgcgcactttttcaagagaattattccgccctccatgccaaagttatggctgttcccaanaactggggctcttctttaataaancantcaagaggatgataccttttcctggttgg

SEQ ID NO: 92575 - DNA, 521 bp, Triticum aestivum
  unsure (1)..(521): unsure at all n locations
  Clone ID: PAT_TA_92575
gcgaaacctaacgcgccgccagcccagccccctcgcttccccaccttcccctcgccgccgccagggcgcgccgccgggcgaagcccggccggcgttggcggcggcgaggatctccttcctcctcgcctgatctgctgcggcgcgggcgcggcaccttggcggggacgcctcgttctggcgcagggtgtggtggtggggctgtgtacggtcgcgctggtggcgggattgggcggcggctggggcggcgtggtgcggggcggcggcggccaggcccaacaagcaggcggcggcgtacggcgggatgtccaacggcggcggcgtccgatctgggctcaaatgggcttcggcgggccgtgcttgctgctggcttgtcttccatgctctgtcaatgggaaactgctcctgggctcgacccgcaacacgagtacgtccgggggctccgggcctcgggcgtggcngtggtggtcggcaactgggttttggatacacatcantccaacnccaanttggaaaacatctgc

SEQ ID NO: 92576 - DNA, 529 bp, Triticum aestivum
  unsure (1)..(529): unsure at all n locations
  Clone ID: PAT_TA_92576
attgacttgacagatccctcatctagcatacagtttagctgtgagatttccaactcaccgtggcctacacaatactcgctcagcaacatatcttatctcagggagcggttatatcacatccacggtaagtatccggaaatctagagtgcgcaagcaagggatgctataagattgaacgattgatatttatcatactctaaatatcatgtcaaactctagaaacaccaacgattatgaacatcaccggcgccgcagctccgtcacgccgctacctctcaacagtcttctaaacagagcaaagtgtacgcctggagctccgtcttccccatttcctatcccaacgacgacaacagccacaaacgaccaacatagacgcatgtctctctcgacattgggcttatctgggacaccgccatcccattcgccatctcaatacttcctggggtggtcgacgagtcagcgtctggttcttccaactctgaggntatcgacgaagaacgcaattnacgataatgatgccagnccgccc

SEQ ID NO: 92577 - DNA, 546 bp, Triticum aestivum
  unsure (1)..(546): unsure at all n locations
  Clone ID: PAT_TA_92577
ctcgtgccgaattcggcacgagttaagtcacagggaatcaatctaagccttcaactcactatgacgaatcaatttcaagaagttatggacatcccgcgggattttgttaaggatggcactcagtttgtcaaccgttgtacaaagcctgactttgaagagtttatcaagatttcacaggcagttggcataggatttcttgtgatgggagccgtaggatacttggtgaaactcatccatatcccggtgaacaatattctcgtaggaggagcatgaaaagataaaaaaaatacaccagttttcctagggaacaattacatgtcaaaagtggcagatcaaaggatcaaatagaaaccccctgcgcgccacggaagaacacattttaagctcagcaaaaatcaatttgtattatacagtcgcgttaattttcgaggcaaagcgtaacctaaatgaattgggaaattttgagatatatcggcgcgggttaagctagcatgaatgttaanttagaattccaagcattaaaaagcaaaaatgaagacttgcccn

SEQ ID NO: 92578 - DNA, 542 bp, Triticum aestivum
  unsure (1)..(542): unsure at all n locations
  Clone ID: PAT_TA_92578
cgtaggtggatatcatctaaccgtttgtccgcctgcgataatggcactggcagaagaagctgcgactaagaataaaacatttatcttctcgctgtctgctcccttcatttctcaatttttcaagggccccctagacgaaacctcaccatactgggactatgtcattggcaacgaaacagaagctttagcctatgccgaatcgcatgatttgaataccaaagatattaaagagatagctaaggctcttgccgctctaccaaaaaaagaatacacaaagaaaaaggactgccatcattacgcaaggcaccgatcccaccattgtagcagtcgacggagaagaacccctcacgtttcctgttcatgttatcgacaaaaatctcatcaatgatactacaggcgccggtgatgctttcgcaaccggctttgtcgccggactggtatctaaaactatccctanctcaagcgatttgaccaaggacaatggctaacnaaaacttanantcaagggagctgggggccttcgtaanccctcccccgaaaaa

SEQ ID NO: 92579 - DNA, 165 bp, Triticum aestivum
  unsure (1)..(165): unsure at all n locations
  Clone ID: PAT_TA_92579
aatacagaagtttggcgatggagcgcctanagcctgtnaagggcctccanaaggtggntcaatgggtgaaagatcacggngtacaaacgtgccgcagtaaccaatgccccanngatcaatgcanagctcannatcaaacttcttgggctatnaaanttcttccag

SEQ ID NO: 92580 - DNA, 512 bp, Triticum aestivum
  Clone ID: PAT_TA_92580
tagccgctcgcgatccgattggaataacgagtttctatcaaggaagatcaagcacgctacctggtgccatcttctttgcatctgaacttaagtgtttaagtagcgtttgcgatgaaataattgcatttcctccaggtcacgtttatgactcgaaaaccaacgaaacgaccagatacttcaaaccatcatggtgggacccacacagacaaccagcagctccagtcgactatagacttctaaggaccactctagagaagtctgttaagaagcggttaatggcagaggttccctttggcgtacttttatcaggcgggctagattctagcttaattgcttccatcgcccagcgagagactctacgattaaaagctgcctcactagaacagtccagtaaactatttgatagcaaaggtacagtaataaacaatgtagggggaaaggaaaacaactagttggtatcgatgaagataataacctctcgactttggccaattactcagctaaacccttcc

SEQ ID NO: 92581 - DNA, 526 bp, Triticum aestivum
  unsure (1)..(526): unsure at all n locations
  Clone ID: PAT_TA_92581
gtaatcctacgcgctggtccctatcttagaaatcagatattattcaaagttcagtcaagcacagctgtaattacataccacacgatatagaattaagagtcttgaaatgactggaaccaagccagaggagaagatgctttggggaggccgctttaccggcggtctcgatccgctcatggcagcatataacacgtccattcactttgatcaaatatttcacacacaggacatcttgggaagcatcgcgtgggctagagcaaatcacaaggcaggcattctcacctctgaagaatttgttgccatcgagtccggtctcaagaaaggtcgaagaagaatggctatcaaatcaagttcaagattatacctgaagttgacgaagatatccacacagcanatgaacggcgacttggcgagctcatcggtacggaacttggaggtaaacttcatactggccgaagcaggaatgancagattgcaaccgacatgcgattatggntgagagatgaaccccgcaaaattgaacatt

SEQ ID NO: 92582 - DNA, 514 bp, Triticum aestivum
  Clone ID: PAT_TA_92582
agcttacactcaagtgaccagagaaatatacaacacctagcaaaaagaaaaaggtttccctccacatttttattcattaaaactcaaacttgtcgttatgacaccattgaaatacctcactttaattgctttcaccattatgcatgaagtcaatggagcttggacaatagaaaaaggattaaattgtggtggcgctaaatattctggccagaacctcgtgcaatttcgcaatacgcattgctctaatgagaggcatggtttttatgcactaaatcagtatagtcacccaagagagtcattcgaagatgaaactgggatcagtttatatttcttaagactccctacagtatcacagagtggtacaatgctttacagtaccccatctgatcactaccttgctgtaaacgaccgctgtgttttctattatggtgctacaattactgggatcggttcaagataatcaacaagtgacaagcaaccagatacaagagatcgtaacattgactggatattt

SEQ ID NO: 92583 - DNA, 540 bp, Triticum aestivum
  unsure (1)..(540): unsure at all n locations
  Clone ID: PAT_TA_92583
cattctcggacatgaaacccgaaacacttgccaccagcaaactggttgagacaaatcgaccaaacggagctgtcagtgtattacttggtcacataaccgccgtcatgaccgacaatctcaccaccattgaaaattcattcgactttccgggagattgggcctccaaaagttctgagccttcaatatttggtcatcgagaggcaggtcgcaccattgtactgcaatcagtcgcagttttacctgaatttcgaggacgaggaatcggaaagattcttgttaccgcctacaaacagcagatgaactcagcgggcatagcagatgatttggctgtactttgtcatgaaaatacagtagcctggtttgaaaaatttggcttcatcaaccaaggcctgtcaaattcacaagcacggaagcggcggttggtataaaatgactgtaccgctggctccagaagtagatcctactantgagtactgaaataaagaattgttgaactcgacgtttttcaaatcttagagtcccacaatggcctaattctgc

SEQ ID NO: 92584 - DNA, 544 bp, Triticum aestivum
  unsure (1)..(544): unsure at all n locations
  Clone ID: PAT_TA_92584
ctcgtgccgaattcggcacgagctcgtgccgaattcggcacgagaaactatttagtgtaaacctcctcgatgatagcggagagattaaggcaacaggatttaacgatcagtgcgatcaactctatgaaattttccaagaaggatccgtctactacgtgtctagtccatgcaaggttcagcttgccaaaaagcaatactctaccctctcaaatgactacgagctcttgttcgacaaggatactgccgtcgaaaaagcagaagatcaagaaagtgcgccacaaatacgatatagttttagtaccatagctgatattcaaaacgttgaaaaggactctatcattgatgtcataggagtactcaaagacgtctctgaatgtactcaaatcattgggcaaaacaacccaaaaatcttttgacaagagggagttatcgatcgttgatgacagctgctacatgattagnatcactatctggggaaagacagcaataactttcgatgccagtccaagagtcctgntggtagctcccaaagggtggtaaaagn

SEQ ID NO: 92585 - DNA, 517 bp, Triticum aestivum
  unsure (1)..(517): unsure at all n locations
  Clone ID: PAT_TA_92585
agggggaattgantattcnactacagataggtctgttcatgggcatatgttcgaccgccattgtttctagttctagaaaagtaaaatttcggnagaatacgcgtgttaggaacgtaaacaagtgaaaataagcaatccgttaagtgactcgctttcgtacagtcgcacgatcgaaattagtccctgaactaattggntaantaccaaaatttcgacgaaaaaagggttattttcactgaaaagctctctgtattcgtcgccgtagctctgcacaaacatctaagtcagccgcagttagatctgaatcaacaagcttttccaacaactgcgtcacgttgctggcaacttcatcgctgccaaataatctactatttgcacgcatgcagtcttcataccactgctcaatgacgtaaagaatatgctcagccagtatacgtcccttttgttcggtaaaangggttaaattttgataacacaatgtcctgttacacgccgataataacctcatgggagaacc

SEQ ID NO: 92586 - DNA, 558 bp, Triticum aestivum
  unsure (1)..(558): unsure at all n locations
  Clone ID: PAT_TA_92586
ctcgtgccgaattcggcacgagcttcagtattgtccgctcttttttgtccagtccatcacggtcaccaccatcttcttcaagtccttattgatccccttgcaaactggcgcatcaccactcccgccgttccaccacatccatagactaccaaaaacgattcatccgaagatataagacgccgagagtccaaagcccaccaccaggacctccctttacgtcaaaacctcgccaactcagtctttcgacagcagagctgctccttgatcaaagaagaaactttctgccaccatctctgtttgtcctcgcctctttcaaaatccaacactatgcgctccctcaatgccgtggcacttgcggctttggtggggaacaccatggctttctggcgaatgggttgccgagctcgatnaggcttaagtccgactagatccgttggtgacgccaggagggatctctgaacacatgcacgccatccaaggctccaagtggattttctgccaatgctacctatgaagagttgatggctgggagattgcacttcctgtgaaggttgccga

SEQ ID NO: 92587 - DNA, 547 bp, Triticum aestivum
  unsure (1)..(547): unsure at all n locations
  Clone ID: PAT_TA_92587
tcggaatatacaaattttaggggtaactcaatacatatcactgcgcttcttcaatgctggtgcataattattgaaattggaagccatgatgtgagcctcgagaccgagcccccccacctggcattccagtccctgtgaaagagtgaaaccctcctgcactgctttgagaaccgcccatctgggcgccaaacatctgcatcagaatttcagggtcaatcccacctcgcattcctccaccgtgcatcccaccaccaaaactctccataggatccatcaaatcttcaccactatcgtatcgcgcacgtttctctgggtcactgagtgtttcgtatgcctcgccaatatctttaaatctttcaagcaagcatttangtcatctggatttttgtccggatggtgggactattgcagccttccgatatgccttcttgatttgaccaagagtcagcacctttgtctacacctanggatttgataagtaatccttccgtttgctttcctcaagttcnaattcggnagctccttacttcnttccggtaacgtnggg

SEQ ID NO: 92588 - DNA, 530 bp, Triticum aestivum
  unsure (1)..(530): unsure at all n locations
  Clone ID: PAT_TA_92588
ctcgtgccgaattcggcacgaggccaagttcataagagagtggctgcctacactccaacccgactgtctctgcgtttacagtgatggttctggggcttcaaccgacagagtgtcatgggccattgtgacttttatcagcggcacaggcgcggcaatcgagcaaaacggctcaggcaagattatcaacgcggaggttcatggagctctggctgctctagaagcaatcactgctagcaatcgagattgaggacgcagcgctatctacatcctgctcgacaattctgctgttgttaaggccttactaacgggaacaaggagctcatcattctggcgtatacaaaagtttgtgaaactggccgcgggatctgctacgcctgtcaaaataggatggattccgggtcacgaagggctggcangaaatgaaatcgccgattaactccctcnaagagagcttatctcgccggacaactccaggacgacacatgatgtnatgaccctcgnctcttccaaaaaggaaactcncgaactgg

SEQ ID NO: 92589 - DNA, 536 bp, Triticum aestivum
  unsure (1)..(536): unsure at all n locations
  Clone ID: PAT_TA_92589
ctcagatgaacaccacgctctaatgcatctgaatcacgaatgcaaaatcaccgctatcaccatgtcaaacaaagataacgttactgaaatttgccacaggtacagggctcctcgtgagattcttctcccgaacgtcaccacttgactttagatgttccctaagatacgcttgatacttatacagcgaaattctgctcgacttccgtcaaatgacactgctatatccctcttcgcacgaatgttatctgtctttgttctgtcggccaactgactaaagtaaggttgtagggaaatatatggtcaatcttccaattgatcttttgatcaatgtagctacttgtctatattttgttcaaagtgcagttaattttggcaaaaataggaaaataaagccagtacgtggatggaattaggatgcccactctgcctgtttgatgaagaaaatgcattcaacgggtaacaatccatagtcctccaaatagctactcatgattcaacaaatttaacgcaaaanaaaaaaaaaaaaactcgagggg

SEQ ID NO: 92590 - DNA, 473 bp, Triticum aestivum
  Clone ID: PAT_TA_92590
cactcttttagtcaacttctactttcgttccatgaatattgcacccattacattgcgcgatatttccaacagattatgagaccaatctgactctaactaactgagtacagtcgtctattttctcgttcggattcaattctttcgattccgcaccatctccgatacgatgtaacagtccatcgatcgatcgattctgcagaaccctcacgtctactttctttgtcgattatcgcctatcgaagtctttcacacttttccggcgcaattttccctccatacgttcccaacttttcgcctatttataccttctgtctgttgtagaagaagagtttcttggtctagggatatttttcgttggaggagccgtggcactttctcggcatctttcttcctccaaatcttcccgagttttcaaccgtgtgtgccttctgtctgggttagcagaagagtttttgggtgaggggtacttttat

SEQ ID NO: 92591 - DNA, 488 bp, Triticum aestivum
  unsure (1)..(488): unsure at all n locations
  Clone ID: PAT_TA_92591
tttttttttttttttttttttttttatggacaaatggaaacctaaataaattagtgttaaataaaagtttctttagtgcacattaacatgatgaaacatgtatgactcatttttttgcttcaactttcttgggcctgtctattcccaatctttgtccaaatacttctcgttcaagtgaattcttgcatgaataaaatttcgattgtggcttcacagaaaattaatgaccagctcgtggaccaattgaatcattcttcgaactgtattttctaattccatcggattcttggatagtacccttttctattatctttttaattatctcctctttgatgcttgttccaaattcattctcaagcacggccattgagggctttcccaaactgccttgggcgccatgtttgccagtcacaaatacatcataactagcgacgacatttgctaaggctcgtgccgaattcggcacgagccgtgncgaattcngcacg

SEQ ID NO: 92592 - DNA, 485 bp, Triticum aestivum
  unsure (1)..(485): unsure at all n locations
  Clone ID: PAT_TA_92592
agacctgagcctcctttggggtgtacacaacgccgaggatatttcctcggctggagtcagtggagtggaattagtgtccaacaagtgcgggcgcataagatctggtagagtgaagctctctgggatccggtactttcctggagcgaaagtgaatttgattagcggcggcatccttgggtccctaggctgcgaaatcataatgaacgcaaaggggtgcaagatcatgaaggacgggcaggtgatcgggggtggccgcatgctgccgaaccgcacctactccgtcgacttcctcgacgacaagctactgggtggtggaatttgccaccactgccgacattaattagctcgcgaggctcttcactccggaacatctgagccaaggctgatttgttttgtcaaggtggttttaagtgaagaaacttccttaagttctcactgggacatgttgttgtaatattgancacgtgctcctacatantactccn

SEQ ID NO: 92593 - DNA, 492 bp, Triticum aestivum
  unsure (1)..(492): unsure at all n locations
  Clone ID: PAT_TA_92593
ctggtgccgaattcggcacgagcaggaaacggtgattgcgatgggctcactgtgattaactttgacaaacacacccgcacggcaaaaataatcaacgatctccagcgtttccagatcccctattccctaacagagattccagagctccaggactggattcattcgcagattcgtcgggtaaagcactcatctgagaatgaacatgtccagcagctatatagaaagagccttttattggaacctcgtgagacacaaaacatgtgtcgcaatcacagcgatgtttcttttcctcttctaccaaaggagaaatttgacctcttcagttgggcttacaaggaccgaagtaactctatcactccttcgacacatttataacagttattcggttcactacagctcaaccacacttttccctgattgattctggtttgaatttttgatttgatacccccattccttggaaagcgttttagcgaatgagacntacgcccg

SEQ ID NO: 92594 - DNA, 497 bp, Triticum aestivum
  unsure (1)..(497): unsure at all n locations
  Clone ID: PAT_TA_92594
atctcatcctgttcgagcctccttgttggcgtgtttctactttttcatcacattcatttcatcacattaaagccttggattagcttgatcttatttatatctctttaatgatatttaatctagccttcgatctttctttcaagagatttcatcatcaatctacgtttgaattatctgctataaaccttacttgggtgctgttccttgaattctaatacaatggagaaagagccattctctgagtcagaaaagcgttttgttgtgacacaaatactcaaggcgagctctatacccctcgagcgactagtattactcttgagcgactgtcatcaggaacctcattgggaacatatctatcttcccccagggcgaactcttcaagagtgtaaagatgcgtttgaagcattgatatcatctcatttctcgccctatccagggactagtaaccatacgtctancaagtactgctatcaaaaacgtaaaccgggaaactgaag

SEQ ID NO: 92595 - DNA, 395 bp, Triticum aestivum
  unsure (1)..(395): unsure at all n locations
  Clone ID: PAT_TA_92595
ctcgtgccgaattcggcacgaggttggcttctcctccccactcagtcctcggttcccggtccggttcggttccgttcggttcgttagggtttagtagcggggaagaggaaggcatggcggacgtcgagtaccgctgcttcgtgggcggcctcgcctgggccaccgacgaccagtccctccagaacgccttctccaagtacggcgacgtcatcgactccaagatcatcactgacagggagacgggccgttcccgcgggttcggnttcgtcaccttcgtgtcggacgaggngatgcnccaggngatcnaggccatgaatggccagganctgnacngcngcaccatcaccntcaatgaggcctagtcccgccgttcnggcggangcngcggcggcttc

SEQ ID NO: 92596 - DNA, 219 bp, Triticum aestivum
  Clone ID: PAT_TA_92596
aaattaaaacccaaacctaccaaattcatggatgatatcatcaaacgacattatcccttttctagaaccttcctcttagaaatttctagagctctcctttcctccaaagacagcccttcacacgcatcagccgtatcgtgagccaagtctggataattttctagcccacgactaaaggccacttgaagcaattgagtccttctctcaatcgcaggaaaa

SEQ ID NO: 92597 - DNA, 493 bp, Triticum aestivum
  Clone ID: PAT_TA_92597
cttgaatccaagctttaagcagttggcgtcatatttacaggctttctagtactgagcagaaaggtatgttgaggaatcaagctcttcatcacggcaaatatgctagaaaaaatctctgggcatgtaaaagttatgggtcgtttcaaccttctcgaggtctagcaatagtggctgatggcaaaacggtatctcgacagagtgagatagatccccgagcgcctccctacgcgaaactcaccgaaaagttaagcttagtgcggagattgcttggtgatgccagaaaactcacactagcggaaaaaatattgttttcgcatttaggtgaccctgaagaatcactactctctaactccgataacgggcgaaatattagaggaaatgcggtcctcaagctcaaaccagatcgagtcgccatgcaagatgcttccgcacaaatggctctactacaattcatgacgtgtagaattcccacaacagctgttccaactagcaa

SEQ ID NO: 92598 - DNA, 489 bp, Triticum aestivum
  unsure (1)..(489): unsure at all n locations
  Clone ID: PAT_TA_92598
cgcgaatctttctttctctcctccacctgccttggccgcgaaggcgccacctttccccagacccgccggccgacctctgcctctgcgccgctcgtctcgctcctctcttgtcttgtcgtgtaacacaaggcaggctcctgctctcgctgtgaacttgcgtggggggttcaatttggttttcatagattgagattgatttcggtgctcggagggcgggatgatggggttggggctgggcgacccgccggcggattacggctccatcatggcggtggggttgttcgtcgcgctcatgtgcatctgcatcatcgtcggccacctcctcgaggagaatcgctggatgaacgagtccaccaccgcgctcttgcttgggctgggcgctggcacggtcatcctcttcgcgtccagcgggaaaaactcgcgcttaatgggtcttcancgaggatttgttcttcatctatctgctcccaaccatcaatttcaatgnaa

SEQ ID NO: 92599 - DNA, 486 bp, Triticum aestivum
  unsure (1)..(486): unsure at all n locations
  Clone ID: PAT_TA_92599
ctcgtgccgcttacagatacctcatttccttatagcggtttgagaatcttacaatcgacaatatggtcaagacttccgtgctcaacgatgccctcaacgccataaacaacgctgaaaagtctggaaagcgtcaagtcttgatcagacccagctctaaagtcattgtcaaattcctctctgtgatgcaaaagcacggatatatcggagagttcgaagaggtagacgaccaccgatccggaaaaatagttattcaactgaacggacggcttaacaagactggtgtaatttctcccaagatacaatgtgcgtcttggagacctagagaaatgggttgttaagcttttgccatcccgtcaatttggatacatggtccttacaacctctgccggcattatggaccacgaggaggcacgaagaaaacacgtagctnggaagataantgggtttttctactaaatttcaaaaaatctggctaacaaaaaaaaa

SEQ ID NO: 92600 - DNA, 223 bp, Triticum aestivum
  Clone ID: PAT_TA_92600
gcgaagtcccgtgttgccgataaaagacccgccaacacgtttattctttcgctttggatctaactaaagttgtctaccaccaaaccatttaacttgaacttcaatccgccgtaacgcagaggttgggcctacactcaaaggactgtgaaccaataaggtggccgctgttccccccattccagaggatcaattttgaacatcatgaacaactcgcagggggggg

SEQ ID NO: 92601 - DNA, 508 bp, Triticum aestivum
  Clone ID: PAT_TA_92601
aaaataaaaaatgccgcctgcagtctattactgcctgataacgcctcgtaatgcgttccgtattaacccttacccgctccatatttagttcatattttgtggccctaagatctgataacagtcgtgaatgtggacagcttctcaggatttttgttaaccatctcacccaacgacagatttcatgcttagactctccagaaatccagctaagtcttctttcttcacttcaacaacgcaatgctcgaagctatcaattcgaactcgagcatttgtctcatcgattacttcttgaaatgcatttccgaacttatttcgtccgaacccccttgaatgttctttatcactttcctcgtcctctgactcttccgccgtcgagtccgaagattctgatgccgaagcttcatcgtcagtatcatttccgagggctagtatttttgcttctcttctctgctttcgcacttgttctttttccttttggcggagcttctgtgcatgagccttggcttct

SEQ ID NO: 92602 - DNA, 248 bp, Triticum aestivum
  Clone ID: PAT_TA_92602
ctcgtgccgaattcggcacgaggtagcttcactgtggcttaagctgcattcttcttcatttctcattcattttgcggaggatatcgttatacaggacaagaggttttgcgggtgttgccttatatgacacccatttggtattttctgatgcactggtgtttgtataaactgtattctggagtggtgatgaaggaagctgactggctgtaagaaaatatttccacttctgcaaaaaaaaaaaaaaaaaa

SEQ ID NO: 92603 - DNA, 516 bp, Triticum aestivum
  Clone ID: PAT_TA_92603
ctcgtgccgaattcggcaccagcacaaatctatccttacaaaccactttcacttctttatcattctcagatccaaaaatttgctcacgtcggataacaaattgggttgaattcaactcaaagcactttggatcagctaacccggcttagtatttaaaccacgatgttagaggcacgtcttgaacaggctgatttgctgaagaagatcgtcgatgcaatcaaggacctcgtacaagactgcaacttcgactgcaatgactctggggttgccctacaggcgatggacaactcccatgttgctctcgtatctatgatgttgaaagccgagtcgttctccccctatcggtgcgatcgtaacttggctcttggcctcaacctcggatctctgaccaaagttttacgtgctgcccaaggcgatgatatactcactatcaaagctgaagacgcacctgatgttttaaaccttctatttgaaagcagcgaagaatgacagaatcaatgagtacgacttgaagct

SEQ ID NO: 92604 - DNA, 518 bp, Triticum aestivum
  unsure (1)..(518): unsure at all n locations
  Clone ID: PAT_TA_92604
ctcgtgccganttcggcacgagcagatatctcccgaaaagacaaaactaaattcatcaaggcatcncgatcaccaaattcgagaaaaagcagacgtcaaggtagagaacgtcaaaagggtggtacaaatttgcccatcaatanaaacagtactcgaacacccgggattttgggcaggaaaactcctgagacaaatttttcgaccgcaaaagtacggtccttgagatcttttagcttgaagactaatactgctgttaatttgaaaaattctagctctanaatttccgaatctatccttggntctgtgaatagcttgattttggacctaaaagacgctcatctgaaaaaggaagatattaataagatagaggataagttaatggatatgaancgtgcattgtatgaagccgaaaagcgtggaagaagggcccacggngaatanaaattatctggagtgcgtttgatgangttcaaaatatcataaagtaattcggatcctatgaaaatcanagtaataat

SEQ ID NO: 92605 - DNA, 354 bp, Triticum aestivum
  unsure (1)..(354): unsure at all n locations
  Clone ID: PAT_TA_92605
ggcagttcgaggtggccgccggccagtccggcgagggctgcagctgcggcgacaactgcaagtgcaacccctgcaactgttaagctgcatgcactcgtgtgatggtgtgagagtatacgtgaataacgagcgtccctctgatntgatggagtcnagcaagggtgcgtgtgcgtgtgcgtgtggtttacttgctccgctctccgccctaatgctcctgnccttgggtggcctttgtggtgtatgttgttgttgcaacgttgtcccctgttaatttgcttcaatcctaatcctcccaactatnggatgggaagtgattgaaatatgttaagaaatgaatgattttacctaaaaaaa

SEQ ID NO: 92606 - DNA, 414 bp, Triticum aestivum
  Clone ID: PAT_TA_92606
tgacaatattccaaactggaaactcacagccgcgagcaatccaggatgattcggacgttgaagaggaagcccttgcggccgactacagagaacaaattcagtatgaggggctggaagtactagaccacatgaattcggcaaatatgacacagcaagcagacgatattcagtccagacttgtagcagcctcacaacctctagatttttctgctccaatcgaagtgaaatttgccagctacgataattattgtagcttgttccattacatcctgaactcggatggacctgttgatctagagccgccttcttattattgggcatgggacgttattgatgagttcatttatcaatttaattctttctgctcttatcgaaaccgggtggcccgccagggtagcaatgaagaaagaaaaa

SEQ ID NO: 92607 - DNA, 507 bp, Triticum aestivum
  unsure (1)..(507): unsure at all n locations
  Clone ID: PAT_TA_92607
ctcgtgccgaattcggcacgagctcgtgccgaattcggcacgagaataagcaggaaccagtcctactgttattttatccctacatagccttgaacttcatatctgacggcttggtaatcagtattcacaattggattccccagatctaaattttcgaaatgaagtttcttagcaccacaataactgcagtgtttgctggtatttcactactggtaccaactgcttatggaaacctacaatacagatgtgaaattggcgatcccattacagaatcacaggttcttgaaactgtcaataaaagttttttgatagataattctcctcaacacccagctattcccacaacagaaccacataagacatatttttccacgagaccttggagtggaagtgaatcaggtatagcttctttccttatacaagtttatgggcaacctccaaaataccaagtatatcaaggagttgcccgaggttggagactgtgtactttagaaaatgggaanttac

SEQ ID NO: 92608 - DNA, 501 bp, Triticum aestivum
  unsure (1)..(501): unsure at all n locations
  Clone ID: PAT_TA_92608
aagcgccgggccaccggtgggaagcagaaggcgtgtaggaagaagcgaaagtatgagctcggccgccagccagccaacactaagctttcgagcaacaagacagtgaggagggtccgtgttcgcggaggtaacgtgaagtggngggctctccgtctggacactggtaacttctcatggggtagtgaggctgtgacccgcaagacccgtctcctggatgtggtttacaattcgtcaaacaatgagcttgtgaggactcanacccttgtcaagaatgccattgtgcaagttgatgctgcccctttcaagcantggtacctgactcattatggagtggaaatcggtangaaagaagaaagctgctgcaactgccaagaaggatgctgctgaaggacaagagtccgaaggtgctgctgctgccacanaggaagcaaagaagaacaacaatgtccaaaaggaanctttagaaaccncaacaagggacgtncaactggnctcccaana

SEQ ID NO: 92609 - DNA, 255 bp, Triticum aestivum
  Clone ID: PAT_TA_92609
gagagagaaccccaagatcaaggaggccatcaccgccaagttcaccgagtacctccgccgcgcggaggagatccgggccgtcctcgacgagggcgggggcggcccccccggcgcgcccaacggcggcgacgcggccgtcgccacccggcccaagaccaaggggaaggacggcggaggcgacggcgccggcggggatgactccgagcagtccaagctgagggccggcctcaactccgccatcatcaccgagaagcc

SEQ ID NO: 92610 - DNA, 495 bp, Triticum aestivum
  unsure (1)..(495): unsure at all n locations
  Clone ID: PAT_TA_92610
cttcaatcctagcttaaccagaccacctcgcatccaactcagtttattcatatttacgtgtcaagccgttctctagtttgactgcttgcacccatctcaattttcgacgtcaattaagatgttcagaaacgctatccgacagtctggtaggactgtaggcgcaatctctgtctcgggtcgagttactacagttgcagcgaaacgatctgctgcaccctcaacgataaaaaattctctaatcccatctcgatgctatgctgtcgaagcaaaagctaccccaacagaagtatcatcgatccttgaggcgaagatccgaggtgtacaggaagaagcaggccttgccgaaacaggtcgcgtcttgtccgtcggagatggcattgctcgcgtccacggtatggccaatgtacaagccgaagaattaattgagttcgcgtctggtgttaaaggaatgtgcatgaatctcgangctgggcaagtccgagttgtacttttcgg

SEQ ID NO: 92611 - DNA, 511 bp, Triticum aestivum
  unsure (1)..(511): unsure at all n locations
  Clone ID: PAT_TA_92611
caacagagagcattctaccaccgcaccgcacgagtgaagtgagagctttgcacgaaaagttcatcagcgaccatgaagggcaccaagctcgcggcgatcctcatcctccaggccgtcctggtcatgggagtcctctcacacgtgaacgccgactatttccccaagtgctgcaacaactgcaggtccttctccggggtcgacgtctgcgacgacgcccaccccaagtgccccaagggctgctcggcgtgccgcgtggtgtcgacgagccccgaaatgtggcgctgcgcggatatgaaatccaccgtcgacggcacctgcggtgggccctgcaagaagtactgatcggctcatgccagcatgatatgttccgcctaaaatgaaataaaagctcagacgaagatgagcaacgtcatcgtgcctatgcgtgtgtgtgtggccaacaaatatgtatancagtatgccgtgtcttcgtcgctgtgttttctcctccccangggggggcccggtacca

SEQ ID NO: 92612 - DNA, 249 bp, Triticum aestivum
  Clone ID: PAT_TA_92612
ctcgtgccgaattcggcacgagctcgtgccgaattcggcacgagagcgaacatgcgctgtgcaaatgtgtatcaagtactctagtatatactgtatcgtgcataattgcatatatacatgcgagttgtgtcccccgcaaaaaaaaaaaaaaaatacatgcgagttgtgatgttggctgtgtagcattctttttgacagttatgaataatattaagtgattgtgtaaaaaaaaaaaaaaaaaaaaaaaaa

SEQ ID NO: 92613 - DNA, 514 bp, Triticum aestivum
  Clone ID: PAT_TA_92613
ctcgtgccgaattcggcacgagggcgctcgacggtgtgctcgagaaggtgatcggcgaccaccgccgccggcgtcaagccggccagcagacgggagatgacggcggcgatcacagggatttcgtggacgtgttgttggacgtgagcgatactgacgacgaagctggcatgcgtctcagcacgaccgaaatcaaggccatcattttggacatgttcgcggcgggcacggacacgacgagcacggcaatggagtgggccatggcggaggtcatcacgcacccaagacagcatgcgtaagctccaggacgaagctcagggcggccgtcggtggctccgggcacgtcatcaccgaggaccacatcgacaagctgcactacctcaaggcggtggtcaaggagacgctacgcctgcacccaacgattccgctcctcgtgccccgaagagccacaagacgacgccgaagatactcgggcaacaacgtcccggcgggcacccggtggtcatcaacgcgttgg

SEQ ID NO: 92614 - DNA, 518 bp, Triticum aestivum
  unsure (1)..(518): unsure at all n locations
  Clone ID: PAT_TA_92614
ctcgtgccgaattcggcacgagtctacgtacagactatcgaatctatcagccaaagcagatctcaatttatatatgggctggtcaaatttctgacgttaagagcccaagtgctttatttgtcaggcccatcatgtctaacctattttcgggaattagcggacgctttcgtggtacgggcaaaggtgcaggtgcgaaaagtcccggtctaccaccatctgcatcatcatcttctaccggaaatgtagcgaatggatcttcaggtggaatggctccaagggtacctccgcttcctaattcgccatcactcactcagacgttctctatggaaaattccgagtccagcccagcaagaagcgatgttcttagccattataacctacctcgtcccaagccactttggataaatgactcgtacgccaagcatattgtgaaggggaacttcatgacactatcaactcganccaaagaacgttgaacaaggagaatggattgcgcatcaagtttgttgacaatacag

SEQ ID NO: 92615 - DNA, 202 bp, Triticum aestivum
  unsure (1)..(202): unsure at all n locations
  Clone ID: PAT_TA_92615
cagataacaacaggaactgaggctttcgtgatcaagaaaagttatatctcaactctaactggcaacaaaagaaataatttaatgaaaggncaataaagtgggcaacaactttaaatggacccaagactggattctgggaggntggttaagggttccccctngcgcaantnacaaactttnangcntaacctaaaggtaaaac

SEQ ID NO: 92616 - DNA, 395 bp, Triticum aestivum
  Clone ID: PAT_TA_92616
ttctcatcggctcagctgttctgtatctatcaccatttgcagttgacgctataattaagttgctataaatgaatcaaagaaatccttggtctagactttctagcagtaaagactccagaaatttgtccactaactctcgacatgaaatttgcattaagcactttgtttctcaaattatgtcagaaaactatacctgatttcaatttttatttatgtaacctcaaccaacagacgggataggagtttaataaatcagagataaaggtctcagcgatttatatgttagcgagctcggtattgaatggatatccagacctccacatacgatctggatgaactactatcaatgagtgctttgcactgttgaaaaaaaaaaaaaaaaaaaaaaaaaaaaa

SEQ ID NO: 92617 - DNA, 494 bp, Triticum aestivum
  Clone ID: PAT_TA_92617
ctttcttatcctccaatgatgtcacttcaaagccatgtggctgctcaacatatacctcttcatgaattggactatttaaaaatgctgttttgacatccatttgatctatgtccaagtcatgagatgcagctatgctgaaaagtatcttgtatgacattggcttcactacacttgcaaaggtgtctgtaaaattatatccctcctcttgctggaagcctcttactacccatcttgatttatattttatgatctttccatccaaatttgatttggttctatacacccatcttccttggattactttgcatccatttggtggaactgacacaagtttccatgtcttattttctactattggcttgatttcatccctcatactttccttccacttattagattcatcacaagccattgcttgctcaaatgtttctgggagtaaattgaatgattgaatcagttgcaacaagacatttgctggatgaatgctctggcat

SEQ ID NO: 92618 - DNA, 511 bp, Triticum aestivum
  unsure (1)..(511): unsure at all n locations
  Clone ID: PAT_TA_92618
ctcgtgccgaattcggcacgagggccggtcagccaagcctatccacatcatacaagagctaggaagctgcgtatcagtgagtctagctcgagaccgaaaccattactttccatccatccaccataatggcggtggcgtcgactctgcctgggcagctcgtggcggtggncgctcttcttgcgctgtccgtcgccatgacggcgtcggcatcggcgtcccctgcgcctgcgaaccggagccgccgctgctacaagcatctattcagctttggcgactctctcatcgacaccggcaactcaatggtcaactccactccgccgggccccgtcctaaagctgcctacggtgagaccttctttggtcgccccaccgggncgctggtcngacgggcgcctcgtccgtcgacttcatccgtaaggttcttcgatggcggtcaacatcttaagtacgcanttgnttttaagtaananggaatttctcttccganttcaattgacgcaaangggaagtnt

SEQ ID NO: 92619 - DNA, 353 bp, Triticum aestivum
  Clone ID: PAT_TA_92619
ctcgtgccgaattcggcacgagattagattttctggacagttgggtttggcatattcatttcattggtgaagtctgaggaggtctgttcttgcaagtgggatggagttcaactgcattatgatggttaacctcatcttgcgcggcccactcgtttccctagctcctcaaagagtgctgaggctacctttgcccttacacgttaacctaaaatcaaaagtgaagcatcatctcaagtttcttccgcaatcactactgcaataatcttaatattcattcatgtttcacttgaagtaacgcctgtaacaaacttttgacaccaatatcaataaaattttgcccccgaagaaaaaaa

SEQ ID NO: 92620 - DNA, 512 bp, Triticum aestivum
  unsure (1)..(512): unsure at all n locations
  Clone ID: PAT_TA_92620
aaaaaaatggcaaaaaggtagtttacacatatgtacgtccgagacataagaggaagtcagtactggtcgtctagcttccacacctcatggaggagcctgtacctcgccgtgtttgagccgctgacctgcttcagcttggcaagcggattcgttggcaccttggagatgaagctcaatggcgagctcagctcatcgagctcgtcatcactcgtgttagacttgcggaggactgccaatccgctcttcctaggatcacaaatgatgcttaggattgtgccaagatgcagggtaagagtacaagatgggtgaagcactgcatggtatcgcccgtatgcccttgtcactgctctccaagatgatcctccaattctagagcctgaagcaaggaatcttgaattgggtctgggcaaaattcatctggtacaaagccaacaagtatgttcctgacaatcgatgaactaaaggtgggacaaatcctctttcctggtactgggtttcaatgagcanatccc

SEQ ID NO: 92621 - DNA, 495 bp, Triticum aestivum
  unsure (1)..(495): unsure at all n locations
  Clone ID: PAT_TA_92621
cgctctccccctcgtccttcgccgggaaggcggtcaaggacctgccgtcgtcggcgctcttcggggaggcgcgcgtcaccatgcgcaagaccgcggccaaggccaagccggtgtcgtccggcagcccgtggtacgggtccgaccgcgtgctctacctcggcccgctctccggcgaccccccgagctacctcaccggcgagttccccggcgactacgggtgggacaccgcggggctgtcggccgaccccgagaccttcgccaagaaccgggagctggaggtgattcactgccggtgggccatgctgggcgcgctcggctgcgtcttccccgagctgctcgcccgcaacgggcgtcaagttcggcgaaggcgtgtggttcaagggcggctcccaaattcttcagcganggcgggctcgactacctcggnaancccaagcctgggtccaacgcgcaaagcatcctcgcaatctgggcctgcaagtcctgctcaatggg

SEQ ID NO: 92622 - DNA, 302 bp, Triticum aestivum
  Clone ID: PAT_TA_92622
ctcgtgccgaattcggcacgaggtgggaacaacctgactgggccgatcccagcatctctagccaacgccacagccatggtgtctctcagcctctccaacaatagcttcaacggacaggtgcctcctgagattggcacattacgcctcagtaagttggagatgtccaacaatgagttaactgcaaccaatgaagacggcggttgggaattcttggaccgtttgacaaagtgcaacagcctagaagttctttctctggacaacaacaagttcagtggcacaatgccacgctccatcggcaacct

SEQ ID NO: 92623 - DNA, 502 bp, Triticum aestivum
  unsure (1)..(502): unsure at all n locations
  Clone ID: PAT_TA_92623
ctcgtgccgaattcggcacgagcacgcatctttgatattgcacttattattgattcaagagggtcaatgggatttcccgcaaagccttgatatgcgtttaaacacaataattcctggagtcatcgtaaccgtagggaaaaatgacactccgcatgtgcagactatggtatcatacaactttgaaggattgcacctacaggatccagaggatgggaatgatattcgagacatgacagcttcgtggctcccaatacaatttcaaccacataaaaatagagaagacgattataagcagagaattggaacggataaacatctaagcttcgccacgtacgaggccacgcggaatgggaactaccagcttcgtaaaaaggtcagactgcaggatgataaattatattctgtgcaagaggtacaagactatgatagaggaatacaagccacatcaccgccggcaaggaaaggatctccccgccgaataaagcaaattcgccatatttan

SEQ ID NO: 92624 - DNA, 502 bp, Triticum aestivum
  unsure (1)..(502): unsure at all n locations
  Clone ID: PAT_TA_92624
ctcgtgccgctcgtgccgaattcggcacgagccaaacgagggagaaactaaagtcggcaaaattacggatagattttgtctcgaataatatttcctccgaatatatggcgcaagaccttccaccaattgggggatatgatcctgtccagtataagcgtaacctgccggcccgcggatttcggccgtcaattttactattcggtgttgccggtatcatgacatatggcttctggcgtgtgggtcaggggattcgtgagcataatgagctcgcacgcgagaaaatgtggtcgcgcattcaccttatccccatgctcacggccgangaggatcgagatcttgtaagacgccatcttgcagaccangcgcgcgaagaatctttgctgggaaccaagacgagtccgtncaacaagcgatagatatgtccgacctacatttgcaattactcccgggaagattacaaaataacaatantcaaggtaattgagggaaacaagggaacaag

SEQ ID NO: 92625 - DNA, 531 bp, Triticum aestivum
  unsure (1)..(531): unsure at all n locations
  Clone ID: PAT_TA_92625
cgctcccgggctctctctgtttgctctcgcgtccgccgcgcccatcctcgtccgcgcctgcgccccgaccgtgctcgccgcctcccgcccgatccaccggtccaccaccgcgccggcggcatggcggatcagctcaccgacgaccagatcgccgagttcaaggaggccttcagcctcttcgacaaggacggagatggttgcatcaccaccaaggagctgggaacagtcatgcgttcgctggggcaagaacccaacggaggctgagctccaggacatgatcaatgaagtcgacgctgatggcaatggcaccattgacttcccagagttcctcaacctgatggnccgcaagatgaaggacaccgactcagaggaggagctcaaggagggcttcaaggtgttcgacaaaggaccaaaacggnttcatctctgctgctgaagctccgccacgtcatgacgaactcgggcgaagaaactcaccgacnangangtgggccaagatgattcgttgaanccgacgtcnacggngatggg

SEQ ID NO: 92626 - DNA, 448 bp, Triticum aestivum
  unsure (1)..(448): unsure at all n locations
  Clone ID: PAT_TA_92626
cttagattaaacacacatccttgtaatctttgtataacataccaaaagtttacgtgaggaaacgatcatcgcagaaatatgagcttttacgagacatccgaacgcgttcgtctttgacagagttcaaatctggaattattcggatccaattcttcttaacttcgattacagataaccttggctcatcgtatattcacagtggtgtacttaacgttttcttaggaaagcaaaggtcgataccaatataatgattgaacacaagcccaggttgaagtcacaatatccttcacttcttaaaggatagtttataaacatgcaagaataaattagtactgtgctattantgggttgagaaaaatanacgtccacactncanacaagttgggggctgaaaactcaatccaagtgacgtaaagcaatcaagtgnactggggaatgtcaatgcaat

SEQ ID NO: 92627 - DNA, 514 bp, Triticum aestivum
  unsure (1)..(514): unsure at all n locations
  Clone ID: PAT_TA_92627
tccccttccgtccttcgtcgccgccgctctagggtttcctcttcccgatccccgatccagcagcagcgagcgagcgatggcggccgcgggagacgccggcgagaagaagatgatcacgctcaagagctcggacggcgaggagttcgaggtggaggaggcggtggccatggagtcgcagacgatccgccacatgatcgaggacgactgcgccgacaacggcatcccgctccccaacgtcaactccaagatcctctccaaggtcatcgagtactgcaacaagcacgtccaggccaagcccgccgacggggccgcggncgccgccggagcctcggacgccgccgcccccgccgcccccgcggaggacctcaaganctgggaagccgagttcgtcaaggtcgaacaagccaaccctcttcgacctcatcctggctgcaaactacctgaacatcaaggggcttttggactaactgtcaagactgttgccgacatgatcaaagggcaagancccngnggg

SEQ ID NO: 92628 - DNA, 516 bp, Triticum aestivum
  unsure (1)..(516): unsure at all n locations
  Clone ID: PAT_TA_92628
tttcgatgttccacagtgacagcgtgcgcttgatactattgtgtgtttggcaccattccggggccaggatcagcttgtcttcgttctctagttcctcttttcggattatcatacgaattatttgagactagcccttcttgtcggggctcgatagcagtttctcttctcatcaagagttttcggtgatcccgacgaggcgctctangaacttctggctcacacaggggttcangtggtgtcattggttgtggaagctgtggtaattcangagtatcaacaaaggatncanggaaatttgatggatnangagtttggggacnaattggagtancnaatgttgcccaaggggtaattcnantaagaaaaggtggcncctggncccaatgttcaaccccaatttgggaattgantaagtccaaaattgcttcccccggtttaatgggcaaggaaaanggcctttcccagttacctggantggacctttgtcccgggaaaaaaatcccaaatataatgcan

SEQ ID NO: 92629 - DNA, 387 bp, Triticum aestivum
  Clone ID: PAT_TA_92629
ctggtgccgaattcggcacgagatcacgatgaactggaggaagttctacagattgttaaaccgcagcatttcttgcctgttcatggggaactcttgtttctcaaagaacatgaattgctaggaaggtcaactggcataaagcacactactgtaattaaaaatggggagatgcttggtgtatctcatctaagaaacagaaaggttttgtcaaatgggtttgtttctttagggaagcaggactttaagctaatgtatagtgacggagacaaagcttttggaacgtccactgatctctgcatcgatgagagattcaggatcgcatctgatggcattatcctttgtcagcatggagatcttcccgacctaaaacctgcttcaacacagtct

SEQ ID NO: 92630 - DNA, 381 bp, Triticum aestivum
  unsure (1)..(381): unsure at all n locations
  Clone ID: PAT_TA_92630
ctcgtgccgaattcggcacgagcaatactatctcctgccataccttatgacacgcgcgatagacctcaagggtcgataaaaggatccctcgcactctgtcagtttgtctacaatacgaaggtcacctaatttttattcacaaaggctaatagaaatcgcacataatggtggacaacacctctcctgaccaagatgaaacaaacgagggtgcctctctaggtgaacagttgatcgaagctgctcgtcgtaataatacccaactccttaatgacatcatcaaagctgtctcggatactgaacgcctcactgctctattaaacaacactaagaccgttacttgggaactacatttaccacgaagcggnacttcaagggaactat

SEQ ID NO: 92631 - DNA, 375 bp, Triticum aestivum
  Clone ID: PAT_TA_92631
attaggtcgtttccaacgccccaaaacccatcctcatgtcaacgaagatagcatatcaacattacttgcgtgcactgtcacgctggcctcacgatgttcttcgtccggagtgccgattccaggatgtcctacgacgacgcatcgatttgagattactgccgaaagctaaccaaaatggtcaggattcgttagcacgcagtgtcgtgccgaaaaagattaacgaaaaagatgaattagcacaggctaattctctctatcttctgctagaagatcgtttctgcaagaagtatccgctaaaaggctccctcctgaagccattgagtaacccaacctattactccggatctaattacggaattggaacacgcaccgctc

SEQ ID NO: 92632 - DNA, 381 bp, Triticum aestivum
  Clone ID: PAT_TA_92632
ctttgacattgtgattgctttagatctccatcctaacaccctgaatataatcaataccgctactagattgaatcataagcctttctatgccgctggggtacatggtctctatgggtttctcttttccgaccttatccagcatgatttcgtggtggagcgagaaaggggcaatcgaaacacatccgttacaactgaaactaggactagaagtgttgtggaggtgaaggaaaagaaagaaaatagtaagaccttcgagctagttagcaaacgcgaacttttctctacatggttcctagccagcgacgttgctgggcctgccggatgaatttctcaagagaagaaatcgatttgaaaagccgtcacgcccattctttcctgctt

SEQ ID NO: 92633 - DNA, 486 bp, Triticum aestivum
  unsure (1)..(486): unsure at all n locations
  Clone ID: PAT_TA_92633
ctcgtgccgaattcggcacgagctcctagcaagctatatacctacatagtacagccatggcccccaccgtgatggcctcgtcggccacctccgtcgctcctttccaggggctcaagtccaccgccggcctccccgtcagccgccgctccaacggcgctancctcggcagcgtcagcaacggtggaaggatcaggtgcatgcaggtgtggcccatcgagggcatcaagaagttcgagaccctgtcttacctgccancgctcagcacggaggccctcctcaagcangtggactacctgatccggtccaagtgggtgccttgccttgangttcancaaggtcgggttcatcttccgtgtgcaaaatgcgtntcccgggtactacnacnggcgctacnggncaatgtggcaactgcctaatgttcgggtgcaccgacgccacacaagggatnaacgaagtggcgangtcaaaaanggtacctgacgcgta

SEQ ID NO: 92634 - DNA, 382 bp, Triticum aestivum
  unsure (1)..(382): unsure at all n locations
  Clone ID: PAT_TA_92634
cgccagccagccacacagtcccgagcagccagccggtcgcctcactcctcgctcgtgcgcattgtccggcaagcaacgctcgctacgcgcggcgtgggtcatggcactactgctgctgcgcggctgcctcgcgccggtcaacgccaccgccccggcgtttcggcgaggggagacgacgagcctggttagttaccgccggccgtcccggttcggcgcggtcgtcgcctcggccgccgcgtcctcgccgtccgggggcgacggcgcgaccgccgcggtggacgcggtgctgcgcggctcggaggggtccaagggcaaagngctcgactacggggggaacaacggggccgtttgtctccggnaaccgctangtcangaacatcga

SEQ ID NO: 92635 - DNA, 523 bp, Triticum aestivum
  unsure (1)..(523): unsure at all n locations
  Clone ID: PAT_TA_92635
cgacggcgtcaccaacatgctcatgggctgggactgactgaccgactggtctcaccatgcctcttccttgacattcagtcttgttgcaaaagacagagaccggcttcatttgtttgttttgtgtaagtangtgccatcgactcgttgtacatagggagggatgttgatggctgctgctgctgatgtaaattaagtggtttcaggttgctgttcactgggatagttaggtcactctgcatcaagtctgaaatactacgaagaagtcatacttgccttgtgttgttgctaggcaatgaaatgatgatacattgatagaccagtgttgttgggtctgaggtatgtagtgtatctttgcccagctcaaactggtgcactagtattagctagtgattagcacagtagggcangttaagcaagtggttccgacaatactattaatagttggcaatgcttgctgattttcttaatttattttattttatgaaaggggtcacaattgctccccnttttcantacnaaaaaa

SEQ ID NO: 92636 - DNA, 516 bp, Triticum aestivum
  unsure (1)..(516): unsure at all n locations
  Clone ID: PAT_TA_92636
ctcgtgccgaattcggcacgaggagagagagaactcttggggcagttttctgcagaaaaccttccaaacaaagaactgaagcagatgacaaataattataacccgcagaacgattacactacacactcaactaaccagccaactgcctccttgaccctccaaacagataatcataatatgggatatcacgtgtcaaatgacctcgatagctcggtctatccagttggnaatactaatggcataaacccaattcacagtgagcatattcacaatattccttatgctcctccggcgaatattttaattcaaacctctatgcagtcagaaataattccagaaaacagtccatctacaaagccaaaaaaaacaacggtaaaaccattatggacagacggnaaaccaagtattctacttgttgaagatgataaagtttgtgctcgtatcggtacaaaatttcctcagtccnttgattgggctgttgatacagcacacgatgggttgggaactgttaacaaa

SEQ ID NO: 92637 - DNA, 386 bp, Triticum aestivum
  unsure (1)..(386): unsure at all n locations
  Clone ID: PAT_TA_92637
gatccaagtatttgaaggagaacgccaacgtacaaaagacaacaaccttctcggcaaattcgagcttactggaataccacctgccccaagaggtgttccccagatcgaggttactttcgatttggatgctaatggaattatgaatgtctctgctcttgaaaagggcaccggaaagtccaacaaaattgttatcacaaacgacaagggtcgcctgtccaaagaagacattgagcgcatgttggcagaggccgagaagtacaaggcagaagatgaggcggaggctggacgcatcagtgccaagaacggtctagagtcgtacgcttattctctgcgaaacacattgtctgattcaaaggtttgacganaagattgacgcccgctgataa

SEQ ID NO: 92638 - DNA, 374 bp, Triticum aestivum
  unsure (1)..(374): unsure at all n locations
  Clone ID: PAT_TA_92638
aaaaggtatctgaacaagtcatagacgagtgcaaatcagctgctgttctctacaagcacaagaagacaggcgcagaagtgatgtccgtggcaaacgatgatgagaataaagtgttcggcattgtattccgtacccctccgaaaaattcgactggcatacctcacattcttgagcatagtgttctctgtggatcaagaaagtaccctttgaaagagccatttgttgagctcttaaagggtagtctgcatactttcctgaatgcgttcacctatccggatcggacgtgttatccaagttgcatcaacanacaccangggatttctataacttggttgatgtataccttgatgcctgtattttttccctaagtgtgt

SEQ ID NO: 92639 - DNA, 378 bp, Triticum aestivum
  unsure (1)..(378): unsure at all n locations
  Clone ID: PAT_TA_92639
cgaccatctacatgagatgttacaagaggccgtaaagctgggcgctacaaacttctgaacagccagccaagatattctcggcctttgcaaccatttccgtcactcttgccccgggaaaaatcgaagattgtgctgaaagctcagaaaagtcttgacggagactatttgatatagtagctcactccaactctttcgtccagtcctggttgctggggagtgtggcagactcaatgggctggagcctgatagaagagactgctgataggtgctgagtatgtctctacgggtgccgattactcaatattgctanaaatatancaacangacaagatgaactccgtactctaaccttatcaatacanttttttgaagggggcc

SEQ ID NO: 92640 - DNA, 375 bp, Triticum aestivum
  Clone ID: PAT_TA_92640
ctctaccaaagcagaacagctcgcttttatggaaattaatcttaagccccgtcaattgttcaaataagcataacactaacttcatgtttctcgctttggccaaatcgtgttccataaagatgatagtatcatcagcgtactgcaggatggacacaccaccatcaaccaaatgaggcaccaagccacccacctgaccggcctcttttgcccttcctatcaggatcgccaacatgtccaccacaatattgaataatattggagacataggatcgccttgtctcaatcccttatgcgtttggaaataatgacctatatcatcattcactttgattccgacactccctttttgcgtgaatgcttccaacctggcgtcgc

SEQ ID NO: 92641 - DNA, 488 bp, Triticum aestivum
  unsure (1)..(488): unsure at all n locations
  Clone ID: PAT_TA_92641
gagggaagcatggatttgtagaggtgctagagctcgattttaaaatagagattcaataacattttgagcggcatactttcgctgtcaacgtaacaactatgagatggccgtatctttttggatcatgggactgggcatcccggttaccggcacttcctcgtgaatgaggagcagagtccactcctcttgagaataacccacctagcatggaagatataggcagccctagttgtaacatgagctgctcgagcatacaaaacaggatttcatttgatggtttggagtttggcacataaaaatttacttggaacgacaggtaaatactgcatataggaaggtacagtggactcatatggaacaactttggggtttaaggagtttggatgcacacgtagtattcctgcttagtacaggtgaaggctagcaaaagactgggaagcgaccaactgagagagcgacaacagtcataaacatgcattaanattaat

SEQ ID NO: 92642 - DNA, 382 bp, Triticum aestivum
  Clone ID: PAT_TA_92642
ctgtggcaagcctctgttgacttccatcgcgcgcaaaggccagcgccctggatctaggtactacaagtgcatggattacgatgacgggatatgctcgtttttcgagttccaggataagtacgcacgacgcctggcacaggagccaccgacggccattcctcaatcagcgctgccggccggctgcagccgtcgtagtgcctgcagggcgcggatgcagtgccgcgcctgtcatggccggaaatcccgcactcgcaggtgcccaggagcagggggcacccatcggcaggactgttgtgcagaagtcggtagatctgcaaggggtcattgctgcggcgagcctgctggtgggctgcgccaacctgctgattaccaatattcgcat

SEQ ID NO: 92643 - DNA, 300 bp, Triticum aestivum
  unsure (1)..(300): unsure at all n locations
  Clone ID: PAT_TA_92643
cttcgaggaccgaaggccagcatcaaatgccgacccgtaccaaataacaggtataatggtagagacaatttttggtgggctcgacaaatagggatttattttaagtagattaagaccaaagagaatatgacaaggcacagagccggggtactactctttactggagtaagcgggttttttggaagcgatgatttactcctaagtacatggagataccgtgtattatatctgcccagctatgcacatagtgccgcgagccaatagaagctacatatattctagaaaaaaaaaaanaaaaaa

SEQ ID NO: 92644 - DNA, 504 bp, Triticum aestivum
  Clone ID: PAT_TA_92644
ttgaaatatgtacagaaaaaatgttgaccatgtattaaaaaatgttaaatttgcattgtaaaaattttaaacatgtattagaaaaatatggaatgaaagccaaaagaaacaaagaaaaccaaaaaatggaaaccgaataagcaaagaaaaaaggaaataagaaatcaaagaaaaaaagaaaaaaaaagaaaaaaatggagaacaaaaaagaaaagaaataaacaaaaataaaaaacccaaaaaaccggttcgactcaaatagaccgcgccctcgtatgtatcacatactgtaggagggtgaggtggctagtagcggtggctttcttcatggcgaccagggattgatccctcgtgttccactttctcttctctttttatttagccctgcgcaaaaatggcccggtagaaagcgagcgctcactgggaaagaaggcaccacgcgccccctcagccaacccgcgacctcgggccggcccaagtgcggaaaggggctcccttgttttt

SEQ ID NO: 92645 - DNA, 507 bp, Triticum aestivum
  unsure (1)..(507): unsure at all n locations
  Clone ID: PAT_TA_92645
ctcgtgccgaattcggcacgagtttggctaagcaataaattctaacgtaatgaatgccttcaactaaaaaatatcaacttgcttcttaactgctaataggtatacatgctgacgtcttgctgcgcattctgagctcactgagcgcgaagtgcggccaaaaatacactaatcctgttgatattgttttccccatcgcatcgtaaaatttatttaaaatttcaaccatcccgcaaatgtacaccaagcgcaaaatcaatcaaacttcttactgaaagacggaaaaagaccaagctaaatttgattactcggctttcttgtcatcggctgttgcagcttttgcgttcgccgggctttcttttccgacatcttgagcacttgcggcanggttcgaggatggaacgtcgtcgtcaacgtcatcttcatcctcaacgtcctcgtcttcancttcttctacgctagctgcgccaagcttcgtcatcaacatcgtcctcaacatcggtcctcatc

SEQ ID NO: 92646 - DNA, 494 bp, Triticum aestivum
  unsure (1)..(494): unsure at all n locations
  Clone ID: PAT_TA_92646
ggaaatttcattcattcgagataatgatttgcttaggtacgataagatccattgatggtaaatgtgcaatcattcataacttttaataaataaccacctacaaaacagatacttagagagtatattcattgtaggggggttattaacaatacaacatgggagttactaagagtgttacaacatgatacaaataagcagaaacaactgttgcaaactcaagagaaaagacaattcaaaggaacatctgaaagcaaatctacagaacttgatgtaattctccccccttttgtcaacaagtgaaaaaaaggtaacgaatagcatgaggtagaaagcaaagaaaatgatcactccaaggcatcaccaatatagttgtccaaataaagtttgtcttcggaagtaactggagttccttcagcagcagcaacacgattgtctttgggcatgatgactgggttgttggctgatgtgcttcgtgcagtaagatnagctttgga

SEQ ID NO: 92647 - DNA, 497 bp, Triticum aestivum
  unsure (1)..(497): unsure at all n locations
  Clone ID: PAT_TA_92647
ttttttttttttttttttttttttagaatgccatgtgcaccaatttaattaccagaaatatactcggcaaggttaccattacatacatactcgaagcagagcgctgtatgcatcttttcagcgataacttgcttcccattatattctgcaacaactttctctgattcgttgcagaaacccaatagttcaacaacgttttgatgcttgagcctcctaaggttctcaaactccttttcaaactccttattatcaaatccagtcatgttctgaagtaccttcacagcaatctcctcaccattttcacgagtacccttgtaaactgttccgtatgcaccacggccaactatttgagcctcatcgaaatcattcgtaatatcttttataaattggtacggtagcttacgtggctgaccatgtatgttgtcaaccttgttccccgtgccattgtcctctgccattcgtcctcttgagcttttgcaacanatgtgaagagaggg

SEQ ID NO: 92648 - DNA, 432 bp, Triticum aestivum
  Clone ID: PAT_TA_92648
ggtcagcagtcagcacccgcgacgaattccgcaaggaaaacgcgaaagatagatccgccgtgaaggcccaacggcggctcaccgaaacccggggccgccgccggccgcccgcaccccgaagcggaagtgcgaaaccccacccggcgcacctccacacgggcagggagagatggtggcgatctcgatgtaccgcggcaacctccaccggggcggggacgacgccgcgcgccgctggccggtgcccccacccacgctctccgcgtcccagttccgccgcctcctccaccgccgctccctcgccgtctcccgcctcgccggggctccccggcccgactcccccaatccccgcccgggcgacggcgccgcggggcccgtggccgtgggagaggcgcaggaggtggacggggctcagcagcagcaccaggacgagcg

SEQ ID NO: 92649 - DNA, 223 bp, Triticum aestivum
  unsure (1)..(223): unsure at all n locations
  Clone ID: PAT_TA_92649
ctcgtgccgaattcggcacgagctcgngncgccttccggttcgggttcnggatcggttcgggttcggttcgaganagangccgagtagctaagcctagtctatggtttcggtaanagaggaagtgaaatccatcggggagatggantnncgctgcttcgtgggcggactctcctgggccatccgacnacacnaactgtccagcacgccttcatcctaccttcg

SEQ ID NO: 92650 - DNA, 495 bp, Triticum aestivum
  unsure (1)..(495): unsure at all n locations
  Clone ID: PAT_TA_92650
ctcccctatacccggcatctcttccctccccctctcgagcaagaaagaagcattcggccagtcattattaaaactcgtcggctcgcgacagcgcggcagcaaagccaaaacccccccgattcctgccccggttccgattctcctcccagccatggcgtcccacatcatcctgccgccggacgacgacgacgagcagcagcggagggaggacgaggagaacgacggcggcgggagcgggggcgacgggcagcaacaagcaggccgggggcaacnacgccaacgcggcgctgcccttctccgccatgttgcgtgcggatntcccgcgaactcctaccccaanctccgcgncctccgcaacgcctcccangccaagctcaacgacgccgcatacgtcaagatttccgangggggacntcggntaagtcctcnaagacgtcccccaactcgcaaaataactcccccgaagtccccaattnacccgaaaccactacaatn

SEQ ID NO: 92651 - DNA, 285 bp, Triticum aestivum
  unsure (1)..(285): unsure at all n locations
  Clone ID: PAT_TA_92651
ctcgtgccgaattcggcacgagaaaaactcgaatacgagacaaaatatcctaaacgcagcctctatttctttaagtttttactattgtcaaaagagtgtttgtcgatctttcataggtaattttaccgaaaatcttagagaactaaagccactcaaacccaaaaaaaaaaaaaaaaaaaaaaaaaaaaaaaaaaaaaaaaaaaaaaaaaaaaaaaaaaaaaaaaaaaaaaaaaaaaaaaaaaaaaaccccnnggggggnccgggnaccaantncccccaaanggg

SEQ ID NO: 92652 - DNA, 558 bp, Triticum aestivum
  unsure (1)..(558): unsure at all n locations
  Clone ID: PAT_TA_92652
ctcgtgccgaattcggcacgagcgatcctcccgcgtaccaagccaccgaccaacatggcagcgtctctccaagccgcggccacgctgatgccggccaagatcggcggccgggcctcctccgcgcgaccgtcgtcgcacgtcgcccgggcgttcggcgtcgacgctggcgccaggatcacctgctccctgcagtccgacatcagggaggtcgcaagcaagtgcgccgacgccgccaagatggccggcttcgccctcgccacctctgccctcctcgtctccggcgcgagcgcggagggggcgcccaagaggctgaccttcgacgagatccangagcangacctacatggaggngaagggtaccggnaccgcgaaccagtgcccgaccatcgacggcggcgtcgactccttcccttcaaggccggcaaggtacgagatnnaagaaattctgccttggnngcccanctccttcaacgtcangggccgacggcatcagnagaacgngccggcgggcccttcaagangacaanctcatgncccgtcnaactaaacccttnangt

SEQ ID NO: 92653 - DNA, 481 bp, Triticum aestivum
  unsure (1)..(481): unsure at all n locations
  Clone ID: PAT_TA_92653
ctcgtgccgaattcggcacgagaaaaccccgactcaagccaccttttcctgcagctgttggtctttttggatgtccctcaactgtggcaaacgttgagaccatcgctgtggcaccaacaattatccgacgaggagcttcgtggttttctagcttcggaagagaaaggaattcagggacgaaactattttgtatctctgggcatgtcaacaatccatgcacggttgaggaagaaatgagcattcccctaagggaactcattgataagcattgtggtggtgtacgaggaggctgggataacttgaaagccattattcctggtgggatcctcaanccccatattacccaaggaagtgtgtganagccaagctcatggatttttgatgccgctgaaggatanncaagtctggtcctcgggacaagcaagctgtaattgnaanggncaangagcactgaacgnttgtccgcgcantctcaaagacc

SEQ ID NO: 92654 - DNA, 190 bp, Triticum aestivum
  Clone ID: PAT_TA_92654
ttcaaaggaagaataagactagagaacaggcaatcagccgggccgagttaggggaggattatttcaacgatgatagcttattagaggagttaaaagattaggccataatcatcgtcacgattatggtccacccagtagctcaataaacccattaatactatcaaaaaaaaaaaaaaaaaaaaaaaaaaaa

SEQ ID NO: 92655 - DNA, 547 bp, Triticum aestivum
  unsure (1)..(547): unsure at all n locations
  Clone ID: PAT_TA_92655
tttttttttttttttttaaaataagttataatgtattatttgatatccaagcgaaatagtaagccccattgtttgtttatcggaggccgtaggctgttcaaatgcgacagtacactagctgatctatgaacataacaactacttcggtaaagtaaaccatgatctaattcagcggtcagattatatgtgtacaatatcatccgcaaatcaaattcccttgattcgtcagtttggccccgataaataangacatgatattgactctgttgtgttagggtttctttcatatcttgacgttggcgagactttgagctagttcatctatatcagttgctccagaagtcacactggggccctccaagagctttattagctgctagtgagacacgtttcngcatctcatcntctgcttcaacttcgncctcttcttcatcaganctgtcatcatccctccaaggtccactcaangcnctctaggacccnantctcaatcaatngancggttancncaantagtttcntccctcccgggntgaggcanctaatg

SEQ ID NO: 92656 - DNA, 495 bp, Triticum aestivum
  unsure (1)..(495): unsure at all n locations
  Clone ID: PAT_TA_92656
cggaaccaacaaatccccacccaatctcgtctccgatcgactccacgctcgtcgaatactcctcccccaccgcctcaagatgcagatctttgtgaagacactgacgggcaagaccatcacccttgaggtggagtcgtctgacaccatcgacaatgtcaaggccaagatccaggacaaggagggcattccccctgaccagcagcgtctcatctttgctggcaagcagctggaggatggccgaaccctcgctgactacaacatccagaaggagtccaccctccaccttgtcctgcgtctgcgtggtggcatgcagatcttcgtgaagaccctcaccggcaagaccatcactcttgagngtggagagctccgacaccatcgacaacgtcaaggccanagatccaaggacaaaggaggggcattcctcccgggancaagcaancgtctcatccttcgcntggcaaagcaactttgagggatgggccgtaaccctcgctg

SEQ ID NO: 92657 - DNA, 545 bp, Triticum aestivum
  unsure (1)..(545): unsure at all n locations
  Clone ID: PAT_TA_92657
gtagaatcaatcgttctacgcgctatgctccgcagctgaatcctcagtggcctgagttgatttctcttttttgttctttttttccttctttttgcgacgtcgctcagctttctcttcggccgtctcgccttcgtgacgcttgcgcttcttgccactttcttcagcgcctgcttctaaagatgaagcttctgcagcattatctaccattggggtatctgcacctaaattggccaacattgcatcagcgttcctgcaaactagaatagcttttgcctctgatgtggcaagtactaccatccaagggagcattaaagtccttgtactcagtgttccattttgcaggagttgcttcgttcggacgaccatatttgtctaacttcccgtcaagctttcatctttttcttttccaaatgcaaccggtccaaggncccatcttctgggaaataaatccgcgctccaagatacaagcggttttaacttcgcaacaacggccgtgatnacatgtagaatagttcctanggttgacatttgngctantaccgagg

SEQ ID NO: 92658 - DNA, 562 bp, Triticum aestivum
  unsure (1)..(562): unsure at all n locations
  Clone ID: PAT_TA_92658
gaacattctgaaagtacacatggaagagaacgaggtatgggactggctcaatttcttcagtgaaacatttttggatcagcttaaaggccctttaccaagaaccatcgaaggatcatcctatcgtcattgaagagccttacttccagctgaaaggacagtattgtcggacaaaatccacaagacgcgcactacaatcaatcggnaaaacccaaattgatttccttgtcaaagacatcgacttgcctaaggaangtcctgctgattgggaaaaagtaaaggcactgggtgagtttaccatatcacctggtgaaaaccaaaggaaaagaaaatttgtacaattatcaaggtcagttcgagaggtcctttgcgctcagccattgagacggntcttacacggnttctgcttgtttgaagaagattttgagctctggctttttgatcgctccggggtgcctacagttcaaggccaaaaanatattggtcgtaacaaagaagttggtttgttccangcaataaagctcgtaacctacngntgaacgatgnagaacttgggtgngatang

SEQ ID NO: 92659 - DNA, 574 bp, Triticum aestivum
  unsure (1)..(574): unsure at all n locations
  Clone ID: PAT_TA_92659
ctcgtgccgaattcggcacgagatggtgcggcaggagcaagaggctaatgtggcgcagcgctctggggcatccagcagcagaaccgggcgtttctcttctcgcccagccttgtctgtggctgtgcctgcgacggcttcaattggacgtcccaatacgtctaagcccatctctactacactggngacacgacgaggtctggatatagccaagccatcttcaagtcctacacacaccacaacggatgacaaactcaaggctctcagggcttttcgcaaagcccgtggtctctactttacttgtggcnagcgatgggggccagggcatgtttgtgcatccacggntcagctacacgtcgtgganngagcttgtgggcatgatttcaccccctgcctcaacgagtactgctgtgattcaagctgaaagctctgaanatgatctctgtcttttgtcggcggcaacgggntcaaggtacaanaagcacccaaaagcttttcgggtggtctggaanaaattgggnacaaggngctngccnatgntcctnggactccgggaagctctcaaagttttgtcann

SEQ ID NO: 92660 - DNA, 511 bp, Triticum aestivum
  unsure (1)..(511): unsure at all n locations
  Clone ID: PAT_TA_92660
ctggtgccgaattcggcacgagaggaaatgaaatcgaaattgatcttcctaaccagctcattaaatcacaaacagggcagccaatttgtagttttgaagtcgaagaatttcgaaagtattgcctcatcaatggtttggatgatattggcttgacgatgaaaatgaaagataagatatcagaatttgagaaaaaaatgacacgacttacaccttggctaaatgggagcggatatttgaaaagacgggacggaggaatgttagcagtagctgcaattccaattcctaaaaccaaccagggtgacaagctgacagaccctttggattggtaacgtaatattttgggcaaatttaagcttttgataaagctttatgaaatgttttatctctaaagccctgtcttcatgttgggttaatcacaaataatgttaaaaacatacctaagtaagcgnatattancccggaatgcgtattattgattccataanaganttactcctaaatcccaaanccc

SEQ ID NO: 92661 - DNA, 504 bp, Triticum aestivum
  unsure (1)..(504): unsure at all n locations
  Clone ID: PAT_TA_92661
gtgtaacgttatctacgattatagcaggcctgccccaggctgaacgccttacgccgtatgtatcctagtctcttgaatactttaatcaaacatcaggtgcaatttaatgatgctctaatttttcctcctatttacaccgtttctcaacaatattagccccgaattcgtcatactccttgcgagaaatccacatttgatgaaaagtacccaagctcccgagaatgctgccaccgatccagctgccaaatctcctttccgatgttagcccagccgcatttatcttgattcgcgcgccaggataaatgttcttgagctcctgatcgagcctttcgaccaagacctaatgtgagactagtacctcctacaaacacaatattttggagtaaactcgcgcggatgtccatgtcgacgcctgagacactcgccttgaccatctcaagggagagnttgggcttttaaatgggtgtggtctcaactggnaaatagtaaccgctggcttttcaa

SEQ ID NO: 92662 - DNA, 227 bp, Triticum aestivum
  unsure (1)..(227): unsure at all n locations
  Clone ID: PAT_TA_92662
ctcgtgccgaattcggcacgagagaagcaggaaaccagaagcgacccaccgggcagttgagctcccgcgccgccccctcacctcatcagcacccaccggcgtcactgaggaaacttcttattagttctgggcgactctcccaggcagcatcggcggcggcggccaggtcaaatccaagtaggatgccgccggggaaggggggggagaagaagggnttgttgggtagt

SEQ ID NO: 92663 - DNA, 473 bp, Triticum aestivum
  unsure (1)..(473): unsure at all n locations
  Clone ID: PAT_TA_92663
ctcgtgccgaattcggcacgaggagagaatgaatcagggatagaagccgacaagcctgaaagcattgggactgaaaagccaaaccaagaagaagatgactatgatagaaacacacagactccagcaaaagtcaataaagatgagagagaaggaatcaaagataagtccaatcctctcatcgatgaggaaaattccagtttgaaaaatgagacagacgatgatacctctaattcaggcgcccaggaatcaagcaacatgaatgaaacatctgattacagcaagaaaaatgagaatcaagctcgctgaatctgaaccaaaaagcgctgataactctgattaaatatagtaacgangcaattagaattatcgagagtgcatattcctgtagaattccacctctcaagtataagtaagtccttaatacgaatagtaattcangaaaaatacacatatgtattgatttggnaaaaaaa

SEQ ID NO: 92664 - DNA, 544 bp, Triticum aestivum
  unsure (1)..(544): unsure at all n locations
  Clone ID: PAT_TA_92664
ctcgtgccgaattcggcacgagcaatctagagcaaatctgaggtgcgataacagtgaacagtttcatcgttggcatgagccttgaattagttaagcagttagaggagtgcatgtctactcctgtactctgcataaattctaaatacctcacttaaccggtatcccttgcgcctttatctaactacccgataaacgtcgtcgcatcctaactacacatcttttttgtattcctggcaatgcctcggcccctaactacagatcttccgccgtggaaaccaattataacatcttaagatatacacccatgcaagcacccgttagaaaggagttgtaaaggtggcaaagaagatagtacagtacccgatccagaaacactctcgacctgtaggcagaaaggatagatatgtccttatgtagtcacagacccattaggacaataacttcaaatatcaatccaagtagctagctacagcaagcgaaacaatggcaagtaggtcaagggtgatcacggnacaaatacagtttataaagcctaaaaaaaaan

SEQ ID NO: 92665 - DNA, 551 bp, Triticum aestivum
  unsure (1)..(551): unsure at all n locations
  Clone ID: PAT_TA_92665
gtgtagacgatcccggaacgccagagctgtcgattgcctatcgagatcgtcaaaagacatttattgccactgaacctcgtggtcgatcgattggcgaggaaacaacagctcttgacttgttgcagggtatccgcgacgcgatcttggcccatcagtcacttttcaaggaggctaggatattgcatcgggacgtgtctattaataacattatactgaccgatcccgctgttaacaatggtcggtatgggttattgatagatcttgacctggcaatatctttgaacgatgtcaatagtgatagagattcgcaagattatgactggtactatggagtatatcgcccttgggatcttggaagccaatattttcgagactggcaaagggtataagcatacgtatcgacatgatctgggagtccttcttctatgtcctcgtttcaacgtgcatccgatttggctggggggataaaaagtcaggtcgccttanaatcctagncaactggtacacaggnacngtcaaacagattgtccgatgccaagcannggggcaag

SEQ ID NO: 92666 - DNA, 568 bp, Triticum aestivum
  unsure (1)..(568): unsure at all n locations
  Clone ID: PAT_TA_92666
gaaggccttcacggcctcgttcacatcctccaacgagggtaagtcctcctcatccacctctcccatcacgattagtctatcctattttagtagtctccccacgatttcgaggtttctatcctttgaatctgtctgcgctccgctgccgttgtttgttgaggccgctgtcgcattttgcgacgcgtcgaaaccgctggatttacccacactcgccatgttgaagcacggaaagcgaaatgatggatcgagggtaaagaagatataataatggtattcacgatgtcaaattgatgataaaagcagcgtggaccgcagcgcagctttctagcanaaatggtgttttttctacctagcacggtagttaaaaaaacanaaangaaataattatgttggtgcgtaatgtgttacccgtttaaaaatggcgttaggggagagagatggctgctttataaaaagtaattcgtggagaaagatagagaagaattggtaagatatagactatattctgatggcgtttagacagtggtttaatagaccgcaaggttccggcggctgaacaaaacgtcag

SEQ ID NO: 92667 - DNA, 544 bp, Triticum aestivum
  unsure (1)..(544): unsure at all n locations
  Clone ID: PAT_TA_92667
gagcggggccctgaaaaaacacagccttcacatgcttgcctgacggaagctacggcagatccaaaggtgaagacgtgtcgacatgagaccagtttctattttaacataggcggcatctttacagtttataagctcccaagaaatggagctccctgcttgaattggggatgtgggaccagcatgtcatccaatgaaaggaatgtacttaccgcctaggccccaagctttacttacacatgtcctccttgtacatccatggggagactgctgtcattttttattctgcacaacttgtcagcctcatgtgcacgtacgtagccaatatcatgtgctatgcacatacgcagcggcggcgtgagaccattttccttcgttaactgtagcgaacagtgtagctgcagtgtgtatacaagtctacagtgcttgaagactgcctgggacggcctgggtcctttgccccaacctggcgccgccactggccaatatggctttggaccatgtcgactttccctccgttacaagtangtgcgacgacaaaggttcg

SEQ ID NO: 92668 - DNA, 567 bp, Triticum aestivum
  unsure (1)..(567): unsure at all n locations
  Clone ID: PAT_TA_92668
ctcgtgccgaattcggcaccagctcgtgccgaattcggcaccaggaagatcgtgcactacgacatcaagcccggcaacgtcctcctcgacggcggcctcacgcccaaagtggccgacttcggcctcgcgcagctgctgaaccgggcggacacgcacaagaccgtctccgggatgcgtggcacgcccgggtacgccgcgccggagatgtggatgcaggccggcgccaccgagaagtgcgacgtctacagcttcggcatcctcctgttcgagatcctcggccggaggagaaacttcgacgaggccgcgccggagagccagcagtgggttcccgaagctggcgttgacaaagtacgaagagcggcgagctaatggaagtcatgggcagttngtgatgacgcgtgcgaagggaagacaaagaaaggcggtggcaataaggatgtnccaaggtggcgttctggtgtgtggaacaanaaaccgganggcaaggccgccgatnaaatgtggnggngnaaattgtccaagggcaaattgncaatggtccggcccggngaaccgntcaaaaattta

SEQ ID NO: 92669 - DNA, 528 bp, Triticum aestivum
  unsure (1)..(528): unsure at all n locations
  Clone ID: PAT_TA_92669
cttatcggtcaatccgaggaaatctaacgatgagaagtgtacggctctcaagatatcatggccctcgactgtgtcatctccggccggcccagcaacactggctaggctttgcttcgtccagtaaagctccgaatgctctagatacggcgtccagtgtgagcgcggacgaggctacatcttcattcttgtcatttgccagccgtccggcttcgagtccgtatccatctccacttcctcaacgcgctgcacattcagccaagcttgcagccctacacgcgcgcctttctcttccgcgacgccttccactcgagaccatggcgcgcacgctagttgacccgtcggccgactcgaatcctgacttcaacaatgcatcactagcacgtcttggaggaagccttgtctcctattatgtcggagagtcacttatttgtacatatcctcgccttccatcaagcgttctctttgccggccgcttacgcctacaatgggcctaatactttgggactgantgcgccgggaatggggang

SEQ ID NO: 92670 - DNA, 566 bp, Triticum aestivum
  unsure (1)..(566): unsure at all n locations
  Clone ID: PAT_TA_92670
ctcgtgccgaattcggcacgagctccggctttgcaatcatcgacatctcctatggggaccgcagcttgcgcgtcgttgatctgggcaagctgggactattacacgacggccccaaggcccccaacagatgtctgccgctctggaacacctccgtcaaactgggccgccagcttcggatcgaccccaccaacctgaacctcatcttttacaactgcacggaggaggccaccgcggcggctagggcacgtcgcgacagatggttagtgcacgcgaggacgatggggtgcgtgaacgcgagcaactcgtttgttcgcgcgggagtgcatacgacccagccggggactatgctggctatgccttggagggatgtgatgctatcaacctgccggtgctgggcnatgtcgcccggggcganacgtccacgggcggcgaaccgactnacgngnaagctcaacaaangatgggntcctccttgacatgggattcggcaacaagcanttcctaangcctggttatctgnaacgttaggttnacccggcctaatccancggttaanccaagttcct

SEQ ID NO: 92671 - DNA, 559 bp, Triticum aestivum
  unsure (1)..(559): unsure at all n locations
  Clone ID: PAT_TA_92671
ctcgtgccgaattcggcacgaggcgacagagagtaactttccataacttacgaagcaatctgacacatcagtctacaagctctgataattctacgggctctgtagtaaagttcgaggaggacgcgtggtctgaatcaaattcaatcccctcgacacctctagaggaagcaacagttcacgacaccgaccacagaaaaatggaccacccagtaaaatctctaccgccctccccctcaattatgcccaccaaagggtttcatgaaatatctgataatgataacggcgtggacttcgacgcagagtctgaagcaggaatatcttttatggttccagcaatggaaacaacgtcaaatacacactcgctcgtttccaagtccacacgttgagctattaccaagttganggataaccggctnatctcaaacaccgattctccaannangctcttatngangaagcaagattgangacgaacngatgngaataaccttcaaggagtatattggttaaatttccttaccaaggccgaagatgaaccnnctctaaanactaaannggg

SEQ ID NO: 92672 - DNA, 457 bp, Triticum aestivum
  Clone ID: PAT_TA_92672
ttatcaaaatcaaaatgacaatatgcattgatgttttataccaaattatatagttacatggggttttgggaagccaatattaaaaagaatgggtgacaaatgaccaaacccacaatgggttctaaaatagtgcgtcctaatggcagaaatgtcataatgtgacatatctgtactcaacctcttgtcaacaggagtcttggaatttggacgtcatccccatggaacttcgatcaagaggtaagagatctccagaatcttggaacggaagttgctatccaaagtccataaactacatcgttgtccaagcaagcagtacttgcagctataccatcttgctgtcaaaatacttggcattaaactgagaaccctctagcaccattccaccacccaggatagccaaaagctggtagatacgaaaaaaactcgagctcgtgccgaattcggcacgaaggggggg

SEQ ID NO: 92673 - DNA, 219 bp, Triticum aestivum
  unsure (1)..(219): unsure at all n locations
  Clone ID: PAT_TA_92673
ctcgtgccgaattcggcacgagcctctgcttagccatcggcctcatcctcctcccctgcgccggcggttgcagggagaggncatacagngtancctagcnccntncccatggnggtgaacaacaangtggagaccctggngttcgacctgcaggnggggcacgggcccggggngaaggcgccgccgccggcggactcgggngcgcgtcagcancaaaca

SEQ ID NO: 92674 - DNA, 533 bp, Triticum aestivum
  unsure (1)..(533): unsure at all n locations
  Clone ID: PAT_TA_92674
cgagcatggtatacaacctgatggttatttgaccgaggagcgaaaagcagccgatccggatgaaggcttcagcactttcttttcggagactggtcagggaaaatacgtaccccgtacaatttattgtgaccttgagccgaatgtcatcgatgaggtccgcaccggtacatatcgtagcctatttcatcccgagcagatgatcagtggcaaagaagatgcctctaacaactacgctcgtggtcactatactgttggtaaagagctgatagacaaagtgcttgacaaaatccgccatgtcgcagacaactgtgctggtctgcaaggctttcttgtattccactcttttggtggtggcaccggttctggatttggagctcttctcatggaacgtctctcantcgattttggtaaagaaagtgaaactagaattctgcgtgtatcccgcggctcaaacgggtacttcggtggttgagcaantnactcaataattnncaaacaaaaaaacccccaagggggggcccggtncccaattt

SEQ ID NO: 92675 - DNA, 447 bp, Triticum aestivum
  unsure (1)..(447): unsure at all n locations
  Clone ID: PAT_TA_92675
ttttttttttttttggtggggtcaagaagggttatgattgggcatgattcggcagtatcgatgttggagatccatgatgaagtaccagttgataccaagggcaaaatgaaagtgccaaatgtcagtgacaagaactgaagttccataagtgtcacaaattagaaaatccaggatctcgccttttctgttttgcaccagagaatctaatatctgcattccgagcgaagacaaccgtggattgatgaatgacatgtttcaatttgatagagcagagtancaattatgttggttggccggggttttgcttactccttgcttccctaaaaacatgtaattcaagcaaatatcaagcatacacaatgtaaagattgctttgggggtgatctgcgtanacagttgattttccagtgcgtcnanagaaaananagaaaaanncccagggggggn

SEQ ID NO: 92676 - DNA, 538 bp, Triticum aestivum
  unsure (1)..(538): unsure at all n locations
  Clone ID: PAT_TA_92676
agctcgtgccgaattcggcacgaggcctgaaagtccaccttgctccttcagtatctcttggtcttttggtgtaatgggtgctttatctggtaccgctatatctcttcgcctagtggtattactaacaattactccatctacaccacttttccatatggcatcgacaatgccagcaacttggtcttccccatcctcatcgggtgagactttcaccataattcttggagttgtttttcgaggcactaactttgcagcctcaacgatacctctgagaagttcggttagaatatcaccccgctgtaatgttcttaagacctggcgtgtttgggctactaacgtttaccaccaaaatatcggcgtattgggcaaccttttcaacgcagtaaacatangtctccgttttgtagcaatcaatatcgtcttcaatccgtatcctctaatccttggnantctgaacggntagaaagttttccaatttttaagacttcccggggggtantccggctcaaccgntnangaacganaatctacggnttcg
